United States Patent 9,328,346 (POLYCOMB-ASSOCIATED NON-CODING RNAS) - sequence listing, part 46

SEQ ID NO: 8236 - RNA, 32496 nt, Mus musculus
caaccucaaggaaaucguggcaagauggcgucccuggaucgggugaagguucugguguugggagacucaggugagccgcuuaacccacgucugggacuaccaacacgcccgagcuucccgacaccgcucucucuucgcuguuuacccccccagcugccuagcgcuuaggucgacagcugaaauuccuuucaagaccuuaaaacuacacuucccagaggacuuugcuccuuuugucgacgugguggcguggcgggagguggggggcgcggagucuauggguggaaaagggacuaguuccacucacuaucacuccuagugacccucuaggaaaauuuuugcuuccuguccccacaacccuagguucugcuggccuagaaguuuugguuccagagaggggagagcuccuaccaggagccacaaaaaacauuccaguucuuccacugcaagcuuuguugcuggggagugggugugggguaagacauggucucacuaaguaguccugacuaacguagaacuagcuauguauaucaggcuagucuaaaacucacuauauaaacaaggcaggccuaaaaugaagagauacaccugccucugccacuguauuagucaggguccucuagagucacagaacuuauggguaguuucuuauaguaagggaauuuguugaugaccuacggucuguagcccaacuccccaacaauggucagcagcagcugugaauggaaguccaaggaucuagcaguugcucagucccacaaggcaagcaaacgaagaagaaucuuccuccuuccaauguccuuaaguaggucuccagcagaagguguagcccagauuaaagguguaggccucccugccuggugcugggacuugcuuugucccagaugaccuugaacucagagaucuccuugucuuagucuccugggauucauagccacuaugccucaagauccaggucagaaacuugaaucucccagccacgagaucaggaucacagugagcccuccaauucuggauuguaguucauuccagauauaguccagcugacaaccaagaauagccacuacagccgccgaccuucuuuaagacaagcucuccccuuggccuggagccccuaggcuaaggcugucaggccaacaaacaucagggauugccucucucugccuccccagcacugacauuagagacgugugccucuuugccuggcugcugugugucaguucugugaacacaacucggguucucaugcuuguagggcaagcacugagccccaugcgguucuuuuguuuguuuuuaaguacacuuuguauaugaucacaauaacaacaugguauaauagagaaagucauauggcuggcaauagugcucuaaggugauguuguuguuugguuuuuuuuuuuuuauacuuucucaguuuuugguaauagaguuuuuauaauaaaaaguaaauauuaaugauaggucuauauauaacauugcacaacaaagagauuucccaaguguuugauacaauuaacaacagccagguaaaugaaugagugacuccacacccgcaaauaaaagacucauagccaugaaaauagaagacucaucucuuuccucuccaccuagcucuugaagaggugcccuuuaguguuaaugaaaagauugccugagcccaauagaucuaaaagggggugaagcauugcuucaaaauuaauaggcaugaugaaggaaagcaaguggaauuaccaucaucgucauucagaggauaagucugggaccaugugguuagcugcuuuuuucagaccuacauguaggcaccaaaguccuuugaguaugguagcauggcaucauggauccugucacgggagguauucaaacaauuuguuagauguucccuggcuuggaagaggugguauaaaugucccauuuaggguuccauguucagcugacuaaagagaccuuguaucuuuacagguguugggaaaucuucacucguccaucuucugugccacaaucaaguguuaggaaauccgucauggacugugggcugcucgguggauaucagagugcguguucuuguuuaguuuuuccuuagucauacuaagcauaaguccuucagaucccgugauuaauuuauaggacuuaauuaaaauuaacacuaauaacugggauugauuuagcucccacugugugucaguacugucauuccuuguuucaucuuucuuaaacugugaaauacaaacacagaaacucagucauagaggaguaaauaacaaccaaauucauucaacucgugagaagcgaaaguaacacgugagcccaguugucuguuugcacaggcuuuuauuuuaaacacuagauuuggagugauaauguuaauauccuccauaaauaauaaaguuaguaucuuccauaaauaguucugccuaaagcuguaacucuaagacugcaaauuugggccuagucauaccauguaaaggaaaaaacuuccagagccuugaguagacugucuguucugugucacaguuagguacucgauagaguuuccacuaaauuaagucauaauguuuaauucugggcaagucugucaucuguuggcacguuuucuuaccacugaauuaagaacaaguacagggccuuguuagaacaacucaccaggucaacacccuugcuguugaggcuaaggacccaaguucaguuccuaccgauucacaugguggaaacaagaaccaacuccagcaagcuguccucuggcuuucauauguaugcccuggcacgugcacucccacaaacacacacacaguaaacaaaggaaauggggacaaauuaagaagugauagugauauuaccagcuguuuuccucuguccuuugaugcugugugguguaggcucugauauacugauuaaaauuuuucuauucaauuaguuauuauucccucuuaagggaauuucuuuucuccagcugcuuuuaagagauuguguguguguguguguguguguguguguguguguguguguguguacuguuuugccguaaugcuaaccuaaccuaugucuuggucuaccucagucuucuacucagaaguccugcucaggaugcccucuccucugucugucugucugucugucuucauucccuccacccauuccuauugauuuucuaguggauuuguuguuuuuaacuuugaacuccauccucauauauccuuuuuuuucuucauuuuucucacugccuucugcaauaugcauuuauaccugccuuccaguugacuaaacaucucucaacugugcuuaauauguuaauauauagacucuguuuuucaaauaauauacauuaaauucaguaacaacuuuuuuaucaguauucaaguuuuucaaaaucuuauuuuucauuguggauuucauuuuuaauuaauguguuuuucacagucauuuuguaguuucuuuuagauuauaguuuguuuuuugaggauaaacauccuauuuguuauauaaguuauucuacuuuauauagaaguacaucuuguaugauuuguaauucuuggaaaauguucuauccuuuauagauuuuuuuaugugcaucaacguuuguucaaauguaugucuguuuaccacaugugugcagugccuacaggggccagaagaagaugcuagauccccugggacuggaguuaccauggagcugcccuguguggauucugggaagagaacccagguccuuugaaagacuagccggugcucuuagccaguagccaucuucccagcucuauguccacauuuuucuaaggaacccacgugccucuuuauggaagccuugugugcuauucugugcaaggauccuuguuuccuuuugccuuuguugcugccagagcucuagcaauuucaauggcacucaaaguuucuaucucagcaucccuguggcaucugagccucauggcuuccaaccacuggggccugaggcuuccauuucauacauaucuucuaucuauucugcagcagcccacccacagucccugaccucuggggacaguucuuauagccuccuccuccccuaacugaggagcucaucaaggguucccauuucaagaugaaaauggcaguaggguccuuaucacucgcccacacauccuuaaaagcuggaaaaugaguccgcuauuccuguacagcagugagacuccaggcacuugcuugaagcugucuguauccauguccucuccacaauguuucuucauuuccaacaucuagacauuucccuuccuuuuucuuucucucucacuaguuuauguucucucucucucuccuucucuccuuccucccucucaaaauauuuuuauagcauuucuuugaguuugaaguagaaauggacuguaucauuuuagcuuacuguguuuuuacauucucagcuacgcaagaaaaccagguuuaagcaaugaauucaaaugcaguuuuguuaagguuugagagacccagugacagguucugacaacccuuucuuuagacuuuacuaacucccuuccugugaaagaucacagcacauuagaaagaaacuuagauccuggaucaauugccuuucuacuuaaagaguuaccuuaaacuaaucaauauaccuccugaggccuacuucuaucauuuauaagagagaagaaaauuacaucguaccuagcuuugacauaguuuuccgccccuccuucuauccuagcccagccuguaucccuguccccacccagggccagguagguucaugagaucaccuucugucuugugcacuuucacuaugucuuauuaaaguggcucauauccaggacguuuuagaauaggugcgccuguaagaauuaucugucuuucauucccaaucccaggggaaguuuuuaagcacagagucuauauuuauauuugugugugguuuuagggauuugugcaaaccaaagagcaccuuaccacugaguuauauccuagcccacauguagaauuucuuguacauauguaucauuuuaaaaguuuccuguacuaguuuauugaugagaguuuguauccuaaauggcuauugaauuuuauuuauucugccuucauaauaaucauuauuuuccugcuuuacucuguuucuugauuuuauacauuaaacacaccuugccauccugcacuaaauccaagcuuuucucucugucugucugucugucugucugucucugucucucugugugugcaugugucucucuuagauccuuuuauacacuuacuuuuauuugucuaggguguuuuaccuauauuuuauagcuauguagcacaugaacuggaguuacagccugcuguccucggcucuguggggacugagaaccaagcccagguccuuugggagagcagcuagugugagcucuuaaccccgagccaucucuccagcccuguccucuccaagcuggucuugacauauuaaucuagaacaguguucuaggaucuagaaucaguuaucuaggauuuuuucagauauuugcacccaaauucaugagaaguauuagccuauuacgugaccuuuuucuauuucuuugugggguuuugauacugugccaaccuguucuuccaaagagcuuuauaagauugaugcuauuuaucauuugaauuuacaagugaaacuaacugagccagugauauucuaugagagaaguuuuuaaguucaauaaagaaaacaagaaauugauggcauuucuucccuugucaauuuuggagauuuguauuuggaaaagaauuuguucauaucaagcaaauugauaaacauuguuucucugccuuaguugcuuuuaaugagacaauucaacaauacaaccacuacugcacauccuauaaaaucuauaggcgaguuaguaucuauaguauagaugauuuucuauuuuucuuucuuuuucuucugguauaaguaacugauggccuugcuuuuaaaauguauauuuauauauggggcauauguaacauggcacacauguggagggcagaggaccaguugccggaguguuuucuucuucccccgcccgcccgugugggaucuggaaauugaacucacguucuuagaguuaguagcaagccagccugaguuuuauucucuugaucaguuuugccauggucuagcaaagacaaguuucaguuuguuguuuucuuucuaugcuuuguguuuuuuaggggguggggguauaugugcacauguguguaggcacauaugcaagguggcgugggaaaaugggaacuuauauguggaagccagaaguuaaccuugcauggcaguccucaggaaccauccaucuugucuuuuaagacagggucucucuuuggccuggagcucaccaagugggcuaggcugucuggccagcaaaccccaggaagccaucagucucugccuacccuacuuuugggauuaugagggcaugcagccacacccagcuuugaaaacacgggugcugggagagggaacuccggcccucaugcuugcccaggacuucacccgcugagcagucucuccaucccuguauuuguuuugucuuucacaguaaagccaaugccucuuuagauuuaauuuacucuccuucucaagcuccuccuugaaaugaguaguugcuucauugauuucuugcaagcuucuuacagagcucugaggcacccaaacgucugucuaaacacagugucagcugccucguuaucauucaauucaaaauauugucuaauuuccauugugauuucuccuuuggcucauuuguuauuucaaaugugcuuccaauuuccaaacauuugacaguguugaugaucuuguaauugcugguuucuaguuuacauucccugugcucggagaauaucuacuauauaauuccuuccuuuaaaguugacugagauuuccuuaugucuuguuuuagggucgguuuuguuaauuauuuguuaaguagcucauuucuaagucagaaagaaagcacacaugcauucucugucauuacugugugcagugugcugaccauuacauccagcuuaguaagcauuuuguuuaauuaucucugcuggguugcuuuuuuuuauccguuucaucauuuauaaggaauaaauguuaaaaucuuucacuauuugugucaauuugucuuuuguuguuguuuaauucugccuguuuugauauuauaugcuaguuugagauugguuuuugguuuuuuuauuuuuugucuuuugaauuuugcuuuauuagauaguuucuuuauuuacauuucaaauguuauccccuuucccaguuuccccuccagaaacccccuccuccugcuucuaugaggaaccaccagacugauuuccagagugguuauacaagcuugcaauccuaccagcaaugguggaguguuccucuuucuccacauccuuuccagcaucugcugucaccugaauuuuugaucuuagccauucugacuggugugagguggaaucucaggguuguuuugauuugcauuucccugaugacuaaggauguugaauauuucuuuaggugcuucucagccauucgauauuccucaguugagaauuccuuguuuagcucucuaccccauuuuuuuuuaauuucuuuuuuuuuaauuagguauuuuccucauuuacauuuccaaugcuaucccaaaagucccccauacccuccccccgacccucccacccacccacucccacuuuuuuggcccuggcguuccccuguacuggggcauauaaaguuugcaaguccaaugggccucucuuuccagugauggccgacuaggccaucuuuugauacauaugcagcuagagucaagagcuccaggguacugguuaguacauaauguuguucuaacuauaggguuguagaucccuuuagcuccuugucucuaccccauuuuuaauaggguuauuugguuuucuggaguguaacuucuugaguucuuuguauauauuggauauuagcccucuaucagauauaggauugguaaagacuuuuuucccaaucucuugguugccauuuugucuuauugacaguguccuuugccuuacagaagcgcuggaauuuuauaaggucuuauuugucgauuguugaucuuagagcauugguguucuguucaggaaauuuuccccugugcccauguguucaaggcucuucccaacuuucucuucuauuaguuucaguguaucugguuuuauguggagguccuugauccacuuggacucgagcuuuguaaaaggagauaagaauagaucgaucugcauucuucuauaugcugacugccaguugaaccagcaccauuuguugaaaaugcugucuuuuuucuacuggaugguuuuagcucauuugucaaagaucaagugauuauagaugugcggguucauuucugggucuccaauucuauuccauugaucuaccugccugucucuguaccaauaccaugcaguuuuuaucacuauugcucugcaauacagcuugaggucaggaauggugauucccucagaaguucuuuuauugagaauaguuuuagguauccuggguuguuuuguuuuuguuuuuguuauuguuguuguuguuguuuucccaaaugaauuugcaaauugcucuuucuaacucuaggaagaauugaguugaauuuugauggggauugcauugaaucuguagagccaucucuccagccccugagauuguuuauuuugccugaaggauuucagggcguuugaacucaaguuuucagaccuaugcaacaaguacuuuuaccuacugaguagucuuacuggccccuggauuuaaccuuuuuuuguuuugguuuuguuuuuuuguuuguuuguuuguuuguuuguuuuuguuuuuugagacaggguuucucuuuguagcccuggcuguccugggucucacuuuguagaccaggcuggcccggaacucagaaauccaccugccucugccuccugagugcugggacuaaaggcgugcgccaccacacccggcuuuuaacuucuuaucacugcaacgugucuguuuucugucuggcaguguuuguuucuugaaguuuaaguucucugauccugaaaugguuuaaacaacuauuuuuaguguuucuguauugcauaauuuuccaucuuucauuuaacuguuuaaaugucaugucuuucuaaugugucuccugcuagguaggacagagacaaauuuuauuuuaauggucagacugguagauuucguccuuuaauugaucuuguucuggauauucuaauuuagagauauaccuggccccaaggaaucugcauuuuaagaaccaucuaaggugacuuaaguagagauaaguggggugcuagaucaguuuucccgaugaauguagaggugcaguggcuacccuagaugcucaccaaagccugcuagcaacuggcaauaagaacagagagaagggaguauaaauagcaguccagacuccaaaggacacaaaucucguagguaaugguagaguaauuaacugaaaguaguuuuggggauaagcaaagcauuucauauuuucaacacagaaauaagaucgucaaagaauaaacagcaucuaagcgggcauagaguuguuucuucagaaucuaagcgggcauagagucguuucuucagaaucuucagugggcauacagagucauuucuucagaaucuaagagggccuagagucgucucgucaggauagagcuaguuauuaugauauguuauauaguuauuguuauauguuauauaguuauuguugauacagaaaagugaggcugagauggagcagguuuuuguaauuauuaggucagacuccagaaggaaaguggaaauucuuggagggaggaaauaagaggacaggaauccagggaagccccuccucuauguguguucaaggaagaaaacaguguccugaguauaacuagcagcaaagaucccaaaacaggcguugucucugcagggcccuucauguggagggaaccugaugauuuugggucaguccuagagcaugucagccaaacucgcuaauucucaaaccucuggccuacugaaguaacagcaauucucugagaaacaucucugcuuuggggguuaccaagauaagaagaguucccuuguagucaugcugaaccauaagggcuuggcuuuguuuuguuuaaucuauaagauaguucuaagaccucuggauagcaugaagcugugcaaagggaaaccagaauaaaagcuauaguagacagagcguaugcaauaguguggcugccuuacuggaaucguuauggugcuggauaaagccagucugacuugaauuauguucuucaagaauaaggcuuguaagggcugaaagaggccuagcuuguauuacugcacauuguugaucucugccguccuucuccaagagggaccuguuuccugagugaaacauagguaaaaggcauuuugaaaguauaaucuaaaguugucauagaaacaucaugacuauuauacuagagugagucguuguuccccauagaaaacugauuaaagcguauaaaggccugaugaaugucuugggagaacccugacuguuuauaguacagcugcagugucuguguuacugagccugccagagggagaucucuaggacuaaaguggauuccugaauaucugcucuucagaacucuuguacacaguuacccuguuuagcucaguuuagauaucauaagagccaacuaaaaauagagaagaugaaagugagaauagcauggugucaagugcugcaugaaguuaaugaaucuucucaauaguuauaacccucugggcccacugauuccacgcagagccugcagcuggauugacgaggggguuuuauuuuguggcauucuugacucucuccugguuuccgacuuugucaccucaaaucgaauggccugaugagcgagcacacggcugucccuaauaaugacaagaugcuucgagcuuaaucuucucacagauuauaaauaaggaaauugauuugucauuucuaguucacuuuaaugggauuuuaacucucuaacuuguacauugcauacaaucaauacuuauugaauuucucuuuggguaaggaaacaaugugcaggcacuggggaaaaauaaaaagguauaguuucuauccucacuagggauaugaaguggauuuacuuggagggauaagguuuguauaucauggucuuuaaagugauaggaacaaugauaacuaccaccuauuuagagcucgcuguggcuaggaguccacauacacgggacuucauugaucauuucacacaacaguucugugacauggguguugguggugccccucccugcucagcacaggaggcaugugaggcacagaggugcuaugugauuugucaaggucauguugcuaacaaguggauagacuugggauucaaguccagacagccugaccuauaagucuguaguucuuagucaugguguuaccaccucuuauuuacugcacagaauaaauggacccagaauguaaggaaaugaguacucugauggcacccaguaugguaacaacuggcuucauguggugacagacuugaacugaaugggccauaucucagugccuuaguaguuacaugcugcuccugggcaugcccaucacugaggacagcacaacagggcaacacuagugcagaagaugauagcuguuuaaagagcgugagcugugugugcaaaacgggauucuacuagaugcugaugaucgaguggccugaguuacuggauagacagacuugccccuccucccaaaggguuccaucuuagguagaagagaagaugauaagaaauuaaguucugccgggcgugguggugcacgucuuuagucccagcacucaggaggcagaggcaggcggauuucugaguucgaggccagccuggucuacaaagugagcuccaggacagccagggcuacacagagaaacccugucucgaaaaaaaccaaaaaccaaaaaaaaaaaaaaaaaaaaaagaaagaaauuaaguucuaaacauggcaaaaaacaacucaucuaugagcugucuaacugaaguugaccagaaagcaucugauaaugaggugcuuaaguuccagguaauuuggaauugcugucguguguguauagagaucaaaaugauggcagccaaugaguuuaaaagagaaauaaaagaaaaccuugggggagguuguuuuuaaagaguuauaguuccuaaaagaaaggucagagaaagauugaucaaaguaggacauagccaaaaggaugaacuacugccugagcaaacaugggaagcgccugaacagggguaguacugggcuucacuagaaaacgccugagauaggaggggaaacgaaaagcaaccauuggguuuuaaugaggaggcacuaaccuauggaugagugauugcauguuagugaugaaaaccaaauggagugacugggcagccaggaaaagauacacacaggcuuaaaucauaagccaucuuuuaugaaggcuggaggcuggggaaaaggagcgaauggugcagaacacaggaaggaacuacuuuauggaggaaugagcccaacugaagacaagugagaagucguggaaagagagcaaucgacagggaccuuuaccccauuaauugaaauguccaggauacccguugcaucucuuaguuguucagagucucccaccucucauuuucuucaaacucuguccuaaaaauuccuccuggccccuucuuucuaggggugacuuuauaggcacaguuacuaagcugaacuuguuaacauccauucuuguuuaauguguauuauuauucuuauugaauuuauuuccuuuuaaacauuacagugaagugcuuaaauuaaaugaccccauguuuagucgugauuuguugaucaauagaaaugugagagggagcaggacggaggaggguuccaguucucuguaauucacauaugcuccugcuuucuuauuuugaugaucugacauagccacauguuaucaguuauuuaugucauggagcaaacuagcaguucuuuuaauugcaguauagagugcuaauuuccauucucgaaaagagugcucaacuucugugacuugcuauuaucacuuccuaucuuguugucuuugguuuagucuguuccuuaucuucuuaaugucagugugacuaucuauagaguaccacauguacuuaaauguuguccuggccaacagauuuagaacuaaacaagugaauacagcaaaauacaaagcauucuguugagugugauaugugagguuuaguggguuucacaacaucucuaacaauugaguugccuuugccgucaccauuacuuaaagccaguagacgcuuuagaacuguacagugcaucucccucaucagaggcucagagauucugggcuaggucauggcagucugaacaucuaacccuaguaccagcauaguuccauucuauaaaaucauccuucuccacuacagagcuacagcagaaucauguggagcuuuauaugccuagugcucaccccaaagaaccugauucugcuagccuggcauguauauuugucuuuuuggaagggagggacugagguguggugaaucaugcccucucuguacagacaaggccaacuucaaaugcaugauccuccugccucaaugucucuagugccaagauuacaaguguacucaaccuaccugccucuagauacucauuuuuuaaguuccuuagaaaauucugguguauaccuuugaaucaucauacaucugguuauuguauauaagaaucuuucuaaauaguuaaauauuuugaauagcuaaaugggcaacaaaagccuugaucgacagguggugggggcauacgccuuuuagcacuugggaggcagagacaggcggauuucugaguucgauaccagccuggucuacaaagugaguuccagaacagccagggcuauacagagaaacccugucucaaaaaaacaaacaaacaaaaaacaaaaaacaaaaaacaaaaaaaagccuaggucaugagggauaaacaaugacccugaaguguaauaugacugagaaagccacuggaugguuugagccaaagguugagaugaucucacucagauuuaaaauaauccccucucacaacuguguaaaaagcaaaugagguugggaugcuucuaguagggagucuggccaagggacuguauguuaguuuauucagaaaaaggaguaaccagacacaucuaucuaaaugauaacagcuucagaggugacaaaugaaaccuuggguauguucuuaaagaugaaaggaacagaauuuguggacagaucagacauguaauagggaaggagucaaacuucaauccuaagguuuugaccugaguuacugaaaagauaucaaggauaucucaaccaaaggauugccuuuguuaagaugagaaaacugggaggagaauggguuuaggaagaagacaagaauaucaguuuuggggcuggagcgauggcucagcaguuaaaggcauuggcugcucuuccgaagguccugaguucaaaucccagcaaccacaugguggcucacagccaucuguagugagaucugacacccucuucugguauaucugaagacagcuacaguguacuuauuaauaauaauaaauaaaucuuugagccggagugaacagggccagagagagcagggcugaccagagcaagcagagguccuaaauucaaugcccagcaaccacaugaaggcuuucaaccaucuguacaacuacagugcacucauauacauaaaauaaguaaauaaaucuuuaaaaaaaaaagaauaucaguuuugauagauuaacucugaagugccauuaaacauuccuaguggugacccaguuaauaugauggucuaauauucucaggauucauauaaauuuuagauucaucaacauacagaugacauugaaaucacaagaguagauggaauugccaaagagcagggauugacagacaugaacuagaagaaggcacuguaaugacagaaugggggguggggggcaaaggaacucugaaacagacugcucaguaggaggacacucuagugacagaauaaggggacauaaggacucugaaacauacugcuucaggggagugggaggggcccugcagaguggggugucacugaagcuaagaaagauugcaaaggucgggguaaguaaauggucagauaaaaugaaagcucauuuggcccuggcguuagcaauauggagauaguuggugaucuugaucagaagcacuucaauagagagaucaugcaaagccgaauagaaaggaguucugaagaguaugugauagcaggggaucugaugcccucuucugaccuguguggguacccggcaugugcacaguacacacauacacagaggcagaacacuuaggcacacaaaauaaaaauaaagaaauauuugaaagagaaugugaggcccaguaauauuguucaguguggaaaggugcuuacuaauaagccugaugaccugaguuugaucucuggaacccauucuugcacaaguugaucucugacugucacauguacaucaugguaugugucucccaaauaauaauaacuacuauauccauauguauuaaaaagugucauaucuucuagucauaagcugcacucgugaaaucucaacaauauuguuaccugaacaagaccuacauuauacuaccaguugacaugccaauguggguggagggaauuuuacaagguccuaccucuggaugaagagcuacaaguaaucaguugcugcuaaggaagggagucccccuggcaggauagccaaccccaaguggucagcucuacucagaucuacuuaugggaacaauagucgggggacagacacaauagcaauuggagaggcagagagggaaggauggaaauguaaguaugcuacucauggacugaacuuucaaaaaauuacagugaaaagaguaaggaaacagagcuggagauagagaaccuagggaaccuucucuaugaaaaugaacagagaaacagcacagaggcugaggaagacaaagugcauuguauguuguugaaaauuauccagcagaggagauacagugcuugagagcaggaagaccuguauaacugcaucuuugcaugaggaaauggaaugggguuuacugugcagagcauucaaacuuagccuuaggggcauagacaggaaaguguucaaggacguagaaagagcaggugggggaaguucuuacuauuacugucacuguuauugucacugucacuauugucacugccacuaucaucacuuucacugucacuaucaucauuaucaccgucacugccuuugucacuaucaucacuaucagcacuguugcugucacuaucacugucauugucacuaucauuauuuuguccuaggaaacaaaguuuugggggguuuuuuguuguugguuuuuuuggggggagugggaggucuagagaagagauacuggaaauuucaagaagagaagcuaugacauuaucagggaaaggaaaguuauguccaggagcacacuuagauuugagauucaguucagucuacuaggauguaauuuucugaacuccacauucaggauggugaauuuuggauucauaauggaaaaagaagaggcuguugccaagauggaguguugucagauguaugucguguuagaaaagguugagagucauagagaauguaagauugggucaugggacuugugcuuaguagggagggaacgaaagcuucagaacuaggaggagauaaagauauucacaucaagugugggucacaugacacagggugaaagacuggaguagcguuagcguggaauaggagaguaagcaggaaagcucagcuauggccaucagagucagagagcaggcugggacaggaagggcucuugcuugacuggauuaaggugggugcucaccaguuuguccuauggcuuuaauaacaauuuuaauuaaucuguuagguucaugacuacaaagaagggaccccugaagagaagacauacuauauagaacuaugggauguuggaggcucugugggcagugccagcagugugaaaagcacaagagcgguguucuacaacucuguaaacgguaagugugcuuauuucucccauguuuuaauggucuagaaguacugaucaccugguacgaagugccaccacaugcuggacucaucuuaccgugagauuuaaaucugaauuccacagucucauuuguuaccuucuggugccaaccagggcaugguugccuuguuucaggguuauuccguucuuacuuuuuauuuauacguauguaguauauauucguuuuagaagcucagcuguaguaggcuuccauauauuuuucaaaggucuuuagugacauuucucccucuccauacuccucaacccuacucuuccaccucaauccagauuuaaccuucauguuccauuacacccuuuuacccucgaaccagcucauuuuaucucaucucccucuaaacccccucuccaugacccaccccuccauaguucucuggccucuguaggcaugccacaugaaauauaccugaaaguaaauucccuuuccucuucccacccugaugauccaggcuacugaucucagcagaaagccgacgaagugucuguggcccuuuagaauacauucucacagcugucaggcuuucaucuggcacucaguugacuuuucuagaucauagucuauuaaaaaacaacacaaaacacuucagccuaaaggaaaaaagaagaauuagaaaaaagaaugcccaaacacccuuaagagcucaaaagccuucccuacagagccucaaaagauuaaaauuuucuguuguucaucuaauagccagcgugggugacagcaugacauuccauucuuuggcccggugagauuuuauuuugcuuuccucuaaucuugugcuaucggaaaacuugacuguaaaaguaugcucaccucagcaagacaugcacaacagcaauaucaguaagcauucugaugaggaugggauaaaucucacaaggcccuaccucugggugacgagcuacagggugacugaaggccacaaaagagaaacagucuccucuagggaucugucuagguuguucaaccucaaggggucagcccugaacacggaaacauacaagcagcacuaaauacacucugcaggcuguaacaauaaaugcauauguguaacaauaacuaaagaagagccaugaaguugagagggaguggagacccaggagaaguuggaagggauagcagaagggguggaaauuauauaaauguacucauuaugaaauuuuuaaguaacuuuaauuuuaaaagagaguucaggccugggcauaguggugccugccuuuaaucccacacucuggaagcagccuggucuucaaagugaguccuggacagccagggcuuauacauagaaagccuaccucaaaaaaucaaaaacaaaaauuaaaaagaguuugaaaaucuuuggcccuuguaucucaagaugauguucuaaauuccaauaggcauugaaguuguuaucuccauuuuauuauguaauuaucuauuuugcuuaucuguacgugauauuaguugauuuugagcuauuuuauauuuuguuauccuuuaaucucaaaaaaaaaucuuuccuacuauucauacuucuuuuuuuacaaauuuauuucuuuuuuuauuuguauauaguuuuuuauuauuuuauguuuauuaguguuuugcuuguauguaugucaaugcaccauguguguacuugaugucugcagaggccagaagagggcaucuggucgccugaaacugaaguuacagguaguuguaaacugccaugugggugcugggaaucgaaccuggaucuucuggaagagugggcagugcucuaacugcugagccgucucuccagccuauauguacccuugccucccuuuucuuauucuucucuagcagacucuuugcuaguugacaugagauugggcaucuucacaguagcauggcuguagacucuuuucccuaaaucaguucauuuuccucccucauuguccuuugucccucccuccccccuaccaccccccuuuauuugcacuuuaaggcagugucuugcuguguugcuuugacuagccccaaacucaagcucuccugccucagcuucccuaguguagacuuauaaagcaugugucacugcagugagcuaaccaaaucucuuaaagaagcaagcuuacauagcuagcaaugaauuuaaagaacaaugaauuuaaagaacaacaaaguuaaacucuugaguugaugguauucaaaagaccgacaggagaguguuuuucuauuaaagaacaguaaccaagaggccgagagacagcccagcuguucagagcacuaacugcucugggacaggacccagcucugauucucagcacccacaugguagcuccccacugucuguaaucccugcuccaggagcucuaauauccucucugccuccacaggcaccugcacaugugugcagagacacacaugcacaggcauaaaaaugcacgcuuaagaauagaagaauagcaauugugcugagcguguggcccaugccuggaucucauaucugagaggaggaggcacgaguguuacgaauucuaggccagaccacacuacacagucagcaaagccaguauccucuuguaguaagacccugguuuuguuuauuuuuuaaaggaaaaguagcaguuauaaaaauuaaaguggugccauuuuaauacauuucaccagugcagaaacgguacaacuuuugaguaauguaaucuguuaauaaauaauguucuucauuggugaagugcuucuauaagcaguuccaagcacaaaguaggcacucaggggcuacgagaugcagaguaaaaagacauucuuaauauuuuaugacauucugauagccuuuggaagaaaaaaaaaacauuuuaaaaguauauuaguggcaaagcuuucuaguuaguuauuuguaagcauuuauaaggacaguuuggaaugcuugucugauuuuguuagucauacuugaauacagaucacuaagccccuaagaugugcgcuuacuaagcuugcccuugcugacuauaaagaggugcuaauggcaucacacuaccugauucuuuuaggcaucauuuuaguacaugacuuaacaaauaagaagucaucucaaaacuuauaucgcuggucauuggaaguucucaaucgggaugcaguuccaaccggaguccuggugacaaauggguaagccuagaauuacuuuacaauugguuuuaagugugauuacaauccugagaaugcucuuuaugaaauauuccucugaaggugugucauuaguccuauuuuagccucuacuuggucuuuccauuaucugaauggcauguuuccuggcagugguguuuauuuugauggaaucucauuacuuaguuuuccuacacugcauuuugcccuugguaucauaucuaagagcuguuugcuuaaucucauacagguuuucuccugcauuuccuucuauaaguuuuauaauaugggguuuguauuagauuuaugaucugcuuuaauuuuauauaaauaaugugauuugggcuuaaauuugaauguucaccugucccagcaucauuugguaacaagaguauacuaucuccauugaaucaucuucauucuuuugacaaagucaguugaccauagugacaguacaggucgacuucuguacucuguucuguugauguaugcaucugcucccuugaaacugugagcuaacauauauauuuuagaguuucugucagguacuuggucacagcuacccaaaaauugcuagugugguagauccugacugauuuucagauauugaaccacccuuucaucccaugguuacagugaauucauucuuucauuuuagauguugcugguuuugauugaauguugucuugcaguuuuguuuuguuuuuuuuuuuuuaaucuguguucauauggaauauugguuauacuuucuguucuauaaugucuuuggccuguuugauuugaggauaauuuuggccucaaugucccucuauguccuguuuggggaaagauauuauauauauuugauguuauuucuucuuuggaugauugcuugaauuuaccagugaaauuuuggggcuugcauauuucauuuugaaagguuuuuaacgucagauucuauuuuuuuuuaauaguugccgaaugguacauguauuuuguuuugucucaagugaauuuggcaaauuugagcuguagaggauucaugcauuuccuuuaaguuacugaacaucugugaacaggguuguuuguaauauuauucguuaucuuccuggagucuguaaugacaugcgcauuuucaucccugaucuugcuaacuuguguuuucuuuuugcuucccuuagacaugcuacuaguuuguugauguucuaaaauuuucagauauuuuaguuucacugauuuuuacuccucaaaaaacuuauucuuaaauuacaaguaagagauggcuuauuuauaccagaaaauacucacaucaauguucagaaauucaagauggcauaauuguuacagauauagaaacuguacuuugacucuguaacuucauuugguccucuagcugcaccugcacacgcauuaaacaacagugcauugguucuuuauugcugcauuauuuuaacagcaaaugaucuggaagcaacucugagguccaaaagaaagucuguuaaauaaauaauggucuaguuauauucuggaauacucuacuuuaacuauuuaagaaagcaucaggaauguuucuauguaggaaaauagagaucuacagagaaugcaaaucaagaugcagagaauauacaucauuucccuuguaaugugcaagagagcguguaaaggagugugcauguauuugcauacagcauccaugaaaagggcuguagcucuagcucaguagagcauuucccuagcauacauaaggaccuagguucauccuuagcaccacuuuaaaaaguaaaacagcaaaucgaaagcccuauuguaucuuuuauuucuugcaucuuaaaccuucuuuauuuuaguuauaguauuaagaguaugcauagcugcuguuuucguuucucagagaauuauugugcauauaaaauuauguguuuuuuagagaaguucuagccauagcuguccauaauaaaauucuccgucaguuuuucacauaaugauuauauccaggucuaauuucaauuggauguaugauuuuuagugaaagaggugauaagaaacaucaaagacaaugugguauaauuuucuuuuaaaguuaauauuuaagaggugagucauuauauacaucuguguuucaaugaauauaguucuugaaaaaaugaaaagcuaaaaagaaaaaugaaagaucaagguauauauacuuacaugguaaucuacaaaagaguauauacgauuuuaaauagcagagauuauguauauuaaagauaguauuugauagaaaacacaaaacuuuucaagaaagaauuugugaauauaagaaaaagaaauaauccugaagggugguacccugaaaaccuuauucucuauaauuuaaauuucaauccaaaccaugucucccaagugaggaguauguagguaaccagguacuaguucauaggccuugaacuuguguugguuuccauacaaauaaaacagauauguaaauucaaaacaacucuguucugagacacaacuacagcugaggcucugcaagaugagugugaaagguggggagaccuagugagugacccucuccgcccagcucaguuagagugcuccaaaagacagaggagugcuaagccggaaaaggagccgcgcuccaguggguuuuauugauuggauuauacagcaucgauuguucaaaagcagguuugcugacugcuguaaauugaacuuauaacguguuagaagucuagaucuacuuugcuucuaauaggcaaauagaauuucaauuaauuaacaacaguggacuuuauguuccuuucaguagugagaacuaucauuuguaauugcuacucaauccuuuggguaaaaaugggaagaaacugaauuauaauagacccccuucuaacacuaagagauucugauggccgauccucugucucuuaugacugucauguaaggauaauucuuugguacuggucgucuugccuuuuagaaucaugcuuuuaacauuucagcaguuuuccuccgcuuccauccaagcugugucucacucaggcgccgcuuccccagcucuuuucacucugaaaagguuuuuuuaauuacucauagccaggaauacauaugcaagcuggaggauuugugcaugaagugccugcauuccuugcuaggcuccuggguuuuccacacacugagcuuuaaaucuacuuccuucuuucacacugaaaauuuuugaagcuguuaccuacugaagacacugcauuauggacacuugagucacaugaucaugguguacuugguaggcccucagccauccuaguuaucugcuauaaagagacacagaaacagacuuugaauaauaagaugaagaguuggaauucaauagaugaugggcugaucaugaagauacauuaaagauagcaggagaaaaaagauuuauaggugacgaugagcagcaauaaguuaauuaucacuaaaguuguguaagcaccuugcauuuaaagaauacacaucuacguugggaagguaaauucuauucuccucuucaugguuauuuaccacagggauuaugaccgagaacaguuugcugauaaccaaaucccacuguugguaauagggacuaaacuggaccagauucaugaaaccaagcgccaugaaguuuuaaucaggacugcuuuccuggcugaggacuucaaugcugaagagauuaauuugguauguacuuucaccaaugugugucuagguuauauucuaggcaaagcagcuuuauacucaaauccgcagcucaccaauccagaacaaaucagagucagccugucuagacuaucacaugaaggucucuuucacuuugaacuuguacacugggcuguuggaauccucaagcuauauucugcgaauaguacaaaucauagccucuuuuuugaaaaaacuuaaaaagcauaccaaacucaaaauaauccuaucaauuaaggcauacauugguuauuguuguuuuuggaagaaaaaaaaaaagcucuuaaucccagcacucaggaggcagaggcagauggaucucugagugaguuccaggagacagagaaagccugucucagaaaaccaaaauaaaauaaaauaaguaaaaugaaagaaaaaaaccucuuaacugcuuaccacaacugcuuaauuugaagggcacacaagcagauguaugaggaaguugcacacuguaaaccaggaaugugucauaaggacugauguauauaaagucuuacauauagaaacucugugauagcuagcuuaauuagaacagaaugcuaacgagcuaggaaacaacgcauauaaaccaauucccacuccccagaacaagaccucgcccgcagccucggagguggagaugaguuaucgaugcucauaagcaggauugccacgcugucaguacacuguuguucaggugugcagugcugacugagccaguggccagcacuuggagggcagcuguucuccagaugcaguuguaagguuuacagguaucacaucacacguaauguagguacuucuagcuccauuuuaaagaugaagucaaauaaggcgcuccgacuauacaacuuaagucccuuucccacuugauuacccuucaacuaagauuuaaaaugaaggugcuuugaaaucauuuauaucaacaguuacccaaagcucacugcauaguuauauuaccaacagcaccuaugaauguuuauaaugacugcucuucaagucagagcuuugugcucagaaugcuggcaggagcucacuguuaaugcuuuguuuuguaaugugguacugagccuuacacaugagaaacacuuuaccacugagcuggagccuccgccagaucauucaagugagucugauaccuuuugcucagugaauuaacaucuguaaacauugccucuaccugucugguucagucucugccugcccuccauuguuucuuauauuuuauuguacaguggaaugugcccccuguuugcauuuaccaccauggaauggucaauguaaauaccccgguagucaguguuggauccuagugcucaaguggcucccuaccauauagauuauaaaagugugcuaucucuguagauuagugcugcagugacuuuauuugcacauuauuugccauuaaauaugcauguuuaguuccaguaguaacuugaauauguuucugaauguaucuuugucuagugccuacuggugucucugacaaccagcuagacacauuauuuguccuuaucuuacagaggcuaggccggcuucagcuguuagcaaaaccaaaagauaagcaguaggacagucucccaaggacuuacauaugacaugucuuuaguuugucaguguguccuuucacaacacaacagaaacaauacuagaaguggcuaaugaggauacaaaaaauuaaagugcaggaaggcagaugaauaugagaauugaaaauagagucagacaagcaaacguagaaccucaaacugagacuaauauggugguagcauuagugcuagcucaccauuacgccuacaaagaagccugaauccaacacacauguaucaagaguggagucaggauuucucuaugccuuuguaaaugcaaauuauuuaacuaaaaguaggcacuaggguuauuacguauauagucuauuuucucauguguguuuauuuaguuucuggucguuuuccacauucacacaagcuguuuagagcuucugauuuucaggcucucccucagccaugaucaauggcagauggcuuuuucagcuccaaaauuuucauccuaaaaaggauguaguuucagauuuccugcucaaccuaaauuguggagcccaguaguuaauuuuaugggggagauggcaacuuguuugauugccauuugauuuaggguuuuuuuuuauuuaguaauuuuaacucuuacuuagagucgucauuaaauguucugaugagguaaucaauaaccauuucgcaaaaccaucuaaugcaggucuaagguugauuucucaucugucccaacugguacagaaauguguucaaacauuauugcaaauucagcaguguguacacggugagauacccggguaguuaauccacacaugggauuaucuguauuaaauuaaauguuucugugcuugaaaauucagucugauagcauuuguaacaaugagaaagagaacugaugccccagugccugcugugugacaggcgugcaguaccucuuugcauuucacaaaacucugaauagaaucaucuccguuucacaaaugaguaagcccaacuuuagagccauaaugacuuaagcaggguacacaaucuggaaacguuggcacagauacuugaagacagagauuacuggccuccaagaugcugauuccccuaguauuuuaugaucuuuggaaacuauuguaauuauaagcaguuagcccccuuuccuaccuccccacuccuggcggggggggggggcggggggggugagaacuguuauaguugcugccauuguuuaaagggcaauccuugaaaugcuguguugacauugcuacuaaauggauuagaaggaaauaugugggccuggcuguuacagcaagaaucauuucagaaacugcucaagaggcacggagggcccacagaugcuugcaagacacuuaucuuuaugaaggagucugaaugauaccuguacaauuuggucuugguggcauuugagguaaagaucaaagcugacucgcuguuauuuacaagguguugugaugacuuagugucccaggcugugcagccuccucugagcucugugcuuccuacguaaagaaucuuccuagauaauauaucuauuauuaucagaaccaguaugccuuuuguuauaugaagaaagggagaaauuccuuacaacuguuuguucuuuggcuaaaucuuauuuucauguuuccaacuauuauacagacugcauaguucuuaacucguuaaacacuuagucccuggucugcaguacguguuuacauaaauccuguugaugugauuuuguuaacauaugcaggucaccugaucagucccuugguuuuguuaacaauaugcuaguaauuaaugauggguguguggaguuaguauccuccaauauugcucagaugacaggacuaaauggcugcaccuucuuugccuuccugcucacguaucauaaucugaguauugcuuuguauuuugugagcauuccgaugacuuauacagaauggcacuggagccucacuccuggcuuuucucugugcgccuuugucuuccaggauugcacaaacccacgguccucagcugcaggcuccuccaaugcugucaagcucaguagauuuuuugauaagguaauggcuucaauuaaguuauuuuuaaacuuaacauaugauagcuuaaacucuuuguagaaugcuguguccuuuuguuccuuugcccaaaacuucacagccugaauaccuguuuugaucucucuuaucuguuggaauaauugcucaaggccugcugacguacuuacuccaucgcuagcgcucucuaagcaaagaguaaaggcuauuggauugaguggggguucuuaaaaagauaggagucuuccucaaaacaguuuauagucagcuguuguuuagugcuuuguguaauuacgucucuccagaggcaccgaacagagguuaaagcccuuuauucucucagcuaugaauauuuuccauguaaaugucgcuauuacuuuguaaagcuaagcugucuccuggagucuguuguuucccugugaggaacaucugcacccuccugacacugagcuggagcccugcucaucugcaucuccaggcuaugcagcugccuuaccuccugcccauuucgcauagcagcgcaauauaggacuuuguucugcaugaauuacugaaaaaaaucaucucuauguuaggucuagucaaugcuggaaaaauugcucaaugguuaagagcaguugcuacuccuucaaaggacucagauuuaggucuccaaacccacagagagcugcucacaaccaccugugacucuagcaccagcgauccacuacccucuucuggccucuguggugcacaugcaagcaagcagguacacacacugcacauauacauauaaauaaacauaaaauaaauaaaguuuuaaaauuacagauguuccuuauggaauauauauauauccaguaggggacugugguucucagaggccuaccgucuagcuagggccugggaaagugacagucucuguucucccuugcuaggcugcacagauauuagccuuuucuugggaagugguacaaggaacuauauauucucuccauauuguuuucaaaucuaaaauguugcagcaucugcuugguuuagauccguguccccaucuaauacaaaacccugucccuuaaaacagcauccuauagaucuggguuugaucuggaaaggccacauaguauacguuuauguguuuuaaguguuuuuaaagcuaagagcucuuaagucacauccuagagaaacaauggauuuuagacuagcauagccuaaguuaucagcaaagcuucauucauaaauagauagauagauagauagauagauagauagauagauagauagauagauagguugguuuuaagaaaggaguaauaugcauaagagaggacuucgugaguugggggugaacaacucucagcaaaagaguaagcuagcuuuguugucuaagucucaguaaagaaugcaucagcaaaacgauuggcuggucuuacacaacguguacugaauaugaaagcaaaauacauggcaauacaggucugccccauuuucuguagagaaaaccuuucagaaugccaaggcugcgucgacuagaggugggcuggguccuccagauuuucuuagcuggugauaagucuaugccugcgugauaaggugacucuguccugcugagaacgaggaaaggcaucaguccuuugggggcuucagggacucaguguuucaagguguaugcuaaccagaaaccagguuuucuaccucaaaggccaaugagugcaucuuuguccuagucucauaugacuucaaauacuaacucagacacagucuccaggagcgaaaaccagaauaauuucucuuaggcaauugugagcaagcuucccaggccugaaaggacagguugugcucugugucagaaggcuucccagcuucaucccuccagaugcgacugucuuaguccaucugcaccucaucuguaacuuacuugauguuucccuugcagcagcaccucugcaaccagugcagugucuacagggauagacuggaaauccguauuuuuuauacucuccuucaucaucugaaagcaugguccucaaacccauuguguuaggacgugugaguuucuucacacgagcugugauguuuuauaagauacauccacugcuuuagccugucuucccccugacaaauucagcaagcccugaaaggacugcauaagaauagcagcgaagccugugagggaaacccgcugacugcuugaugcugugugcuuguccacaggcaggaugcacagaauccucgcugcuucacgcagacccgucuugaggauugcagcagugcuguagcgauccuuuaggagccagcuggugggaaacucggccugauugcugcuagggaccuguugggacauuauucuguccuuauuuaguuuccauguguuacuuauuucugaguuuuguuuacuuuugaagcaaagucuuacuucauaaacuagaauggucugaaacucaccaaguugcccaggcuugccuugaacuccuaaucccccuggcucugcuuccugcaugucgggauugacuacaaagucucauaaugauagaguguacaccguauccuguucauuggugaacccuuccuuccuuuagaaaugaguagauaguaauggaaauaaucucacucuuucaauccgguuagcaccagguuuuaagauugugugcaugcaugcaagugugccuguguauguguguguaugcacucgugcacgugucacauauaccacaaguaccugcagaagccacaagacggugugggauccccugaagcuacuugcaggugguugugagcugcccaguguaugugguggaaaccaaauuccaguccucucaaaaagccacaagugcucagcugccgagcccucccucuagccccagcaucagagucuuaacucacuguauuaaauguccagagcuguugaaaaggguuuuaauuuggcaauauguccuaugguugcauuaaugaaaguuauaaauuaauugcuuuuucuggggaaguaugcugagcccuaaagucuucgucuguuuuugcagguuauagagaagagauauuuuuuuagagaagguaaucagguugguaucugucuuuuucuugauaaagugacaucuuaaguuuugaaaaacagccgggcgugguggcacacaccuuuaaucccagcacuggggaggcagaggcagguggauuucuuaguuccaggacagcuagggcuacacagagaaacccugucuugaaaaaaaaaauuuuuaaaaacaugguuucuauuuuuuccuccagacgggauuuuguuuguuuguuuaauuaggaaaagcucucuauaggcacaggcaacaugaggaucugcaggacaagaaaaacccagggaugaggagaggcgcugaccuaaguaaagaagcccccauuuccucaagggggcuucaagucguuuugucuagaguccuccauaacagacacugcguauaaaguccaguuggugauuccaggagauccguccuuucuagauggcccugccacugauuuguuggcaaauguuuucuguauuuguagaguuucuuuuuauuauuuaucauucuaugauuuucugauuggaagcucagagagcaucaggcuggcaggaguuuaguuuuaacauaugacucuuucugcuacggcauaacaggguucuuucuugccuacagauuccgggcuuuucugaucggaagagguuuggaggaggggcacugaagaacuuccacugugacugaguggcccucagcccuggaagagcaagggaacagcagcaguguccacagcuuccucuugcuguguagggacauuaacuucucaggcuuugggaaaaacaucucaaaaugcuaccucacccucucuuggaaaauugaaaggaagcagcggcauggaagguccuagcucugcccauucucuguauccucaccacccugucccugauuauagcuuauguaaaagccuugugacgacauaaaggcuugucaaacccaugcaguaaagaacuggagacaagggcugcagcgaaggcugacucuuacuuggaaccagcggguuuuacaggccugcgauuuucccacacuugcugcugaaggcuuaauuaaguacuucagaaacauaucuguguuguuuuacuuccugaggggaaaggucauguuaaucagcccugaguuauccaccccaaaccaucccugccauuuuaaaagaagccaaaugguguuauuucauuuucuccauccucauuacacacagggaugccuaagaauagcaaccccaucuccucugcucucucugggaaagggcuuagugucugggaagagcgauggacuaauagcuggaguuaaauagaaauacaaauuaauaauacauggcgaacagaccagaagagaagggucugugagacucuaacagcuccucugcuccaagguugcagcugucggaaggcucuuucugcuuucuguuuggaaagugggugaaaucugagaccuguacaaggccaguaagacagauuauugccucuuuggugguucuuuuuguuuuguuuuguuuuguuuuguuuuguuuuguuuuuuuuaauuuucuuuucccaguuugguugguuguuguucuguuuauuuguaaggaaauccaauuccuggaaugucccuuaauacgaugaacaguaagcuaagacuauuauccuugucuuaacaauguauuuaugagaagucaauuacgucccagaguaacgaacucauauacauuaugagcccguguuugagguuucaucaucacgcugcaacguuuuuggcggugguguguauguauauguuugcauaacugguugucauuguuucuuagcccaucuuuuuugcugguuuaaucucaguuccuuaguuuauaaaauugguugccaaaaaacgacuguaauuggcugcuguguucaacaccuuguuuccagaugcuccugucugcagcggcgccccgcuuccugcuccccgcuccccgcucccuggcuuuguaccuaauuaaaaaaucaugguaugaauauac

SEQ ID NO: 8237 - RNA, 727 nt, Mus musculus
ggagacagggugucuuuuuuuuuuucaauauauaagucuuuuauucucccaaaagagcccaaauuguucuugugaucaggaucucguuucuggggccaggaacugaggccuccucacucgucagccugcugcacaguucccuucucagacacauagaugccguccaaaaacuuccugauauccuuguuuuuaacugcgguggcuugcugaaucagggcagcugaauuugaaacaaguucaauaucauuuccuucaaggauuaacucauccuucugggcuugagacacagaacaagcaacaccuguccucauccgaacccuguggauguauuuuucacccaagaaauuucggauuucaaccaaagagccauucuccuggaugacgauguugauggggaagugagcguacacagaccgcaucuuguaucggaagcccagugugacaccuuugaucauguucugaacaugacugcagaugguccugacgguggccaguuccuuucuguuaccccaccauuugucaacccagagccuuuucuuuuucuucccaagaagacagcuccacguugaugugauugaagucccuccgcagagucccccuggggcccuucacaaugacugugcgccccuucagagugaugucgacauucucuggaauguccacagucugauugcugagaauggucuucauccucgcaguagauggggcaaagagagcgagacagggu

SEQ ID NO: 8238 - RNA, 727 nt, Mus musculus
acccugucucgcucucuuugccccaucuacugcgaggaugaagaccauucucagcaaucagacuguggacauuccagagaaugucgacaucacucugaaggggcgcacagucauugugaagggccccagggggacucugcggagggacuucaaucacaucaacguggagcugucuucuugggaagaaaaagaaaaggcucuggguugacaaauggugggguaacagaaaggaacuggccaccgucaggaccaucugcagucauguucagaacaugaucaaaggugucacacugggcuuccgauacaagaugcggucuguguacgcucacuuccccaucaacaucgucauccaggagaauggcucuuugguugaaauccgaaauuucuugggugaaaaauacauccacaggguucggaugaggacagguguugcuuguucugugucucaagcccagaaggaugaguuaauccuugaaggaaaugauauugaacuuguuucaaauucagcugcccugauucagcaagccaccgcaguuaaaaacaaggauaucaggaaguuuuuggacggcaucuaugugucugagaagggaacugugcagcaggcugacgagugaggaggccucaguuccuggccccagaaacgagauccugaucacaagaacaauuugggcucuuuugggagaauaaaagacuuauauauugaaaaaaaaaaagacacccugucucc

SEQ ID NO: 8239 - RNA, 59649 nt, Mus musculus
agaggacggggaugccugcggugcauggacgcuccugggcuacuggcgggggccgggaggagggagcgcagcgggagccgcgggggcagcgcugcagaaggggaggagaauagggaggagcuggggggccggagggcggggaaggaggggucuuaaggggcggcgagcccaggucggacuuccucggagccuggugauaagcgacgcucccaccuucgccucuaacucgcugccgccacccugcccaguguccuccggagucccggacccgagcacggugagcgcggugcagaggccgggccgcugcgggcaccgagggugcugggaggagggggaugaaucugugggacccgaagaaguuucuagggucugagcggggcccagcgccuucacucucacccucuucucucuuccgcagauguggaaacgauggcuggcgcucucgcuggugaccaucgcccugguccacggcgagguaggugaccggucucugggguuugcgccccagcggucgagugugcacucuagggaugcucucugggggugggacugaaggucccccagccuuacgauggagugggauucuggcacgcuaggagcagaaauucuaccuaacaaacuuagaucucaauucuugaaauaguuugggccaaaagcuggagccccaccacgccuaauauggagggaggcuggggaguggggagagaggacagacuggguggauaggagcagaggcggcggccagagcagccgcagaguucaaaaaggcgccuugaguucuguucacuucagaggaaacagaauaguuacggacuuuuucuuuccaagucuuuccuagccggggggggggggggggggcacuuaaaaguuuuuuuuuuuaacagcaaaaugaaauuuccuuucuucuucauagagugaauugagauuuccugaaaugcauuuucuucuuuguaaaauguccuggauuuuuguuguugucauuguuauuaucugggcccuauaagagucuuuuauaauccaaauuuccccuuaaacucgguugagcaaaugcaggaaucugcggcucuacccuuugggggccucugguuuccagcuaaaauauguagagucucucucucucucucucucucucucucucucucucucucucucucuuguuuucuuuucaacuccagugaccuuccugagacacuacaaacaaaccaacaaacccuauggcacaagccccuccauuaacucaaagguuuagggacagaaaauaaacaauucuaaauucccugggcuccagucuccagaaaagugaggucagaaacuaaacauuugauaauuguggcaggaaauguggaaagaauuaaaacgcaugagagagaagaaauggaaugcacauuacaaaagaaauagcucccuggugggugguuuauagccccucagaguuuuucuuucacuuuacaguuuagccccacccuuugcaucacagcuugagucaaucccagaauuaauaaaugcacacagucuucaggacuuuaaacacacacacacacacacacacacacacacacacacacacacacgcacacacuguacugguguguguuccuuuaauucacuguaucacugauugagguagaagcagucuauuuuuauuucuagagaaauaaaagcagcaaguauuuauuagguagcuacuacuuguauuaagauucuacuuuaaucauaggggaacugagucagggaaguuugugcaacuuacaaaauaaguuauaguagugagggcaagaugcaaacccaagccgucuggcuccagacuccagacaauucaucacuaccuggcccgcuuacaaacaugagggcuuaggauuuuaccaaguguuuugugucugcucggaucacuucuagcauuucuuuuaaagccucucagcccugugaguugggcuuuguuaguuccguuuuacagagcagggaacaaaguuaaggaaacucauuaaauggcccguguucagauaacugauuagcuuuggaaguggaucaguaugugacccccucccucuaccuuucagauacgccuugagccccguuugccccucagccauuuucuuugaguggaggaaauagccucgguuuuuaacucugguuaaagaaugcuccuccauccuugugauggcccucaacaccguuagccaguggcucucaccuuuaauuccaacacgugggaagcaaaggcagguagagcuuugugaguucaaagccagccuggucuaccuagugaguuucauaacagcuagggcuaaacagugagacccugaugauuaagaugaugauaaaauagccaggcagugguggcacaugccuuuguucccagcacucaggaggcagaggcagauggaucucugugaguucgaaacuagccuggucuacaaagaguuccaggacagccagggcuacagagagaaacccugucuugaaaaaccaaaccaaaaaaaaauaauaauaauaauuaauuagucagucaauaaaaagagagcuacucuucugugauagaugaagugaauuccugguuaauuucucagccagcuuaggaauugccaaccacuuugugaaaagacagaaccguuugcagaaguaaggaaucugugucucaucagcacgagacugugagucucaaggucugcgaucuguucuaaguaaccuacuccucacuccagccuccucaucccacugcacagcagagaacagcucacuccagguaguaagggccccucacugcaauuucccacuggagcucuauggaagaacauucaguucccaggaaaaaccugcagagaaagaggcaaagugcugaggcaugaaaaccaggggagcuggugcagaagagaggcugugaagucaggacacacggacagugaagagggagcccaggcaggagccacaaccgcacauuucauaacuucacuguccuaaggauuauuaucuuuuaaucaaccaagccuuuguugccugcccuuccagauaacacuuggcaaguuuuaaugcacguguuaaauacuacaucuuuacucaugggugaaaaaaguaaauuaaccccucuccgugggagacgugacuuggaauacauuuuacacacuauaguugcaguuaaugaugcuugcaguggaggguuuuuuccuuguuaacuauaagaacauucagcaaacacucaaguaugguauuucuagucuuuuggcaugaguccauuuuaguaaaauuuagaucugcuacguugugcaaauauuguugaauucucaaaaagagagagagagagacauagaagacacagagaauuuucuuggugcucuuugcuuuaauaaucaaaccuaaagauuuauuucacuuuuuuaaaagcuacgauuguuuuacaaauucuauugguuuuugaaaaagcccaaagcuuuuggagucagcuuucagaagcagagcuguuccuucuuggguaaggauggcugugauguucuuaaugcuaguguauaaauucuauuugguuggauaugagaaacugcuacuaaaucucacuaaggccaaguauuacauuguuucuguauuuucaaugcccuuauacuugucaccucagaguaacacugcugcuguuuguucccuuuguaguuucccuauuuuaccuccaggaugucccugcagccagccuccaucagaauaaugccccacccaugugagcacacacccacaugcucuucagagcucugcacacggcucuagauauacacauauuggacagaaguaggcucuaguuggggcagcagcagagggaaggcuucuacuaauauucaucccuuggccugcucucucuuuccaugccccuucuacugaaaugaccacuauuugggggggggguuaugcaauugggggaccaaggguaguauagagaauuccagguauaaguuugugugccccuggagucuugaggaauguauauuaguuccucugacaugacaggcuagaggagacacacagcccaacugccagcuucaaaaggacaaucuuaguaaguguccaagugucccccuaugcacccuggcuuaguuuuacucugcauucugggucuaggaauucauuaugauaaauuacauauacaagggacagauuuaccgaggagaucacucacuccagcaaggaauccacacuugagccaugagcugggaaugugucucuugagacgguaguguggagagccaauaacagcuccacagacagaugcgcugugcuuagcuguuaggcaugccaugcuagcagacugucagggcuuugucccuaggaagcuacacugcuuaaugucauuuacaucuccucacaugcauguaguuaaccacuagguuaguaucugccaggcuggggaggguugggagugccucugcauucuauagaauuguucauuaaucuacagaguaaaccuuccacccccacccccacccccaacuacagcuucagaaagagcacuugcagcuuacacaucagcuagcaaaaugaucuccuguuuguccuguagcaaauaaacuacuugcugugaugcuaaaggugccguugggaaucgagaaguugaagcauagcuagacaccacugaauagccaaaacagaugggcaagcaccuggcagauggaagugcugcugcuuccaaggucuuuggaagguggaugcauuacaguuccuguugaagugggcugggucacaggacgcuugggccaacauguugaaaggcuguaguaggaaguggcuguaguagaaaguggcuguaguaggaaguggcuguaguaggaaguggcuguaguaggaaguggcuguaguaggaaguggcuguaguaggaaguggcuguaguaggaaguggcuguaguaggaaguggcuguaguaggaaguggcuguaguaggaaguggcuguaguaggaaguggcuguaguaggaaguggcuguaguaggaaguggcuguaguaggaaguggcuguaguaggaaguggcuguagggauuacggcugagcuggauauaaggauauaagaaguggggcuggagagauggcucagugguuaagagcaccgacugcuuuuccgaagguccugaguucaaaucccagcaaccacaugguggcucacaaccauccguaaugacaucugacgcccucuucuggugcaucugaagacagcuacaguguacuuagauauaauaauaaauaaaucuuaaaaaaaaaaaaaaaaggauauaagaagugguuggggggcuggaguaauggcucagagguuaagggcacugauugcucuuccagagguccugaguucaauucccagcaacuacaugguggcucacaaccaucuauagugggaucugaugcccucuucuggugugucugaagacaguaacacuguacucaucauguauaucaaguaaauaaauaagauuuagaagaaggaggaagaggaggaggaggagaggaaaaagaaggaggaggaggaggaagaggaggaagaggagaaaguuggcuagacagcagcacaagccuggacaagaauuaaaaauaaaagauaagcuguaaauagccagggccacauugauagauuggaaaugugaugguuucuuuuuuuuuuuuuuucaagacaggguuucucuguguagcccuggcuguccuggaacucacuuuguagaccaggcuggccucgaacucagaaauccaccugccucugccucccaugugcugggauuaaaggcgugugcuaccacgcccggugugauaguuucuuuuucuuucuccucuucacauaauuggacgugcagaagaauacuuuggacaaucaucuauuuuauugacuucauaauaccagcuguuauauuacuaggacaaauuaaguauguuaguucuguaagucagauaaagagugaccuuggagguuaaauacauacaucuucccagguugcucaauuccaaaccuuguggcuuuggcaaggaugcucucuccaagagugaggcacgaagggcccagaacuucccuucacuguuuccauuagguaacagugccugguccaggucaagaaugcucugcacacagagaggaauccagcaugaugugcaaggcucgauuucuaugcucuuuccuuguagccuacuggucgaucaggagcauuaagugcuaaaagaugauauuauauuagaauaacaucauuagcaagugaacucaaggacagccuggucaacauagaaaguucuagaccagccagaccuacauaguaagacccaauuucaaaaaaauuuuuuucuguuauauugacauagguucucccauaauuuaaaaaaucccccuuuuguuuuuaaagguucauuuauuuuauuuuaugucuaugaauauucuaccugcauguaugucuuguguacuuuuucccuuuagaagucagaaaaggguauaugccccuggaacaggaguuuagagaugguuguaaucguccaugugggugcugggaaucaaaccugcgucuucuacaagaacaagugcucuuaaccucugagccauuuccccagcucucaaauugucucuaaguuaauaaaauccauacauuuauaauauguagcuugaugaccuuuuacagugggauauucucagguagccacucccccagugaagacagagggagcuggugaggaaaggcucugaguucaaggcaaaaaugucacauaguggaacugugugucaaaggguuugcuccagcaugcauuucaucauuccuuggugaagagagaguuuuuagucaguaucuuggugucuagugacauuuggcagauucuuaguccauguuuuagcaauaaugaauuuuuacaaauuagugaaaagguuaacucacucucuccaggagucucgugauuuagauguuauguaaguauuuggauguguagcuaauuguuacauuuaaggagagucuucauaagauaccaauuauguuauuuagaagagcuguaaaauuagaacuaccuagacauguaguugaagaagggagggcacagccauggguaccacucugggcugaauuggaaaaccuuacccauagggguaauuuuauucuuuguuccagucuuuucuguauuuucuaagcuuuuuugaauguaucuuagcuucaugucgcaugagaacaaaauccuaacuuuuuucucauguguauggucaugugaccuauguguaugggucaauauugacauguguguggauacuuaauggggcaucaugggcauguauguaaauguauguggcgucccaagguugauguugaaugccuuccucuauccuucuccaccuuucuagccaaggagucucaguuacacccagagcucagagauaugacuagacagugaucuuacucuaaggguuuccugucucugccuucaaaguacagggcuguagggagaccgccaugccugucuagcauuuauaugcaucugaauuccauuucucagauuuguacagguagugcucuuccacugagccaucucccaagcccagcauuaacuuuuucuuuaaagugacauuaggaggauaaauucuucuuguaaaaggaaauagucacaggaauccucuugacgaugaaauaucaaaaagaauaggaguaacagggaauauggacaauauagaaagugagguucaacaacuagugugucuuccagagaaucgaucaugucaguaguaauaugugaugaucuuauuaaacaccacaggcaaugaaaauaaguaccugccaacacuggaguaaauggccugcagagaucgugugaacaaagcauguguacagcuccuacauuccucuacccaugacagacaugacuaaucaaucacagaauucuuuccuacagaauucagaggagguuugaaaaucucauucaacaacacuccuuguagccauuagcaaucagucagagucccugugugagaugaaagcuauuugucauuucugcuggaauacucaauucaguuuggcaagcaccgacaauuuuuaacugaaauuaggauaauuagaugggagacuucaggauuguaugacugacauagacaacagagagaagaagagcugcuggaacugauguugaaagucucaggagaagccauauacaaguuucaggcccaaguaacuaaguaaaacaaacccuuucaugcuggccaucagugaggaugcagcagugagccguuucuuggcugcucuaacgaaaugcacccuugcccuagcuaagacuggaagagcugcugcuaucgcagaaagcaucuucugcauuagcagagucuggcaguaacuugcuaauagaacacucucuagguaguuggaguacaaaauauagccuauaaauuugcauuuucugcuuugguugaaagauuuccguguaaucuccucacagacuuuuuauguccucauuuggaaguaauaacuauuacacuagcuccaggauuaauuuuaaauuuaugaugccugguauguucuuuaaauagugugccaggcacuauuugugaccaaucaggccauugccagaugaacuaugugacauaugacaaaagcuauguuguacugcaggcacauguguguguucuugugugugugugcgcacgugugcaugugcaugugugugucuguguaugucuuucugugugaauguguguguaugugcauguguguacaugucuauguacauugcaugcaugcguguguguuuaugugugucccauguaugugugucugugugugucuuugugugugugugugucugugugugugugaugggauauuugaauucauguagggaaaguggcuuuuucuccuuuguuguuuucaaaaguaaacuccugagucugagaaaaacauugucuuuccccgggcuuucauugauccuucauaaauaugacuuauuaaucugcagaagccucaggcauuaccucauggcccuuccugggguguuauaucagucacuuuacacacuucccuccauuagcagcagugugagacuaacaggacugcacaggacuuuccuggaggcgcugccugcaucaucacuguagacagcccaaauggcucuggccgcuagggacaacaggaacgagcagcccguccuuaccucuugcaucugauuuagaaaauucugagagacagcagugggauguguggucccugccaaccagaauuccaggggcugcucaagggcagcugggaucguuucugccugcugacauugucuucucugucagcguggccacuguggcagcgucuuguacagaacuuuaucugaaauggugucucuucuggguucuggcgcuuucccguuuucaugucauucugagguuccccacaucucccccuucauuguccugugcucuugacccgagucucuuuuguuuuucugugcaucuguuuuuaguuaaacuaaagcauugaacccuaggccuagcucaaccuugccaagagcuccaccacugagcauguccccuggcccuuguggcagaaucuugcugugugccucaggcuggccuugaauuuguaaugcuccugccucugcaucccgagugcugagaugacaggcuggugccaagcugccuggcccccaaggucugucuuuaacauuacagagcacuuuuguuauuaagugacagugauuguggggaacaaugagguaguccaugauguugagguagguccugggacguguugguggaaccuggugcucugaaggaaaacauuggguucugcuaagagagcacugcuccacccggagcccagccugacuccagcuucacgugcucacagaccccauucccaggccagggcuccucccugccacccucucccuuucucuccucauccuauugccuagccuuuccucucuugcuuuucccgcucuccuuauagacaucaccccgaagugcaugagcuguuaggagcugacggauaucuacaaaccuucugcucgucuccacacaguuuaaacucacagacccuggugugcuccuccguaucacuccccugaaauaauuccuuuuuucauaaucaacuagcaagaggaaagccaaaggucucccacacuugugcucccuguagggcacuaaguuaaagccggugaaaaacauacucucuggaguguuuggucucgugcaguguuucucaaccugugggucccaaaugacccuuucccagggaugccuacggccaucagaaaacacagauauuuacauuaugauucacaacaguagcaaaauuacaguuacaaagaaacagugaaauaauuuuaugauggggggggucacuacaauaugaggaacuauuauauuaaggggucccagcguuagaaacauugagaaccucuggucuaauaggagaaguaggcagggaaggucauggccucagaacuguccagugugagaaacaguggaucauggcugagaaucuacccugugcagagguccaggaaagucugucagaggaaguagccugcggcugaacuuggaaagggaccuacaguguagcauaggcagaaaagagagcuucuauuuaauccucaaaaagugacaaguaacuauuauaaggcucauuuuacccaugaagaaaccauucaguuacccuguaucagcuaccuaaccaaugguagagccaggauguaaaacccaggguuugauauccccaagucaaagcucagugguuugugcccuugggucugauuuccagaagccagacucugaaaacacaccaacaaugaauguugccuguaguauggcuccagcacuguacaguccuagucacuaacuauucaaggcacaucagugcuaaauggcucuaguaccugaccugauccugcagccucgccugcuccagccacaugaucuccacuugaauccagccccagcugccucucugacaugugcggaacugcaguuauuauuugggaauauugccagcuaauggccagagacucgggagauguuuuaaggcaguuucuguguccuugaaacguauucacaacuguuccauacuauguaagaccgaacugcaaaauggcucuaaacuccaaucugauugcuaaauauggccguguagugcacagaugccugccugagggggucaguugggccaaucccacccugcacugcacucauaaaggcgugugcccugccacagggccccccugccacucagaagaaaaggcccuuuuccccaccagcuuagauuagcaaagcuucccaaagcuaacauuacccccgagucauaagccuauuggacuguggcugccguuucugugucuguacauuuuaaucaacugguuucaucagaauccugaggcccccuucaagagcuaguucuuuuuaaugaacaagcuaaaauaacacaacuggaaaaucuuuuuuuuuuuuuuaaacauaguccuucaccccuacagugugcaucucuuggauauuacucacuucaauuuggguggggaacugugaguucucagggacuaauacgaucauccucagcuccccaugauggauggauuaacggaacuucccucggccuauagcaggaguccagcuccugggacgaaaugucuuagauagagccagcccccagccuggagccugucggaaguuguguccuguguuugcauuagcugaacaaagagcuacaggcuuucucgccuggcuccccuccucccuccuucucuccugcacugggagaggccagcuaaagucuagacagcagaggcugcuuggcaccgcgccuucacagcagccugcagggcucugcagcccugacucccucagcacugcucacucugguuccuuccuuacucauuuccugcuuuucucaaagucagcccugaguugucuuggggggcuagcauguacccacacacguaagaagcaagugagugaauuaugagccugcccaggauucggcugcuuugugagguucugaacugagaaguuacagcuggccacguggcugagauuacuguccuagcaucaagcaagcucccuucaucuugggccagacaagguugggaugaauagcccagugguaccccaaguguggacugagacaaacaucuaaccccucaucccccucaaaagagugggagagacccgcaauguaaacucuaucccuguaaguccacgcaauuuggaucaucaaaauauucuuacuuagaaguaggauauuugauuaagcucuuacgucaguuuccuacccguggggagccaugggaaagagaggcuggccaaggaccaagaaaacaguguggagaaaggcaagaggccccugggucccccucuuagguacugagugcaucaucgaacuccgaagugcggugccucaagugccuuugugcucugcaaucccaaguccugauuaccccacagauaugagucauuuggcaacugugcaucagcacugggguggggaugggggggggcuggaauaucccagaucccccugggauuuagggagggaucuacaaacaacaacagcaaugacaaaaugaagaucaauccaaacucuaugauuuucaugagaaaaccgacuuucuuccgacuuuuccuucagcuguagcauugcaaagggcuuacaaaaauagcuguguggaaaugguguuuggaaucauucucaucucucaccguguugccuggcccaugaccaggaucuaggagcuccugaacagguguugaugaacguccugccuccauccccugucccugaucuggcagucggcugcaucaggcacuggucuuugucuuugucaucaacacugagauccagugaccuuuguaagcaagccaaggcuagccuggaggcuucagcccacuggugugcuuggugccauguccugacuccaagcccuaguagauagccagguaaauugcccugacuucuggucaugaauaggagcuagccaugcaaugucuguguccuuccuaauagaaguucuuguacagguuagaacuggacacauguauguacacacaucugcacaucuacacgcaugcacacuggcuuaaauuucaccccucaggaacaaagccgucugccaguaucuuguaguaagacuuuucucaaccacagauuccuacggaaacgaaugagagggacacauguguguugggauuuucucugaugaacugccuuguuguaccuuguggcuucuguagacugucaugaugucuaagccuaggcgcagcgcuuaucuuuugugguuaugaaacuuagcugcuagugaacucuugucauucagccagucggucagucauucugcuuuaaccaaaaauggucaaaacaucugcaauuaguuaagccagcuaaguuucggagagggagugaugucuggggcauagcauuuuuaagaaagcaagaaaauggauaagggacuaaacgccagcccagggggauuccugguuacugccccagggaucagugggugguuuaaacggugaggugcuacgggaggaaugucugcuggagcagcucuaucuagugaagcagauaugcaugugcucacagugagcacggacacccaaguccccuuuacugacugacagccuccaucuugagggcccaggaagaccucauggcuucuugcugguuuagcccgguucacagaagcuuugguuggaaagaggcaaauguucugcagccauucauucacaaauggcugcuucaggcuucucuaaaugcuguagcuaggauuccaccauccauuagggcggggccaggcuaccccagaaacugcaggcuccacuagucccaaaaauuuuuggaaugugaaugugcccagucaucuuugaucauuuuucugucacuuccccucguccccuucauuugccacuuucuuuccugccuuaaccugugucgccuuggccuacugacaggcaugcagagaaucagaauuccuagguagacauuuauuuuaaaggccggacuuucucuuucugcaucagccggugucugcaucuuguucauccaagauuccugcagugcaccaagggcuggcuaaggaccaagaaaaacccagccgaggaacucccguugacuuuggcuuccucaauuucccuucuggaugguggagggaggaaagugagggcuggcauccaggggcuuacuaaagaucggguguaguaaguucacucuucacugugugacugucauggcaggaaugacgacggacauuccacaugugugccccacccuugggcuaucagacuauugaaacaacugaccccaagagaaucaaagugcuccaggaagcucaagcuggaaagggggcaaaggcggaaagccuagugccagccagagggggcuuuguguuuagaagaaggcucaacacaguucuuccaaccugucugaucaccuuucgagaguguccagagccagugaugagggccacaccuuugucugcacuacuuaguacgcuuuaugauaccuccuguuuaaaccauuagaaccccgagggugaacuuuggguggcacuuucccuaagguggccgcagugaguaaaucuccuccuuucuauuuuuccuauuacuuguuuuugauugguuuauuaaggaugggagacccagccuggauuguuuucaagguugccagggcuuacuuuuuucacagcuuucauaauuaaguaauuaaucaauuaaugaaguguggggcggggggucagaggcaucgauucccugagauggcauuacaguugguugcgaguugucugaugugggugccaggaaugaacucuugucuucugaaaaaucugugugcacucuucuuucuuucuuucuuucuuucuuucuuucuuucuuucuuucuucuuuuuuuuuuuuuuuuuuuuuuuuuuuuuuuuuuuuuuugguuuuucgagacaggguuucucuguguagcccuggcuguccuggaacucacuuuguagaccaggcuggccucaaacucagaaaucugccugccucugccucccaagugcugggauuacaggugugcgccaccacgcccagcaucugugugcacucuuaacuaagccuuuucuccagcaccuuacuucuuaauaaaauuuccucauuuuuaagaguccauauuacuuucuccuagaaauacaaccagaaagaaaaagucuguuuauuuucuacuaaagacaugugugauuugaucuguaugagauacagaacuguuugguuaugcguuugauauuuuaggcauuuuuuuaaucccccuaaaauccucaguggugauagagaauccuguaagaacagcuaauguuggaggauuucggacugauucggucauuuuauagcuuaggacacugcauuuuccuccgaaccccuuuacauguaucaaacagaaggcuccucaugucuggcuuaaguuguuccacuaaauggugguuuaacuggcagccugcucuccacacaggcugauucucugguuggcugggcuguuuuuuuuucaggugaugucauuuuucuuaauguaaguggcauugucauuuaggguucgugcuuacucacguuauaguggccuaggaucuaaagaccucauuaccaggcggaauuuuaggauuuugaauuauaggaaaugucuucuuucuguugggguauggggcggggcuugcuuucuguguuggcuggccuguuggcuaugugccugugugugagagaguaugugaguauguguguguagugugugugugugagugugugugguaugaguuuguagugugugugugaauguguauaugcauauauguagcaugagugcauuuguguauguagugugaguguuuauguuuguaguguauguguggcugcacaugcacacacaugagugaguauguaguaugaguguguuugacuccuagguaacuggauacuauuguaggcucuaggcuaccaaucugugaccacagauguaacaguagccauauucagaaagcuaugacauucccuuuaaggagaaacaaagauuaaugauuucuaaggcugagaguauucaaagcaugaacuaacuauuccagggugauucucauccuagaaauguauauauucaaucuauagcccaggcuggccucaaacucauggucaacccuucagccucagcuuucaaaugcugggauugugugugagcccaguugucaggaauauuucaaggcuaguguuccaggugcuaaucuggacaacuuucugcaagcagaaucuaucuccuuccagcccugggucucaguguacccauuuccugggguuaagauaggaccuaucuggagccuugggcuaguccaagggaagagucuucugggaguggcuugggucuaugcaucagcaugguucucuccauaacuaccucuggauauuugggguaucaaacaaaaguauucaagaauuuucucagaauuaagacaggcgcucuaggggaccugacuucacgacguagaccaggauaaucuaaaccccacccaagugcuggggugaaagguauaugcuaccacaucucugguguuuaacauucccuacccauucuccaggcucuuagcaaauucuacuacgggcucugcugucagaguauaucaccuguggugacucuucuccgucaccauggucaccacgccagucccagccaccaucauaccaugucugcauuacuacaggagcagccuaagauguacuguuuguccauucagcagcccuaagcucuguccacacacgucacucucugugcaguguccuccacuguccuuuacuacgcuaucuucucaguggcucugggcccuugcccccaguucuuccaguugugcccucuaccacggucacauuggccuuuucccccuauucugggaacauggcaaaucccauccugcuuugcacuuuccuucccuuugagugaacuaacuguccaggcuuccauuuucaacucaacuguacccacuaaggaucccuucucucucagcuuuccguaacccauaccugccucccgccagcuccugggugagaaauggacuugcuuuuguuuucuagcaauccuucucgaauggcauacuccuuaaaaagacgggaccuuuguucacgcaccaacgguuucccagcucccagaacugugucuauuagauaaugcgugcuuaguaagugcuuguugaauuacccacgggcugaaccguaacugaggcggcgguccuacauaaugugcugcccugccuuugguugugucgcagcaucaucaccaucucugccagagucugcggauguuuccugugccaaggacuuugguugauaacaccugcccguccacacuucguuuagccuggaaaguccuagcggugaaaguccuagcagugaaaaugacuuuguucagacaccuggauucugauccuuucaggcccuaaagaaguugaaauuuuuagcagaggcuaucugagucuuaaacauuuuuggucuuuaacuuccaugcucagcaauucugcuauaagcgggcaccauucccagacgaagugaauaccccuggaacuguagaaucaagcauuacauuuuuguuggcgauucuuuucccauagcccacauauuucuuucgguccuaacuuugccauguaccgagacccugacuucggagaauccuuccucugccuguguucaugugucaccgcaacuguagggcgaugucuccaaacaaagaagcaaaaaaaaaaaaaaaaaaaaaaaaaauguucagcauugcugggugaacacauucaggucucgaggggaaaguccuuuauugcagaaacauuacauuccacagcacagugagcagcacuggauggagaccuggagagcaggcagcuacaacucccaacccccaacugaccugaacccaggcuuuccaaacucucuuacauuugacccacagaccagggguuuucuaacuuaccucucugcacauugcuacaccuuuagguggaguuggaagucccuuaguguaaccaaaagcacuuaaacagguggcauuucuccagcgucagucgguuuaaaacaagggugguaguuuuaggaacuauccuguuacauaguacuugggauauuucugucccauaaaugcagaucuggccacaacagcuaaaggaguacagcuucuguuaccccuuuuggacagagaaggaggucuuuaugcauuuuuuauacaggcugagggaacucaugggauuuuauucccuaacacccccacccccgaacacuagaagaucuuagugcacuggaacuaaauaccucccagucacucuuuaagucuccugucagcugagcccuggucugauuagcuaguacauguagaucuuccagcucuuuauuccuagcugcucugggggaacaaugcaaggcagaaguauuucaauaauaaaauguguguguuuucagcuauuuagucucaaaacauuaacaacagugugugugugugagugagugaguguguguguguguguguguguguguguguguguguguguguguguagguuggagagagagaaguggaguggcuggagagauggcucagaaguuaagagcacugaccgcucuuccagaggucuugaguucaauucccagcaaccacgugguggcucacaaccaucuguaaugggaucuaaugccuuccucuggugugucugaagacagugacaguguacucacauacauaaaauaaauaaauaaaaagaaaaaaggagagagagagagagagagagagagagagagagagagagaacccaagagaaucuaaccaaggaaacgaaaaugaaaagaaaaagguuugacaagauauaucuaccucauugucuggaaaagcuccaaauauauagcuuauuuagccccuuacuuacaugaucccuguugugagcuaagcuguucaaagucuaaacauaggaaauaacaaacauuuuuuuaaaaauacauuuucacuuccuuaugugggaaagaugggcgugugugcgauggcacgugugccaaggucagaagacaauuuguuggccaacuuucuccuuccccggugugggcucagggauuucacucgggacacuggucuuggcagcaagcuccuuugucugcugugcccacucacuggacccaaccaugaugcuggaauaccuggaccucggacauugaaagcagagccaaagugaggcuucugugccccauagcaccugcccgcugcaaaaaucuaggaauucauuacguucauaccuugcuccuagauaagcuccgucagugccuugcccauaugcucacauuaucuguggacgucaguuauauaucugugccugucuagagcauucaaagcuauauaaagucuuucugccccguucuccucacuccaacuccuccucugauucaguaaggucagaacuggacacucacuaucaagauauuuaguaugaauagcuacuuuagccacccagcagcuauaacuacuccuccggagccgguuccaguaagaaauauccaauuaucuucuuaugacuuguucaucaggcaagcccagaagccccaaaacaauacaaucucuugccacucgucaacuagcugauaagguccuaucacuaaagauaccacacuaaagagaaacuaaagugaccuaagauggaagcuuccuucaucagacuagcuuucagaguucaaagagcacucugcaggcggcuccaggccucgauggucuuaaccagcucugacuccuacaaagucucagugccaaccuguugcgcgcgcucaacaggccaggaagaacgacgcugcuacaggauccuucugcacacguuuauucaguccuguuucuucuuguuuauaucucccuuguucauaucuccccuguuuauaucuccccuguuuauaucucccuuguuuuuauaucucccuuguuuauaucucccuuguuuuuauaucuccccccuaauaguaauccucucucgaauaauaauccucccucuaacccgggccucucacucuuauauacucucaguucccauccacgcacagcaggccacgccaccucaccaggcacgcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuuaggacugccgccacaccugcuccuaacaauucccccuuuuuucuuuuuuggcagagagaaugucugucuguagauagcccccggcagccaugccccuuacccguccuugggugacaaacagcauugguuugaucccugucuuagguuggugacaugcccagagagucuuaucacugacuaccucucaauauaugccaagccacuccuggggagauuguguuuugcuugcggcaggugcaucaaaaggccaggauguuacuuaaccuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuccugggggaagggaacuaggacacugaaccuucaugcaaucagacgugccuuccacaggaugccaacagcaagcuauccucugugcagugcuuagccucgcaacccauggcauaaugcagcauaauuucuuuuagagcggcaaaccgaaucugaggagauugucccgccuccacugcagcaaaagccuacgcuaccauggcgaaagugcgggccgcacacucugcaccuaacacaugugccaaacacaaaaaacacacacacuauaacaagcauacaucccagggcucucauccccgcucaucuucccugaagcaagggauagauggccagcggggcuaucucuuuaaggggaauucagggaucaaaaagcguggaaaaauuugaaugucaugucgagcugguaucggcuucuggaauaccgaaaggaucucucaucucggcuccauccuuugugcuugugggaucauccaccacauccacaggggcaacuggaucaggagccucauucuugcagcgucucaccaaucucucuggcacccaaagagguuccaucugguccuguggaaacacaaacagacccucucgcccaagucaacaccugaucuggucgauccccaggggagauagacacaauaccucguuguaaugagaccauaaccucaaucaccuguguguccaucuggggagucaauaugagagucaaguuuucacuaacuuccccucuguuaggcaaugauuuccacgcccuuauaggaaucugauucaccugcucaaacaccugcacuggauauccugucuguuguugugcaaaucuaccuugaucaagcagcauaucucuaucccaugcaaauuuagcuugaucagugaaaauaggacaucccagcaaggagaaucuauccucuuuccagaccuccggacagaaggucugcccauagauggcugccgaggaggcauagggagggggagcaaaagcuaauucgccuuccuccucugccucagcucuuuuauuuuguccuuucuguccaccugauaacacugugucuccuuucuuuuuccuuuuucuuuuuaagcccuucucuuccgacauacuuucuuguugcucuauaaggauuuucugaccugucuugacugccucuacacacaguuucaaacaguaacagaguccauauaucagaacaaacaagaccaaaacuaucagaccuacccacaaagggucaacgggagaaaaaagcauaacuacacagcgaggaucuauugaucacuacaccgagguuaucauaguuccuuaacuugucccaaaaccaggaaccuuaacuugucccaaaaccgggaaccuaucguuacuuugugccugcuuccuggcaacuuuauauuccccucuauuuuauccgagguccuucccaaacuccuggggucgcaaauuucacucaccgugaacuuacccugccggcaaccacugacugcugaaaguucugaacucggugggggagucgguuccccguacgggccaccaauugucacgcccacucucgaccagcaagaacgacgcgaccaccaguccuucuaacagcaguuuauuccgucuucaucuuucuucuuucucuucaucaguaccguuccccagcugaagaguucugaauccacgccggauccuucucaacagucuguuuuacgggaacuuuuauuaaccacuccuuccccgugaugcaguucugaauccucccuguagcagggggucuucacucaugccugaagauguuucuuuucccggguuucggcaccacuucuugcgcgcgcucaacaggccaggaagaacgacgcugcuacaggauccuucugcacacguuuauucaguccuguuucuucuuguuuauaucucccuuguucauaucuccccuguuuauaucuccccuguuuauaucucccuuguuuuuauaucucccuuguuuauaucucccuuguuuuuauaucuccccccuaauaguaauccucucucgaauaauaauccucccucuaacccgggccucucacucuuauauacucucaguucccauccacgcacagcaggccacgccaccucaccaggcacgcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuuaggacugccgccacaccugcuccuaacaccaaccugccaggcaaaauguucccccucccccagccccgguuagccacagaagggaacucaugccugccacuguaauuccagucaaaacuccaugguugaggaggucuuaggcccuggauggugacuuaguauuguguggccagauuggcaugcucccaaacuguuuuagaaauaccuguuuauaaacguagacaaauacugcucucagcuuuagucagagggucauguuugcaugaauggagauucauggcuaccgugaauggaggugacagcagagauucauggcuacucuagguuccuagaauaaguggcagcugaguacucuguccucuggaagucucgggaacacugucacagaggagaccggaagaccguuggagcccaagguagggcuagaggcugcaagauacugucuucuggaugcgaugcagccaucccaaucaugaucucauagcagccgaguuagccuccacugggcuugcauaagacuaggucugucaguagucauccauggauggcggagggauuccuucccuuccugcuaaacggcuagcaauugguagacugggguggggugggggggacugcgggucgggguggggggaggaagggcauucauugucuucagugacccaugauccaaccaggcuccaguagacgauuccaaacucauggccacacagcucacccuggauaaacucagugggucauaaagcaaaauaaaaagacacgaauauacaaaggggacuuuugggaacugggaguguuaaugugggugggggaggggcggggggccguaggagauuggggugaggguaaagacaacgggaugcauuaugcucagguaugcaauugucagaaaggggaauuuaauacauuuauuuaaaaauauagaauuaagucaaaaguuaguaugaaaaauauguaagauuucuuaauaaugcuaguuacauguugaaaugguaacauuugggaaauacagcuuaaaguaaauuuuuagcuuuuauuuguuuuugcagugcccuccuuuggcuuuuuagaaaagugacuauguuaaauuaauagaagacuuugcaucugagacugguguucuguguuuguuguccagacaaccuucaguuauauugguugcuuuucuggugagcaaacauaccugacaaguuagaacauucuagcaacaaccucaggaggagaggcuugcuuuggcccacacuuucagaaagaguucaguccauccuagcaaggaaggcauggugaccagaguggccaagucccuggugcuggggacuugcuccuggagcuccucaucacagccacuaaccaagaagcagagacaggaagagcaaacagggauggucugaucuucaaaggccuucuucccuuagugaccuauuuccuagccagacccuaccuccuaaggaauggguccgcagccuucaaacagugccaacagccaaguucaaaauacuuaaaaggcuuaacucaugagccuggggugggaggacauuucagauuugaguuacaacaucacugagucaccauuaucagaccacaguguuucuguugcuugaaaccccacguguauguucaugccaaaccuaaaccacaagcugcucagacaugggcugugcuuuguucuucuuugagccuacaacagauggacauagugugauuugagggagaaagggugugugugugugucugucugucugucugucuguguuauuuuacuguuugauuauuugcccuguuucauuacugucuuugaaauggagucuacucauuucaaaucggacagcaguaaggauuguucaaagauggauuuagacccuugaccacccccauaggaacugguuuuauguagcucuuaauuuguucuugaaagauugauauuucucuaaaccuaccuauuaaaaacccgggaccugccagauccuuccaccuggcagaacagggaaaucagugguuaaaaauguguccuuguaagucacacauauucuuugucaccucagaaaucuugggguagucccaaacuugucaaagaccuguaccucacuuuuccaggcuuagagucugggcguaaguacagguaaaugaggaugugagcuccguggcuuccagucuaaagccagaguagagaucagggccaccaccagugugcaggaacugucagaaaccccuacuagauauauggcuaggguugccagcaucuggggaaauacuagaagaugcauccugggugggcccuacccucuaaccauccuacaauuuucuaacugugcuuguggcucagccagaugcucauaauauucaguuuguaucuauuaugccuagaguacaggcaugucugccggucuccugggggacucugaccuuucccuguacuuccuaaccacaggaucccagaaccacugcuuuuggguaagaacuguauaaaauauaccuccaagaaauguccccucuucugaagagauuuauuaagcccccugcugggaaugauuaacuacugaccacuuuauuaccaggaagcaguucguaggcaccaugacaauguauguaaugaccuuuuuagagaagcaaaggagauuucuaaugauaacaucuagaaggguaagcagccacuuugccccgauuucccagcauagguggucccaccccccaaucucccagcaucccaguagcagggccuuuaagaauccuaugacuguugaagcaggggcugcaaagaggcaguccaugcccugaguaguaaucucuuagguuccucacuguuucacgacucauaaaaaauuccauuuggguuuuuuaguaucuauucgucccauugaaauccaguucccagaucuguagcugaguuucuggggacccucagacauuaggcuagaguuccuacucuauaaaauaaccucccaucccccauagaccucaucaucaaugugauuguggucauaguuugugccugcuauaucugccuggggcuacaugaaagguacuuucauuugugucaguggauaagauuggcggcugaaagccacauccacagacacuuuccuguuugucuuguaucacugaccuucccagaauuacuggcuauguaauaaaacagaaauggagccugaggccucccuuccugccccgaggccucagaugcaaaagcagacagugcagagaacuuuguucuaacaacuuacuuguccuuccuugcugcugaagggaaccauugguucccacuuagcaucacugagaggugggauaggggacaggaggaaacuaggcagaacccaggagccuggaagaaggcaagcuggaggaguaccaccugccucaggcaguucucuggaagacuauuccugggacuccagguuccuccuggccagcgguuuccauggcaacacagugucugagcacuucuaauuacaucugucugcuucuccuagaacccuacugagcggcacacauauggagacuucauuuaguugggaguuucugaguuuuaacccauucagcacucuuagacuaggaaaaagaaaauguuugucaggauauugaaaucuugggcacagccccaaaagauuccccauuuuuagcucuguccccacuuuuagaccaggucuccuacuuccaucuuguucaucauaccugaccucccugucacccagcgcuagccccagcccaugcuauugacggaugagcucagucucaguuggccaucacaaucccauugacaguacccaaucccagggaaaacaacuccauagguccagcuaaguaagggcccuuccucccaauucucuucccaguaaauuccugcccauugccaggauagcacauaagccagaaggagugucaggagccaagccucaaacguucugccaggagccaggagacccaaauguucugccaaaagagaagggacaaagcaaagcaagucucauuucagguccgucucaggguguccauugcugugaagagacaccaugaccaaggcaacucuuauaaagacaauauuaaacuggggcuggcuuacaguuucauagguucaguccauuaacaucauggugggaagcacggcagcauccuggcagacauggugcuggaggggcugagaguucuacaucuugauccgaaggcguccaggaggacacaagaagaagggucucauccacacugggcagagcuugagcacuagaagccuuuaaagcccgcccccacagugacgcacuuccucccacaaggccacaccuauuacaacaaggucaagccuccuaauagugccacuucccauggaccaagcauauucacacacccacaaggucuaaguucgaggauaaugaaggggcaagguccauagaagaggucacaaaaaaacugugccaauaacaagccacuauuucucuugcuaugucucacuugccaaggccucugcuucacugauaacugugaccauggugucaggcuguuuuuacucagccggacuguauacccugcagccccaccugacuucugcaacauucuuucucucccuucuuauccguucagcauaucucacuuacagcauacauucaucauaggcaaaagacgcggcuaaaagcucuuucagccucccauugccucgaaagcugucugucagcuuaugugugcccauagagacgcacacugcaucucuugugugucucagacuauuccagauugguaaaacuucaggcugaauguugaugguguaguggagaggagugaggucuuugggcucuuuccacagaagaauccauccuuguguuagcucugggaaaggaguugauacugucaccaaaccuugcugccccaacccagggugaugugacucaagucugcuucuuuacucuuuuaguuaagguugaucgggugacaugggugauauacuagggucuacaaaaggacccuaaaacuuaaccuuuguccccuagaaagcucagcuggaaagaaaggaauauauacaaucaacuaauauguuuuuaaauggguucauacaaaggagaauugcaagucagacaaggaaagaggaauucucacuaaucaaaaagaaaagcucacugagggugaagccugagcuaaauguugaaggacaagaaggacuuggacaagcagacaguaaagcagaccucccacauggugaggguguuuuuuaaagcuggucucaugggccauucucugcccaucugaagguuaaagaagcauccagcaguaucuuauagcacugacacuuacaaagggcaacacucucauuucagcaugaaauaccucaggagcuuaguacuuuagucuaccuuauaccuuuaaucugcccuggccauucacucuacucacaggucccucacccuacucucuacagucaagaaggaagucuugaaggaagagcauccugggcagugaggccaaggauggcaaggccucauuaaacagugaugucacauaagagagaggaaaagaucauauaugcugugcacuuguuaaugugucuaaguacgugcugauagauaaaagucaggcagccaacccaugaaagguccaauggaaaccaaucugcaggacaauggcuucucuucagaauaggcaacuguggugguuugaauaagaauagcucccauaaauucauaaguuugaauguuuagucaugaaggagugacacuauuugaaaggauuagaaggauuaaaagguguggccuugucagaaggagugugucacugagggugggcuuugaaguuucaaaagccuaugcuaaacccagagucacucuaccugcuugcaaaccaugugugccugccaccaugucccugccaugaugauuguggacuaaaccucugaaagugugagugaacccccaauuauauguuuucuuucauaagaguugcauuggucauggugucucagugacauagugacuaaaacagggagccaugugcaaauugggauaauggaauuaagcugcagguaggugugaggaguagaauaagcuacucccuaaacaaggaagccacugugguucuuuugccacagccaauuccuucccugggaagcauguauugccagcaacacccagauagugcuugacuugacuaacggggagcaagauggcucuugguuuuauccaucucuuaacuuccucccaccaaaucagagcaaugaacucugcauuccacugagauuucugaagaaugaaugcuaauugguuccuggcugggaaagccuggggagauggagagucagcuugcuugggauggaggacagagagcaagcagggauguuccugcagauguggcugucccugcaggggaugcuucuaaaacuggcugucugggaccacucagccagcugcccuggaguguucaccagucagaauugagagaauugggaauuuaggugugggggaaguuacaaaaaaagaagaagaaagcaaaugagacccucagucaaccauuuuucuugaacuacauguggaaauaauuggagcaugaaugcagagugaaugugaguccuggcagcacaggacauaccucagugacagguuccuggcagaaaaggagacugaaucuccagugaauuuccguuagccauuuuuucccuuucuuccccccuccccuuuuuucauacaaggcaaauguaggcagaauuaaaacuacauuagcagcauacgagugggguagaaaguuccagcaggcuccucaccagugaagucagcccacuuggguauccauuguuguuuccucuagaucuguaguucucaaccuaccuaaggccauggcccuuuaauacaguucccccuguugugcugacccccaaucauaaaauaauuuuauugcuacuuuauaacuguaauuuuucuauuguuaugaauuauaauguaaauauaugguaugcaggauggucuuuugugaccucugugaaagggcccuucaaccccaaagggguagcagcccacggguugagaagugcuacuccagagugaccccggagaaaaugggaaagcauugcuugcuuaugaaguccuuagucuaugggaaucuacuccaaugcuuccaacaauauccuugaaauuccauccagauggcaagugcaccggaugggcauggugggccugccugucaucccaguacccugggggaugagacaagagaaguccugauaguucaauaucagcccugagcuacacacacuguauuugaggcaaaucgaggcuacauagugagacccucaucucaaaaagucuauaaagacucauucucuacauuucuuccuagggagauaaacacuugguauucaggaucgcauaaaguaauaaauccuuuagcuauuuaauggaauucaaacaguccaagggaacugagcaucguguacagccgccguauauuggaaguugguaaacgaaggcucggagagaugaagcuuuuucccccgagucacacuguauaggcggcaggcacauaucuagggucccuccccuagguccagccugccucuuggugccugauucagcacugaaaugcucucgccgccucaccccagcgucuacccagucaccguucacucaucuuccauucuucagagccuccuucccaggauccugaaucuuccucugcuacucucuuggcagcuuuaccuuuagagcccucgcacgcugagcaagcugcugacuacagagaaaggagagagccuguaacccuaccugcauugugcuugccaagcccuguacaccagucugcuacugcaucugccuggagagaagguguccuuucugcucgcagagaccccuggugggcuggugggcacacgcugugcuuguucuuggguucuguuuccgauuuucccgccccuccacagcugcccucagccuucccccccccccacccuuucuccugaguccaaaggcucuucuucccccaccucucacuccuacaagaugacauccagaugugcaucuccuucccuauuuccagcugccaguggggauguucuacugccugcuuagacuaguguccauaccugacucugccuaccuugugucccccuacccucuugccaaggcugggucucugacagagaccuuccuccaccugauggucccucaagacuaaaggccuccauggcuccuuccuuccccaacacccaguauauuggcagaccuccauauucuuuagaaaguuuuaaauguccuuuaauuaugucucuacccuccucccaugaguggucucagcauguucccaguccuuucuuuguuucuccguguaucuacagggcuuauggguagacccugccauacugcaggggguacaacaagccccccuuuggcaggauuacaggugucaacaugccugucucagcacccagcuauguuagaaaccucuuaaagauggaggccaugcccucaguuccuuuuaaacuuaugcuauauuccucgugccguguaggucacagauuguuaucuucauugguuuuuuguuuguucauuugcuugcuugcuuguuuugaggcagugucauuuuacuuccuaggcgaguauggagccccuagacucaggugaucuuccuuauucagagcuggagguacaggugugcucaccaccauagacagcuagauccucaugauauagcccuggcuggcagaacucucugugcagcccuggcuggccuagaacucacauugaucugccugccucuuccucccaagugcugggauugcaggcaugugcugucaucauucuuuagucaauauggcauuuaucagaucuaagcuuaaauacauugaagucacuuccuuuccuuauuugaagaagccuggagaacuauuuauaugcccuacauuggcuacuaaaguguacaaaccuuaggcugaaagaauggagaaugaaucucuuguacggaucuacuaggcuaauuucgaauagauaaauguucugggcuaggaaguuucaucagguagucuaagcuuugacugguauacaaaaaaaauauguauuugagacaaaaaucaaaaaacaaaaguacacagaaaauucuuguuuguuuuuuuuaauucauauacaaccaaauggacuaacauuucuguucccucuaaguaauagauacuauugugugccugcccugagaagauuuaagguucccucuuuuuuuuuuuuuuucaaauuaaaaccauccauuacaguuuaguucacaaaauaccauacauagucugcagaaacuucucaucuuguauaacugaaacuuugaauucccaaauggcauuuaaugugaaaacuguucucuaagagugggucugugggaagccaaaguaugcaagccacuugcuugagauaagccauaugugugcaggcuauucugcagggcucuaacggacaggcugacaaaaggcccaaagccauuguuagaaagcucuguuuaagacggaaacaaugaagcaaauggcaagugggagcgaccuggaugguaauuaagcaucuguuuccuugcuuuugcuugccauucccagccagaacccugggcuccaguuugcauucacuuuugcaaguucuuauagagccccgccccaaacauucaagcuuuaggccucccgaaauccacacguggcccuggucucuuaaacuugagguaaggccuuggcugggaacacacacaggcaaaggacucuuaagugugggguuggcacaaaugcuucguguacugccaggcaaaucaggccaacugcuguagagcggcucucccccuucuuuuucccguccauugauggcuugcacauuccauuucaaagcugaagugcagagacugcauggggucaugugacagaugcuccagcuagauuuuagcagcuggaagagguuucguuuucuccucuaaacucuccagcuuuuuuaugaacuuguacuccgggagagcaucugagagguccugauagucucgugaaguuucuguggcuaauucugacgaagcaaggagacccuuucucgugucaacaaaguugcucuacuacagagcuguggcaaauggggcugcauauccaccuuggcauaagcaggacagagugagaggaggaauggagugggaugggggcaagaacagagaccaugcugcugacccaguuccaacuggcaaaacagugaggcugcacuaagccaacaugaacagcuuugcuuaagaacguccguccuugccagaacccauguuuugcagaaacaguuuuaccucaacaggcuuuuuagaaaccuuucaauguauauuuugggcuguucaacccagagacucgggcacaggaucgccucuacugguuuuuuggguuuuuuuccaaauaacuuucuuuuuuauuugcaugcaaaauaauaauaauaauaauaauaauaauaauaauaauaauaauaauaauaauaauuaccugucuguaaaaccuugggcugaagaugaucuguuccuugguuuguagagagauagaaugguuuauuggaacuagacugaauuugacagcuggaggcuagggccaggguacaaugaaugucaucuuggggcaaucauuauguuaggaucucagaucuggaagggcuuaaugucaagcuccuuugagagagagagagagagagagagagagagagagagagagagagagagagagagaacaagaaaaauagcccaccaagauugccaagcagugcuuaaaagcauuugguguccuuccagaggaccagaguucgguucccagaacccacaugugcuggcucaugaccaccuguaacucaagcuccaggagacccaguacccucuucuggcauccuugggcacccacagguuauccucauacagaugcacacaccacacacacauacacacacacacacaucaauuuuuaaaauaaguuuaauugauuuaaaaauugcuaugcaaucacacagcaucguuaacaugcaagagcugaaaguugucaacugguaaaaggcauucauuggcccagaagaauuuguagugugaaauuagccaugagacuaacucuucaaagucuagcuugucauaugcauucagaagacaacauggagacaagucaaagguggaagauccuagcuacaaguuccuaaugcuuuucuauuggaggcuauguuaguuuaugucgacuugacacaagcuggagaggagggaaccucauuugagaaaaugucuccagaagaucaggcugucagcaaauuugcuuaauuagugguugaugggggaggccccagcccacuguggguggugccaucccugggcuggugguucuggguucuguaagaaagcaggcugagcaagccaugaggaacaggccaauaagcagcacuccuccaugaccucugccucagcuccugccuucagguuccugcccugcuugaguuccuggccugaccuuugaugaugaacagagauguagaaguggaagucaaaugaacccuuuccucuccaaguugcauuuggucaugguguuacaucacagcaauaguaacccuaacuaaaacagcagcagaaagcuuguugaguuucuauuuauuuauuuauuuauuuauuacuuguuuauuuauuuauuuauuuauuuauuuauuuuaauuguugaugcuugggggauuuuugcuuuguuuuguaguuuuggguuuguuuguuguuguuguuguuuuagacaguaaucuuguuauguagcccacaacagccuaacucaauaucuucaugccucagucucucacgggccaccauacaaguguuuuguuggcuuuuaaagcuacaucuagguauucaugcuucaagaacauagccgcagccgggcaugguggcacaugccuuuuaaucccagcacucgggaggcagaggcaggcggauuucugaguucaaggccagccuggucuacaaagugaguuccaggacagccagggcuauacagagaaacccugucucaaaaaaccaaaaccaaaccaaaccaaaacaaaacaaaaagaacauagccccuauuaauacuucauccaucgugaguacauucaggucuaugugucuguucacacauuuguaagaauggacaugccugagaccuuguauggagacugugcacaggccaaugugguuaucuuucccaaaagucauuaugacugaugacaguguaaacaguguaaauagugaaagagcugcacgccaucccugugccaggccgugcagcuggccccucugccugcagcacccucucuuggcuuuacuugagaagggacuguggagacucagggacuaggucaacuugugucccuuucgugacuugccugucgcuggugcuuccacggagcuuuucugagucccaaauacuccucauuuguuacaugcaacugaaaaugccaacaccugaacaggaauggugagcacagaugucugcagaggcgcgcacuguugugggugcugaguuagcaucaguaugucagcccguggccuaaggccuuugcaaccccugacuagguuacuaccuuagacuuucuggccagaaccagccacuccacagaagcccacuuaugacucuaaggaacuuuccaacagccuuaaggaauggcuccaauacuuuggcuucucaaagauguugggguuuaauggacagcuuugaauggcacaaagaaaugcuucccuagaggaagugcccuucauuuuugaccuugacgucuguaaucaagcauacucacugugaggaggugacggaauggcuuugagcaccacagaauagacagccuucccacacuggcagauccuucugccugugucccuggcgggucuacccuccucucccucacgccuguauuucucacugaaaggacagagcggggcugcagcagccaggaaggcucuucugcaaugcggcucagggcugugugagacaaagagagagauugccaccuauugacagauauaucaccugcaaagagaccgcuuauauaaccagagccuccuccaucucugcuguaugaaaggcccuccagggguugcugggcccuuugcauuuugcauccugucaguucggcacuggcguaccuuuccacugucaaugagacagggaagaauggggacaugacaguccaaggugacagugacaucauuucgcaggggaaacugaaaauaaaucacccccuguagugacagucgcuuccuguuacacagcacauggcgcggcucaguuaauucucaagacaauucuaaccuucaauguuuuaugucugcacccaaggaaggggguugcaagagaauacucguggcagauaaagaagggggcuggguaugagugcugcauaugggaucuaaacgccuuacacuugcuauuguaacauccauauucccauuauaguuucccuaaccuuaaugcauacggauguaagaaucaaccaaacauaaaggaaucauuugccuuugguuggaggaacauccaacucuaucgcuuuuuguuacugggccucucaagucagcuuuccuaccuguaaaagagggauaauaugacucuggaauuaggaacauauagagcgcuuaaguagcaccaaccauaguaggucacuuugagggaagccagguguuuacaaauggauucuuaguuacccgugggcugaauagagguuucucucucucucucucucucucucucucucucuuuuuaguuuggggaacuuaggcaaauuauuugaccuuuuggggccucaaauugcucguuuguaaaauggagcuaauaaucauaugcaugcucuucucagguuagccaugcaguaaggugaaaugcugugugugaaaacauucacguuuuuaauugcacucuucaaguacuaguuguuagggugaaagaaaaagguguucuccuccaaacauaacgucagugagcuaccugugcaaaugacuuggguugaauucagauuccacauaauaguguuuauuaggaauauuuaccacaguaggagagaagaggggguagcucauuggguaaaaacacuuguagccaggccagagggccagaggucaaucucuggaacucacccgauggaaagagaaccccccccacacacacacacacacccaaaaagccauccucugaccuccacaaacuugcccugacuggugugccccucccacacaccaauaacuaaacaauaaacaugcacaugagacaagaugaggcucugaacucggcaggaucuucugcaagcagcccuguaagguguccccuugaucaugcucgcccccucccccacccaccauuuucuccugccccacagacgaggagauguguaguuuaaaggaucagagggacuaguuaaguacacacugggaacauuugaguuuuuccuugaaugcagacauaugccaaagcucacugauuugugcauuuguguaucuucagcuccugugauaggcccagggguuaaaguguucagcucagggaaguugaagaggccacuggaauugucuuuuauaacaaucagcacugucuuuuucuauucccuucuggcucugcuuuuugcucggagacacagcucccacaagagggagagcccugucugucugaagaguuugcucaauuuuauucccccucucuguuuaggaaacaaagaucuaaauccauccuccacccuucugggaauuacuuccucuuuucuucacugucugccagcuuuuuugaauucuccuuagcaacauuuuaaaaaaaaaaauuaguuuagcaacagcauuuaagccaaugagaucugagcaugcaaaugaguucuagaccaaugagagcucugcauggcaggcaagggggcuuaugggagacaagaauaaccuggaguuugcagagcagccuccaaguggcagcagagcagcuauuauggacccaucaccucucaagccucuacuuuguuuccgugugugugugugugugugugugugugugugugugugugugugugugugugugugugugucugguucccccguuuaaaacauuuacuguuacaguaagccuuguagguaugaguucuuuagauacacuguaggcaagggcuggaaauguggacuuugcuguuacccaagucauucguaggccucuucugucuuuguuguuuuguaaccagcuccagcccagucgucuaaggccuggaagccuugggugauucagccagcccagccuggcggaacagaggccccgggggaaucccugucuuuguuuauccaccacuaccacagagcuggggggugaaugucgugggaguaaaggaauguaccaccaacaaacugguccuaucacaauccacauguggcauacagaccuuccucucccugcaguucuguaacaucugucugaacaggaaaccugaccagcaagaagcuugggggccauacucuuuuuggaguggguuugguccucuucaucuuguagccuggguacacacagagaguggcuggauaucauagcauauccacauggugaccauccuucgguccuuucagaugguauugcaguaaauaccuugguguuaagaugucuggaugugucuccaguguuuccauuucuuccuagcuuagacuucucauccuuaaagagacaguuaagguguggaaucuucagaaagggccaucugauucucccauacaccccugcuccccagagcacccacuguggcccuuccguauauguguuccucccugagagucacagaguucaugagaucaaagauugcccuguguagcucuagcccuuagcauagugcuggcuuuaucacaaaugcucaaaccguauuuuuuuuuaaugaggaaggaugcaagaaagucacucuucacaggggaacaaucuucagugccuguaccugagccagaacaaugccugugagucugaugcuaaaagauaacuuuuggcacacggaagccccaagccugaaaggucauuaccaccaauguuucauccugugaugggcucaucucaguaacguggcauccuuuaugaucuguguuuuaggaggaaccuagaagcaaauccaagaucugcgccaauguguuuuguggagcuggcagggaaugugccgucacagagaagggggagcccacgugccucugcauugaggugaguccuggugucaggcauggggggugcugacuguuuaggggguccuugagaacuugcucaguaggagaugcgcuugcugccaucacagccucaggaccuacacagaugacuggcauggcagcaggaggcacugaccgcagugcugggcgagaggaggcaaauccauggaguucacugacuaaccauuccagccaaaucaugagcuccaggcauagugauaacucuaucucagaaaguuauacugaaaacaaccaaggacaacacaauauggaucuuuggccucaauacauacaugaacaccaaaaaagaaagaaaaagaaaaaaaaagaaaaaaaaaugauguuaacaagaaaauagaaccagucugguuguccaucagcauaugaacagaugauggaaaugugggacauauagacaaugaauaauuauucagggcuggagagauggcucagugauuaagagcacugacagcucuuccagagguccugaguucaaagagguccuaggggcucacuacuaucuguaaugggauccaaugcccucuacuggugugacaguacgcucacauacauaaaauaauaguuuuuaaaaugauauaaaaagaaauauuauuuaucuuuaaagaaaaaugaaauguguaggaaaauagauggaccuagaagguguacuauuaagugagaugauucaggcucaggaagaaaaacaaaacgcauguucuccuucccauguggauccuagaccacacauauaacacagagagguguacaggaggguacaguugagguugagagaggaaggggugcuacgaugcagucaucggugagguaggauggacagagggacgcaugagucaugaaaggauguacaucaauauuuugucuaguuucuagucugucauaguuucuaccuuuugaauuuuggguuuauuuguuuuugugcugcaucugaaggagcaagaauuguguaguuuuccauacgaauccaacguguguccauccuuugagauagugguugugauaguugaacaaucuuuguaauuccacugacugcugguguaacaagaggucacauggcuagucacaaguauauucgucacauugacccacuuugaaaaagugaccuaaaaaaaauguucugaggggagacucuguaagaguaaaugguuccuuuuuuccuucaacuuaaaacucuaugaagucacuccauugcaguguuacuuaauauguaaacuguauugcaauacaugaaauuagguaugguauuacauuuuaaacuuuucuuuaaauuaaaaaguuacuaauuguuuguguguuaaauagcauagguauuuagacauuuguacuaauggcgcucaguucucauuagucuuagguaacuggcacuaacaacuuuucuaaacacuagacuuuccccuaucuauuuuauacaaaauaacauuuccacacauaggucugugcaauuuacuuugcagccuuuggugggccauggaagccacccauaucagcauagauuuuuuuuuagcucauuuuaaaacaacuguguaauauuuagaaauguaaauuuauucauucauuuccuaagagauggauauuuaaguaguucucugggguuguuuaccacaacaauaguaucauuuuacaaauacccuuuauuuuuuagaauugauggccacugggcaccuucugggucaaaggguaugcagauuuuuaaauuaucagacagagugucagcuuugaguuuuguuuuuaaauggcauuugaaaggcaaaauaagccuugagaaguaagcaagacuuuaauaaaucuucauucuuaauaugaaugugaauacaauggccaugggcuuuucucuucucccuucuaucaagcugcccuguauccuggaaauggguuagacccuaacuuauugcauuuaagggaaaauguaccaacuugaaaccuaaaaccugauccuguuaggaucccuucacgcuggaggucugcauuagaaguauguaugcuaccauaugguaacauuaauuagacuaaaaaucugacuucuaggcucagcuuguccaugguaauugugugauucuaagcaaauucccaggaguugcuguaauacccauguugguuuugccuaguauggaaaacuuggugagcaacaguaguaaaugccaguucggugaauaagugcaguccaccuuucuuaccuugaaagggucggagucacuuccuggcucagaacucugcuucuuuuuauagcuguuuuuguuuuguuuuguuuuuuuccccuucauaccucaaguaacucuagugugccuacaagccgaaugaacuuuauuccguauuucuguccauuaugauuuccugcagucuuucacccucucugucagccuuacaacacugguugugaaaucaggacaaaagcugaauagcucccaaauacuacagagaagaagagaaagaaguccuuguaacagagacagagacagagacagagacagagacagagacagagacagagacagaauuuccauuguggaaugccugagcuaggaacuuuucuaaaucauagacuuguauacuucucgcaguuuuggaggcugugaggugcaaaaucaaagcaaauucauuuauugucuggugagggccuggucucuucuugccagugaacauuugaacacuguauucucacaaggaaaggauagcaggccaaaggcacaaaugcucugaaaucccuucuguaaaggccugaauucuguucaugaggaaggagcccugguaacuucauccccuccugaaagcacagccucuucaugccauugcagggaggauucauguaguacaacuauuauagcaacagcgggguguuuguguacucacacuggacuaggauagacagagggacauggagaacuugggguaaugagugucugcugcaucaaacauaguagagucacugauaaccagaacuggguucccugggcucugacagcauacaggcuccaucucugauggugguuugucagguggucaccugacaagauggcagcaugagugcauauggccuccauggcuacacaaacacccuccugcuggucuguuucagcaaugcaaaccucacaagaggccuguguguggcaguaauggcaagaccuaccucaaccacugugaacuucauagagaugccugccucacuggauccaagauccagguugauuaugaugggcacugcaaagguaaggcauaugucaucacugaauggugggucuuaugauggggagacagagacagaaaccagagcaguguggccuggcuccauuuuaccaaguccacgacuacccagagcuugagagugccgggggcugggggaucgggguggggggggggcagcccuggugggucuucuuucuuuuucuugguucuucuucaggcagcagaaggggaagagugccagcaggguuaagacuuaaaagucuuaaaagaaauuuaggguugcuguauaaucauaaaauguuuuccuaucucacuucuaagucacuuugcuucccuagcugaccugccuucugaguuccucugaggcagaggggaaaaaaaaccauuuagcaccucauccuaaaacagcaggagauuaagugaagcagccuuuguucuauuaaacagggaauuuuuauaugcauacccauuagguguaacuaucuggcuaaacauuuaucacuugccaaagcuccacagguucauggagaguuuaaaaacauaacuaaguuauuagugaaguuuugcauacauaaacccagucaauguuuuaucuucugucccaacaccuauaauaaauuguuaguuccuuuuuuacgaccuuugguuaaugguuuuaccauuugggacugugcucugaauaguuguaugccugcuuacuaucucagaagcaauuaacucaugacacuaaagacugguagaguucucguugcaguguugacuaucacaaaagaccaaauagcagucccacuauaaaagagcuuaauaaauacugauauaauucuaggaauucuuauaggaucaucaugaagaauuaagaaaucaucuauuuguuuauauagcaccccuguauagacaaauagaugauguuguucugcagagaucugcucaaaagggugggcuaaucccuagugacaguuauauauauuugauaauauuaggaaaagcauauuaauaacagaaaucuuuccuaaaauggauauuuccuaggucuuaccuaucagagcaaaucugucauaaauuuuuaaucuaaggcaaauccaucucaggaagacuaccugcuaguuauuagcuuguccggugucagcuccuggcaggggagaccuccucucuuguuggagaugcucccuccucacauucaggagccugcuagguuugaacuggauggcuggggccuuuguccuguuuccugcaucagaccuggaucugcuuucgguaguaucugcagcuguagaguagguaagcuaacugcaucaguaguccacaauggcaaaaauguccuuaaaggacuuccauacauuuuagaaaaaaaaaaaaauggucaauuucucccuacccugcuuuagggcauuucucaaccuagcaauauuuuauuuuccuuuauuuuacacucuuaacauuuuccaggguuggaaaaauggauuuccaagcaugauugguaauuagccaccagaccuuuccaaguuuagagccugcccagacaguccauucuugacuuccuggaaaaacacaaagcuuugucccagauaccaaucuccucuccaaccucugugcagaauuaaucuccaugugaaauuucaaaaccccaggaacugcucaacccagcaggaaggaauauaaaucuagaaggucaaucccuuguccacaggcagacauccuuagaugcuacaagaaagaaaagcucaaaauuuuaaggcagagaaauggagagauggcucagugguuaagagugcugacuacucuuucacaggaccugaguucaguuuccagcauccacacagaagcuggcaaccaucucuaacuccaguucuaggggaugugaugcccucuucugaccuucaagcaccaaacaugcacacagacauacaugccauacgggcacacagacauacaugccauacgggcacacagacauacaugcaggcaaaaccccauacacauaaaauaaaaauaaaugacuugaaaggaaggaagaaagagggggaggggaaggacuuaagguaaaauuaugacaagguugcaagacuuggcaguuuuaauucuagaaacagacauuuucuuuuauucuucucuuugcuuuacacaucucuuuucguuuuuuugcagaaaagaagucugcgaguccaucugccagcccagguaagugccuguccuuucugcagugugugugcaucuuaggguggagacuuuucauggaggaaguauuuugucuucuacaaauuccaggaagcaagcaucuugucuucuacagguucuauugagcugccaaggucaucugugggucaggacuuuggauccacaucuggugugagcacagcacagcucaguaaaaucaugaaacugcauuuuuaagauguuccuuuguuuuggaguaaacuggucaaaggaacuguuugagucugaauguuagcugugcuacauuuuugcugacuagugaccucacuguagggacaaccagugagcccucccuucagggccuuguaagacaugcucauaucguggacccauugaaaucagaagacacagcucuuuuugaaagaggauaguugggaaugccaguauggagacuaccagagcucucuauuaaaaauauauuaaaaucucaacaugguuucuagucccagaccucacaguaaccuugugggucucacuggaauuaccuuaagguguagaggcucuuccccuaaaucacauagcuaggaaaggcagagucgggaaggcacauauauuuguuccccggcccuguacccucuucacagccuagcauuugcugucuuccaggaguuuccuuuggccagagcugucucuacccugccucuauucccacuugauucccaccugcugcuuccacauggcuugcaacagcacccacagcagggcugaggcuuggcccuuccuuggccugguuuucuguuguuuauaaugaagggugaugggagaaaguuuugaaaggcucagucggugagcugggagaagagcagcaauccagcaacaugaacaacuguaauguuuucauuuauugauaagucaauaccuucugcucaucucagaaccaagagaguuuccuuaguaaugacugauuuucucccuuguucccuaacauucaugaaaauauccuuuauuucuuuuccuuauuuuuuuuccuuaaaugacaacuccucuguuucaaguuucuaaguuucuaguccaguggucuucaaucuuucuauuacugagacuauuuaacacaguuucucaugcugcggugacccucaaccguaacauuauuuuuguugcuacuucauaacuguaacuuugcuacuguuaugaaucguaauguaaguaccugcuaugcaaccuagucuuuauauauguuuuacccgggggagcaucacuccugggguagacacauuucuguacucuggugcaauagcccugccucccuggaugcuuuaaagacugaacaggguggcacaugcagaacugaauggcacgaggcucugugcagggggugcugaugaccccaggguucaccuccuccuacucgccucacauuccucuccucccugcaguugucugcuaucaagcuaaccgcgaugagcuccgacggcgccucauccaguggcuggaagcugagaucauuccagauggcugguucucuaaaggcaguaacuacagugagauccuagacaaguacuuuaagguaagcagagcugaagccaaccguguucaguaccaagggaaaggagggcgccaucuucuccuugcaugacucccagaagacacagggcuccuuagagucccugaguguguccucuccaccaguuauguuacagagcugugaaaggugcccugugaccuguuugaccaguggguuggcagcaguugaccuuuaggauccaacaugaauguguucuucuuucccuuaaaaccaccaacauaucaaggagcuaccgugggaaauguggucaggcgcucuccugcccaguguaacacuucaaaugcugguacagagcaccuuuugcuauaccagacccacuucauccuuccugcccagcuugccauuucuccacaucacuaacuuggccauuuguagcuucuucaucugagaagaagccaggaauacgugggacuagagauauuccaaauccucaccauguggcugucuaccauauuaccaugucuaccguagaagaggcaguuccacuggaggcccagacagauacugauuuugaaggaggaagagugaggaacuuauguuugguagggguuaagugcaccaaccauuggaagaaacaguuaaaggcacucugcuaguuaguugacaagaacacaaacacacaccuacaguauuuccaacacagagacacucccuguacucagccacacauucaaguacugcaugcacacagaagcaccaagccccugcauuuuccagauguacauaaugaggucaguguuucagguacccacuccagugccugugcacaaagccugcugucccaaccacuagccagccagaauuuagaguagcuccacacauccaggggacuuggaaguucuugugcuccccucccccaaguauguuucauuccagccuagucuauggguuccuuagcuggcauuauggauacccacagauaaagagaugcugguuuggauugaaauaaauauuugaucauuuaaggcaaugguucucaaccuuccuaaugcacgacccuuuaauucaguuucuuguguuguagugaccccaaccauaaaauuauuuucauuccuacuucagagcuauaauuuugcuacuguuaugaauugucauguaaauuucuauauuuacuggaggucuuaggcagcccccaaaggggucauaacccauagauugaaaacgacugauuuaaggcaucuccuauauuauuggauagacauuuuuuucuacugugacacagauuuaaacucuggauuccuaguuuuugauauuacacuggagagaaagcauagcucuucccacucucugcgugcagucucuuggccauugccaaagcacugaagacauuggcaggucuacagaaaaccgcaucacuucacugagcacgggagucagauggggguagaagcaauguaaugaagauaacuuggggcuggucggcugccaagucuaaugaccugcacucaguucucaggagccacauggugaaaaaggaaaaccaacucuuacaaauuguccuuugaccgucacauacauguuauaucaugacacccucacucacacauacacacauaugcauacauacauauaaacauaaacaauaaauaaauguaauuuuauuuuuuuaaagaaaauuauuuuuccugaagccaaaugaguaauaucugcauagcuuauuguaaguagucacucuauccuguccuuacaacaugaagcuguugggcacaugacacuauuuccaaggggccacaugggaucugauaaccauuuguagaugacaccuuggccucaggcacuucugauaccugcuauuaaaucugauugccaaguacccgggccucagggccacccaauacaucuccauguccccaagcagaaacacucuuggaggcuccuagcagcaucucagcauggccgcuugggaaagcagcuuuucucuggaguacuguacugagaaagcgugcucacagcuuacagacacaagcuccucuuucaagacaucugagggagaugccauccugccagguccacagcugccuguaggugagagagagaauaucucagagccuaguucuucaucccagcuggcuuuccucacaccagauaguugaauagcaaaucuaaucaauaugugaguaaggcccaaacugccuuucuccugcagacaccauuucuuugaugaacacagaacagaaucaaaagggaaagccuuacauccccaugcuauucacacccuguggcacuagaugggagacucucggagccuggcacugaaacuggagccagccuuccuaccucccgaccccuaacaccauacaccccaucgccucagcugcuucgugugggugggugccgggcucaacccaccucuucugaacacuaaaugaacauacgaggauggcucucaagcaugggucucaaaauacucaucuuccuuccuuucuauagucacagaaccaaaaacggaaauguuacugucucagaaauagagcuacagauaugggcaugcaaacguaucgggucuuugcaucugguuaguugagugaauucugcuggauucuggccaggcacugaaaugccucgcaguuuaaugcuauuucuaggcagguaucagauuuaugagaugaggcugccaagagcugggauggccccuuaguucuaggccugcgcucugcuucccugauaguugaagggugugcacaaagcacuggcuuuuaagagccugcuauacuguaaguaccagguccagagcacccaguccauggcugugcggccacuggugaaguucuagguccagauagcccagccaacagcuacgaagccacugcagggccauugcuuucucuucacucacucuuguccccagacagaugacaggguuuguucuagcuguccucgggaaaguucucugguccucugaauguucccggaucacgcugguugaauugcacauccuuaauuaaucaaaaccccacaagugaauucuugugagauuuccucagggcaagcauacagugagugcauaaagcacaccugagacguggcccugagaauccggacaagagugagaagcagguucuaagcaaaggcuuaauggguguuucauggauuccccucacuauauacgccauggaaauuuuacaacacgugacccguggcagccaugagaggagaaaaaaaaauggcuauguuuugcccuuaccuucuuccagacucucuuccaugguauaaggaaccaacuugaaagcaacauggaaaugcugaucauuauccagcacagccuucagaaagcguggggaaggaagggguacugcuggaccuaguuagaaauuugaucuaaaccuucggauugaugcuuccucuuguugcuaggacguaggcaucuugaaaaguugccaauggcugcugucuugguuuagcaucuugcuuuagagggauuaaugcuugaccucaccacucccuguucaguuguguucuugggguaucgacaggucaucugccugcacaguauggccugagauccuguacacacaucugcacuggggccccagcguaggguauaggggcaaggaggcuggucuuaaaauagaaagauagacuucugugaguccccugggcuucaccuccuagauucuaaguuacugcuuauaaugccauaccuugcuauguguucauaagggugugagacagugacuuuaccaaucgucugaagccgggucuauaggacagugucagggacugggucagacaucuguucaggcugcccuccugagcaggauccauacugaaagaaccccucucccauggccucuguccaggcacuuacacuugcucaucuuggggguuccuagugaucugagccauuacuacugugggcuaggauagcguuggaguguguuaagaguaagaugaacugaggggucaggccagagggugcaccaauaaaacuguggcugucuaagcacugcugagaggccucgucaucucucucuagagcuuugauaauggcgacucucaccuggacuccagugaauuccugaaauucguggagcagaaugaaacagccaucaacaucaccacuuaugcagaucaggagaacaacaaacugcucaggugaggagugggugauugggccuacggucuccagggaagauugccugagaagggggugggauuugaaccccuucuaccaacagugguacugccagggccaaugugaaagaaacagaaaagugagguuucugucccaaucuauucugugaacauuacaaaaauggaauaucgagccacauugauaucugaucaagcaguuacuguuuggggucagaacucgcaaggauaaaagaauguaauuucagaauaaauuaucaaggucaugucauaccuacauugcuucuggguguucuguuguugaccuucugaaggaacugcuaauguguucucuaguuguucugcuccugguguuuacgacgauccaagcuguuccauguagauuucccuaauuguuaugaguguauguccuucuuaguguugccuuagaaaaauauuaauaaacaaagaagcuucuaguauggaacugguacaucaguaagaauuaaacaugggaaagguaacucucuuuuguucacaacaaguucaaagugcagcuuuugugauucuuccuagccauaguccuugaccuuauggaaaauaaacucagaaagauugaauaauuaguucaaggucauuugaguagaaaauggcugagccagggcccaagucuuaggcaacaaggggugauagagcuggggaggcucaauaaaacuucugaaagaacucucuagggcuggagagauggcucagugguuaagaacacuaacugcucuuucagaggaccugaguucaacucccagcaaccacaugauggcucacaaccaucuguaaauggugugucagugucagcauacucauauacacuaaauaaacaaacaaauauguaaaaagaaaaaagaacucucuagaaugacuaugaggugauucuuguuuaaguuuaauauucuuuugccggcauaaauauuauuuugaggguuugcuacacucccuuguuggaaauauauuaaggguuucuaccauauaguucccaaauaaaagacacagagccuuuagauuuaugauacgguaaaaagaaaaacacuagagcugagcagauaucaacccuauaugcuauuuuaucuauuucccugucaauauccccaagauaucacuugccauguucugccugggccacucguacuccaacaagccaucccucauggccaugugcucaccauccaacgaccccauggugacuuccuuccuucuucuuccucuucuuucucaucucuccuccaagcccgugaaccuuugcucuaccucccucucuucugcccaucucaagcuguaggcaucuuuauuaaccaaucagggauaacuuggagggcaagguuuaccaacaaaagcuggucuacaugaggaucucuuaauggggggccaaccagaucuugggggccaguaucuagcauuugaauacaagcagcaccaggcgaacccacuacauucuuucaaguccuauacuccuuuucaugucaucugucaucucucuucuggaaugguuaacuugacagucauccaacagaugacaaucuacacuagaggagguaugcaaauggugggagcauuuguuaaccaaagguggacuaaauuauucacaagauguuaguugucacuggggacgcauaugagcagcuuaagugaucugggacacagcuuaagaagcugaagguuggagguuugggguuacugggccacagugugacagguuaaagaggagggagguguuuucaguguacagucaucuugccuggggcuccaggugucugugagccugaugcuugcuuuccuucuuagggagagaagccaggccuugcugauggcauuucuccuguguuuccuuucagaagccucuguguugacgcccucauugaacugucugaugagaacgcugacuggaaacucagcuuccaagaguuccucaagugccucaacccauccuucaacccuccugagaagaguacguccaaucuagaaacugagugcugcuggggauggaagcuuggcagggaaggaaagacugguagaacucuccagagauaacugaucuagcccucauccaugaaacugggcugucacuagcccaucaaccuccaugauaagauugaggccauaaacguauggggcauuuccccaugagauacaaggccguccuugucugagaaaggggcauguaagugcccagacuguaucagaaacaucacccagcucaaaucucaugucucaacuguugccuuuguuuaugguccaacagagugugcccuggaggacgaaaccuaugcagauggagcugagacugagguggacugcaaucgcugugucuguuccuguggccacugggucugcacagcaaugaccugugauggugagccauacuuagugcagaaggagggagcagugcugugacuugaaugagagaaggugacagggcuaugaugaggaaaagaaaggccgggaaggaagcggcagacccgcagcuccccaggggcagcacuguguguaaagcacuugcuucagguaugucaggugugacaauuaccccagaagccuccaguuagagagaaggcugagccacagcaugaaugaauagcaauaugagacugaaaccaucaccaugaaagaaaacacugaucugugagaaaugcgugccagcgcucuuccauggucuuugcauccugaccaacuucauccuuaugacacuuaaggaaauacuguauauuuuauaaaagugucauguauucagaagucaagaugucuuagcuugccauaacauguaggaaaaacaauuuaagaagaaguguaaaaaauuuuuuuaaaauuaaauauuaagaucauugcaacauggacaagauggauuugggacauauaggugucggaguuugggaggcagaguggaggucaaagaguaaauuagaaccacuugugucccaucagagaccucuacuacagugaugccagagaucaagagagaacuuauaucaaagccagauucaagucaagacaaaagcaaaucagagaucagucuuaaagccagguccagaauagaaaucccgcucaugucaguuagaaccagacuuaaaaguuauaccugcaggaaugacccugaacuuauauuuuaggaaguuaacuggggcagaaaaagcugauacuuaauauuaugcucagggagaucagguaagauggugacuaagagacagaagucaaagccccaggaaagcauguuagccagggagcccagaauaccaacauguaaguggaagccaguguuauccauagauucaguaaccuuccuaggaccaagucugcuucaacaugagagaguaggugcccaaccuaaccauaggggcagaugaaaaagcagaagagacuguuacgagacaagaauuuucuagaaguuacuggaacugauagccagaugcacacaugguagcuacugaagccauccgagggccccuuuaaacaucgacccgccugccuuaaccaggaagcauccucagagacagagagaaagagaaagagagagagagagagagagagagagagagagagcgcugcucggguucuggcuuugugaagguaucccuccuccauuucuaagauguaggagucagugugcacugacuuauggaacccuaaacaccaucaucugaguaaagcccaaucacagugcaucaaacagaauuuaaucccaugagauugccauagccacacugagagcugcaugcccuccacccagagaguacagucuauggagccucaacacaucuugguguacaggcugugugauguaagaggacauucaagaggcauuuucaagcuaguaccuggaaacuagcagaaccauuuuagaucacaaaucucaaagacacaaacaaucaggggcguugaaauaaugcccaaaggagccggggccccgagaaguggcuaugagggaugaauugauuauccguaucugcaguuuccuaaugguaaauacuguguucaguaaacggagucccaggcauccuuucaaacuuucuagguuguaaucuaccaaaagaacaucuugaggaucugugaaggauuugguuuuuuuguuuggucauuuguuuggguuuuuuguuuuguuuauuuuuacuguuuuuuaucguugugcucgagaaauuuuuguuagauguuguaguaauccgcccugggugugcagaacgaccucgagagcucuucaaaaagcaaaaucucuggcacccagcuaccacccaccccaaucaguuacaucaaaauuccagcaggugaaagccaggcccuucgaauuuauuuucucuuuguuuugcaguucuaggggguggggaugcgguuugcaugcugggcaagcacccugccagugaacuacauccggagccaaaaauuacaucugggacauugugggaauggcugagaaucgcuaccccagaggaauuuccugagccaggaccccaguugaccccauugcuuuucuguaggacuagcaugucuugugggugugcauuaaggaaaauaucaggaacagaagccgaagaacuaggauagcuuucuuguuucuauuaccuuggauguuguaauacucagagaaaggugggcaguuuaacucucccuccacggguuaaauguugaaucuguuagguagugucuucccuggccuagcacagcccccuuucucugaacguugauucuucuugcaggaaagaaucagaaggggguccagacccacacagaggaggagaagacaggauauguccaggaacuccagaagcaccaggugaguggcaaucacagugccaguucaaaccaggcucuuuuuuuuuuuuuuuuuuuuuuuugguuuuuugugacaggguuucucuguguagcccuggcuguccuggaacucacucuguagaccaggcuggccucgaacucagagauccaccugccucugccucccaagugcugggauuaaaggcgugcaccaccacacccggcuucaaaccagacucuuaacacuaccaagaagcugucuagugucucagcagaugagagaaacucacuucauucaacacaggagaucccggaugaugaccucaucggccccaucagacugugauacagacccuucccugagggaguuacugugacaggggugggaggggcugggguuccucuagaaaaccuucucucagccaucaccugaaagcugcuaccaggaaacaguucuuagcauuucuauccuccaacacaacacgugugagccgaaugggcuucuaagaucagagaaagccugaggcagagaggcagguguagucagugagacagcaagcugguguucgcugaggaagcuucagugccaggcagcuggacagggaguaccaacucugucucauagaugccagccacgguugucagcaguuuccuagcucagguuuuaaguuggaggagaauuagcaugucauaaaauuuaccccuuucaaagacccaauuuuggccagguggugguggcacacaccuuuaaucucagcacucccuaagagaggagggagaagcagguggauuucugaguucaaggccagccuggucuacagagugaguuccaggauagccagggcuacacagagaaacccugucucaaagaaaaaccaaaauuaaauuaauuaaugaaauuaauauuaugaaauaauacuauguaauaauuaauuaaauuaaauaugcagcuaugcaagugagcaacuuucaguguauuccuaaauuugucagcuacuccccacugucuaauuccagagaaucuuaaccucccccgaaaaaaccaucacauuagaaauugcuccucauuucccuuguccucauccucugaaaguugcuaauccugacuaggaauucauaucccacagaaguauuaaaaacaauaggucccagaggugcccuuaucugggccuaacuugacuauucaacuguccuagaguccuuugaagucuacaucuuaacaucuucaacuguuacaugagagcaauacuacaucaggucuuggaacagggccugacacauuccuccaaagaugugcaaguagccaguaaggguuuaacaccauuagaugcuagaagggugccuggucugggugcgucauagagaaugacccuuuucugucugacuucuuccacuuagaauaaugcucuuuggguucaugcuuguagcaugaaucugcuucccuccccuuuaugugagugccacuccauauaugugauaguuuguauucauuacaugaugcguauuuaggugacuucugacucugaugaacgaugcuguugugaauguuauuguacaaguuccuguguggacauauguuuucacucccccuauauauuuaggaauagaaaccgcaccaaaagauaacucuuuuaaucuuuccaaauaccagucacuguacacccuccccuccguguucuuuacauccuugccaacguguguuacuacuguucuuuaucucauccgaccaacugaauguguagacgugucucauuguguuuccauuugcaccccucuaacaucuagugguguuaagcccuuguuggcuaucuguacaucuuugaaggaaugugucaggcccuauuguaagaccugguugaaaguguuaagauuguagccuugaaaauauugucaaggacacuaggaaugaucaaguucaagcccagacaaguacgcccgccccugaggcccauugcuuuuacuacaucugugggaauuggauucagaacacauucccuuuaguacccuuuuauccuuaaaacuggggcaauaauaucugauucauaggauguucauacagggucagcugguaaucccagacuaccccuaaaagaccaugccacaaacugacauaaccucauguuuaucacucaagaaggaaccauacaagucagcaacuaaaaucuagcauaaccgcgugucuacugaugcuauggaaggucuggggaccuggauaaacaccaccaaccuuuaauaucuucguaaugauuauauccucuuacaucucaaagggcacagcagaaaagaccaagaaggugaacaccaaagagaucuaagaagaggcacagagcaccguguccggagcccagcgccuccucuucagcgcugagcccaguacacacagagucugcagcaaucaccaaaucacuaguauuugcuuguauggcagcgaaucuuauuuuguuuguuuugcaauaaaggaaaugaggguggccagccuagcgagggaaggccacaaccuucaccuguaggaaugcuuuaagagaaacuaaaggacaccuugggacgagaggcaacuaaggaaacagcaucggguuggcagaggagcagaggcagguuugaaugaagccuuucuggggucacagcagcugcgaggagaauacaggaaaagcauagagaaacauugaacuagcccugcuggaggaaguggggggagcuuuguagggaggaacccugcugcuuugacccuugucaccacugucagcaugacagaccugcagcaagucugcuucuccuuuuggucccaacaaucaccugaacacacagccgcccaacuaguuaccugugucccucagccuugcauggaguuuccuggaggagguguuuaaaugaugcagacacuuauguacuucaagcgccauggagaccuaaccaaauuuuuaaaauacauuuuucuuuuuuuuuuuuuuuuguuaaccaaaggugcuauuucucuguaaaagacuuuuuuccaagcugacuucauuccucaguuauuaccguuauauuauuguuguuuuuuaauauuucauuuuuugacuagauauuaagcuuuuguaauuauuuuuucauuaguccuacuauuucagaagugaaggugaaggggguuugggcauuuuuccagguacagggaacucuguaacacaaacagcccauacccugucacauauuagaccgguugcaguucggagcugcaccccaacccagagcuucuagaaaaucagcuccaugccacgaagcacaagaggccccucagacagaagccacaggacaaagcaucuucauagacagcuguugagauccaaacaguuaauuugcuuuuguuucuuguaagaaguuccaaggauggacgcucaggcuaucccagccugccagccugcugugaucuguggcuaacuggcagagucagccacugugguccuuagcugcuccuguuucuaggugucaguuuacuuaguaaacugguaagaaugaaucuuggaauuuaauaaaugguaguuugugguuuagccaacugguccagagggagcuaccuucuccuuaggauagaugaaucuacaccauaagaaaaaccagccaggaauagcauggauggguuuugcuuugguugaaaugauccuagcaggugacuggguaugaggacuucauggucacucugcccaggaagagagcgugaaggacaacuagcagcuuccuuagggaugguacacaugagugugaucucuggagucagagguuuccccacacacaugaugauaaaacuuuucagauuuagagcgguuaaaacuggagaucgaaucuggauugagaaucagcacugggggagaaacuguuauugaaagucaauccuuucuuugagccuccgaauaaacuauggagauuuuccugcauaggaaaguguggaauguugagcuauugagaugggaguggaauucguccuaaauaguuuuuccuggucucaucugaacaagacaauuuggcucugccuaguguucugugcccucccuuucaaaagcucugagccccgcucaugcaguccagauuucaucccccucuccaagugccuuggagagcucacagcagcaaugccaucaucaaaaguuuugcugcugggaagaaaaaaaaaaaaaaaaaagaaaaaaaaaguuuugcugguucuuggaggugaugggagagggcaggaguaucaauuuguucaaguagcugcagugucuguuggccaaucaucuuuagaacccuguaacacugaguaccagagggcaagcccacauuccucuucugcuacuucaguguaacuagggcagcuguugucugaagcaccauagauucaggugauccuccauagauucaggugauccuccauagauucaggugauccuugaaccguucaugaaaagcugcuaaguagccugguuugggagacuuggguugagauuugcaugggaccaacacgcaggauuacaucuucuucaguuccuagaguccucuagaagccuauagaacaagacggcaagcucucugggcuugcucugggguuuuguucugugguuuuauguuguucuuguuguuuuauuaacaucagugucucuuaagauccaggacccagggaggucuuuucacauacauauaccaggacucuuggguacuacugucagucuuggggaagcaggcuccuccaucggcaaccaaauccaugugagcacuccgaaugccuugguuaguccuaugaccuaaauaguuaaacuucagaaaaugguuucaacagauuucugugccgagugguuuugaaauugcauuuguauuugcugugcuucuguauuccauuuaacuggguuuuuuguuacuucugauuuuuguuacuauuaauaaauaaaaauaaaauaaaauaaaauaau

SEQ ID NO: 8240 - RNA, 2407 nt, Mus musculus
cuuuuuuuuauuguuuuucaguugucagugauugaaaaccacuugggugaccuggaaggaagagugcuggcggauauguucgacuuccuguccaaagagcuggugagguugcaggaggagaggaggauccacgccuucgccaugcuggcugagcgccaacggcgcaugcgggaggcagaagagagcggucggcgccagguggagcaaaagcgccugcagcaagaggacaugauauucaaggaggcaagcaagggcagcugggcagauguaaacuccccagaggcagccagaugugaccaaagaugugccagacuguaugauuucacacagacauuucaugacauaaaaugggguuuguggguuuuguguuucgcuugauuuugcaaauaugcagaguuuccacuccuaacuaggaagugcagaggcucuagggauacucuagggaaaacacagacgcagcucuccucuccugcaauuuaaaugacauagaaguguauguaguucuaggauucaagauuccuugaagggagcaaaugaggccaagaacuagguccucuuuaaggaguugcggccggaggcagacacggggugagcuggagaacggggacuagccuagggcuuauacaaccugaggcugugacuccucuuuucugagguagguaaguggagagaaugaugaauguucagggguaggagcauaaucaagaauauaacugaaaccugguuugggguggccaagugggagagggagaaauuucagugacacaaaaggguuaaggguuuugggccugauuuaaggaccauuuauguguaaguacauaugucauuuuauguauacacacacauauauacauauacauauacacauauauacaugguccauauuaagcugaccucaucucuauuauacaacucagguaucugauguuccaugucuuuguagcuugcuuccugacuaaaugcugagcuucaugagagcaagcauacugcgcaaucacauugugcucucugcaacaucagcacaggcccugcacacauuugacauucaacgagugucuugguugguaacauauugaacugccaccaagaugcuaacaucaggaaggcgagggguucgagguugauauuggaguugaagguacaugaagaauaaguauugcacacuuagguugccugacgggcccucuaagaaacaggucuuaucucagauuuaaagaaauauuuagacauaaaaaugaauuugccucuaggagacccgcaauuuguugaggcauauacauguacacaaaauacguauauacagagauuaacaguugaugcucaugguacucugugcgugugugugugugugugugugugucagagagaaagagagacacacacacagacacacacauacagagagagaggcagacagacagacagacagacacacacacauacacacagacacacagagagagacacacagagagagugagagagagagagagagagagcgagacagacacacacacacauacacacagacacacacagacacaaagagacagagacacacacacacacacaagagacagacacacacacacacguacacagagagagagagagagagagagagagugagagcgagcccgagguuacauaauuagcaaaagccuaaagaucaauaaggaccaucaugaaaguggaaacaggcuguggucaggaaggaccuaguggccuucucaggcacuagcagcagcuguauggauacugauucauauugcacaugaguuugaucacuuacccccucccccaacccucugaauucuaucucaugauaucaagaaaucuccuugggcuggugagauggcucagcgguuaagagcaccgacugcucuuccaaagguccugaguucaaaucccagcaaccacaugguggcucacaaccauccauaacgaaaucugaugcuuucuucuggagugucugaagacagcuacaguguacuuacauauaauaaauaaauauuuaaaaaaagaaaucuccaaaaaaaaaaaaagaaaucaagagucauuacgacaaugcggcaaacccgugagugaccuggaacccuccaggccaccugcucugcagccccgaguuuaugucucgugccugggccgccuagaaagccuaggcaguuggaugagaaauagacucggcuggugacuuaaaugagcuuucaucucauuuacaggagaaguccccaaguacuauuuuuauuuuugcaggugauuaaaguucaccaaaguacgguaaccuccuaccuggaagacaucauacugaacaccgaggagagaacugcagaggaacaagccagaaaagaaaucgagaagaucgcugaggagaucaacaacaucgcuuaugaaauggagaaccggu

SEQ ID NO: 8241 - RNA, 32141 nt, Mus musculus
ggaggaaaaggccaugaauuugaaggauaguggggaauggguauguauauguaaggauuuguagaaaggaaagggaaagggaaaaugauguaauuaaauuacaaucucaaaaacaaaacaaaaacaaaaaccauucugggugaccuuuuaaccuuugcgccagcgcugacgccacgcccuuggagcgaggccuuguaccacuucuuuugcgcacgcgcuucuuagacuuacuuccguccggagaggcgggacuuccugucccccuucgauugacugcggaaguggagacagacggcucaggguagucggaguuugggagcuuugcgcgugugcgcucauaguugcuuucgccuggaaagaugccgggacuggcggccgcuagcccugccccgcccgaggcucaggagaagaagccacugaagcccugcugugccugcccggaaaccaagaaggcgcgugaugcguggucagugcguagcccgggagggaagcccgggcuuuagcagcucggcuccacucugcucucugggacucuggagaugcagggacccauaguuccgcuguccucucugcucccugaucccgcaccccagucucaguuaggggucaacggagagggcaagagguuacauugaucccaagguucucguccuucauuccuuacuacgauugcauuuuagucuucuuagggauaagacccagauaaauagaagugcguaaagaugcuucuugauuuaaaggcauuuaaaauauguggagauuuguuaccagccaauacuauaccaccagcugugauagauuuacuaagaccuagguguaaauuuuucagguaaucuuuaguaauuuuuuuuuuuuuuggucgaaacgugugaauaguagaacacaggauacauuucugaagggauacccuuuccaagaaguuaaaagucaaccugucuggagcuggagagauggcuaaguggauaaaagcccugguugaccuuccagagggccuaguuucgauucccagcacccacacgacuguuaacaaucuuguguaauuccaaccccagaauaaucugacacccccuucuagcuauugcgggcacugcacacacauggugugcaggcaaaacaccuauacacauaaaaacaaauuguaaaacuugucuacaggacagaggugauauuaauguucaucgacuuuaucaucaagucacaaaagguuuuguuuggucuccucccuuuuauguagccuggguucuggggcagauacugaaguccucaguguggcuaugcaucuccaucuucucccaucaaagcagaaaaauacucggagaaacaaauauggauucucauggugugauuucauuaccggagagacugaaacaguuuuaagucuagccugaacauccgagugagaccaugucucaaaauaaaaauagaaaaauacacaaaacaaaguauuccuugguauuguaagguaauaagaguguaaccaguuauuauuaucacuaccuauaaauggagaauuuaaagaucgaucugauaccaagguucuugaaauaccaagguaaccugcuuaaggagacuuugguguggcucaagacucagagcuuagaaauacagucaggcuuugaaucuucucccuccaaguuggugaccuuaugcaagguacuuaacaagucugcuucacacguguguugaacgagucccgcauuucuguaagguuuagcagugggugucggugguaaggggaagcuagcuguuauacggaacucacugucacacccagucuucucaucugcugguaaggaugguaauaggagaaccucuuauucuuuuugagacaggguuuugccauguagcccaagcuggccuccuccugaggagucuccugucuuagcuucccgagcaugauuacagggguguuucaguacauuugggcucuugugacuacucuuaggauuuuaucaucacagacccuuaaccuucugaagaacgauucaucuugguugcucguggcuaccagaucucuuuugauguuuauguuguuggguguuuaaugauuaaagguaggcuuagguauuuggauguaagaggaaaaggagaaacaggaaguuaauuucugugugauaggaggaccaaacguuagacucuuuccucgucauuuuauguaaauauucaguuuauuucauuauaaagaaauguuuauuauuccuuggguauagaauaaaggcaucauuugcuacacauaauuauuucaucuaauuagaaccuuccccagacaacaacaaaaacaaacguuaagaccuuaguucuauggaacacuuuugugggaacagaaccaucuuaagagcaaauaccagagagcaaaggagcugagcugguugguguaguagggauuuguuugucacuccagcuacaucugcacgugcccugucucacucccugucacagauucuccaugaaugugcuugucgucuauuuauuagguaacgagugcaucuuauuuuauagcaucauugagaaaggagaagaacacuguggacaucucauugaagcccacaaggagugcaugagggcacugggauuuaagauaugacguggugagugaacuguaaugcuucaaguuugaguguuaaccuuacagagguagcugcgaggcaggcagcauucuccaaaagguagcuugccugguuaauauagcauguuuaaguagcagcuuaguucaguuucuagaaugggguuguaacaguuuggugccaacaauuugaggcacccaguagaucugagacaguauaaagcuuuugagaacugguuugacaagagccuuuagaguuacauuauagucaggaagaugcagggagcauggcugcggggaacucggguacacugguuuccaagguaaaggaacuaaguggaaaauucucuugguuucuuguuucuaauauaggucugcaguagaguuacuuuuuuccagugaaaauggaagcuuuguuuuaagccagguauuguucuaagaaaacuaaagccucagaucaccaguuuccaaagaacuuugaguccaaauaucaaugucaaagggaugugcccaccaagaccacaguccgugacuucugguuggaaucucuugcuucaggcguuagcuucgcucacuacuacacuucuuuccagaugcugauuuaaagucuccuuagagaggcuuuccucagugccccauguaaaguaguacccuuccugucacuguuccagggguacucaguaggccuucccagauguuccguggccacauucuccaguaugguagccacuagcaauguaugacuauuaagcacuugaauuggccauaaugagacuggggaauugauuuuuuuuuuuuuuuuuuuuuuuuuuuuggguuuuucgagacaggguuucucuguauagcccuggcuauccuggaacucacuuuguagaccaggcuggccaaauucuuaacuuauaagaaggcuagugguaaucugugguuaguggcuucucuuguuuuugcaaucaccagcuauauacugagccucuucuuacagcggucguccucgcuucccuccggcugggcuguaagcuccgggaagcaucugguuucacugccagaguguccagcaugucccagcaccuagaucauugccuggcacaugguuggauucccgggaugggcucagcaggaugagaacuggaaccucagccucguaagcacccuguuugugcugcucgaaggccacaucucacugucaccuccuaacuuaucgacaguugagagacacccaggccacaggccaguuucauaguaguauccagcugguuucuuucucuuccaccucgcucuggaaugucacacaugaccaguuguguuugaaguacgggagggaggagauaaggagcuugcccuaccugauaagucugacuggaggaggagacuguuuaaaggcucagacccagcauccaggcauggcuuucuucacggucuagcucuuucuagucaguuuuguuaagauuugccuagagccucaaggggauuugaaggcacagugaaggguagugguggcauuaaaugauuugcauucuccagaccagaggcacuuugucacuccugacagugauauuuuaucgccagcaugcucauuuuuaggauugcacauuaccuuaaucuucaguacuaaaacucauaaugaauacuaauuaaaaagaugugcugcugaaaugcaugagaguguauaccucagaagccaagccucugacuauaauaaacuccugcacaguucccugcacugcucugaggugagcuugauagacugcuaggccacguucucugagaaccucuucgaggaaaccacuccacagacucggguugcuccagcaggggucauaaaaguuccuuaauucaaaacccgucauagauguugacauucuucccaaguaagacagaucuuaauuggaccuggcuggcagagacggcauaaguauuauucucuucuacucuguacagcaguguccccaggccucagaaacaccuaagcagcauucuccagaguucccaagcccugccucaccugcugacuggagcuccuagacgacuuccaagucugugacauaaaccugcuaacacgaaggaaacaguagugaauaugcuggauauaaaauaccggaggacuuuacgcuagcaaaggcagagacucaaaacuagaaagaaaaauuagguagcaugguagugagucuagacagucuagacacuuuuuuucagucuugcaacuuuuucuuacugacagagaagguagacaauaaagucaccaccuaauuagaaguagcaggaagugaguggcucuuccugcuuguaagggucaaaagaaacaugggaaaucugcucaaauccauauaaaauaaccgguaugcuaaguuuuuguucauguauuugaauauuuaaaugagacacuuauacguagguuaucuacaaaagcaucucaagauaaugcaggaaggggucauuuccagugcucaaaccuaaacacaggacagagcaccuaucaagacccuauaaaaugcccaggugcaaaagacagucccacuuggcagggacucuccaccagagaagaagcagucuguguuccaccugcagacguagccccucugaugagcgcagugccugagaaguacaggagcugcaggcugugggaaugggggggggggggggcagcuccaggucugccucuguguccugcccgugccuuugcuuaaguguauugguuuuccuucaagguuuuuagacaaaaagggaauuuaggugucugugucuuggugaggcuauuuuccugccuaaaccagacuaagggaacagguguagaaugaucuugaguuagucuuaagaauuggcugccugagugaccauucaguauucuucuccaucuugcauaucgacuagggugguguguccuggcgagaagcccggcaggcugagacagggccagccgcacuguccccugcugcucucccucggguucuuucacuguggcuguuauuugcccucuggucaaggaggagcuuccugcaggaacaaauauggaacugaccuuccuucuaccuuugacacagagcgagaccaguucuugaaagagcagacuuacagcccucuuuacuuuaugucuggaaacacacaccgccucaccaaaagcuccuaaacgucagacauugugaccagcaguugcaggggagucgucaguuaagcugagcugggguuuugacugguuuagaacaauugugacaguuacuuaauauuucagugaagcauuuauuucugaugguccugagucuguaaaucccuagguccaguuugaugucugaacucugacuuucuaaaaucaaaucucuucuguagguggccuacuuugugaaugaauaauccuugaagaaugaagaagauuaaauauuuuggaaguucuuuggagaacuuugauaaauggauaaaguauuuauaauuuauuaaaaaacagaaggaaagaaaauaugcugaaccgucuuuguuguguuucuuuuucuguucuucgcauacccacaucacuuuuaguucgguuuccuuuuucuccuagugaauauaguagcaacaacugugccaugacuuucuuuugcucauuauuguggcaucaugggaauuugaauaguuauuguuaggagaaagcagauauucucucaaccaguaaaaucuccaaauuuggauauauagaagcuggaaugaacaucuuuugucuguucaaaaugaugucagacauauaucaucucagucaagacucauuggccauuugugagaccacaccuguaaucccagcacacaggagccagagcaggggggcuguaaguugaggggauuuuuuuucucucucccucccucuaucuucuuccucuccuuuucuuuucuuuuccuuuccuuuccuuuccuuuccuuuccuuuccuuuccuuuccuuuccuuuccuuuccuucuuccccuuuuuuucccuuuuuucccuuuuuuucccuuuuuucccuuuuucccuuuuuuucccuuuuucccuuuuuuucccuuuuuuccccuuuuuucccuuuuuccccuuuuuccccuuuuuuccccucuuuucccuuuuuucccccuuuuucccuuuuuuccccuuuuuucccuuuuuuucccuuuuuuucccuuuuuucccuuuuuucccuuuuuuucccuuuuuucccuuuuuccccuuuuuucccuuuuucccccuuuucccuuuuuucccuuuuuucccuuuuucccuuuuucccuuuuucccuuucccuuucccuuucccuuucccuuucccuuucccuuucccuuucccuuucccuuucccuuuccuuccuuccuuccuucccucucucuaagugaaguagucuggccuggaagaucccaacuauuuggcgaaguuacuuuguguguggccaguuauaugguaagauaaacuaaaggcaguguagacccuagggccaagauagcuaccuguuuuuaagaaccugguccaggcugguggcuagauugaugcuagaaccuggcuagucauggaacuggggcuguagcucaugguggagcacuugccuagcacacccacagcuccuagcaccaaauagcucagugccacugccguagagauagcuggagcaggacccacuuaugaagcaagcuugugaccugggagcugcuuaggugcuaauaaagcagcuguucacauucugccuuuuagugcauugagcugaaaaccucaaacacaggcuggaguuagcuuaguggcagagaacuugccuggcauacacaaagccauggguucuaaccccaaauaaaccccucaaaaccaaaugugugguugauuccuuuauagaauaaaagaguucaauuagauccuucaagaaccugaccuaauuaaugguuaaguguguggcuuuuuucuuuuuuccacuuauuuguuuguuugguuuuguaguagucauuguuguauaagaccuaggucuuaugcaagcuaggcagaugcucuaccacuaacucggucccuagcucucuuuuuaccgcuuauaguaugauugagacaguggcccauacuccacuuggacauacucugaggccuucaacuuggaaucuuacagccccagcaacuagauggcuuugauguaugacagacaugguuuuuagagcuagcuaugugcuaucaguaagucacaauggaucuuucucauucucaaacaaaaaacccaauaucuaacucaaaaguuuuaugaccauaaaacuaauguuauuuaugaagcaacuggccguguauauucaguguuacuagcauucucuguuugauuuuuuuagucauaguuuuacuuaauacucauuugaauauauauguuuuaauaaaugcuguguggcugauagagacagcuaugaacuaacuucccuuucagcccuuggaagguuguugcuuagacugcuugcauacaccccagaccacaaaguggaagacagauaaccccggcagcugacgcuaaguuuaaacaaacugucccugacauauccucuguauuuguauuuggggggaggugagacagggucuucccuuauagcacaaaguagccuuaaacuuguauucuugcuucugcuuccugcauacuggaauuauagguguguguaaucacacuugacaugucuuuaaagcuuuauuuuauggguaugaguuauggguauguaccacauguguacuggugcccuuagaggccagaagaaaauauuaguuucccuggaacuggaguuacagagccauugugugggugcugagaacuggacccgggacucucacaagagcaguaaacacucuuaaccgccgagccaucucuccugcccuaauuauacguaucuuaaaguagaaacaaacuauuuuuauauuuuucaaauguacucuuauuuacuaaugagauuauaauaucuuuuucccuuaguauuuugcucaguuaguagaauucuguaucauuagauguaugaauuauucuauggcuuacuauaacuuaacuggaauuuuguauguauacuuacuaugugucagagacaccccccaccccaucccccgguagaauugcaucucaggcugaggcaggugaugucagauacauagauacugaguaucugugccugugucuaucugugugaauauguuuuguuguuggcugguuuugugccugugugaagaauaaaucaccccaaauucacuggucugaagguaccuagagguucugcauguuuucaagacuacugaugaguacugcccaauucauauuuagaaaggcaaucuccauguguuccuuaguauccaaggggucccauuucccccagcuccuaggcaacacacugauauuuuaaccuuuuccaguuugauaguuuuacuugauuugugagcaacggaagcacuucacugaaaacauauuucagaagaccguccagccuaccccuugcuagugcacagccauccuggagacagugugcagcauaucacuacuaauaugaagagauacuaacacaauaauggaaagauagucuggcguaguagaugaccauggaauucugagauaccucuuuucuaugucuuucuuaugcacaguaauuccuaagcucauuguagauacauuuauacuuugucuaacaguuucuuuguuuaaccuugaaguagucaacuuugaacuugaaauaggccuguauccauagacugggccaauccuagaauuacuccaccuuccacgggugaugcuguuagagaagcugcaaucuccacuagacaggugaguugaguucaaauguuuagggacagggaaguuguccugagcaggacagcugauggccaggggugugugucuagaucaucagaaucuaagcccagugcacacugucccaggcaucugagaaagguucaguuuguggauauauguucauucacaacauaguuaguaaagucugaucuguaggaacagcccuaaguguugacuaugucaccugaguuacugcuugcuccguuagaccagagacugagcuaugauuucuaacuacgcuuucaggcaugacugaguggauuuauuauauacaguaaagaaaggucagagaacaaauagcaaaauaccaucaaagcaggugcucaaaacaccuagcauccagcagaggugaacaaggaagcccuacugagguagccagcuggaguucugcugcagagucuggggagggccaucuccuucaggaaggagcaaaugaccacagaaaggcaguggccuugaaugagcugcuuacaacuuuccagcagaaacagccugggaggccaaggcagcuggaguuuaugauuucgaggguacuuccaacuucccauuuccaacacagguauuuuucuauuaugggaaaagaguaguaaucucuguugggaacaguucucucucaggcuguucucaagggcacaauauuuuaaaugcucuuaucugcuugccucuuuccuuguuucugagccaggaguccagcccgacccaggauggauuuuggaagacacuugacguaaaugugagaguucaaagcagcaguucucaaccugggggucgcaaagcaugggacuguugaaugacccuuucacaggccuaagaccaucagaaaacaaauaccuacauuacuauucauaacaguaacacaauuacaguuaugaaguagcgaaaauuacuuuaugguuuggguuaccccaacaugagggacugcguuaaagggucacagcauuaggaagguuggaaaacccuggucgacagugugugcauggggucagggcaggggagugggcaugggcacuuccagagccagcuucucaaagagcucaaacaacaccugacaauuuaccaacaaccauuauauauacguggccugcccuccaggcagagacgugcugaguaagaggcacuguuugaacucuggugugcucaguguacagagauuuguaagaugaguacucugcccauaaagagcuucuaaucugaugaguacauaaguauaaucagaaauuaaaaucugaauguuugauauugugauggguagucaaggugcuucccucaagaguuccuauguaacucugaaaugaguucuuuuauuuagcuacuaacuacuuaaguacugggacauggcucauugauuaagugccugauucacaaacaugaggacuugaguucccaucuccagccacauauaaaagccagguuugaaacaggcagcucuccagaccuagaguuugcuaaccagccaaucuaaccagucugagcuccagguucacugagaggcccaguuuggaaaaaaaaagggggugggggaagcaauacacuauugaccucuagccucaacaugcauccacauaaaugaauauauuacacacacacacacaccccaccugaguguaauggcacacaccuuaaaauuuuuuccauaugauauguuuugaucauaaacuuuuuuccuccccaacaccucucuuauccucacucacuuuccuauucuuucucucucuaaaaacaacaacaaaaaucaacaaagauaucacaucugggggaagaaaccaucucuucuacccgucuugaacaagaaaguacacacgugguuucacuggucugagaagagaacacgcugugacaauccacacacacaaaacauggagucugauuuguguuggccaacaaauccugaucacaaggccugccuacucuagaguaugguugauauacccagugucacuucauugaagaaaacugacuucccuucuccuggcagcuaucaguccgguuucccagacacagcagagccaaugcacauacgaacucagacugacagcaagcacaagaccugcacaaguucaagccaacccacaucccaccucuaagaaggcgcauugcuugaaucccagcacucggggcagaggcaaguggaucucuauaaguucaaagcuagucuguucuacauagugaguuccaagccagccagugcccagugcuacagugagauacugucuuuuaaaaaauguaaaaauguaaaacucauuguaguuucaucuuaaguuuugugaguucaacggcaagcauagaaaaccccccauaagggaaagugagcacaauugugagaguccaaguugaagcaacaauuguaccugguaccuggugccauccagcagguggauugucacagcguguucucuucucagaccagugaaaccacguguguacuuucuuguucaagacggguagaagagaugguuucuucccccagauaugauaucuucaacucccccuuuucaguaugacugagcaguacugcuaugugucuuuuuacaaagacaaugguugucaguacaccuaaggcuaaauggugugagcagggcuugcaccuuccauguccugucagaucuuuggacaaaacugaaauccuguuucacaggaggaaaggguaaauggauauugaguaaggaaccaguguuccauaucacccuaaccauccugaauggucacauagagugcauaagaucgauucguccuagaguuaagaaaaaauugaagagucaaagagaaaguugaagagucaaagagaaaauuggguagaggaugagaaaucggcgccuggauuuguagaaucugacggucagcaagaguucaggaagcuguuuccugaagaagagucuguagaacaguaguuucggcccccuccccagcccccaugggucccaaaccuuuugggggucaaaugacccuuucauaaggaucauccaagaccaucagaaaacacagagauuuacacugugauucauaacaguagcaaaauuacaguuacaaaguagcaacagaauaauguuaugcuuccgggucacuccagcauauggugucuaguaaagggucagaguguuaggaagauugagaagcacugcuggagaggaucucagucaggacauggucagcuccaaggagcagagcagccaauuccaggccauaagcaacacagguaugucccucacucuccagccugggguuaggaucaggagguuucaccucugugaccguggccaagucagacuuugaacaacuuaaacugcugcgguuugucuuuguccuucucauccuuaggcauguugucuccugacuguggaaccugcaaguguuacauuguuguacaguuguaugaaaggucacaggcuaccuuguuaccaaugugcauaccuucuguucugggcuugcccacauaucuguacccuauuuuuggcaugcccagcugcagagcaccugagcagauuuuagaccuccuuaaauaauccucucccccucugcuuuuuuauuuuucuccuucuucuuagaguccccaucagagacuuuccuuugccccucuagucaucucuuacgagauuucuggguuuuuccagguuagucuucccucuagauuaaaaacuucccugaaggggauuguuuuuuuuuuuuuuucuauuucaucuuugucuuuuguuacuaccucacagcucucuaaauacaugcuuauuggcuuaaaucaccaaaggccuuacuucuggcuuuuuccacuguguguacacuuucaugucuguggguuuccucaaaaggacauuacuaucuuaauacauacaauauauuuauucucuuaucucugucaacugacuuuuuaaauaaaaagacauaauuuccuguuauuguagucugccgaucuauagacaucaaucucacacugagacccacaacauaguuagguccucuguuauaaugccaaacaccugguaggaugguguaguggaaaauuacagugagacucgugcugauagggcuuuaaucaccacucacauauugacucuguaaguuuagacaaguuccuuagcuucgcuaagccuuuuucuucuauuuaaaaaugggaguguggggguaauacaauaagacccuguccaaaaaucagaugauagaauaauauguuauuuuguuagcauuagaaaaugguagcuguuugguaaauguuaguccucccugcucaguucgucucagguggaaggacagggacaguggagaagggagcaaggguuaguuaaccugccugucucuuuaaagggccagggccaagccuaugggcugucuugcugacgaaauucuaucuuggagccuugguugcuucuuugugccugcccauugacagcuggcagggacuccaaccccagcagggagccccccccccuugccugaagcacaaacagcugcuacuagcuaaaguugguuaggaaucaggcagaugacaaaaagaggcauauggaaaucccccaccuccagugaacacgugaugucacagucacaccuguaaccccagcacuugggaggccaggcaggaggauucccaagaauuccaggacagccuggacugccuagugaguuccaggugagccugggcugaagugacacccaggcaaucagucagucagaaagacacccaaagccugcugagagagucccguggugcguuguucuccaaaugccccagcccuuucuguaccaaucuccagagaccgggagcuaugaagccaucugcagaucaaucgauugcaauuaaaauuuuaaaaugucuuucuuuagcauggcaagaacuuucugacuucuguaacuaugcuucuccucucgccaugagagagucugcucucccuuccaccucaccccucagcucugcccaugucacccuucuuccugggucacaccguucuuugaacuuaauuugauaacuuguugcaggcaucgaguugccauuguuguuuguagucucucccuuauaaagugacacucaggugacgguguacacuugaguguugagauggaagcuuuagcuucugauuucuccuuaguguuauucaggucagugagucuccauggaguuaggauuuggauaguucuaggcagcugagcacuagccuaaagccuuggaacaacagggcgaagaugcucccgacccccaagagcagggauggagacucagcaaguccuccagaagccagcaagucaggucucuuggcuuucauguuugcacaguccacauuuacuuccuggccguccagaguugauccuccacguucauuuagauguuccuugaaagucaucagacaucuuaggauugcggagucaugggucuaguucagcguuucugcuuacugugaacccacuuaaaacaggaguauuucguuugaccgucucagguucaaauccuggcuuugcugccuacuccguguuggaacacguuacuucuuggaggcuccauuuuccucaacucuaggagaauaggaauguguauauacacugcucagugaagguggagugccaaaggaguauuuauuucuuaggcagucauucuaacuugagguuauugguguguagaugggauagugacuuacguccuguguuacuauuacucugggcagauauuugcagaggagugucaacuuagagcugaggggggcugcuuuacacagcugcuuuuguugaucgaaagucaaauuacagcacagugauguuugcugagugucuuaaaccuuucacggggcuuuucuguucucccugccaguacuguuucuguuaguagucccagguauucccgcucucaauggccuuccuaccucccauaaauccccaaauccuccagacaggacaucagcgcugugucccguccacuccauggaccucaauucccugcuugcuuucccuuugacccucccugccugccucuguugacccugggucuuaucuuguccucuggagguaugcuaagugcccugccagccuggccuguuuucuuucacugccagcaccuccuggauuccaauuccaaacaugguaucccucuggggucacccuuucuuccggcgccaagagaucaugcauuccaaauggaacacaagugugcuuccccugcuggcucuccacuccgcguucugccugggaacgacagagagcagaauguggcugcuucgucccguguugcugaaguucauggugucgaguuccuacuuccucucaggacaauguaugcuguuugcuaaggacuaaauaugaagaccagccuaagaaagccggagccaaagagguuuaccagagcacugcgggagggacaagagcuucgcugagagagagagaaagagaggaacgaggaaaagaaaaaucccaaacaacaaacuuaggcuuucaagcuuccaugaaguguacuaugcuccugcguucuuucucagagccaccggaagcauuccugccagcaagguugcauugguagugagaagccaccugggaggacaaacugacugauuuuccccucaguuuccuuuguggagaccguuuuggagccugcaaaggccucgagggccccaaagaugagugccaauggcagcucgguggcucagcuccucuggcagccgcccgugugcaggagcuggaaaccggauguagaaggagcugucuaucaccuggccaacuguuucuugcuuaugggcuuuauggcaggcaguggaguguauggaugcuucuaucuuuucggcauccugggcccaggcuaccucugcugcgugcuguggggcugguuugaugcuuguggacuagacaucguccuuuggaacguccuccugacaguggcuugccugcuucagcuggcacagcuggucuaucguguccgggugaauacccucccggaggaauucaaucuccucuacaggacacugugccugccccugcaggugccccugcaggucuacaaggagauuguccacugcugccaugagcaggucuugacgcuggccacagagcagaccuacgcuguggagggggagacccccaucaaucgccugucccugcuccucucaggccgguaagcugucuguguuguccaugccuggaauuccccgccucccaccccccaccuacacuuccuguucccuagugucccuuuccauuuuguguccccuuucaucaagggacggauguggaaagucaaacccagaaagacuuuuuuccauaggagugaguuugcuuccuuuuucuugacacuuuccaagaggaagcuagaucaugaggcaauuucuccgcuauccaaggugacuguauuuacuugucaccggaagggcugauaaggccagacagacccaaaauggauacacacacacacacacaccaaugugggaugccuaaaguguagaaccucugugagcauuagaaaaaugaccauuucaguaagaucaauuuguuccuuccauaugcauuuaacauuugugaagcacccacuaugugcaggaaauaaaacaaacaaauaacaaaacccaggagguuuccagcgaccccugugcucugcuggggcauuaaggagacgccuuguuguaguugagauauccuauauaagcucuggaguguagcccaugugcugacagcugcagagaggagcaagucccaccuggauucccaggcccauuguucuacugagagucuacccuguaaucagagugcccacgguggcagaagaguagugcugcccacagaugccucacuggugauucgguggagacaugugccucagaggaagagggagaguuggauacuggcuggcuucagggucagaguguaucuguccaguuagccuccauggcaucaguggccguuuaugcucaaugagaaaccaccuuggggcucugugugucacgcauuggaagcauccgugcauucuuugaaacauugccccauagcaccugaccauagacaagccccuccuccaccgccccgcuggagaccaagcauucggccuggucaaaaaugaugauacucagaacacucugguuacaggaaggacggggaaagggaaagauaaggcagaggggagagaaggggaaagggagggaagagugaaaagaggaagagaaaagggaaggcaaaggaggaagggaaggaaggagaguugguggggggggagagggggcaaacuaagauggucagguacacgaugacacgauggcuauuccuagguguucacuacuuaguuccaugcuuauaagacaaacaaugaacguuggucugcuuagacauuagacagacagugucacgucuuggcagaaugcuuugggaaccaacuuccuuaccugaggagaggaggagaaaugauacaugcugcuggcuuccuucucucuuggugucuucuuuccuuagagauauuuuuucuucacgcacucacacaaagacagacacacacagagacauagacacacgcauauauacuuuguucgucucuccucucccuuccccugccuucuuuggauuuaagaguagggauccaguguuagaugugacaagcauugucuugaacucacgaagcuuaagccaauaauaauuaugagccauggugauuaaucauggacccgccauugccaaggggaaauaguaaaugugacgagagcauguaaguuauagaucuucauuuucugggaggucagacacacuccagccccgagagaaacuggccuagcuaaagacagcaugugugcagacgcugaggaugcggcccuucacuuccucuugcaucuuccaggcagucucuauuuccuggccuuguggugugucucugccaucagaggcuggcucuguccuucccgugauuugggaacuuucuucucuaggugaucauauaauagguaacuacuuaaugacuacccuucagugacaugcaugcgugcacaccuaucuaggcauucauuuaggggagacucaagaguacuaauaucccauuggccagaaccuagcagcaaaggaugcaagaagguguggucuuuagcuguuaaaacuccagcugccuggaagaagagcaguugguauugagacuaggcucucucugggcuggagagauggcucagccguuaaaggcuaggcucacaaccaaaaauauaagagaauaggcucucucauuaaacuccccaggucucugcccaucucuacacuuaccugcucaucauagcccguuuauccuucagaacucacauggaaugucaucgugagaagcuaugcccugcaaaggaccagguucuuccgucccccuucuccugugagcccgcuccaccucaguacucagcacacugaguucuucacguacucgagucuuccacugagcugugaaccucucaaagaccaggaucagauuauacccaccucuguagcccucagucuuugggaacacgggagguucugugaauaguggcuuagcgagaacagcugcagagcucccuccucugagcgugugggccacaaaggugggcucguuuggcuccuucuuugccuaacacaacucgcuuuggaagaggugggugugaaaacuggagcuuucugaggaacggaggaaaaggccuaggcuggaucuuaaucuacgucuagauguuacaccacauccaaaaaccauucacuuuaugccggcaaacagcugggguguuagguaccauaccagacccucacagaaugcaggucccuucucugcagggacaaagcaccaggguggacgcuggccauaggcuagagauccagcaaacaacauuagugggguugcuuaccccgcuucagauguacagcaaaccuguguuuguaggaaaggccagagcaguugcuuaacggguugguaguauggaauaaucauauaauuuuuuuaaaauuaguuagaauuccuacucacagcugcagaaaaccaacucuaucuagcugaugugagguguccuuuagaaaaagaaaaggauuucucuucaaacuuaagaaaaggcaugcacuuaggccucaggcuggaauaagauaagaucgugucuauuggcuguucuguaugauuuagauucuccuguggccaguuggggcacauccuuuugcaaugucgggauccuauuauuugagagacaagguuuuagguuuugaauacaggaguguguuaguuuaaccagugugugauaguugucucugcccaaggcacaaggcacagugacuuaaccaguucuaaagucuccaaguuauauuagaaaaggcaucaggcuagaugugcaugccgggaccaucagugagggagguguuuaggaucuuguguccuugugcuuggugaaggcagagaaggugugaugugggaaguguccacaaccaccuacccaaaccuccuguaacaugacagcacggugagagaacacggacucuguucugcugccugguagucaugugaccuuaagcucacugucuuagucaggguuucuauuccugcacaaacaucaugaccaagaagcaaguuggggaggaaaggguuuauucagcuuacauuuccacauugccguucaucauuuaaggaagucaggacuggaacucaagcaggucagaaagcaggagcugaugcagaggccauggagggauguuccuugcuggcuugcuuccccuggcuugcucagccugcucucuuauagaaccaagauuaccagcccagagauggucccacccacaaggggccuuucccccuugaucacuaauugagaaaaugccuuacaguuggauuucauggaggcauuuccucaacugaagcuccuuucucugugauaacuccagcugugucaacuugacacaaaacuagccaguacaauugaccccuugucaacuugacacacaaacacaucauuaguaagccucaacccuuacauucuuauucauccccaaggucuaaauaacuuuaaacgucccacagucuuuacauauucuuaaaauuucaaucucuuuaaaauauccaucucuuuuaaaauccaaagucuuuuuacaauuaagucucuuaacugugggcuccacuaaaaugguuucuuccuucaagaggaaaaauaucagggcacagucacaaucaaaaacaaaaaucaaucuccaaccauccaaugucugggauccaacucacgaucuucugggcuccuccaagggcuugggucacuucuccagccaugcccuuuguagcacacgcgucguccucuaggcuccagaugccuguacuccacugcugcugcugcucuugguggucaucucaugguacuggcaucuccaaaacacugcaugaccccuucaguccugggccgucaauugcaacugaggcugcaccuucaccaauggccuuccauggccucucacagugccgagccucaguugcucuguguaaccccuucaugccuucaaaagcaguaccaccugggugacccuuacauauuaccaagucccgcugcagcaggaguacaaccuuggcuaucucuggaacacagccccuuugugcuuucagaaaacacuucccagaagaugccaccucaaugaugcuggucucuucugaaucaccgcuaauuucuuagcuccagcuaaccagcaucaauaaucccaguaaugcaaagguuuugcuuugguaguucugguaucuuguuaaucacagcugauucuucagccccagcuaaccagaacuauagaaucuucacaaucaaaacagcaauggcccugaaaagagucuuuaauuuucccucugaaauuucacaagcuagaccuccaucuucugcacuguucucaacauuaccuuccaagcuucuacacaacaucuaacauagcucuuaacaaugaauggaucuucaagcccaaaguuccaaaguccuuccacaguccuccccaaaacauggucagguugucacaggaauaccccacuacgcugguaccaauuugucuuagacaggguuucuauuccugcacaaacaucaugaccaagaaguaaguuggggaggaaaggguuuauucagcuuacauuuccacauugcuguucaucacuaaaggaagucaggacuggaacucaagcaggucagggagcaggagcugaugcagaggccauggagggauguuccuugcuggcuugcuuccccuggcuugcucagccugcucucuuauagaaccaagauuaucagcccagagauggucccacccacaaggggccuuucccccuugaucacuaauugagaaaaugccuuacacuuggaucucauggaggcauuuucucaacugaagcuccuuucucugugauaacuccagcugugucaaguugacacaaaauuagccaguacacuccccacgcacuuuuccugaccaucuguuuccuuggcaguaaaacucagaaagaaaaccagucauguccaucaccacgaugacucagugggcaggcacacugggagcauccgucugccuuccucacaugcuaucuugcaaacaugagcuguccugcccgcugcuccucaugcagcccgccuggaaggggaaaggcagagcagcaccucccauggcaacagagacauucuacauccacgcugugccauaccgcagccccagaccacacgugcuuuggggugcaauuagugugacggaguaacuggaccgacuguuaacuauuuacuuuuaaugaauguaacucucaauugaaauagccacaugugguuagugcacagcagagccccugacggugguuuuucauccuggauacauaacgggauuacuggggagauuuuuaaauuaauaauguccauaacucaccuacagagauguuuuuuaauugcuuugagaaaagcucaugcguaaggguuuuucaggagauuuugucuccuucuuccuuccuuccuuccuuccuuccuuccuuuuccucuuuuuaucccuuccuuuucuacuccuccuucuuugggguguguauugggucugugggguguugggggaugguaguggugauacgggaucucacucuaguccuuucugcuuuggcacuuaugauguaagccaggcuggcuucacacucauagcaguccuccugccacagccucccaccuguugaguggccacccaugagcucauacacacaugaucugaugcuacgcuagacucauguacacauagaccacgcugcuaggccccccaaguguucuuacuacccacuccccauccccaagacucugguccugcacuguggaauagaaaaacacguacaggacgaggaccgugugagcuucaucuccaucuuuaauugggccauaccugcucuggcuccccacagucuagcugaguacuucugcgggaggguuucagcuacucagaaaauaggcaguuucugcagagagcggccacugcccuuccccauucagucuccucucuccuuugucaggguucgagugagccaagacgggcaguuucugcacuacaucuuuccguaucaguucauggacucuccugaaugggaaucacugcauccuucugaagaggggaccuuccagguaauaaggagccccgaggcagcacagucaccugccacuguaagcccacaacauuguuaccucucccaucaccucucucccaccugcccuuugaccgccaccaaaagugauucuaggagggggcgggaucguggccucugccuucucuucaagaagagugcuugggcuccugggucuggggaacagggaaggguaguucuggucccugacagacagaucagucauuggccuacaacucuuccaaaagacugaugcccacaggauaaaaaaagcucaugcuacuuaggguaacugaaacucuuagcagcuccagcccuccugguacacgcugcucauaacaugacccuucuauugcccuguaccugaaaugcauucuaaacaaaccaucaugcuccccagaacucuucuaggagggcuaccagguucaccucugaccucuaugccccacagcuuccugcagccgccugucugucuguuuccuuugcuuuguacugccugugugcacaccguucacuauucuagugguguggaggcaucggcaucucucugucucugugucugucucuaucuccacacuccaaaagacagucccaaguacaguuuuugcugaacugguugcccaugagcagguggugucucagaagacucugugggucacucacagccaugagcugcgggggagccugccacucauccccugcuguccccucugcagcccuucacacuuguggguguggguugcugauggcuagcauguggcacacacugccuuuuuauugccucucugaaucauacauacaauguacuagauuggauauuacuguuccucuguuugacagauagggcaacuaaggccccagaacaucauguacucagcuagggaauagaagggccaagcaagagccuggacccucagaagcaugguccgcucaacccucucagggacucugccagucaguuugcuguucuggggacuauguaucuucugugaugucuaccagagaguccucuagccagcauaugagcuauccccggaacagaugcaugccaggcaaugccacugucugggccugcuuccgcccuaauccuagcucuguggcgauauugucagagaagcagucuugcugccccugaccagcuccagucacagaaccuuugucccaucuccacccucuuugcuuugcccagaggcauucucuggggacucccucaggccaggagaaugacagaagagcccugaguggcuggaaccagccagaacaugcuguggcauugacagggaggagcagguggguuaugcucuaaaggaagggcuguuacccuagauggccucucugccuggaauguaagcaugcucguauuccaccauuuauaucuugaguguuugucucauuuagaagcaaugaguuccacacccuugcuguuggcuguguaaagucccauuuccucuuugcagauaucaaauguuguguuauaguucaucuugaccuugccucugauguagcuuuguugauuggaagaacaauucuaguuccugccuaaaucguaacucacagcucauuucacacagaucaccgcaucccaucacaccccucaagcacgcaguccaccagaucuucuggcugcuggcccugugacgcucucuuauucaucaagagcagggcacaggccaggcgcagcccacagaauucauccuuagccuccaguuugcaaccuguuuuaccugacucauguucuaccuagguaugcucucacaaagaaaaaacuuggcacuuuagcaaaacuuuacuagagacaguccuguaugcacgagggagccaaccgaaaccuagguuucugccgggcagugguggcgcaugcccguuaucccugcacuugggaggcagaggcagguggauuucugaguuccaguccagccuggucuacagagugaguuccaggacagccagggcugcacagagaaacccuaucucgaaaaacaaaaaacaaacaaacaaaaaaguagguuucuggggguuaggggcaugguacaguggguaacuguuugcuguguaagcaugcaaaacugaguuaagauuccccagcacccacaaaaaaagcagaacauggugauguguucuuguaacuccagcacuaaaaagggggagcaaauauuaaaggggguagcuaaccauaaaaguaagacaaaaaaaaccaaaacccguuauuuuauccuuuaaaaacaacggaagaagcgguaacggccuacacaggggaacgcccaugcucgcugugcuuggccuucugaacguggacugcauuuaggucaggucuuccuuaggcucaucugcucucugccugauagagaguuuuuugucugggacuugccgauaaggacauuuagggcacaggcuaugacagagugugaaagccacucgcucagccguuggugauggacagacugugaguauucucuucagaauuuucucaggaggcgauaugcccagacaugguaguaacggaugucucacagcugguacaggggcaaaccugaaaccagcacccagcuucuggcccugaugacuaauuuagggcccuguuagcgaucagaugcuguacaaaagccgaggauguaggagaggaggagggguacaguggacauggaggacgaggagugguuggaaugggaagucaggugucuauuuuuacaagauuuauuuuuaaaccagguggugguggcacacaccuuuaaucucagcacucaggaggcagagcagaggcagguggauuucuaugaguuugaggccagccuggccuucagagugaguuucaggacagccagggcuacacagagaaacccugucuugaaaaaaagauuuauuuuuaagugugugugugucuaagauuuauuuuuaauugggggggugugugugcacacaugaguacagauaccugcggaagccagagguauucgauccauuggagcuggaguuaggcaguugugagcugccugguauggaugugagaaucaaacuuagguccucugcaagagcagcaagugcucuuaaccccucagccaacuuucuagcccugggaggcaagaguuuaaggagguguauauagucucuaacagagaauucuuugaaccauauuccauaaucaguaaaaaaaaaaaacaaaaaaaaaaaaacucagagcucaguaaagguuagccucgaaggcugccuucaccacucacaaagacacacacuguagcccugucagccagaggguuguaucaggcagaccagucaagguugucuaaguuuauucucuuuucuauacuaucuggggaaccauuucauuuucaucuuagcuuugcugcucaucuuugguuuugagauagcaucuuacucugcagcucagguuacccuacaaucacuauguagcccaagcuggcuuccaguucugguccacuccuuagugcuuauaaggaaggcaugagccaccauccccagcucaucauuugaacauggauuauggagcccuacugugugccaaguacaugcugcugccuuuuuguccugcugguguaaucuaguuugcauccugggcacggugaauacacagacguuccuccauccucagauaacuacagaaggggaccuguuccauugcucccgaguuucuuuuucugugccuuuauauuccuccucgggucaugaaauccuuugguuugcaaccaagagcagauucugggaccugaaccccauuguuuuguccaucugauacaguuuggcaugcuuaaucuguagccguuucuuucaauaaacuuuucuccccaguucuacacacacacacacacacacacacacacacacacuggaaacucaaccccgggccuuacacacauggucaaccacucuaccacuaaguuaucuccuucccagaccuugauuuuucuccucuaaggugcgcaugcccugugucaggagcugaagucagucccuugcucagcugcccaacaccuucuggaaccucaauuugcauauccuaccuccucuuuucagcaguuccacugucgauaacaauaauggcuugccaaagauucugaccucaguccugacaccggccaugcacaucacagugcacacaagaagccugacccuggacuucgucccagcuaggccauagagagcuaccgugucaaaauagcagccuguuucucuacgcuuuaaaccuuucccucuccgcuccuaaccccucaggugacgcugacugcggagaccgaauguagcuacauuuccuggccccggaaaaaucuuuaccuucuucugaacagagagcgauacaucucccgccucuucucagcccugcugggcuaugacaucucggagaagcucuauacccucaaugacaagcuguuugccaaguuuggguuacgcuucgacauccgccuucccagccucuaccacguucugagucccucugccucagacggggaaccagagucugagaaagaugaugaagaagcccuugaggcagcuguguccccugcucaggccaggcccaucugcaucgugccaacacccccuuguuccgcgccuccagcaaccaccaacuuucccgugccucugccccgggccaggaugcccaggaugcccaggccggacagcggcaaccugggugaggacuccaccagucuggugcuggaggauuuugaggagguuucaggaucagagucguuuauggauuauaggagcgauggggaguacaugaggugagggcggaacuaacacgggcacagucaccggcucaggauccuacguaaguaugccgaggugaauaugccuuguuccucacacugcuuuugaaccccucagaggacucacugcuagaacccaacccuaccugugcucacagcaaaugcaugcguggcaugaaagauuucuaaaaccuacucaugauuaguugugguuacauuguggagaaugggcugauugacauuuagagcaggccaaugggcucucgucuuuugagggugggcgugacuagauuuugcuaauagcuaagacugcugcuggggccaaggagauuuuugcauguggcaugcauguauuucaagggaagcgaaugcugguaugguucuacugauuguuccuggcacacagagaguucugggaagcagcuguuuuugagucuucacuaggaaggacuguuaaaaucaaagcgacuggugauggcaggcaaauagucuggggcuaucuugcuuuccuccugcccaguggcagacagugcuggucacucagaugaggcucagacagugcuuugauuagaacauuccuaagacagauguaggacagccuggguuuucccagcagcccacacgugugggcaaguaacccagguggccuccccuugggaacaggaugucccucguagggguguguaccaggaaggcuguguuuugguaguucugagaaguugcuuucacggucuccugauugauccuucaguacuuugacauuuuccucuggacucuaccggaccauagugagggcucagcuuuuucugaggaaagccccaccauccacaaccugggaggcauuuuuaagugacaggggugcacaaacgaaacuggcacucuuagagaagcaucccccccccccagaugugacgaacuagucuggcacagaagaccuccaaggcgcacagugugaaugagugcaugcgaauuucagacaagccacauugcugaugagagaaucgagagaugaaggccaugaagaccgacccuggcuuuagagauauggauguuaucauuuccuguggaguaauccaaggcucugaggcucaggauagcuuaguguaccuuccugugcauuuguccucugucucuccacaccccguuccuugcugaccagugugagcuaugggugcuucaugcuguccagccugcuuccccaccucuucauuucacacagcacugacuucuguucuucuuuuggcucuuucccauuccugacuccugcuugucccuguugucuugguuuguggcucuaagcaucccucuugcuuacacuucacccucuccauccccaccugcccccugacuucucccguccuguggcuuggaugucuggcgaucugguugcucucuuuccccuuugccccagucucuggcuugucucucucgucucugcccuaagcaacccugugucucuguuuuucuaauucugaauccauucaaaucaaggccugaaaaaggcccaguuuuagggaugcuucccagaugucaggagacaggcaccauugaaggacacuagaacuuuuguggcuggcugcacaguaaagcaaaucuggacagaauauucgcugugacagcauuagaaauaaccuuagcaccucugaggcaucuuugucugggagccuaacucacugugcaaaauggcaggaugucuuggggucccugcacaagcuccucccaccccaggagcuucaucacauccuagaauccuaacuucuagccuugaugucauuauccccuauaaggaugauuccaaauuaucaugggaucucuccccagaaccacuguuagccuccagauauccuuguguguguccauccauguuuuauuuaaauagcggagaggaaggaaagaacaggcagguuuuacuuucaaaccacagaguguucagaaugaggugaacacauaguuuuaaguggucauauguuaggcagcuucugugugacugccuucccucccuggaaccuacccucugccaucccacccuguggaaaaagcuggcagggacuggggggugaggggggcggagagcagcacuuccaagaacucaauaacaaacggaacccgguggaagugguuuccagcuugguggcuggcagaauccuaucccaacugaggugcauccugggaggaggcugagagacggcaucuauuccugagcuucauucagacucuucccucagaaugaaagcugauuguugcggauugcuguugguauuuucugguccagcagauggcugccagugcaagcaagcaaacagccacugggcagacuuucugcucuuaggcgcaggcgcgcaggcgcgcaggcucgggggggggggggccgggggccucagcaguggcugcucugcuggcggaggcccccugugugggugagguccagggcagcagucuucucugcccagaucuuucuuccagcucugcucugccagcuucgucuucccacccgucucuuuguagaaaugaaaguuggcgucuugcaaagccuuucgaauuucaguucagggcuugggugguuuuucuuccaucauccacgucuuaguuaggguuucuauagcugugaugaaacaccacgacggccaaaggaacugcuuucccuuccuucccuggaacccacucucugcccucccacccugaaaaggaaaggguuuuuucagcguacacuuccacauugcuguucaucaucagggaagucaggacaggaacaaggcaggaaccuggaggcaggggcugacgcagaggccaaggagggcgcugcuuacuggcuugcuccuuccucauggcuugcucagccuccucucuuauagaacccaggaccaccagcccagggacagcaccagcuacagugggcugaguccucccgcauugaucacuaagacaaugcccugcaggcuugcccauagcuggcucaucuggaggcauuuucuuuauugagggucccuccucacagaugacuucagccugugucaacuugacagaaacuaggcagcacaguccaugagcaguaagcaggauggagaguguuuucuuuugagcacucaagaagaggcucugucucucaccuacagaccaagagaaaaugggccuagauaauaacaucagaagugagcccuccaugacccuuccauguccuagaaugaaagaacugaaaggcacaacugcuuguggcuaggcauuggggugcagucaaaacuggggucuaaagaggacauagaaacuguacaaggaucccaugaaaucuggcaaacccucuggagccacgcgcugacauccuucuucuguuucucuccacagccucuagacguccucuccagaacucuucucaaguuauguccagaucccaggccccucuggcuccaauucacacuccugagcucuaaggaucacagagcugucgucucuguagccagauggcacuccuccauguuccccggauggccacuuauacucucaccccuccucuuagcccuccagaaagauguguggcaagcugggggauggacaugacgugaagaaacucaccuucaggagccuuccuuacagcaggaggguccagaggcaccuggccugacuccauccuuuauggguugcaggacauugccagguuuacacggccucugagccuggacugugaggcuaggaacucacgucacaggguuguugugaggauccagugagcugauuggguagagcaccuaugacaggacauggcguccugcaagcaugcaauaaaacgcuucacgccucuccccguguuguugcuuuaaauugucugaaagaauccaaugacuuuuacccaugcuuauuuuacucccaaaauuaauuuucaauugaaauaaaaaauuuuaaaucccaauuguucccuucaacuuuuaauuuuaaaacacaaguaacuguguccuguuuaugaaucuaacauuacguuuuaguucuuaaaagcauuuuauaaaguuagccaaugaguuuuccuuccucgaauauuuaaaaauggcuuacaaguugaauauagucugcucucucgcucuuuuucucuggcucuuuauucuugauugagucaauaugucccuacuauaacagaggcuggccucgaacuugcauuccuucugccucuccuucaugaaugcuaggauuacagguauaugccacauaccuuguugaauauauuuuacuuuguuuuuccucaaaaacuucaauguacauucugguuaccuaaugcugugugacccuaccccuaauauaguggcuucaaagacuuguaauuacugguucugcucaugagguggggacuggcuggggcggcuagauguugcucacacagcuccauauggugcggcuuucggcacucacaggcuugaagcagguuucaccucagaggccucuucacucagccugucuggggccagacugagaaaacucccacagcugaggacuaaccaaaguggaggcuugcuccguuuccagggguuggcugugcugccauguggcucucuagccugucugugaguacaccaugcugucccca

SEQ ID NO: 8242 - RNA, 8666 nt, Mus musculus
ggggcacgccuuuaaucccagcacuugggaggcagaggcaggcagauuucugaguuccaggccagccuggucuacaaagugaguuccaggacagccagggcuacacagagaaacccugucuugaagaagaaaaaaaaaauggucuccauaggcucauguauuugaaugcuuagucaucagggagugguacuauuugaaaggauuagguuuaggaggaagugagucacuggaagccuguguuaagcccaggaucucucuuccggcagccaggauauccagauguagaacucucaacuacuucuccagcacugucugccuguuugcuaccacgcuccccaccuugaugauaaaggacugagccucugaaacuguaagccagccccagugaaauguuuuccuuuauaagaguugcuguggucacggugucucuccacagcgauagaacaguaacuaacauagaugcccucaggaccuccacucugcccuucugcucucgugcucuaugugaagauaaucacguuugguuugcauacaagcaagcugagaggucccagggugcugcuauaguugcuuauccuccccagcggcacuacccaucccaaugcucuggauucuccaacacacacacacacacacacacacacacacacacacacacacacacacacacacacacgcacuuccacauugcuaacgccuccccuccaauacuccugaauuauuacuuacuaaaaucuauauuccaucuuugcuacccuagacccauuggggguggggggcuggggaccacucuuccuuggcucuuacaugauuguaugcuuucucuucugcagccucaaaucuggaucuuuuuccuuuucuggcaaggccauuaugcuccacuccugcaaaagucccgccucuaucuuccugcccagccacuggcugccaggcaacuuuauuuacccauuaaagccaacuggggcaagaacccgcaccuucuuauaugcagacuugcaaauccccauguaauuuuggggacucaauuaacauaauacaaccaauaaaccaaauccacaccaccagggacuuaacagugucccugggccuuaaccaaucacgugaaagucacuggacacacacucaaggauggcaaggcaucucaccaggacaacucugaagauugccuugggcagaggaaggaaggaaguagcacagacuacaccccauggccagagaauccugcucuugacacacccuguguggccacuccucccuuccagucuugcuuccuggaauugucucccaaauaaacuccucccaaaaaaaaucuuuguuuuagucuacuugggauaggugggagacccaaucaaggaaaagucagacaaagcauuuugcacaauucugugauaaaaacaaaaacuggaauacaagguuaugagguuucugaaugggaaaagcugaccccaucaacugaaauaaaaagauucucauacacaagagaggaacucggggagaacaggguaaauguggaaaggcagggcuaaacgcauccaagggacuuguuaucucagaacucuucaaacacaaaauuaggauucuugacucucaaaaggcugaagagacugagcuucagggcuacagggaaagaaaccgccagaaacaaaccaccuucucccuagggaucuaauacagggucuucuuuugacccgagagaauacaaagcucuuccggccucuucuagccgcugucgguauucgagcuucucguaguuggcgggauuuacgccuuuaaagccguacauaacuccccaccagcagccagcaauggcggccguggaaucacugucuccaccguggaagaaggcucugugugcgagcuccuuccaggaaucccccgcggccaggagggcaucguaggcaaucaugggggcaucguguccgcugcugccaccccagcccgaguagcucacgucgauguagaacugaucccuuuccuucacaccaaagggcugcgggaagacgggagccgaguugccguccaaaauuccucuaagcuccagguacuuuucccauucuuucucgaaguaggaccuguggaggagaagucaauuuaaaaaauaaaacaaacaaacaaacaccuaaugucaaaaguuauauagacaaauaccaaguauauguguaaagagugaaaaguccagaaugacuucagcuccucacacuagugucauaaauuuauacugaaaaaaaucuaaauuaacuccacaagccauccauauaguuuuuauuaugaugguuguauaugcucagccuagggaguggcacuuucagaaggcguggccuuguuggaguaggugugucacugugggugugggcuuuaagacccucauccuagcugccugaaagcagguauucugcuagcagccuucagaugaagauguagaacucucagcuccuccugcaccaugccugccuggaugcugccacguucucaccuugaugaucauggucugaaccucugaaccuguaagccagccccaauuaaauguucuuauaagacuugccuuggucauggugucuguucacagcaguaaaacccuaacuaagacagacgucuucuacauaaaccagguauggacgccgcugcucaggaaggaaaauauguguggagcuaugggacgggaaguaaagauuuguuuuucugggcccagagcaacuucuuaccauuuuuccaggggaaagucuaauaucacaacuauagguaacuucaguaagagucucugagccuuguuucuucuaagaaagauaauguaagguaaccaauaaaaggggacagguggccuuacagcuuacuagcuccuggagaaaccucucuagggauuucaaccaaggguuuugaaauacuguuuggaacaauacuggaaaaacaaaucucagggaaguuggaaguaaccaagaaaagcucaucucagcacuggcuggucacaaaaauuacagaaagacauaauccagaauaggacuuaagagaggaccacaggugccuacagugagguauccacuuggcuguuucaggcaaccauggacggaaaggagcuugaaauacuuagcagacgccccggcagggucagguuagugagacugauggcagcugugaccucugaacccuagguacauguauggagccugugcacacauccucacccacaagucagcuaggacacacacccagagacucaccaguguugaagauucuccuucacaaaguagccugacugagugauguacuuuuuggcuucaggcagcaccuccauuagcccuuuuccccacugccauggugacuugccauucacggcauaugccguaaaaagagcggacgcaaggcugccgagguagcccguggggugguggugggucauccggccgcucucgaugcucacuuggaucagcagauccaguuggcuggggugggggaaccucagcccgaugcacauggcgcgcauggcagccccgcagccacccucgugacuguugaagggaauccuauagccgucggcccuguugggcuguagcagcauggcguucugcaugcaagcaccaccuaggggugagucggggagagcgaggggucagucaccagaacaacagacccagugcgagcacggaacuaaacagacucccagguuucucugaaaugaacggagagucauggacacaugauggggguggcuccucaauuucaaacccccaugcuggggcaugacagcuaguguuccuuauauauaauccucggugugaucuuaugaauuaacaaagcauauacguacacacauacacauucucacacacacucucacacacucacacacacacacacacacacacacacacacaccuaccuccaguuauuagagaacucacagcagcucaaagggaagcuguccuguauuaucuuuucuuuuugaaagacgagccuuccauauaaaccaggcuggucuggaauucucaugggaaugagaauccuaggcuggccgcaaacucacaguaauucucuugcuucugccuccccagggcugaggucauagaugugcacuaccacauauuguuccuuuuuaaauaagauucguaacuuaggaaacauaaccaagagcccagaaccagcgagucaguggccauggacacacacauuggcuccaaggcugaagcccucagcgugucuaauaagaaccuacugggguuccuggcuguuagaaagagccuagagguuccaaaaugaagcacugggcuuagaucaggucaacagacuguggcucuccccuaccugaugguguuagagggaggccggucccaccgaccuacuguagcggcggguagggcuacaaaaggagccgagagacagcagcagcgcaccuugggaugcaauacuacugcucccuuauugcagggcccuuauaaaccagauccgaggcugacacaggaaggcaaauaaagccuccuacacuaaguggauagcagaugcuaagacgggacgaacagggaugggccucgagagccagucggugggaccuggggugaggggaggcauucuucaacuaggaguuauuuuggccgaauuguguucauauguugaaaucugaauacauaugucgaaaccuuaaugcccagcggcuuaauuuggagacagagccuuucaaucaagcuaaaaugagccagucuaauaagaagcauauggacacacagacacaacggaugccauacacagagacagagcacguggggaccagaguugguguccaucuguaagccaaagaagagcaaagacacaccagacguaaugaugugugcuucgacuucuaguaaccagagucaugaggagaaaaugucaguuaccuguugggguaaaucuccaaccccaaaaaagcccaguucaagaaaucacaacucaauuaauuggaauacaagcuacacaccuagauugggcagaucuaccacuacacuacucuauuaccgucuaugagaucccauauaacuuacgguuucuccaagccacgugcuucugcuccauucuccucccaccaccacuaccuccucuccuccuccuccucuuccuccuccaucauccucccucccucuccuucucucucccuucucccaacuuuucagguccaccuucccucuuacugcccaaucacagcucuagccuuaauuugaaaaguuaagguggggaggagguucgcaaggcaccuguauaugugcuucacuccccaaagugagucacagccacacugagcagggcuggaaccaaaggagggucuccacuuuuuuuuaaguaauaauacuucuuuaaaaguuuuucuuuauggucauucauaacaaaaaugcagaaaauacaaacagaaggacaauuacagugaucacuuguguaacucagguagaauuaugaacauauuccuguguuugcuuccagacuucccucaauggagauaagcaacuguucuuugugugugugguguuugcacacauguccgucucucagucccuugaugcagggucuagagguagguuagggaccaggaagcuccagugacccuccaguuucugucucucuucacacacgggucacauaugugacauuuuaugugggugcugggggauuugaacucagguccucaccuccugcacuucccauacuccugaucuuucuguuuccaccucccgagugcugggauuucagauaugcaccaccacacccggcaaacucugguacuuuuaaguuacuuucacaacauguccugaaaccuauuuuuuuccccaauuucaucaauaaauccuuuccauaucucaucugcacaacacacagaacugugacuguggcaccaugaguaaguuacaagaauugaaauccacacuaguuucuguuucacugauaaugaaauguuucacgaaguuuuucuucuuuugauuuucugaaacagaaucucacuacggagccugggcugguuuugaaaucaaaguccuccuacgagugacuaauagacauauuacucuccaucuacagucuuagcgucccccuugggcccgcuucuccauccucgggaaccucccagagacuggcacucaccuggugcccggccauccaugucucccaugcagucccgguaauguuuggcuaguagggaauacagccgaggcaaauccggggacuggccggcuuccaugagggccuccgcuguggccaggugcaugacgguaucaucacugacucuccaucgugccacaucuauggcuuccaagucacccaucugggccaacugcugguguaucgucuccccaucccgaaugaacucccacuucccguugaaguagcccaagguaucuccagccgcgcucagcaccauggcagccacauaccucucaaucagccccccacccaugcugagcuuggcacaggcgggcuuauggggcaacggagacuccuggagaagagcagaggaagaugaaucggaaaacaaacaucuacacucuccccacaggcccugccuuaagccuaacccauucgaucgucuucuaugagggauuugcugcucgagggucuuaagcaagaguaagucagucaucguggagagaaugcagcucuguaaauauuaagagaacugaaucaggccacagagcuagcggggagggcugggacucuaucacagcccaaagcucgacuccaaagcuugucuccagcugugucguggucucucgaggaguggccagcccauuaaaacccacaggucaagccaggccugccaucuucuccaucaccugauauucgcuuuggaagaucucucucucuuuugugcggagagugacacuacagcuaacuguuuacagaugaggaaauggaagcuaaguuuacauaaucaauagguacagaccauggaauccgaccuaguucccugccgccagaaugcuucauauuacauggucugggcccuggccuuaacuuugggcucagguaaagugauaauggaaaaacccagauguguaaugagggaugaaugaaugaaugaaugaauuuccauaaaguacauagugagcacaacuuugugauuauuuuuauuauccaucuacaaccaauucuauaagcaauuuucccuuuaccagcaauauuuaaaaauuuuuaaaugauuuaguuuuauuuacauauucuaguuuauauucaguuuuauuuacauacucuaguuuuuuggcuucacugguaucugugugaggguguugggcccccuggaacuggcucugugagcugccaugugggugcugggaauugaaccugagccccucuggaagaacagccagugcucucaaacugcugagccaugucuccagccccuugucugucuucuauaugguaaaaguucuauagugccgggcugcaaaugcuauucccaccacaaaugaaauccuugcuaaagcccuggcuucccgguguacacauuuucuacucuacucaggccagggcuccaugacacccauuccguguggugauucaguguuccacugucugcccccuccacgcacccagccuccccaugaacaggggcaaacacucuuaggggcaaaaagaccuagcucaccccugcccucagcccaagcucuucccauccaccugucuuucuuccucuaaccgccauuuuagguuuaguucaagcccagguaccuccaccauccaucuagucacacugcucaggucuagggcacaggccagcagagaccuggagaagcaguuaaggguaaagaucuggcuuuuccaugcuugauccugauuacauguguguguguguguguguguguguguguguguguguugugugugugugguguuguguguguguguuuuauguauaaauaacggcuaggaacuagaguucuguagucucuuguguuagcucugugaccacuaacaauccucucacgcuggaguuucccaucuguuucccaucugugggggaggaaggccucguucuccgagguccuguuuuggcccagguuuucgaagcccuagcuuuguuaaccucugagaacuaaggacuaacgcccccaccuucuccucccaaugcuccagguucccuuuuugagcucuccauggaagagugugggaaccuacggaggaaguagccaguaucuuuucucuuugaaauuccuuuucaccuuggcacaugcauccauccuggcccagacccacccuucagaagucauuauuccuuaacccacucuaaacgggcacaggugacaaagccaucaaacuauacaaucaaagccgaaguacacuucgggauuucccauugguuuccuggccuggguagaaagaggaauagggagaggggaugaggggaggggaggccgcgaugcacucaggaaagucuugguggccacuuugaggacacuggccuagcaccagucuggaggugagagcgggaccgagcggguacuaaggucaguaagaggagaguggcucggggacuccuggcuguaccugcugaggcggagcugagagcguggggcgggaucggggugguccagagccgagggcaggauugcccgagcuggaggcgggguaccgggcgcaggaguccugcugugggcacccaagccaaaagccgaacaggggcggagccgcgggccgggcgggucgcuggcgcacag

SEQ ID NO: 8243 - RNA, 8666 nt, Mus musculus
cugugcgccagcgacccgcccggcccgcggcuccgccccuguucggcuuuuggcuugggugcccacagcaggacuccugcgcccgguaccccgccuccagcucgggcaauccugcccucggcucuggaccaccccgaucccgccccacgcucucagcuccgccucagcagguacagccaggaguccccgagccacucuccucuuacugaccuuaguacccgcucggucccgcucucaccuccagacuggugcuaggccaguguccucaaaguggccaccaagacuuuccugagugcaucgcggccuccccuccccucauccccucucccuauuccucuuucuacccaggccaggaaaccaaugggaaaucccgaaguguacuucggcuuugauuguauaguuugauggcuuugucaccugugcccguuuagaguggguuaaggaauaaugacuucugaagggugggucugggccaggauggaugcaugugccaaggugaaaaggaauuucaaagagaaaagauacuggcuacuuccuccguagguucccacacucuuccauggagagcucaaaaagggaaccuggagcauugggaggagaaggugggggcguuaguccuuaguucucagagguuaacaaagcuagggcuucgaaaaccugggccaaaacaggaccucggagaacgaggccuuccucccccacagaugggaaacagaugggaaacuccagcgugagaggauuguuaguggucacagagcuaacacaagagacuacagaacucuaguuccuagccguuauuuauacauaaaacacacacacacaacaccacacacacacaacacacacacacacacacacacacacacacacacacauguaaucaggaucaagcauggaaaagccagaucuuuacccuuaacugcuucuccaggucucugcuggccugugcccuagaccugagcagugugacuagauggaugguggagguaccugggcuugaacuaaaccuaaaauggcgguuagaggaagaaagacagguggaugggaagagcuugggcugagggcaggggugagcuaggucuuuuugccccuaagaguguuugccccuguucauggggaggcugggugcguggagggggcagacaguggaacacugaaucaccacacggaaugggugucauggagcccuggccugaguagaguagaaaauguguacaccgggaagccagggcuuuagcaaggauuucauuuguggugggaauagcauuugcagcccggcacuauagaacuuuuaccauauagaagacagacaaggggcuggagacauggcucagcaguuugagagcacuggcuguucuuccagaggggcucagguucaauucccagcacccacauggcagcucacagagccaguuccagggggcccaacacccucacacagauaccagugaagccaaaaaacuagaguauguaaauaaaacugaauauaaacuagaauauguaaauaaaacuaaaucauuuaaaaauuuuuaaauauugcugguaaagggaaaauugcuuauagaauugguuguagauggauaauaaaaauaaucacaaaguugugcucacuauguacuuuauggaaauucauucauucauucauucaucccucauuacacaucuggguuuuuccauuaucacuuuaccugagcccaaaguuaaggccagggcccagaccauguaauaugaagcauucuggcggcagggaacuaggucggauuccauggucuguaccuauugauuauguaaacuuagcuuccauuuccucaucuguaaacaguuagcuguagugucacucuccgcacaaaagagagagagaucuuccaaagcgaauaucaggugauggagaagauggcaggccuggcuugaccuguggguuuuaaugggcuggccacuccucgagagaccacgacacagcuggagacaagcuuuggagucgagcuuugggcugugauagagucccagcccuccccgcuagcucuguggccugauucaguucucuuaauauuuacagagcugcauucucuccacgaugacugacuuacucuugcuuaagacccucgagcagcaaaucccucauagaagacgaucgaauggguuaggcuuaaggcagggccuguggggagaguguagauguuuguuuuccgauucaucuuccucugcucuucuccaggagucuccguugccccauaagcccgccugugccaagcucagcauggguggggggcugauugagagguauguggcugccauggugcugagcgcggcuggagauaccuugggcuacuucaacgggaagugggaguucauucgggauggggagacgauacaccagcaguuggcccagaugggugacuuggaagccauagauguggcacgauggagagucagugaugauaccgucaugcaccuggccacagcggaggcccucauggaagccggccaguccccggauuugccucggcuguauucccuacuagccaaacauuaccgggacugcaugggagacauggauggccgggcaccaggugagugccagucucugggagguucccgaggauggagaagcgggcccaagggggacgcuaagacuguagauggagaguaauaugucuauuagucacucguaggaggacuuugauuucaaaaccagcccaggcuccguagugagauucuguuucagaaaaucaaaagaagaaaaacuucgugaaacauuucauuaucagugaaacagaaacuaguguggauuucaauucuuguaacuuacucauggugccacagucacaguucuguguguugugcagaugagauauggaaaggauuuauugaugaaauuggggaaaaaaauagguuucaggacauguugugaaaguaacuuaaaaguaccagaguuugccgggugugguggugcauaucugaaaucccagcacucgggagguggaaacagaaagaucaggaguaugggaagugcaggaggugaggaccugaguucaaaucccccagcacccacauaaaaugucacauaugugacccgugugugaagagagacagaaacuggagggucacuggagcuuccuggucccuaaccuaccucuagacccugcaucaagggacugagagacggacaugugugcaaacaccacacacacaaagaacaguugcuuaucuccauugagggaagucuggaagcaaacacaggaauauguucauaauucuaccugaguuacacaagugaucacuguaauuguccuucuguuuguauuuucugcauuuuuguuaugaaugaccauaaagaaaaacuuuuaaagaaguauuauuacuuaaaaaaaaguggagacccuccuuugguuccagcccugcucaguguggcugugacucacuuuggggagugaagcacauauacaggugccuugcgaaccuccuccccaccuuaacuuuucaaauuaaggcuagagcugugauugggcaguaagagggaagguggaccugaaaaguugggagaagggagagagaaggagagggagggaggaugauggaggaggaagaggaggaggaggagaggagguagugguggugggaggagaauggagcagaagcacguggcuuggagaaaccguaaguuauaugggaucucauagacgguaauagaguaguguagugguagaucugcccaaucuagguguguagcuuguauuccaauuaauugaguugugauuucuugaacugggcuuuuuugggguuggagauuuaccccaacagguaacugacauuuucuccucaugacucugguuacuagaagucgaagcacacaucauuacgucuggugugucuuugcucuucuuuggcuuacagauggacaccaacucugguccccacgugcucugucucuguguauggcauccguugugucuguguguccauaugcuucuuauuagacuggcucauuuuagcuugauugaaaggcucugucuccaaauuaagccgcugggcauuaagguuucgacauauguauucagauuucaacauaugaacacaauucggccaaaauaacuccuaguugaagaaugccuccccucaccccaggucccaccgacuggcucucgaggcccaucccuguucgucccgucuuagcaucugcuauccacuuaguguaggaggcuuuauuugccuuccugugucagccucggaucugguuuauaagggcccugcaauaagggagcaguaguauugcaucccaaggugcgcugcugcugucucucggcuccuuuuguagcccuacccgccgcuacaguaggucggugggaccggccucccucuaacaccaucagguaggggagagccacagucuguugaccugaucuaagcccagugcuucauuuuggaaccucuaggcucuuucuaacagccaggaaccccaguagguucuuauuagacacgcugagggcuucagccuuggagccaauguguguguccauggccacugacucgcugguucugggcucuugguuauguuuccuaaguuacgaaucuuauuuaaaaaggaacaauaugugguagugcacaucuaugaccucagcccuggggaggcagaagcaagagaauuacugugaguuugcggccagccuaggauucucauucccaugagaauuccagaccagccugguuuauauggaaggcucgucuuucaaaaagaaaagauaauacaggacagcuucccuuugagcugcugugaguucucuaauaacuggagguaggugugugugugugugugugugugugugugugugagugugugagagugugugugagaauguguauguguguacguauaugcuuuguuaauucauaagaucacaccgaggauuauauauaaggaacacuagcugucaugccccagcauggggguuugaaauugaggagccacccccaucauguguccaugacucuccguucauuucagagaaaccugggagucuguuuaguuccgugcucgcacugggucuguuguucuggugacugaccccucgcucuccccgacucaccccuagguggugcuugcaugcagaacgccaugcugcuacagcccaacagggccgacggcuauaggauucccuucaacagucacgaggguggcugcggggcugccaugcgcgccaugugcaucgggcugagguucccccaccccagccaacuggaucugcugauccaagugagcaucgagagcggccggaugacccaccaccaccccacgggcuaccucggcagccuugcguccgcucuuuuuacggcauaugccgugaauggcaagucaccauggcaguggggaaaagggcuaauggaggugcugccugaagccaaaaaguacaucacucagucaggcuacuuugugaaggagaaucuucaacacuggugagucucuggguguguguccuagcugacuugugggugaggaugugugcacaggcuccauacauguaccuaggguucagaggucacagcugccaucagucucacuaaccugacccugccggggcgucugcuaaguauuucaagcuccuuuccguccaugguugccugaaacagccaaguggauaccucacuguaggcaccugugguccucucuuaaguccuauucuggauuaugucuuucuguaauuuuugugaccagccagugcugagaugagcuuuucuugguuacuuccaacuucccugagauuuguuuuuccaguauuguuccaaacaguauuucaaaacccuugguugaaaucccuagagagguuucuccaggagcuaguaagcuguaaggccaccuguccccuuuuauugguuaccuuacauuaucuuucuuagaagaaacaaggcucagagacucuuacugaaguuaccuauaguugugauauuagacuuuccccuggaaaaaugguaagaaguugcucugggcccagaaaaacaaaucuuuacuucccgucccauagcuccacacauauuuuccuuccugagcagcggcguccauaccugguuuauguagaagacgucugucuuaguuaggguuuuacugcugugaacagacaccaugaccaaggcaagucuuauaagaacauuuaauuggggcuggcuuacagguucagagguucagaccaugaucaucaaggugagaacguggcagcauccaggcaggcauggugcaggaggagcugagaguucuacaucuucaucugaaggcugcuagcagaauaccugcuuucaggcagcuaggaugagggucuuaaagcccacacccacagugacacaccuacuccaacaaggccacgccuucugaaagugccacucccuaggcugagcauauacaaccaucauaauaaaaacuauauggauggcuuguggaguuaauuuagauuuuuuucaguauaaauuuaugacacuagugugaggagcugaagucauucuggacuuuucacucuuuacacauauacuugguauuugucuauauaacuuuugacauuagguguuuguuuguuuguuuuauuuuuuaaauugacuucuccuccacagguccuacuucgagaaagaaugggaaaaguaccuggagcuuagaggaauuuuggacggcaacucggcucccgucuucccgcagcccuuuggugugaaggaaagggaucaguucuacaucgacgugagcuacucgggcugggguggcagcagcggacacgaugcccccaugauugccuacgaugcccuccuggccgcgggggauuccuggaaggagcucgcacacagagccuucuuccacgguggagacagugauuccacggccgccauugcuggcugcugguggggaguuauguacggcuuuaaaggcguaaaucccgccaacuacgagaagcucgaauaccgacagcggcuagaagaggccggaagagcuuuguauucucucgggucaaaagaagacccuguauuagaucccuagggagaaggugguuuguuucuggcgguuucuuucccuguagcccugaagcucagucucuucagccuuuugagagucaagaauccuaauuuuguguuugaagaguucugagauaacaagucccuuggaugcguuuagcccugccuuuccacauuuacccuguucuccccgaguuccucucuuguguaugagaaucuuuuuauuucaguugauggggucagcuuuucccauucagaaaccucauaaccuuguauuccaguuuuuguuuuuaucacagaauugugcaaaaugcuuugucugacuuuuccuugauugggucucccaccuaucccaaguagacuaaaacaaagauuuuuuuugggaggaguuuauuugggagacaauuccaggaagcaagacuggaagggaggaguggccacacagggugugucaagagcaggauucucuggccaugggguguagucugugcuacuuccuuccuuccucugcccaaggcaaucuucagaguuguccuggugagaugccuugccauccuugaguguguguccagugacuuucacgugauugguuaaggcccagggacacuguuaagucccuggugguguggauuugguuuauugguuguauuauguuaauugaguccccaaaauuacauggggauuugcaagucugcauauaagaaggugcggguucuugccccaguuggcuuuaauggguaaauaaaguugccuggcagccaguggcugggcaggaagauagaggcgggacuuuugcaggaguggagcauaauggccuugccagaaaaggaaaaagauccagauuugaggcugcagaagagaaagcauacaaucauguaagagccaaggaagagugguccccagccccccacccccaaugggucuaggguagcaaagauggaauauagauuuuaguaaguaauaauucaggaguauuggaggggaggcguuagcaauguggaagugcguguguguguguguguguguguguguguguguguguguguguguguguguguguguguuggagaauccagagcauugggauggguagugccgcuggggaggauaagcaacuauagcagcacccugggaccucucagcuugcuuguaugcaaaccaaacgugauuaucuucacauagagcacgagagcagaagggcagaguggagguccugagggcaucuauguuaguuacuguucuaucgcuguggagagacaccgugaccacagcaacucuuauaaaggaaaacauuucacuggggcuggcuuacaguuucagaggcucaguccuuuaucaucaagguggggagcgugguagcaaacaggcagacagugcuggagaaguaguugagaguucuacaucuggauauccuggcugccggaagagagauccugggcuuaacacaggcuuccagugacucacuuccuccuaaaccuaauccuuucaaauaguaccacucccugaugacuaagcauucaaauacaugagccuauggagaccauuuuuuuuuucuucuucaagacaggguuucucuguguagcccuggcuguccuggaacucacuuuguagaccaggcuggccuggaacucagaaaucugccugccucugccucccaagugcugggauuaaaggcgugcccc

SEQ ID NO: 8244 - RNA, 4154 nt, Mus musculus
aagaaacaaauguuaaauuuauuccuaaaugcauguggauuaugauaguuauacgguuguucgugagaaacagcugaguuaauucaaauaaaauacuuggaacgaggcucaugauaaaguacucaaccauauguagccugugauauauaauauucuuguuaaucuucuguccaggggaagccaguucaucauaaaccauuugcagauggaugacaucaccuguuacugggagaaccucuugacugacuauuccaaauuccuguccuauaauguaacaagaagaaaagauuauuaucagaucguucccagacguuugaaaacugaacuguaguauccaucccaggaccagaauccugacaguggaucugagaugcucuguggugaaauaccaugaucaugaugccuguaccuugaacacuuuuggacaagccaaacauccaguuuuccuuaucauguugaagccagagggacucuugagaaagaucuaguauguguguaaugagcagaaaugaaacagcucagcucuuuggaaucaugagauaaggcuuuggaacugcauucuaaccaucguuuuccuaugaucagucacagcuugugccucgggucaucuacguguguuaucacugugaaauggacuguguccaucugaagaugcuuuguccuguuauuuggagcagaccauccaucguuuggaacuaguacaauacacaagcaacucugaaguuauuuuagguuugauucuguugcuuuauuuuuauguagaaauccuuuggaguuugugaaaaauaccacagcgauugcuuccucuggagucugaaggaggccaguggcugugcucuguuuuguaacugcauaaauucucuggcacucaggagguuuccauaaugccucaguggcaugaguaacuucugcaguuggauuucagauucccauuuugugccuucaugcccuuuuuauucucucugaaggagauuaagagaaauuucccaguccuuucaggaagcagucucacuaaagaacuaugccucuguaauacuagcacuucugaagcgagaggcaggaagaugaauucguggccacccucagcuacacaggaguucaaggagagcccggcuacaugagguccugucucaccuuuugcacaucuuuuauuuugccauuuugaauuuguagcagcaggaucagcucaguuugcagagacugcagucuucauaugugaccauaucaugaaguggcaauuuauagagcacucagcuuucgcuuuuacuccgguaugagguuauccuugggcuccagcaucaccucugaaccuccuuggcaguuggcggcucacaucuguguucugugccaccgugcugcuuugucguuacgcgccucuuucccccacgcucuguacgcuuacugauggacgagaaugacguuucucugcucuugaugucuccauuaucagcacagugccucacgcagagcaguuacugaacagcuauuggaaugagugagugggaauggauggauacacucgccuggccuaacuaaagucuauuuuuuaaacugcucgguugcuugcuccaguggggaugagauacacugugagaaaugggucaguucagauccuuacuugcccuggaguaguaaggaguaucuguuuuuaaaaacaacaaaaguuacucggcucugacucuugccuguguaccucacuguagaugguaugcgaaugguggguaacaguaugucaagugugugauuucgaaaaugguuuguauggucacacuucugaagauuucuguuaucauuaauacugguucgguccuaaacguaaccauuggcuccucauuuacuuacuauagaaaagacuacuauuguuuucaauauaaccgaauauaauauguuuuguaagaguuguacuuggugagccuggaaaagagaacccauugacccaagagaaaagugacuguggguggaaaaagugguuggguuugaugagcagaacucagcugggcugagggauaagcguugguucuagacagagaugauugaaacccuucacuaaugguuccuguuagcaaguccauguccugaggaugagagagcuguguauguuagaggguauuuugacuacauuuugacugacaguauugcuuugagacccuucaagaucagagaacagagcugggcggugguggcauaugccuuuauucccaguacuugggaggcagagucagguggauuucugaguucaaggccagccuagucuacagaguaaguuccaggacagccaagacuacacagagaaacccugucucgaaaaacaaaaaacaaaacaaaacaaaaaucagagaacagaagaggcggaguguuucucugcugguaaaggaagguaaggucugguagcuucgagaaugugggaggcugaguaagagagagaguuaagguagagcggugagauggaccaucaccaagggccuagggaaauucucgguacuagguaccaaaggcagcuuuugagucuuuggggcuaggauguaggugagugguaggacacucgccuggcauaggagcauuuuccaggaccaccuaaauggaaaagggagcugaagaguuugugaaaucuaucugguacuaaggaagaccuuguuugucucuacaggauguuggauccuggggacaucugagcuauauguaaugguuuuuaacauuuuauuuuauguauuugagcacccugucuucaugcacaucagaagggaagaucagauuccauuacagaugguugugagccaccauauaguugcugggaauugaacucaagaucucucagaagagcagccagugcucuuaaccacugagccaucucuccaauccccauagguaaaugauuuuguuaguguuugcccaaucuuugcccuguccucauucaugucgacccugauucuagaaaguucaagugcaaaggaucauuuccgggaccucaaaugugucaaagaaaugcacucagcucuucucacagcuaagcuagacagucaacacauucauuuuguugggcuuucaggcccugggacccuaaucccagugaccaccucugaaaaauagaccaagcaggcaucaagcuagagcuaggaauuggggucugaauaauucacucaacauuuaauuacuucaggcaaguggaucacugagauggaggccugccuggucuucagagcuaauuaugugacagccagggcuacacaagagaaacccuaucuuggacccuccuucccuccaaagaagauaauuacuuaacaucuacuucaugguauagacugauuggugauuccuaaguccaaauccagagaugaaagcacagcuucaguccucuugauagagaucagcaaauaggcaauuauaccacugcaguaaaugcuaaugggggcuucauucacggcacuuuccugaaccucaucuguagagaugucccacagucaacucccaaauccuauuacuauauccucaugaaaguuuguaaucaaucacuuauuuagguacuccguggaagugacuguagagcaccaccaagcuguauauucauugugguacuuuaacuagaaaagaaaaauaguaggugaaaggguuugcaaagacuaugagauuugugguaacgaccaauaacuaaauuacacaaaaugauugggaauauuuuuaccuugguaaacaaguuuuuugguuuugucuuguguugaaagaaacaggaaauaauaguuucaguuauuaaaugauaauucuagaucuuuugccuucucggagcaguaagcauacggauacuuguaguggagcccacguuauggggaaaaaaaugcccacagcugauauuucaaaaauaguuuuuaaaucuuggaccuuuucgggugcgcccuaagguuagacucugcuccgcccaggaagcuccuccggcccgccagggcguggccuagaagcgcaucgccuaccucuuuccccacugcgcuugcagugauuaaaguacuguccccuucugcguggccuucugcaucuuacaugagccaucucacuuaagccccugagcacuucaagcugagcagguccagaagaccagaguuacggggcgcaaacgccaaaggacaucacugagaugaaacgaaacggccgccaacucacuuccg

SEQ ID NO: 8245 - RNA, 3980 nt, Mus musculus
ucuuuuguuugauucuuuagcugagaacaagaggauuuauuguacacgagagagagcagaacuaguccagagugccaaagguccagggcagagguccagcaggacuguuuuggccguaagaaaggcagucauuuucccaggugaucauggcgaggugacguuccaggucuccugagacuuauuaccaacagcagcauauaguccgacagcuuguucuggugucccggccuugagcaucccuaacuucugcaggcuucgagggugcacaggcugguuuaccuggaccucugccucaucuuucuucucuugcaccucagccugcacauucucuucuuccaccacaucgcucucauggugcaggagucucaaggaagauggugcuaagaccgagccugaauagaagaauucuuaagucuggcuagggaauauaacucaguagauagaguacaggcuagcauacuagaugcccuggguuagaucucagcaaacccuugaaccuugaugguggcagaugggcaugaaauuccauuauaccagaaguagaaucaggaacagacauucaauucaacagcaacaaaacagcagaaaaauuggggcucucaaaucugaauuuguauuauauuaagugguucucccugccuucagugcacuagugauggaacccagggccuuccuuccacauguuauacaaguacucuaccauugagccaaauccucagaccaggaauauuauuuuuauuuuuccuaaauauucaugaauuaauuuucucaugcauguugaccaaguauaucaauucuuaaauuucuugguauuuuuauuuuuaauuaguuuuuaaccauauauauggaauauaauauaguuuuuuuuuucuuuuuuuuuuuugagacagaguuucucuguguagcccuggcuguccuggaauucacucuauagaccaggccggccucaaacucagaaauccgccugccucugccucccgaguaccgggauuaaaggcgugcgccaccacgccgggcuaauauaguauuuuaauauguguacauuguucaguuauuuaaaugauuuugguuuuuaagaacuguugacauaucccucucaagcucucagcuuuguagaagacgacuugauuauacagcuucucuuucuauaggagugcuuuccuuuucccuuccuaugcccuuuauugcuuuaccugaccuuagucuccugucuuuuggcuugaaguucaaaaaagcgaaagcugcagagaguaucacaagcaugaacuucucugucaauacuuuguuuugaaacaagcauuucauuggcuugguuaguggaacaaguauccacuuuccuuggagaacuuuuuauguccuuuaaaguuuugaauaucaugugaguuacacaugcuuucacccuuuauuuugacugaaggggaacaagaauuuuucauuuguuuagauuagagucuccugguuuuaugagauucaucaguaucuuuaauuuccacauuuacggcuaacugacgagcgguagcuguggcgcucccugacccuuuccauucaagucauacuguucuucacuauucagaaugggcaaugccggacgugguggcgcaugccuuuaaucccagcacucaggaggcagaggcaggggcaggcggauuucugagucugaggccagccuggucuacaaagugaguuccaggacagagaaacccugucucgaaaaaccaaaaaccagaacaaaacaaaaaacaacaacaaaagccaaccaaacauucuuuuccuuguuguauaaauaagagucaacuuuuagaucuccagcuaguccuucgaaauucuucucacuguggauagcuaagcucuuucuaaccuguaaacaagcguggucagaagacaagaagacagggacuagcaguucuaacucuguuuuuuaaaagaucuuuuucucuuucauacuguacuggucugcugacuuccuuuuuuuuuuuuuuugguuuuucgagacaggguuuuucuguauaguccuggcugauccuggaacucacucuguagaccaggcuggccucgaacucagaaauccaccugccucugccucccgagugcugggauuaaaggcgugcgccaucacgcccggcugcucugcugacuucuuaaguguuuauaucugcagugaauuaaggaaaguauuuuuuguccucaggacuaugaacuaguagcuaagauauaaaucuaggugcaaaaauuaugugauggaauuuaaaaauacaauaauaaaguuauaguuaaguuugaugaagagagauguaccagcuuugaguuagaauaaaucucacagaggguaaguuugcagcauuccccaaaggcggcccuuucucuugugcccggggagagcacaugcaugcgccaugugccauguaugaaggucagaggacagcuugcaguaguuuuguuuuguuuucuguauggucccaguguucaaauccuggcaccuagcaccuuuacccaccaagcuagccucccaacuagguauuuuucccccuccucuuuuauuugugauucuauagaucuaacccagauaauugguacaugccaaguuauuucucugucacugagguaggguuucccucccccagccccuuaaaagucuugaagaaugaagcugcuggugguggcacucaccuuuaaucccagcacucagaaggcagacgcaggcagaucucuuaaguuugagaccagcuuggucuacagagugaauuccagaacauccaggguuacaugggaaacugucuuaaaaugaaaaaggucuuuuuuuguuuguuuguuuguuuuuguuuuuuuuguuuuguuuuguuuuguuuuguuuuuuuugagacagaguuucucuguguagcccugucuguccuggaacucacucuguagaccaggcuggcuucgaacucagaaaucugccugccucugccucccgagugccgggauuaaaggcaugugccaccaugcccgacuuaaaaugaaaaagucuuaaagaaugaguaagaaaaccuucaaaguuugucaguaagugugggugugaaguuaaggaagguaugacgguggguacaguguauuuaaagggaacgaguccacagaaagaauaagacaugcaucccagauagcucauggcauggauagcauguguggugcagguagacuaacaaguuugacuguuauaucuuugacagugcagaacuauuuaaaguuuuuaagaguaauuucaugcugggcgugguggcccacuuagaaagacccuugaaggaaaaguagagguagacuugggguuuguuucagugauuggugaaaguugauaaaugguugaaccaagaugguucauugagagggaaagugaggcuaaagaaaauuuuauaaaguggagcgugguuggauacagagagacagaugauauguuauagcuuagaugguuuuuaauuuggguagccagcagaauaagcuguggacuagugucaggacuacgcaguagguagcauggauuguguaaugagacuaaauuuaaggugagcucuggagaaauuuuagucucacccgggagacagugguaagacacagcuccaucuuaaaucacugguacaguguaugggaugaggaggagcuaggaaagccagcaguagaggcagauggaggagguaguagggcuuuuuaugugguguaacaccgaaggcuaucacugaguaacuguaauuucuuuuucaggaaugguaaugcuauuggccuuccagucccacccaccacagccuuaauuaccccagguccuguucgucauugccaaaucccugacuuaccaguagaugggagccuguucuuugaauuucuuuucuucaucuaccugcugauuguucuguucauucaguauaucaacaucuauaagacgguguggugguauccguacaaucauccugcuucuuguacuucacugguaagucuucaggugccuuggagcu

SEQ ID NO: 8246 - RNA, 3980 nt, Mus musculus
agcuccaaggcaccugaagacuuaccagugaaguacaagaagcaggaugauuguacggauaccaccacaccgucuuauagauguugauauacugaaugaacagaacaaucagcagguagaugaagaaaagaaauucaaagaacaggcucccaucuacugguaagucagggauuuggcaaugacgaacaggaccugggguaauuaaggcuguggugggugggacuggaaggccaauagcauuaccauuccugaaaaagaaauuacaguuacucagugauagccuucgguguuacaccacauaaaaagcccuacuaccuccuccaucugccucuacugcuggcuuuccuagcuccuccucaucccauacacuguaccagugauuuaagauggagcugugucuuaccacugucucccgggugagacuaaaauuucuccagagcucaccuuaaauuuagucucauuacacaauccaugcuaccuacugcguaguccugacacuaguccacagcuuauucugcuggcuacccaaauuaaaaaccaucuaagcuauaacauaucaucugucucucuguauccaaccacgcuccacuuuauaaaauuuucuuuagccucacuuucccucucaaugaaccaucuugguucaaccauuuaucaacuuucaccaaucacugaaacaaaccccaagucuaccucuacuuuuccuucaagggucuuucuaagugggccaccacgcccagcaugaaauuacucuuaaaaacuuuaaauaguucugcacugucaaagauauaacagucaaacuuguuagucuaccugcaccacacaugcuauccaugccaugagcuaucugggaugcaugucuuauucuuucuguggacucguucccuuuaaauacacuguacccaccgucauaccuuccuuaacuucacacccacacuuacugacaaacuuugaagguuuucuuacucauucuuuaagacuuuuucauuuuaagucgggcaugguggcacaugccuuuaaucccggcacucgggaggcagaggcaggcagauuucugaguucgaagccagccuggucuacagagugaguuccaggacagacagggcuacacagagaaacucugucucaaaaaaaacaaaacaaaacaaaacaaaacaaaaaaaacaaaaacaaacaaacaaacaaaaaaagaccuuuuucauuuuaagacaguuucccauguaacccuggauguucuggaauucacucuguagaccaagcuggucucaaacuuaagagaucugccugcgucugccuucugagugcugggauuaaaggugagugccaccaccagcagcuucauucuucaagacuuuuaaggggcugggggagggaaacccuaccucagugacagagaaauaacuuggcauguaccaauuaucuggguuagaucuauagaaucacaaauaaaagaggagggggaaaaauaccuaguugggaggcuagcuugguggguaaaggugcuaggugccaggauuugaacacugggaccauacagaaaacaaaacaaaacuacugcaagcuguccucugaccuucauacauggcacauggcgcaugcaugugcucuccccgggcacaagagaaagggccgccuuuggggaaugcugcaaacuuacccucugugagauuuauucuaacucaaagcugguacaucucucuucaucaaacuuaacuauaacuuuauuauuguauuuuuaaauuccaucacauaauuuuugcaccuagauuuauaucuuagcuacuaguucauaguccugaggacaaaaaauacuuuccuuaauucacugcagauauaaacacuuaagaagucagcagagcagccgggcgugauggcgcacgccuuuaaucccagcacucgggaggcagaggcagguggauuucugaguucgaggccagccuggucuacagagugaguuccaggaucagccaggacuauacagaaaaacccugucucgaaaaaccaaaaaaaaaaaaaaaggaagucagcagaccaguacaguaugaaagagaaaaagaucuuuuaaaaaacagaguuagaacugcuagucccugucuucuugucuucugaccacgcuuguuuacagguuagaaagagcuuagcuauccacagugagaagaauuucgaaggacuagcuggagaucuaaaaguugacucuuauuuauacaacaaggaaaagaauguuugguuggcuuuuguuguuguuuuuuguuuuguucugguuuuugguuuuucgagacaggguuucucuguccuggaacucacuuuguagaccaggcuggccucagacucagaaauccgccugccccugccucugccuccugagugcugggauuaaaggcaugcgccaccacguccggcauugcccauucugaauagugaagaacaguaugacuugaauggaaagggucagggagcgccacagcuaccgcucgucaguuagccguaaauguggaaauuaaagauacugaugaaucucauaaaaccaggagacucuaaucuaaacaaaugaaaaauucuuguuccccuucagucaaaauaaagggugaaagcauguguaacucacaugauauucaaaacuuuaaaggacauaaaaaguucuccaaggaaaguggauacuuguuccacuaaccaagccaaugaaaugcuuguuucaaaacaaaguauugacagagaaguucaugcuugugauacucucugcagcuuucgcuuuuuugaacuucaagccaaaagacaggagacuaaggucagguaaagcaauaaagggcauaggaagggaaaaggaaagcacuccuauagaaagagaagcuguauaaucaagucgucuucuacaaagcugagagcuugagagggauaugucaacaguucuuaaaaaccaaaaucauuuaaauaacugaacaauguacacauauuaaaauacuauauuagcccggcgugguggcgcacgccuuuaaucccgguacucgggaggcagaggcaggcggauuucugaguuugaggccggccuggucuauagagugaauuccaggacagccagggcuacacagagaaacucugucucaaaaaaaaaaaagaaaaaaaaaacuauauuauauuccauauauaugguuaaaaacuaauuaaaaauaaaaauaccaagaaauuuaagaauugauauacuuggucaacaugcaugagaaaauuaauucaugaauauuuaggaaaaauaaaaauaauauuccuggucugaggauuuggcucaaugguagaguacuuguauaacauguggaaggaaggcccuggguuccaucacuagugcacugaaggcagggagaaccacuuaauauaauacaaauucagauuugagagccccaauuuuucugcuguuuuguugcuguugaauugaaugucuguuccugauucuacuucugguauaauggaauuucaugcccaucugccaccaucaagguucaaggguuugcugagaucuaacccagggcaucuaguaugcuagccuguacucuaucuacugaguuauauucccuagccagacuuaagaauucuucuauucaggcucggucuuagcaccaucuuccuugagacuccugcaccaugagagcgaugugguggaagaagagaaugugcaggcugaggugcaagagaagaaagaugaggcagagguccagguaaaccagccugugcacccucgaagccugcagaaguuagggaugcucaaggccgggacaccagaacaagcugucggacuauaugcugcuguugguaauaagucucaggagaccuggaacgucaccucgccaugaucaccugggaaaaugacugccuuucuuacggccaaaacaguccugcuggaccucugcccuggaccuuuggcacucuggacuaguucugcucucucucguguacaauaaauccucuuguucucagcuaaagaaucaaacaaaaga

SEQ ID NO: 8247 - RNA, 1422 nt, Mus musculus
cuaccucugcuucccaagugcugggauuaaaggcaugcuccaccacugccuggcuaccuuuucaaauguaugguaauuauuauuaucucugcucuauacacugcuuuucccucaacucuuuaguaaagcagacaagugcucguguccuaguuaaccuuuguuuauguauuucaaaguauccacucuauguuuuaaaguuacauagguuuggggaaguauacaguguuuggcauauaggauaguuuaacuacuauaaacuucuucuuugccuuaucuagucaaucuuacccccccccccuucccucaaacuccuacuaaccaaccaugcuuuuccugcuuuaccguuuuugccuuucccacagugagguuaguagaacugugaaguaugcaauauucucaaacuggcugccuucacuuauccauaugaacuuuaggcucacgcagaucuuuugguaucuucauacaucacuugcuuuuauuguugccugguauucuaaguuaauucaucaguucuaagacaucuugcuuacuccuauucuuuguaauuuaggaauaaaguugcuauaaacaacugugaauauaaacuuucaagucaguuagguaaagauguagggacacaauugcuggaucucguaguaagaguaacuuugugaaaaaugauuaggugguauuccaaaaagguugggccauaauggcacagauuucuuguucugcauccuugccaguguuguguuguguuuggauuuuaaccauucaaauagguaaauuagggugucucauuuguuucaauuuguaguucucacgugauauaugacauugagccucuuuucauaugcauauuuuccaucucuaucauuuuugaagaaauguuuguuuggaucuccucuaaauuuccguuguuuucuuauugguauauauuacaauuuguauguauauuuugaauaccaagccauuuguguaauuuauguauauucaugagucugucacuuuaaagacuaauucuuuuaauaaugucuuuuauaaagcagauuuaaauuuuaauaaaauucuauuauuuuuuuuucuuuaggaaacuuuucauuagcuuuauuuagacuauguauguguguuuguagguguguacacaugcacauauaugugccacaucauauuuauggaagucagaggacaucuucuagcacucauuuuucuuuuucuaccaucuaaggaccaggggaugaacucagguugucagguucgcuggcaagagccuuuacucauuaagucaacucaucagucugugguuuuguuuuguuuuguuuuguuuuguuuuguuuuguuuuguuuuguuuuguuuuagugaaucuuggcuuugguaccuuaucaaagguucauuauuaugcuuaauguauuuuagaguuuuuuuuucucauauuuuccaga

SEQ ID NO: 8248 - RNA, 5084 nt, Mus musculus
gaaaagagggucaaaagcaggccaccgacacauggauuccgagaacuacaggauguuccagcccugggucaucaccgcucuccugaccacacccugacaccaccaaguuccugcuuccccguguagcugucaaaagaaagaauuucuauugccccuccucccauaaguacuucuccuuuugcuuguauugcccugccccucccacugauaaguaucuguacuucccccuuugcuugugcauuuaaaccuuggaccuuucucaauacauuggggucuugauacaacuucagaacgguuuccgugucguuauucguacaagacccucgucucucucuaccccccauuugguuauuaggaggagguccccucgagauccucgaauaacuggaccugcuggaugggucaaguggcgcccgacguggggcacgagguacgacugcccuccggacaacggauuaaggauuaaagagguaccgcgcagacagagaaacagugggacaguccaccgacacuucacucgagugucgaguacggacgucgggagguaagccuaggcauucaguuguugucccauuaaccauggggcauuuagugaagagauaaaggguucucuuaaggagagagggauaagaguuuuaaaaaaaggggaauuuaauaauauauuuuuguuuuguggacaagagauguccauggcugguauuaaaugguucugaaacuuagaauaaaguaggcaaagaaaucaauaguuuaauaaaacaaggagaagauguccaugaguccuuuuuuaguuauuggggaaucaucagagaucuccuugagcaggcagaaaagggcggaaaaggugcucgccucuuagcccuuacugaagauuuuuuagaaaacucccaaucgccaucucgcaaaagcaagacuaagccgccugcgcacaguaucucuauuagaagguuuagcagaaggcuacuugguacccaauaaauaaaauaaaguuauucagucuguccucacuagaggccaauauuuaacuugaaagucagaguuuguggaagacagccuccuggacugcugacaaaaucuguuguuaaggcaauuucgcugcagacauaaaacaauuagggcucuccccugguguccucgcccagacggcacaagcggcccugagagcuuggcgcacugucccugcuacaggggcacuaacuaugccccuaaccaagauuauacaagggccccaagaguccuaugcgcaguucguugccagauugcaggaagcagcugagaaaauuuugggaccugagggucuguuaguccgacaacuugcucuugaaaacgccaauucagcauguagggcugcucugagagguaaaaccaagaguuuagauauaaaugguaugaucaagcuuuguaaugagguagauguguuuucucaacaaguuucuaagucuauuaaccuggccauuggggcugcucuaacuccagcuccaagauuggugccaagccccauuggcccaaguuaaaaguagacaucuguguccucacauuggguauagaugccgccuggggcaccccugauuauuauaugccucaauuaacagcaguuaacacagguaaauuugagcccccuccucaaaagacguuuuuucucaucaucggccgaguguccagacuuuuacaaggccuaauggugacuccuacagugguugacaccgacuaccauggggagauaaaaaucuuagucaccgccacgcaggaaccacuuacccuuagggcuagagagcgcauagcccaagccuuaccacucccacuauucggccauuucccuuauaugaaagaggagcgaggaccuuccucuuugggauccucggaagucuacugggcacagaaaauaaccgauucauggcccaugccgacuuuguuucuagaggacaaacaguucaaagggcuccuagauaccagggcagaugugacaguaauucccucaacacauuggccugcagccuggcccuuacagcccacuaagggaugguguaauccacugaucauaaaauuuacugcuaagaggaggaacuuagaggcuugagaaaguucucggcucucucaccuggggccuaagauuguaucaagauaacuaugacaauggccugaccuuuaaaaccaucccuaacaaucauaaaggauccauaggacuuccaggcacccgccccccuguuccugccccagggugugcuacgacccuguuucagcccacucucccugcggggaggccccccucuuccacugauuuacuguggucuauauugaaugcuucugcuuuagccuuguugcauaagacacaaagagauaaugcgucagaaucugaagauuguuggaugugcuuuucugcuucccugcacuuuuaugagggcauagccuuauuugaaaauuuuacccugcuuucagacgcuaggcagcuuccccuugagucaguucagcuuaccuugacagaacucucugggguaagaaguuguguguugggcccaggcaugcuucgaggcccuugcuagagauuugcaauaacacauuuauaguaaauaaaaauggguuuuaaagagacuucguaaaggucaaaaaauucauagauuagguuuuauuggaaguuaagaaaucauuuccuaaaacacauauaauucauuuugucaaugguguuuuuguugguugcagaaaauagagagcguuuuuacagauggcuauaaaauauuuaacuaaguguggacugauaauggcuucaaaaaagauuuagcaugguaaacuuuuaggcuauuugagacauuuaguguauagagauuguguguuuucucaaaaauuugcccucagauuaaauaaauuaaaaguuuuagaugcuugccagaaacuguuagaaaauuuuggauuuuaaucuugguuugacaagcuaccucuucuuacaagcaggaaaggaaagaaaggaauaaaagaaaauggauuuuagaacucucccagggacagagagaaauugggggacgcccuguuuuauucucucuggccccuacaggagaagcucucuacccucuuucuauugucugguuggugcaccaaucacgugucaauucauguauguuuucuguuuuguugucugaaugacuguuucauugucugaaugacuggcuguuuuauguuucauguuaaaaagaaaagaaaaaaaaaaugguuaaaacuuuaccugcugaaucacucucaguuugcacaacugaggcugagaggcccuucccuuuagccaaaaucaagcacagcaagagagguccugcugaaaaacuuagaaucuacaaccucuuaguucuaaggcaaauaagcugauaguuguuuuuuccuaaaaaaaaauucucugcaauuuugugauuauuguguuuagcaaaugacaaaguguguuuuuaucuuauaaguauaacuauaaaaaguaaaagucuuuaauugaacuaaauuuauaagauucguaaagccacuucauuugguuuuugauugaucuuaaagguauaaauaugaucuacauaucuuggccauagagaauuggcuuauaaguuauuuggguaugauuaaaaagguauaacacugguuacaaaguuagcuuaaauaauaacucaaggcuagagucauuuucaaacaaaagcaccuggcauaaaacagcccagaaaacuaguccucuaaagauacuucuaaauugagauaaaauuuuguguaauucuuaucccagaaaguagacuuauagagauaagauuuuaaaacaaugucucuuuaauagaacauuaaaauuuacacugucaugcauucauaaauuagcagccaaacuuuguaacauaauagugauguuucuaguauugacuuuaaagaaaauaaauuguuuaaaauugggucuuacuuuucaaaguuauagauacauucuaauauuacaacaaaaacuuaaaaauuaugguuuaaauugccaguguuccauugacugcagcuugcaguuugauuacaaauuuaagaucuuuaauucaccuguauauuguaauuaagauaauuauaagaguaaucauccuuaagaaagaguaucaaaaauuagaggcauagacaguuaaauuguuccucuaaaacugguccuuauuacaggagggccaagaugcucagauuaaaaaauauucuacguuuaaguuaauguagcccagagaagcuuauagccuucuuuuauuuugcaaacagugccuaagaaaguuuuucccuguguucaagaaaaguucuuuuuagcuuuguuacagaucuauucaaauguuuaaaauaaugcuuaaauucaaagaguuuuacuuuuagugaacuggugaucacuagauaauuuugccuguagguauggcuaacauagcuuuacaauauauacaaaauuuuuauugucugcuucaauacaagaaacaaaguuuaaaucuuucaguguauauuguuuccuaagugaaaaaaaguauucuauuagcuaaugccuccaaagagaaguuuaaaguucugaaaaguaauuguugcuccauaagacuuagaggcaacauauuuuuaauauuuaggaucuuaguuacagaaaaucuaagaaagaaaaauuuauuugcuucaaaauuuuuauuuucaaaaccuccuaaagauguuuugucaacaauuuaauguuacacauguuacugagauauuuuauaauucucaaagacaagguauuguaaaacuuuaaaaacuauaccuucuuuaaaaacaaagaaggggggagagaaauuauauccccguguacauuauuuggaucacauauuuguuuuagaaaaacuggauaaaauagugucuagggcagauaaaaaggauccacuuauuggcacuugccaugauccuguucagauacuuaauauggggaaaaggggaaauguuucuguuuuuuccacagaaugcuacaagagcaugcuagcuuccaauaugacaggcagaccugugaccugugagugcccugacaguggugaccaaaaagcugugcugagugcacaaaagaggagaaaucggagagcauccacuuacaaacagauaaagaaacuucguau

SEQ ID NO: 8249 - RNA, 14759 nt, Mus musculus
cggagcggcgaccgggggcgacuggcucgcucggcaggcgcgcgcaccggcggugcucacaggugggcgacuccgcccggcacucccgagccugccgugcggggucgcaggcucagccgcgcccaggggagucgguccuccucccgguccccgccucugucgggagggcagguaacuuccccgccaaggucauucuccaggcccgcccacgcccucggagcggcggguucggagugggcuggacgggcgaccucggggcugcuggggcuccuggcauccccgggccggugggugguugcagcgccagggcgucgcugccugcaccugcgagggugaguuuccacggcgcgcagccuugggguggggacagcccggcccuuugagccggcacccucaggugaacugggccgcccuagcucugcugucccgggccgcguggucggcugucgccaugggaacggcuggugcccagauguugcuagccuagcugggaaggggaggggaaggugcucagagccccagaagucaaggaacccuccugucaggccacgcggagcccgaaaagccugaugaaagcaggacccuuccccccuuuucauuuuuuuauugcucaggcguuggcguuaaugagaagcaaggauguguuuacaggaugugaguugaguucuugccaccuuuaccuucugugagcuucuuaugccucauggugacagguacaaauccguacacuaaagggcaauaugaagccagucaaaaaaaagaaaaccgaagaaccugaauuggagccccugugcuguugcgaauacauagaucgaaauggggaaaagaaccacguggcugccuguuugugugauugucaagaccucgaugaaggcugugacagguaagcuuacaguuuccagaugcugaccccacugguucuguugagaccuacauauguauauauauuccuucagguuugccguccagaaugcugagguuuguucuugcuauuccaaaggaucuaaaauagaggauugguuuuuugcugucaggugugaggauuuuaacaguuuucauuuuaaaggaucauggaggauaguaggguagauuagauguauauaagaacgcaauccagcacacacacugcaaguuuaaauggacacuccagaaaguucuguauuuucagugaucuuaguaggacccaugcaugggguuguucucacguggucacaugaacuugaaggguaaaagauagcuucucuguucucaguucacccuguauuuccagagagagaggccauguacaccuuguggggagugacuguuuuucuguguguagcaacacaguccugguuggaauauugucuuaucuuuggccuuuacuuuuaccacaaucucagcgauggagauugcuaucuaaaaagagaguuuuuaaccucuguuaaaaccaguuuguaucaagcagcaauaaacugcuuuuagccauuuuucuaaauauauauauuuuaaacaucugcuuauggaaggcauaaagugauaggaagagggauguuggagacaagcuuuucccagaaauugucccuucuggcuacacagucauggugacuguagauuguuaaucaggccaagaacagcuuugcauggggaccacugcagucuucugucacucuugacugguaaagcccauuaccucuuuguuccuugucucuuucuauaguauuucuuuuuaaauagguagccuuaaauauagcuucuugagacuuagucuaaaauccauccugaggaaaauagagcacuuugcacuaaggaauggagaguguaugccaguuccauaauggccaucauucaggaaggaccauggcuuugccacuaacuuugcuaacucuuccucucuccuagcccuuggggccugagcuguccugaguucucuccucugcccuaucuuuuuuccuggagacaggcugcccuguucccaccacuccuacuacucucugacuccaggugauaucucccauucacuuuaaggugugucgugccuuuaaaaaaaaagccuacaguuauuuuuaccuaaacuaccuuuucuuucucgccugucuuaguccacuuaggcugcugcaacaaaauacuucagaguggguacauuacaagugauggaaguggacugucuacgguucuaaagguggagaaacccaaaguccaagugcuggcagauuuaguaucuaguguggccccucuuccucaugggugguaucugcucaguguauccccacccagcagaauggaugaaaacccugccuuucuuggucuucuuuuguguggauguuaaucucauccacaguguguucuguugaccucacacuucccaagagccccaccucugaauaagauugcaccgagaguuagguuugaacuacaugaauuuuagccacuaauauuggaucauuugcagucuaccucugcccccuccaaagaaugucuucacaugaaaaacauaccccguaccuccuaacaaccuccaauauuuaaucauucaaaugucagcacagacaucuuaaguuuccagaguggucuggguggcaucgaguaaaucagaaaugggugaaacucaugaaggccucugcaugaagcugugggccugugacuaacaggcuguuggcaguagagagguuaggagugcuucuugcucuugcagaggaccaggguucaauucccaacacccacgugaaucuacaacugccuguaauuccagucccaagggagccaacaugguccucugaccucaguggguacgaggcacacaugugauacaugguauauacauguaggcaaaacacuguacacauaaacuaauaaaaaguaaagaagaaauaacagacugugaacuuucaaaacacaauagugggacauucuuugaaagacauucccagggugggaaagagaaaugagaaaaggaauggcacaucccauacccacaggacaaaugacaugugugaugcaaauauccuaccuuccagacacagugcugagcuagaaguauggcuuugcuccuacuguagcucucaugcauuggagucuugugguugcacagagcuuguggguggcuggcuccaccauccuggguccuggucaguucuuccccuacagcuuuccuaggcauugccuggugaggcucucugcaguggucccauacccacugguacacaaggcaaugcccucaugagggcucugugguacuucuuggccucagccuugacauucuuugggacauuguuugacauccacguggauagaguaaugccuccacagcucuuguauuuuuuggggcuguagaacugggagcaaaugaugccacccacauuuaccgcugaugcccuugggaguagaggccucaguaguuuacauugcaccugggaguaucugugggacgaggaauguggggaacagagauuugaugugguacuagggaguggguccugaaguuucaugggcguucugagccauuuucugugaaaccaugcugccauuguguaccuggcauuggaggcuucugccuggagcacagucacacccagagcuuuaaagggucauccuccuguggucuuggugcauaccccagggcccauccauacugaucucagaugcucuccuccacacaggcuugcaguuacuguaaagacagguucagaggccaagaacuuuccaagucuucaaguuauguuuccccuuugguuauacauuuuuuuucuuuaaagucaguguauguguguuauauguauuguguguguuucugugcacacacacauaugugcuccuggugaaaguguuugaugucaagugacuuucugaaucguuucucugccuuauuuuuugagacagagccuuucagugagccuagagcuccuuuauuuuggccagaguagcugaccagcaaguuccuggaaucccccugucuauuccccucacuccccacagcacuagacucuaagugcauauccccacgccuuuuuauuuuauaacgcaugugccugaguaugcauguguguuccguggcuuugauguguaggucagaggacaaccugccagucgguggcccgugaagacugaacacaggucgucagccauggucacaagcaccuuuauccaccgagucaccuugccagcuccauguccaaauuuucacacgaguacagaggaucugaauuugucccucuugcugucauggcaagugcuuugccaacugagccaucaaccuaggcccuaaaguaguaguuguuguuacuguuguuguuuuuacuguuauuauguuauuguuuguauauguaguuguauauaggccagagauugucagaugucuugugaaauagauccccacccuaauuuuugagugaggguuucuggagcuagcaaacugggcagguuggguagccagugagcucuggggagccacugcucucucccuagugcuggggucacaaaugcuuauuagcacugugccuaccguuuuacacggaugcuggaaaucuagacucucggccucauguuugaacagcaagcaucugcccaccagaccuuuucccuagccccuccuuccuuuacucccacuggagccugcguccaggagaaacugugcagccccccaacacuuuaguuaauccucuguucuauugcgccucaguccuaccuccuaaagaacacuaggaccugaacacaguucaacuaccugcuucauaaauggcguucucugcuauaucuucaugugguggaagaguuuauaggcuccuggggccucucuuauauaggcccuaaucccauucaugaagauucuccugugauuugugaccaaaucaccucuuacaagaccacccuccggaagucucuccauauuguuugcucuggccuugaauuacugggcucagauauccuccugccccaggcccucaugcaacugugaaugaaggugugugcuaccacaccccacagcuucaccucuuaguacuuagguguugagaauucuguuuuaaaauuggaacacucaauagcagcaugcgucccugcaaagucagcagaccccauccuguguagucaucagacuuauuuuaguuugcacuucauuuuugcucaggcagacuccugucuaggacagccugguucacucccagggcacaggacaggcuuugaaugcaccuaccucucuucagugaagcacucccuuccauugcuaagugaccaucaagguuaaguacagcccacacccucccacuaagcaccuuugaugucuguccccugagcuuaagaccucccuggaagaccauuaccgcuuaccuaaugccuuuugaauucucacugucaagauuuuauuuuaaagauucauuugaguguacaccacucaggucuagacauuuguccagaauauguguauguagccguguauuuaggaaagauggcugauaguuaacauuuauaagcauugucuuccuauuuuaaaaaaugauacaugaaucugaaaagcuuguguuuaguacugugagaauaaaacgcuggcuuuugcugucuuaccauuucugcugcuguuugacauuuggggcccuguagguuuucauucaccagauccacaugaagcacacucuguucucucugaauagauggcuuaccugucaaucacuucggccggagacuugcgaaagaaucacggauacaauuucugaccgccuccgaauuccuuggcucagaggagccaaaaagguuaauauuagcaucgucccuccacuugugcuuuugccgguuuuccuucacguggcuuccuggcacuuccugcuggggguggugguucugaccucccuucccaugcuggcacucugguauuacuaccucacucacagaaggaaagaacagacgcuguuuuuccugagccucgggcuguucucacugggcuacauguacuauguguuccugcgggaaguggucccccaagggcgcguggggcccacucagcuggcccuccuaaccugcggguuacuucugauacucuuagccuuguaccgagccaagaagaauccaggcuaccucagcaaugacaaauccccaagcaacagccaaauugaaugcccggucaaaaaagggcaggagaagaccaaaggguuccccggcacagacgccucggggagccucaacaaccgcacacugaaggacgauguuagggguuccuccaggguggggcuugacagcccugccaaagugaaggaagacuggugugccaagugccagcuaguacgacccgcccgggcauggcauugccggauaugcgguaucuguguacggagaauggaccaucauugugucugguauguuggaaaaaucuggauucccagaaacuaacuaaauccacauccuagccauuucgaucuucuuuuaugguguccuaaaaugucucuuccccaguuuuacaccuuguagauauuuguaggcugugaggacguucccgcuuagucaucggguuugugagucucucagauuuagugccuucagucauuuccugaagauuaguagaaaaacuucgggaggguuuuuuuuuuuuuuccuuccuuucuuuuucuuuuucccuuccaauuucccuuuaauugguuuuaaaaaauguauuuagucaggaacuguagagauggcucuguugguaaaaugcuugcucugcaagcaagagguccugaguucucuccucuacacccucacaggaaggccaugcucaguggcacgugcuuguuaucccagcacugugaaggcagagacaggagcuugcuggccauugcaucuaacugaauuagcaaguuggcaaguucaguaagagacccugacuaauaaaacauacuguagaaaaugauuaagauaccagcaucaaacucuguuuccacacgcaaguguacacacacacacacacacacacacacacaacacuauagcauaauugguauaggucuuuuccucuguuucucuugaacagagaauucugggaggcggucccugucuucaggugacuguucgcuggcuguauauccuucaucauuuuaugcaagcagggauuccacucacccuugugcaguugugguccuaucagcuaucucuguauuguuaccugccaggagauaggcuuuguuuuguaccuuccagcuggccugugacaaggaaggcacaucaggcccauaccauauaaggugcagcucuaaaacucagugagugacugagugaagggagucuuagcacucagcugagaaggcugggaauggcaaggcugcaguugccuugcucucugggcagugcgggcuacugaacuacauuaggccugaagagaacaggagggagggagacuguaggaggugcuggaggucuugaaguggcccugacaggagcagccuuuucugggacuugucuuucccuguaaaggguguuuucauuuuuuagaugggcacuuuuuugccuuuaucauuuacuccuauuauguacguacagacgugaaugugguggcccauuuccaaaugcuuacuugcagaguccgacagccugucccaugggaaaccucuggccauugagcauucugugaugcuuggccggccugcgcacccuucccucacagaggcccugacacaggaccaucuuuuaccugaccugcuuccuaauaccuuguuugccacgcugagccauagcuguaacugcuuccgagccuucuguugcucuuauauguacuaagcauaguuugcuauuuugugcggguauuucugacuggacuuuucaaguuuucauaacugcuaaguaaacuuuccucacggcuagguaauagaccucacuaagauauagggacgggcuggggguguagcccaacgauaguguuugucaaacgauaagccgggcuccgucacuaagcacuccauaaaacccccacauagauguauacacugcaugugugcaagcucuguaucuauauggauagauuugcuagcugggucugcuguguuauuaguuucagcuuuaaacuaagugguaaugguucuaucuuuccauagagaaugugagauuuugucacgcaguagacagguuguuuuuuuuuuucccccuuaagacggaaacgauaaugauuugcuguuuuauaacugcaguucuuacugucgguauuucaaggcuuucuuguauaucacgugaguuacaggagacauucucaaacaaauguauuuguguccccccccccugcuguuuugaggauaaauagcugcgucggagaaucaaaccaucaagcauuuauacuugcccuuuccaucuucuugcucacuucgguuuacggaauaucgcugaccuugaacaccauuuguagggauagaagccucuucacagcccucuucuacuguccuggaguuuacgcuaauuacagguagguugugcaacccucugucaggagggccagcgacaaaguaauaaauguugccagaagugagaguuaccugcuccuaagcuaagucagcgguucucagucaaagcauaggaugggcuuuggggauggugggcagccguaaaauugccagcaaaauacugcagugguuaugagugagcuuccaggguaaugucagacgcaucaucgauggcacgcaccuuuaauccuagugcuuaaugugcagaggcaggaucucucugaguuugagggcagccuguucuacaaaacaaguucuaagccagcaaggacuccauagagggacccugccucaacaaacaaacaaggcuuggcucugucagggacuccacagcugggaaguuucuuugugccugagguugcagugugcuccuuuugagagacauuccuaucuguguagccuuucuuuucucucuaaccucucaugguuuguucuaauuuuuuuuuuaaauucaccacucaugauuacuguguuaucuaggucaagauuucuuaggcaucauuaggugggaacccauuuauaaacuucagauuuccaugcaguguuguaaguggggcucuucuguguugauccacccccacacacugagguguucaugccacucccaccccaacagaccaggagcgcuuuugcuacuucuaccuccacaugccaagggugcucaucccccccccacacacacaccaggggcccccuuagcacucucacccuuacagagcaggagugcccuuaccaacuuccaugccacacaucaagggccccuccacugccaggugcuuccuguccauucucuaaguucuucacucagcgugagggcucugggggucuggucucuucuuuccucucacucuuagcucucagagccaguucuguuuuugcuaccagacaccccugcgugguguugguucuuaguagucuagauuuggacauuauagauauuugggggugacaguuagcccucucuucuugugguaacuuucuucucuagcccuauggaaagucacugugaauuccuuggccaucaugagggugauaaaguuguaaugcagaaugccuguguccuugguggguugacucaagugaauaggugcccagugccaccauuaugucuuaccucauucuuguagugguuccugucgcuucagcuuuauggagaaguuuuggguuaucaucugugaacuccuguguaguuuuacaguugaagagucuguguguaucuuuuuccagcuaauucuucaaguguguaugccccucccuguagcuccugagggagcccggaagaugaucuugccauguuugauuuuguuuggaauguuagguucuuagagauauuguuuauuuuugaaaauuguuacuuaauguaaauguaugugaauguaugacuucacacagcuggaagggggcaucugaugggcaucugauccuuaggaauggauuugcaggggguugugugcuaacuuucuaggguacuaggaacugaccccaggacugugagccauugcuccagccuggcucuuaaaaggcuguugacuugagaguuauccucucugugcucagucagcacuagauugcagacauaacaguagcccuguccuuagguugccaucuacagcuucuuagaggacaccaacaaugacuccuggaaccuguuuccuccugaguuaguuauaacaguuacaauuaggaauugcucauucauucagcaaacaggugcugaauaccuuguugucugcaaaguauaagaagacauccuuugcuaaauguaacuagaauguagcuagaaaaacauguacuaacaauccaaaggagaauugaaaagguuccaugggguuuuggcauucugaggauacuaugauauccuuugguagggugggggguggggacuggagaggcgcuugagucccuacugacaaguacaaaauguucagaaagaccccuuucuccacagcucagcccuguccuucaccugugugugguacucugugaucaucacagccggcauggccuacaucuuccucauccagcugauaaacaucagcuacaauguaacggagagggaagugcagcaggcccuucgccagaagacagggcgccggcuccucugcgggcucaucguggacacaggccaguacaacaggggcuuccugcgcaacuggcuccaguucuccacccugggcacacacacaguccacacccccgccgaagacaucgucugaagugccuuccgcgcagcucugcgggacauuccuguccuuuccauuucacacgucaguguccaugcaggauucauuuccaccgcccacuucucagagggacuggagggcuauacucagguuuggagagaggacuggagaaagggccauuuucuucugccuuuauaacuuacgggaguuuaguccugaagccgcgagacagagccauuccuuccugucaccuugcugacucaggcaccagaugcugcacagaggcuguggcucacucaaaccauucauguaaguaaggauguuaguuagaacucggggcauuucucgcccuccuuucaauucuuaauagccauaugaccccucgguagagucacuuuucccgagucucagguucaucuguaugggggcuucugcugccuggcuaccucauggagcagccaugauggccaccugaggagggauguggaaacacuccagcccagucaagcacucaaaggaauccggcaucaggaaaucccggggaccgaagcagaccgccugucggucagaacauugacaccgauacuauuaagacggucaguuuguacaguggcggaaauucuccguguuagacuuuguucucacagguuagcaaugacgagaggucaagaggucaucuugucuugagaaggacagcugaugaagauuaugugcgcaguguggaaugggaagaaauuuauuuauuuguuaauauaucaucuuauaguuauuauaauucuaacaaguuuuucccuccuuccauguuuuaccuggaugaggcgcuagcacacugguagugguggcuggaaggugaggagacuguccugagaacacugccccucuucuguggcuguggaggcugguuacuaucaagggcuugauuuuuuauuauuguucauguauuuccagugcuguagguuuacggcacugaaugggaacaucagccuaccaugaacucucuccggggugacugacaccuucccacguccacacggcuacucacuaauccucccuaggaacacgcaucucacuaggagagaagagcauggcacaugcacuccccaguauggaacagagcauugcuuuccagcucuuccccaggacuaagaugauuccuuugugucucagaacugaaacuuggagaagucugcagauugggcccucauucugccauagaaacaggaggaaaacuccaucuugaaagcauuugucuuuuacacuuguacuguuucgggaucccaaagauaaucugugagaccuuaaauuugccuuggccuuguugcuucauagaggagaaacaguacuuuguggguuucuuguugguugcuguucugugccugcuuguacacacugaggaaaugccccgccucuugaguuagucugcccuuagcgccgcgugccacccugagacuugccauuaaccagggcucuccugaagacagguaccacauuuucauucaggcuugucauugaucuccccagauagcuauuguuuaauaaacaauagacuccauauuccacuggguaagccagagcgagcuuggggauguuugcugacugcaguuucuacggcaaugccugucccuggucuagauucagacauucauuuagaaugagaguuggcguggauacaacuauuuucugucguuguggguuuuagguaagagagaugguaguaaugucaaagacagcguaugugggcagaaauugguaguuuucaugucucuugaaugccagguacauagccaacuuugaaugucuaacugcugagaaaauuuacagaaaucggauagucaguccaugugccugcugccucuugagcuugccacucaagggucacaugaaugaggccacucaguuucccucaaauggacagggauuccuuguuggcuuuguggcucacaggaauuaagaagcugggacuuuucuuuuuagauuuuauuuugcguguguguguguguguguguguguguguguguguguguguguauaggggaggccagaaaaccuccccuggagcuggaguuauaagcagccaugagucagcuauccugggcacugagaacugaacuugguccucuggaagagcagcacgugcuccuaacugcugagccaucucucuagccuccaaagcugacguuucuggagaacuuugacgguuugcagaacgaagcucaaaccuguaaagggcucaguccgcucauucguuuguuuuuuacacauguacuguuucugggauuccaaagaucagagauaauuugugagaccuuaaauuugccuuggccuuguugcuccguagaggggaaaugggaacugugcacgcagcuuuuugcaguugguuucuaagagacagucuacaaucagaccuuugugcuuuaugaucuuaagauguuugugggauucuggcauucuccagacaguagauuuuuuucacuuggagucuucaaaaaggcaagcccuuugugaguggguugucccaagcauccguggauaagcuagcagucccuugaccaugggagcaagaacuccccaccaaagugacuccagauaagcagguccucuuguccuacaucuaagcuucauaaagaucccucccuguucccauccuuuauguuacugccauacugucauguauauucccaggaaagaagacagagcuugcuucugaaaaacucaagggcaaacacuagggaugaagacuggaaggaaggaggaauuccuuccuugguagaaaaguguuuuaggagcuuacaaaguacuguguaggucacccucacugccucgucggcaagccacucugacacugcuaaaaugaagccuuaaauguguuuuggggacaaugcugucugcucccucaaccacauaguugcuaggauauuguaaaucucugcucucccaguggcauuuuccucugaugaaugcacugacuguuuguuguccacuguaccgccugccuggaaggcaacugcuguaagcuugcucucuuacgcaauacuccuugguacucuaauauuuuuagcaaaagaaaacuuuguauucaagaacuucccacugccagaaaacacaauuccaguaagagucuauguaauacugauaucugccugccugacuuccuucuuuuggguaggacaucagcuuuuauuauuaagcucaauugacagaagugaaaacuuguagaagcacagcuuuaaccaugacgucuaauaaaagcaaugcuccacgcacucacucguugcuuuaaacuagccgaguagauuucugugacggaacuucccguuagccauauuuugguacccugccuuucgaaaaggacacuucucaaacaagcagcggguucgaguugugcugcuugaagccugguuugcucagcguaacuuugcaggugaacuguuucauguuaaacacgcagaggccguguggugggaaugaaagccaugcugacuaaacugaacaccaaaugaaacucaguguguucuugugaguguuugcugagauucauggaacuguccagaagcagcggccagacugaguccuguugcugugagcuggcucugagcauuccacuguaggaacagcaggcugaauggugagcagagcacauggcucucgccacauugggcuugagacuucuaaguaguggagauguccuggugucgcguuucaccuuuaaaaaccccuacuuaaaaggcaaagcuucaaacccagagcuagucugcucuaaugguacaaacgaaagccuuucaggcagagccacugacaagaugccaugucagagcagccaacucaagcuugugccagagucugggugauuggaugacgugugaugucuuuggggccuuuucgugauccgauuucugugucugaugguagaguaagugaauccugggaaugacuuuaauauuaaauucaguauuugauauggauggccuacaacaugaaguaggauucccgaagccaagcugaggcugagggcugggcucuacucuuuuugucccuuugucuacaucuuagccuuuaaaacuggaauuuuacaaacuccugccuuuugugcaaaauaaugugaccacauuguuuaaaaggaaaauaaagugcuuucuuuuaugaaaac

SEQ ID NO: 8250 - RNA, 23674 nt, Mus musculus
cgcgacgcggcggccgcgccggcgcguugaggggcggggugaaaggucacagcgcggcggcgggucuggcuggcggcagcugcgggcgggagccgagugucccgagugcacguguggaggagcggcggcggcggcagcgcggcggcagauuuccccgcgucucccggagccucagggccuggcuuggcuucucagccaaaagaccggcgugugggguugaguggucugagcucagggcgcgggcggagagcuccgggcgacgaggacgacggcguuggcggcggcuguaacgacggccucagcagacggggaagaugaaagggugaggaagggcagcuggcgggggugugggggggaccccggcggccggggcccaggagaggggcgugggucgauggacagggagagcgcugcggggaagagacgcgcgcgaagcccgggcggagggucauggccgggcuuccccggucccgcggcucccggaggggggcggaggcuaggccggcuguuggcgggcugaagggccgacggaggcaagggcgcgaguccacgguuucacgugugugcaccgccugagaucacggggaggaggaaugaggcgcccgggggccucuucccgggagcgcaccaccgagccaccugaaggugcuccuccagauccgggaacggcgcuguggccgcgggcuuugacacguugcggguuuucuuaagacuugugggccgugcagaaccuucuggagggaaaaggaauuggaauaaagagcacgggggaugagugcuaggagcuagugacucaacggacuuggguugggucagagcgaguggaggaaggcgggcggucgggaggggagggggaauaaacuggagcgguguagacuuuggggugccaaaauguuuaaggaaguagccauggaucaguagguggagcuauugcuucagugguguguguguguguguguguguguguguugcccccccccuccagugcaaggaggagagcugcugcuuuugcucuucguuagcaaaguugagguuuaaucuugcaaaucuuccguaacauuagaaguuauuuugguuuaacuguucccguuugauaggaaguauuuccuuuccauugauuuauauacuguuacaguauuuagcgucgcgaguuuuggagguugccuuuacuuacagucauuagaagaaaaaaaaagaaagcuuaaacauauuaaacggucuuuucuuucuaagucagcugaaaauuauaacuacaguuucaguuaguuguuuauucaacaucguuuuauggagagcgaaguaagucguuucuccaaacaagcuuguucuguguaaaaugaaggucccauaccucugaaaugauucugagaaaguuuugauuuuaaaucuaaauagaaaacauuuuuucuaaacucugguuugcuuuaaauguuaguuuuucauucgguguuuuuuggguuuuauuuuuggcauuuuuggggggauguuugcuccaccugagccaugauccaggaugcuugguaauuuuuaaaaauaugauccaguuauuuuuaggaaguuuuauuuuucuaguagaguacgacuuugaugcugucauuuuuuucuacucauugcuacacacucagaacauacuugucauguucuguuauaguaaaagcaaugaagauaacaagacuaagaaauuauucuggauguuuagguuaaaaauauugggucuaguucaauuucaaguguaggauuagucuuucugauacuugacaauagaaauggaaccacaccguggugcuguuggcagucuauuggaacuuuuaucuaguauacucuugaagcaauucuacuuuauuaacuaacuggaguucuuggaauugaagcaaaguauucggugcucugcaaguacucugccacugagcuacguccccagcacuuuauuuugagguagagucucacuaaguugcucaggcugacgcugaacuuggcaacaaucuucuugccucccucagcccuuugaguugcuaguauuacgggcuugagccaccagcaccagcuggcucuuuguauuuaaauagauauuuaaguguaacacgauggaggcagaugccuagaaaugcguuacugggcaaacuuggaauuguugaauccauauuuuaggccaguaguuaggcucaaaauuaagacuccuuaaguaaauuguuuuauuuuuuuaggguugagggcuuagaauuggguucuggacuaaacaacuuuuaagaugauuucacagguauauuugauuuuucccuaacuaacucccaauaagcacgggacuuaaaauuuuccuuuccuuccuuuuaagauacuaaaaugagaucaggguauagugcaguuuuacuuuguuguuuuguuuuauuaagauguuaauguccuugagauacagaacuuguauaaaugucuucuguauucagucuccagacucuucauuggaaagacucuauuccaugaauuuucuuugaaguuuuauuugcuaaaguuuuauuguauauugagcuuaccaaacauaguuaaauagaugaaucugaaguuuagaaaacugaaacacccccuccuaugauuuaaauuuugggcauugaaacuuuuuaagcuuacuuuuaaaaauguuuuuauuucauauuuuuuacuuuaguauucuuauuaguaauagcaacaggauauccaguuguaaaucauguauuuuccuuaucuccauaguagauaauuuugcaauuaauaacuacuguauuuuuaugugcauaucuagaaaaacgagaacuacauuauuagacuauuugcucuuuccagugaggucuuuuuuuuuuuuuuuauggaccaaagacuuggcuugaauuugugguugguaagcugauuucuuccccccccccccccccccccccccccggcaggguuucucuguguagcccuggcuguccuggaacucacucuguagaccaggcuagccucaaacucagaaauccaccugccucugccucccaaaugcugggauuaaaggcguacgccaccaaagccuagcugauuacuuuuuaucuguuacuccucucugggggugaugauauucaguaugccacagacagcaaugacuggcccuguaauucguugucaguguuauagaaaauacaacuaaaugcacuuauccuucaauuauaauaaagagguacaaauuaguuuuaauaaaaaugccuuuaaauaaaauaugaaugcuaaguggaccaaaguaaagaugaaaagguagguaggaauaauauaaauacagagcaaaauaaaaugcuguugaaacuuggccaacuggggaacauaagauucuauaguuauaaaugaagcuuuguugauaaauacaaaauagucguuauguauacugggaacaagcccaggaagucuucugugucuuuaucuagguguuuguuacauagaaaauagagaacaacauuuguaucugugucucuucucaaucaggguggggccccaaaccuucagauccauccuuugcccuuacuguuugcuacugagccuggauacaaaguauaucuuguauaccauuaaaacuuuuugaagaaacugaauagcagcaggucauauuuugcuuuuuguguaaaccagaaauuuguugucuguugauugagauagcaaucuauuuuuuuuucccucccugauaugcgguuucucuguguagccuuggcuguccuggaacucacucuguagacuaggcuggccuugaacucagaaaucuaccugcuccugccucccaagugcugagauuauuaaaagugugugccaccacugcccagccagauaaccaaauuuuagcaaauaccuuaugaugccuccuuugcuguguugagaguuuugaaauauacaaucaugauuuuuuuuaaguguaucuucuaauugaagagguauccacuuuggugagugcgggguuguuacuauagugauuucuucuuuccuaaaaugguggacaacuuuuaauaaagcugcagcuaaucaaucaaugaauaaaugaauagggguuucugugaguaucaguaugaaauucaguugguaauaugcuugccuagcaagcauuaaaccccaacacugaauaacuggauaugguggugcacacuguauucccucccagcacauagagaucaaaguaucaaguucaagguuacauaguaaauuuaaugccagcuuggaauacauggggcacugugagaaaaagacauuuucccuacaugcaaaaaucauccaagaggcuaugggguuuuuuuuucugcuuuaucauaauuugcauaguucuuauuacaauuuguagccaaguuuuggauuauuacaaccuaacuuuugucaguuaaaaucuuauuuuaugaagcauuguuuuccaaagucauugccuuugucagaacaaacuaauuauuaccugucuuaaauuuuacuuugcugcuuuauccuguagaaaucuugauucuuuuuuuuuuaaauguaaguacacuguagcugucuucagacacuccagaagagggcaucagauuuuguuacggaugguugugagccaccaugugguugcugggauuugaacucaggaccuuuggaagagcagucaguguucuuauccgcugagccaucucuccagcucgaaaucuugauucuuguccuccagguguaaaguauagcuuucaacuuaauggguuuugaggaggcaucucuucaguuauucaaauaauuuuucuuuaucuuuguuuuaaaccuagccugcaguacccaguauaauacugcuagaagccuguagaacaguuuucauuuuaaaaauggauuguaguuuaaagcugcagaauugugacuugguaguacuaucacccagccuccucccccccccccccccccccccccccccccccggcuaauuaguguuuaucgccacugcuguucacccagcacuugggaggcagaggcaggcggaucuguggauuuuuuuuuuucaggacagcccaggcuacacagugaagcccuguuucaaugaacaaacaaaacccaaacagaucucaguaucuagcuuacuagcagagugcuagucuucucugguacaaugauggaaugccaggcacaguuggucaugagcaguaaguacucuuguacaccuaaguaaaauuuaaaguugaguuaaauuuuuuaaaaaagauuuuuauguguauggauguuuugccugcauuuauuucuguauauuaugugugccugaugaggccagaagaggauguugaggcagacguucuaaacaacugugagccacaugugggugccaagaaucuaacccagguccuuuggaagagugcucuuaacugcugagccaccguuuaaauuaaaauuuaaaugucggguuuuugacauuuuaaaggauuuuugacacaaauuggauauauagaucagauuuuauuaaaacuugauauauguaaauuuucccaggaauauuagcaucugaauugaaguaugcuguaaauaauagaagggaguuuuaaagauuuaguaugagucuggcauggugguauauaccuguaaucccauuacuaaggagaugagaguuaaauauguggguuuauuauauuucuuuuggacauuacuaugcuagggccuuaaagaacaaagcuguguaaaaauaugcuuuagaauguaauucccaggugguagguauuccuaaauguuucaacuugugggccacauuuaacuugucuguuuauaccucuguauuaaaagauucugagacugcuccuggguuuugaugauaaacucuuguuuccaauuacuucaucuacugugguugaagaacacagcuagaaauguguguauuuguauuuucugagcuaguucaaccugaguuugcuuccauuauuccucauguuuguuguuguuuuguuuugagacaggguuucucuguguagcucuggcuguucuggaacuaacuauagagaucaggcuggccuugaucacagagaucuaccugccucugccucccgggugcugggauuaaagcaugacucacuuugaauuacuaaauacauauacuuaguaauucaaaugcuauuacuucugauuaagaauaaacuguaaacauuuguuuccauuacuguucuuuacauguucuuaagggaaaaguuugugcuauagcaaaugguuauaaaacugucugauauguauaguccaaaaggaguaaauuguauacauaguucuuaaacaugugauuaaauauuaauauauaauguuaauauuauauguaacauuuguauccuuaaucuuuugugggcuauuuuccuaguagugagguuuugguuuuuguuuaggaacagggacucuuguagggcuggaugagcccagcuggucucaaauucagaaagaaccacuuacuucuaugugucuaguguuugaauuaaaaggcuugcccaauugauaguuguuguuauuuggucucccaaaguaguuuuuacugucagcagugugcucuuuuuuuuuuuuuaaggguuuuuuuuuuuaaacauuuauuuauuuauuuauuuaucucauguaaguacaguguagcugucuucagauaaguacaguguagcugucuucagaagagggagucagaagagggagucagaucucauuacgggggggggggggggggugagccaccaugugguugcugggauuugaacuucaaaccuucggaagaacaguccggugcucuuacccacugagccaucucaccagcccagcagugugcucuuuaaaggcaaaaccugcaagggagaaaauuuugggaaaaccuuaagaaaauugaagaaaagacacuagcuaccauuuuagccaagagugauauaaauuuuggguugugaacgccuuuaauuccuccagaggcaaaaauagguggcucucugaauuaaacuccaaccucaucuacagauggaguuucaggacaaucagggucacagagaaauccugucuuuaaaaaaaaacaaacaaacaaaaauuuuugucugcaugugcugugacuacacaugacuauuugaaaaauaauagaaauaacaguuuuuaaguagauuuugaguacauauucacuuuaguuuuacuuuucugauuaaauaauuagcauuuucuuuugauacaaaacuuuuauuuagugaaguuggacauuuucuacuuuuaguggucauuuguauuucuuguaacuagcuuuuuuuuuuuuuaagaucaugaucuuuaucaacugccaaaacuuuaaaaauaaaaauaauguucuuggaaaaaauguaguugaggggcuggagagauggcucaguaguuaagagcgccgacugcucuuccgaagguccggaguucaaaucccagcaaccacaugguggcucacaaccaucuguaacgaaaucugaugcccucuucuggagugucugaagacagcuacaguguacuuacauauaauaaauaaaucuuuuuuuaaaaaaauguaguugagcuggacggugguggugcaugccuuuaguccuagcacuugggaggcagaggcaggcggauuucugaguucgaggacagccagggcuacacagagaaacccugucuugaaaaaaaucgaaaaaacaaaaagaaaaaaagagagagagagagagagaaaauguaguugaaacauucagaucaguuuuauggagcaagaaguuggaagcugagucuagaucaguauccauccauaggaauggcuuuauuauauauuaugcaaugcuaagguguuugauuuguaagacuguacaacugggauuuuugauguugcuuguuuugagauuuuguagccuaggcuggacuugaucuucaggaccucugccucuaagugcuggcauuacugaugugccugcuauacucuaauccugcugaaggguuuuuaaacagaacagaaaucaaacuuuuuuuaaaauccugauuuaucuauauuuauugugauggcauucucuccuugccucauauuaccuucuuccauuaauuauacuuuucagaauucaagcugaaauaauggcuugagcuguccugcaaaaggaaaaguaugggaaucauaacauuaaagaaauggauuuaauaaguauuaaaauagaacauaaaguguagguuucuaucuggcagaagaggcuacucaucucuaugaucaugugaaagggucagggacaagauaaacccuucauaggcauggcuccaaguaccuauuuccucuaguuagaccuagcuucuccuagucacccauucagugugaaucuguuagugaaguuagaaucccugugguccaguaccuuucaguaacccuacuacuuggggacaacucuugaacauauucaaucaugauacauaaaguauaccucaaaacuaacuuucuauauugucugaaucgagcuguaauugaauaaaugaggcuauucaugaaaguagagaaaagagauagccuccaaugggcaaaagcuagggaucugaugaugugcagccccaaggaguauccaaucuaaaaugccagcaguuacauauuaagaggccuuacuuuaaacucuagaugagaagcccaaaccuaucaacugacucuuugauuuacugacaauacugucuuacauuuuggaguuugguagagaagauaaguguaaaaguuaaugcuuaaguagggcuugucgguccacuuuggaagaggauugguaguucggggucaugcuaagcugcaaaaaacaagucccaggccagccuuggcuacaagagauacugucuuuaaaguuuaaaggaauugggagaggggaggacagacauaguaauagaaauuucaguaaucgaaaaagaaaagccuuuugagcaguuaguauauucaagccauguuuuugaccuuucaugucauuuacugaaagucaggguuaaauuaaguccuauuaaucaggaaggggagaaaucuauuuuaauaucucaaaauuuuuuacugaccuuagucauacuuugaccucugcuaaaauauacuuugaguuugauguagaugcacccuuauggggcauguaucccucucucuaaccuuaaggaauacaggugauuccucugagggaauaugauagaguggaucucucaguauaaugaaaauuccuagaaaugcccaaguauaccuuuauuuguaaauauuuucuacaggcgcauucucuguuggagcguuaauuuaaucucugggcucagagguuucuauggcaccuucaacaaaaaauacugaaaaucagauuaacuaguuacaauuuuguuccaagauagguucaauagguagccauugaaugaauaagcagguauagggaguuucucugcauuuauuuuugcuguuauaaguaagucagaccuggguggggggugggaggucauuuuuguggagucauaucuccaucuuguggucucucagaauauugccacuaaauuuguuuuaaauuuuugagcauaauuguauuaucuuaauaacuugauacauuuggguguuuucuacaguuuggucucucuaaaacucacccugaaaacugaguucccaucuaaacaguauugagaaaugugaauggcaggugguuaaguuauagggcucugugcuccugaaugaauugaaaccuuuguuacuguuacagagucuguuauaaaaaagaagagcggagaucuuuuccucccuauucuuaaauuauguggugacuguuaauauaacaagaccaccagccagaugugauccuucagucuugcauugcucucuagaacugugagcuacauaaacuuuuagucauaaguuugcucacccugugauguccuauugcaucagcagacagugacccaaaagagugcuuauuaucuaauggaugcauaauuuuacaacauggcuuacaagagcuggucugggccaugaauuuguacugcaaaacuggagagacuugacacaggcugaugaucccuggagccauacuguccuaaagacuauaaauaucuauaugcauuuuuguauuuucuguuugauuuuauugcaaucccuagucuaguaauucuuaaaugaagaugacgugggguuugauugcuauagauuugaaaaucagaaaacaaugucacauuauuuaguugagcuaagaaaaguuuuguccucauaauugcugucuuuggcuuucuguaauucggauuguaaacuugaguaccaguaggaaugauauagaugagagauagaugaguaaaucauaagagucuucucgugugauuuaaguuggcagccacuugaaaggaacaagggaugggucaaaugcucugaucacuugucugacuuaaguuuuaggccaacaauauaggguucuugcucuuacuucugaaauucauaaguuccuuguuuuuguuuuguuugucugucugugugacccuggcuguccuggaacucacucuguagaccaggcuggccucgaacucacucugccucccaguucugggauuaaaggaauaagacaccaccgcuggacucuucuaguauuucuauaguguguuggaaguaacaauucucaaaaguagucuguuacauuaucauuuuauguaaaaagucuugaaguacauucucucuacgacuuuuugcuuguuuugacucauuuaacaccagcauugcuuuaagucacguuugguaauauuuaaacuuaagcacauaaagaucuuuuaaggucauuauuuccuuaaaagugacacuaaugaaagauaacauuagaaugaaggcucaguggaaucaccuuggauuuaauuucucucacaaauauccauacaagguauacauacauguaauauguauuuguuguacagauuugcaccaaaagcagacuuaauaacuggacggcuugauauaguuggagguugaaauguuaaaauuugaagauuuuuguuuacaaaaauaagauguauaugugaaugcauuucugucuuucuacaauguuagaauuuauuaacauugaauucacaagguuuaaugauuucaguggcagcaauuugccagguagucugguuaaagugaaugcaaaagguuuuuuguuguugguuugauuuugagaugguuuuucuauauagcuguggcuguccuggaauggcuauguagaccauagugaacuagaccucagaauuccucuuugccucugccucccaaguguuggaauuaaagguguaugccaucaugucugacagauguaaguucuauaaauucacaucuaaauuguuaguguaggcuuaucacauagcaaguaauguuuacauaucuaauuauguguauauaugugguuuguacaaugaauacaagucagagaggcuauaacaaaaguugagguuucagaagugagcuaagcaucuguauugauaauagcaaaacaaaccagggaguugcuucugggguccagcuuugagaguucagcaucaagauggaaaacugaauaugaucuaaacacagggaaugugaaaagguggacaaaaaccaaagcuccagggacagucugaaguccucugacuguugguccuuuauacacauacaaagguuggggggagguauauaaggugauagguuaaaauggggcugugauaucagaguguuuguuggguguccauaacuuuauggugcuaaaaagaggagaguauacccaguuugagguuguuuuguuguuguuguuguuguuguuguuguuguuuauuuuggugugucuauucauccuaagucaugcauccacauuucccuauaaucucaauaauuuauaggaagacuaccuguacugacuaguuuugugucaacuugacacagcuggaguuaucacagagaaaggagcuucaguugaggaaaugccuccaugagaugcaauuguaaggcauuuucucaauuagugaucaagggggaaaggccccuugugggugggaccaucucagugcugguagucuugguucuauaagaaagcaggcugagcaagccaggugaggcaagccaguaaagaacaucccuccauggccucugcaucagcuccugcucccugaccugcuugaguuccaguccuaacauccuuuggugaugaacagcagcauggaaguguaagccgaauaaacccuuuccuccccaacuugccucuugguuaugauguuugugcuggaauagaaacccugacuaagacaaauugguaccagcagagugggguauuccugugacaaccugaccuuguuuuggggaggacuguggaaggacuuuggaacuuugggcuugaagauccauccguuguuaagagcucugucggauguuguguaggagcuugggagauaauguugagaauagugcagaagauggaggccuggcuugugaaguuucagagggaaaauuaaagacucuuuucaaggccauugcuauuuuggaguuugauuauucugugguucugguuagcugggacugaagaaucaguugugauuaacaagauaccagaacuacaaaaucaaaaccuuugcauuacugggacuauugaugcugguuagcuggagcuaauaaauuagcggugauuaagaagagaccagcaucauugaagugacaacuucugggaaguguuuucugaaagcacaaagaggcuguguuccagagauggccaagguuguacuccugcugcagcaggacuugguaauauguaagggucacccaggugguacugguuuugaaggcaugaaggggucacgcaaagcagcugaggcucggcacugugagaggccauggaaggccauuggugagggugcagccucaguugcaaaugaaggcccaggacugaaggggucaugcaguguuuuggagaugccaguaccaugagaugaccaccaagaacagcagcagcaguggaguacaggcaucuggagccuagaggacgaugugugugcuacaaagggccuggcuggagaagugacccaagcccuuggaggagcccagaagaucgugaguuagaucccagacauuggaugguuggagauugacuuuugcuuuugauugugacugugcccugauauuuucccucuugaaggaagaaacuguuuuaguggagcccacaguuaagagacuuuuaauuguaaaaagacuuugaauuuuaaaagagauggauauuuuaaagagauugaaauuuuaagaauauguaaagacugugggacuuuuaaaguuauuuagaauggggaugaauaagauuguaaggguugaggcuuacuagugauguguuugugugucaaguugacaaggggucaauuguacuggcuaguuuugugucaacuugacacagcuggaguuaucacagagaaaggagcuucaguugaggaaaugccuccaugagaugcaauuguaaggcauuuucucaauuagugaucaagggggaaaggccccuugugggugggaccaucucagggcugguagucuugguucuauaagaaagcaggcugagcaagccaggggaggcaagccaguaaagaacaucccuccauggccucugcaucagcuccugcucccugaccugcuugaguuccaguccugacauccuuuggugaugaacagcagcauggaaguguaagccgaauaaacccuuuccuccccaacuugcuucuugguuaugauguuugugcaggaauagaaacccugacuaagacacuaccuuucuacuccuaggaacaacucaacaguuugugcuggauagguagugacugacagguaaaguuugguuuccccuaggagccacagucauccuuuucucuucauggagcuccucagggcaagacagccuggaaaagcaguuucacacaauauagucucuuagagcagggcauaccugaccagaacaguacugcuccuuuuuacuugguguuucaaacaguaaaaacagugcaaaugaaccauuguuuugcucuaaagaguuggaucaauucuaagucaguaaaaauuguucucagggguauaaaaaacuguggaguccuauaaugcauuauuggugggaauauaaaugguguaccuugggagacaaccuacuguuaauucuuuauuaucaauuuaacagugacuucagacuucauggcuuaaaaguaacacaauuauagcucuuagguucaaauacucaaaaaugcucuucacugaauuaaaaucaagguuuugguugggaagguaauuugcauaguagccacaucacauuacuuagaauuucagcaugucuccuuauuuagauauagggucuuggaagaugaaauuuuaagaagaggucauuuggauuagaguugauccuaaaucauaugacugcuguuugagagaacaggugcagcaggaaaccugugauuagaagauuauaaaguuuagauuaucccaggccaagaaaugccuguacuaucacaagcuaaaauagauaaggaaggauuuuuuccuagagccaagaggcuaugagcuuguggaaaguauucucagauuucuaccuaccugaauuauaagugugcauauuuuugcuuuaagcauuugaauucauggucuuuuguucagaaaaggcaaauaccuguagguagagaaaauagauguauuuacagcugaggauaggaaaagaagacuauaaacaguuccaaaagcuaaucgauguuguuugucuuugcacauagccaaaaauauagauucucuuauuauuuuaaaaguuuuuuuuucuuuacaaaaugaggagaugguuauuuaaagagaauuccuauuuauuugacacaaaauguccaguuaauauauuaaugugaaauaaacccuguuugcaccuuggaaaaaaaaaguuuuuuuuaaagauuuauuuauuauaaauacacuguagcuucagauacuccagaagggggcgcuagaucucguuaaggauggaugugauccaccgugugguugcugggaauugaacucaggagcuucggaagagcagucagugcucuuaaccgcugagccaucucuccagcccuuaaaaguguuguguacguguuuugccuguauuugucuaugcaggacaugugugccuagugucuguggaggucagaagagggcaucugauuuuucuggaacucauguuaugguugguugugagccaccaauugauuucugggaaucaaaccccauauccucuuacaagagcaacagguagucuaaacugcuaagccaucuaucucuagcccaaauuuuauauuuuuaaaagcugaauuuugugaguacaucuuuggaagguuacauacaaaaauugagauggaucaucaccaucuuuuaucacaguaagacaucacuacacauacguagcauacuuagaacagccuaaguuuuaaaacugccaaauauuggugagaauacagaacugggguucugacaccuuaaaauucaguauugucauuccuagguauuucguaaaaagaaauuaaagcauugucacaaaaccuugugucaaauguuuauagcuccuuuuuucacaaucuucaaaacccaacccaaaugccuuuuaaaagauagaaguguggcucugugcaaagagcuacagaaauucauugugauaauuagaugagaugguuguguauaaugguagucauaugguuagacauacuugucaaaaaauuauuccccaaaaacaugagguuaauuuuuaaagauaaaaauccaagaaaaaaaugaccucccaaauaacuggaaaaccaacuuauaagcugguggacuugaauuugauuuaagcuaauugcauuaaaacuaacugaaacaacaucccauguacaauauuaaaauaugacucaaguacgugcuauuugcaagaaacaugcuguggucaagagauaagauuccuguguugcucaggguggucucuacauccugggcuuaagugauccucugucucagcuucccaaguagccaggauaacagccauguauaguagacucacccagcuccacuuuaaagauagagggaaguuaagguuuuguguggaguguguuguuguuguuguuuuaaauagugaaagauaugccaugcaacuguucauaggaaguuuuucaaaauucccagauucucauucugaaauccucauucugaaagaacaggguguccuguaauaugaauucuuaauaucacuucacuaaaugugaugucacuggaucauuccucucaacaaauaagugaaaauuguuugggcagauuucucaauacuuauuugcuagauugccuucaaaaauaauguaccgguuucucaucugcaaaguauaggcauaccguuugcuaucccuuuguuaauauuagguauuguugcucuguuugaucaguaaucgauguaucugcaguuuuaaauuauaagcuaugaggacaauuuuagcauauauuaaaggauaauauuucuggccuucuugaauauuaugucccuaaauauauauaguuaauacagaagcuaugaguagaauuucgguugaauguuugacaaaauuugcuuauaagugaugguguuuuaggaauacuaaguuuuaccaaaaggguugaauuggucagucaugugcaaaaaugacugauacccuuuuaaccuuaucuuaagaaaugaaguuaucuuuuauugaguacauuuugguuuguuccaguagccggaucgagcugggagaugugacgccacacaauauuaaacaguugaagagacugaaccaggucaucuuuccagucagcuauaaugauaaauucuacaaggaugugcuagagguuggcgagcuagcaaaacuugguauguauuuucucuuucuaaaacauuuguacuucuaaauuauaucuguuaauauuaaagcaguuaauacaggcucauuuuauaagcauaggaaguuugaauguuacagauuuugagaaaucaauauugaauauuugacguuuaaaaacaaaauacuaaaugucaaauacuuuuuaaaagcaaauacuuaacaucagcuuaagggaguugauucuacccuuccacaugguaaguugcaacaauugaacuuagguugccaggcuugguggcaagcaccuuuaacugcugagccaucucucuggcuucuaaguuguuuugguuauuuacugugagccuggguguuuaucacuaauuuaauaacuauuacagagaaaguuuagccuucuucagacaguguaaauguugaggccauugauacucuuaugaguagcuaguuaaaaucugaugcuuauuaacaacuuuuuaauuguuuuuaaaaggaccugguuaaaauguugagacuuacaucuuuguauuuucuguggcagcauauuucaaugauauagcuguaggugcagugugcugcaggguggaucauucacagaaucaaaagagacuuuacaucaugacacuaggaugccuugcaccuuaccgaagacuaggaauagguaaaaauacauggcguuuuuuguucuauuguucuguuuuaagaaaauugggggcugggcagugguggugcacgccuuuaaucccagcacuugggaggcagaggcagguggauuucugaguucgaggccaaccugguauacauagugagugccagggcuauacagagaaacccugucuugaaaaaaccaaaaaaaacaaaacaacaacaacaaaaaauugggaagucagguaggaauuugcacagcuuuuuaaucucaacauuaaggaggcagaagcagacagaucucugaguucacgaccagacaaagcuacacagagaacacaagagaagcccugugaaugaaugaacugaacugaaggaaggaaggaaaaaaagaaaggggacacagcaaacugggaggggguacugaauugugaaaaauaaaaugaaaacuauugcuuaguauucguguggaagcccauaaauuuguucacauauuguuuaucagucuggaauucuuugugcuaaaaaggggccuuuucuauuaguuuuagacguguuaaguugcacagugaggacaaauuuggggaaauaauguauagaugcacucuaauucugugucaggacuuaguaaagauagcaaguagaugucaauuucuagguugauuuauaagguuacucauuuauuauuuguuuuauuaauaggaacuaaaauguuaaaucauguccuaaacaucugugagaaggauggcacuuuugacaauaucuaucuguaaguaacuaauguucaucaagugucugauaaauuaauuaucaguauaaaucccuaucugacagaaacugggaucuacucacucauuguauuauuuaguugaagaccccuugaaggucugcuagucucuugauaacacuagggguugugaaggggaggcuggagaggcuucgucugcuaagagcauuggccguucuuccacuguucuuccagagggccccaauuucauuaccagcauccacauggugucuuaaaaucauuuguagcuccauuuccagagaucugucaccuuccuuugguauauaagugguacacaggcauguaugcaaacaaaaaugccuauacccauaaaaaaaauuuuagaaaagaauaaaauacauucauuuaaaauguuauaaauccauauaaaaaggcaugcuauuuacagaugaccuaugccuaucuucccagucuuuaaacugcccuaauuuacaugucuacaacaaauaaaaugcuauagaaguuuuuauuaugcuguacuguuuaggaaaugguguagaauaguacauauguuccauucagaaugacuauuuuuaaauucaggguuggugaauuaaauuuaaauucaaguuggugggaaacugauaauguaggugaacuacuuuugguauaauuugguuauaauuauauauaaggaaccugagauaaaaaccaaaaucacauucagaauuuugagaccauuaaugccauuaauaguugauauauuuuauucaagguaacuugauuauuuacuauagaguagaguuuaauaaagucagaaguagcuuaguugaaauuauacuugaauuaagagccaagacaacuggucgugguggcucauguuuuucauccuaggacucuguacucaggaggcaggggcagguagauucuuaugagauugaggccgucuggucuacauauagugaguuucaggacagagacagagauagaccacuccugucucaaaaaaaaaaaaaaaaaagucaagacaaagaucaaaacugauuguuuuucacauugguauugcaaagaguaaugaaggaagcucaagaagauauauuuggcaauugagucuguguuguguuuuuaguauguguauuuguggggagaggcauguacacauguguacaggaggccagaggcauaaguuaucuaaggagcugaaguuacaggcaguugugagccaccuuacagcauugcagagaacaaaacuucaguccacuggaaaaaccacugagccucgugauaaucuuuguuaacuuuaagaauaggcaccgauccuucugaucucugccaccugccuugcaaauggaggaauuauguuaagagauuuacugauaggaaucgacuaaccuuuguuaaauauugauuguugauauauaugcgaaaugucugaguuggcuacucuugaccaguuuuaacuaccugugguuaagacuugaaaguugaugaaaguugucuuauauaugugucuguguauguauacccuguaucucaggcauguccagaucagcaaugagucagcgauugacuuuuaccggaaguuuggcuuugagauuaucgagacaaagaagaacuacuauaagaggauagagccugcagacgcgcaugugcuucagaaaaaccucaaagucccaucuggucagaaugcagagacacagaagacagacaacugaacaaaucacaaaugaacuuucuugcacuugcuugucgccaaauaaaagaaagacccauugguucccuuccccccuuucuuccacuuuccuccuuuguuauuccuuuuuuuuuuucuuuccucuuaaaguuuuuaauacuuucauggacucuuaaaaaugaucauguguuggauuguuuuaguucucuuacuuuugugaggugguuggauugaaggaggagaagauagaucuguauaguuucacaguuaagaugucccgaaaauuggguggcagaugauuucaaauuuuuagcugaauuuuuuuaaaaaauaaaaacaaaccaacauccugcuuucacauugaagggcagagccuacuauauuguuuauuucaaaagacaaaaagcagcagcaauaccuugcucucuaauucauagacaagcuuaguguaucugugguacuuugaguuauacagacugucuguggggugcuaauccccagcauugccuucacucuacccuuaguccuuugagcacucucaggaguuggaccauuguuauccuugugagaaaauaccaagcuuauuuagguuuuuaaagcaauuuuuuucuauuugcugauuggcggggcaguuuguguagguaguaaguauuaaacuuuggucaaaguauuucaguuaaacugcuuuuuuugcugaggaauggacuucuuguuagcagguuuuuuuuguuuuuuccuucuuuccugcuguuaaucuuguuacuagaggcauuaacugguagagugugggcuggugaaauuaacuguuuuaauaucccagcuagagauauggccuuuaacugaccuaaagaagauuguuauaauugauuuuuuuuccucuuguuuuucaguaagcccaauaauaguguaaccuuauaaauggaguuaugcccuuauaagucaauaucccuaaauaaaccugaagcaaguguuuucucuuggacgaacagaauugcauuacguaaaaggcuuagauggacuuguaacacauuaaguguauuuaaugucaacuaauacagauuguuaaaaguguggucauugaguguuuaauaauauaugaaagaauuucuagacaguauuuuugaaaagaacauuguuaugcuauugcuuaucuguuggagaacaucccagguuagcuuccacucugugccuacaauguugaguuuaaagauuuggaauaagaggaaucaguagaaaaauuccuucuauucuuggaacaauagacguauaaaguauuaauacaaauaucacugugaccuucagcugacagguuugguuaagaccagaccaucuucaggcacacugggaguggcucugauggauugagaacuguaauguggagacaugugagauacguuuugcucacauuguccugucucaaauauauggaauuucuuagauuguuaguagucaucaguggcucaagaaauguucuuguuagacuuuaaaacaguacagauuguguguuuucuuucauuugacuuuaaaaggaaguuuaauacaucauauuaguaaaauugugguaugaaaguaucauuuccaaauagguugaaugauaaaauuaucucacaagaugauaaaacaccuuauaacucuuacguuuuuauuugagaaugugaaaguauguaaaauggacuugaguagucuugagugccaagaauauagauaaggggugggauggauggauggauggauggauggauggauggauggauggaugggcgggcuagugaaauuguagaaauaccaugcuuguuucuuggguaucaguuuccuaaacaguccaaaucuaagcucagaaguuuaguguuaagcaccuuuacuuuaauggauaagcuucagcgugcucuugccaagagaagagggcauaaauaauaguaaaauuaguuugaaaaacgucagcaauuuuguaaacuuccugauagcaaaauagauuuugauauauaaaagaguuuucugagaugacacugccucuauuucuauaaccauuucacuuggacuaaguaguccuaugaauguaucccuaaaugugguuuuugaaaaccgaauagcugccucacaacaauuaaguacauguuauuuaaagaggaagaacaaauaauaaagauugauuugaauguguaggcucccuauuauagcuucuuuuuccacacuagucagugauuuaaccuaaaauuuaaauguaugggucaauuguccuguaucaaaguuacaguaaauaauuccauccacuuacauaaggagaagauguggaaaauguagaaacugggacuaguccauguaccugugagucaagaaauacuaaaguaaugccccaguugaguuuguggguuuggguuuugauuuguuugggcuuucucuuuguuuuuaacauuauaaaaauaaucuuugagguaaaacuaauucuauuaacuggaagauacccagcuaucuucaucauuuuuucaggaaagaucauuuuuauugugggguaaauagguuaaaauuauucuguaugcuauuugaauuuagguucuaaaguaaagaauccguagaggaaucuaugcaauauguaauuugucaagauuaauuuucaucuggggaaagaaguugcuaagugucuccaaagcaggucacucaauaacugaaaguccuccaaaaagagaacuagugggaagcaugguguguggugguggaaaagaaaaacucccucaguuuuuggagggaauaacuuuaaagauacuuaaguggcuacguuuacuuggugcaguuaagaauuaaacuugucaauuuuaauguugcuguuacaucuaaaauaaacuuaugugauguucugguagugaucugucuguaacugucaugaaaucauuauugugcugaauuuuacagucugcaacuaugucauuguuguguacugugauccauacauccauauuucacuagggccuaauuuaaaacucaugaauaaucaaaguaugcuaauucagaccucuuggaauugggaaaagacaccaggcaauauaucugaauuuaaucuaggugaaaaaaagauccccaggaaugccuuauugccauauuuuaaauauaguuacuauaaauagaacuuuaggcuuuauucuagugaguaugaacuguaaaugugcauauucugaucuauuacuuuuuguagugaagauuuuaguugagugaguggauuuuauguuaaguacuucgaaauuuuugacaguguuuaauauaucuagucacaauggucugaauuaguauuuugcuuauuacccaagaaacaaaggauggccuuugucuuauuuaccauaucacuacaaaauuuagcaguuuaaaauaacagauuuguuguauccuauaguuucccaaucaagcagugugugacauaaccaguuaggucugacaaaggaucuuauaucagguaucagccaaggcugcaaauugaugaaggcuugaccgcagcuacuucauuucacucacauggcuguucuggaaaccauuugggacagaacacuaacauaagacuugcuuaacaaagccuaguauuagucuuaaaaaguuauggucuuuuuguuauauuguaaugaaagcuuaaaucuaacaauuggaaagugguauuguuggauaggauauuuuguaaauuuacgaacauucagugaacucauuuacuguccucaacaauucaagacauaugaguuaaguauggauuaaaacauguugauacugauucaaaguauuuguuuuugucaaccaaaccucuggagccgguuuagcccuuggagaaacaauauuggcaauaucagaaaucauuuuaaagaugugag

SEQ ID NO: 8251 - RNA, 41374 nt, Mus musculus
gcagggucaguuuuaguucccggugaaccuagcgcguuuggcuccacugggagguagcaagacauauuucuaagcaaacgaucaaaaguuaaggcaaggaagugcgguauguggagguuggugugcaaguuucuuuuggagacuucuagaggcuuaugacaggcgcgccauuuggcccuuugggugagaacugcagagccccacgccaguaccgccucugggucgccucggaggagcucgccggauguacgcaaaggcgugggggcggagcucugguaacccaggcaacggcccggaagccacuuuccgcguucccccguggcgggcucugugguucuggaggcugaacuuuuagucggggcggaggcacagucggccagcggcaaggcagguuggggugaagcgggggcauagggcgaggagaagcggccggcgucuccgccugggucucggcgcccgggugggcgugcgcaccccagggccggccgcucgccucgcagagccugagagugcgguuccggggagcgccuggaucccccgcgggacagcgggccccgcgcacgcgcgccgcguucccgcacccugcuggcgggagaaaucccgaggccggcgggugaugcaguuguuuacugucccgcuagggaguggcagaguaucggguguugggacagggcgcguccuuuaaguugagcguuuaggugaggguuucuaaggaaggggccguuugaaaguuugggacaggcuugagcuugggagucaaaaauaggaaauuguuccagacagugcauggcacugcuugugaaggucacagcugggucucaguaugggugggagggaaaacuggggccgcacgaagagcagcucuugaaguuggauuuuucucuacagugggcuccauuaaaaucuuacgagggaguaaaacguugagaucccuguaucccuguauccggguaagauugauggcagggacaguguucugguugucccccaguuuguuuucauacuaguuaagguaaaucugguagaauuccaccaucccuccuuaagagcaggcaagggcuuccaguggucuuuuguauagcccucaaauugcaggggcccucaguuagcuuuuagacuguuauuguucagacugaaacaaauucuguaaauguuccacacacacacacacacacacacacacacacacacacacacacccacuugcagagaacauuuucuuucugauuuucuccccccaucccccuuucuuuuuuuguuuuuuucaagacaggguuucccuguguagcccuggcuguccuggaguucacucugucgaccagguuguccucgaacucagaaaucugcuugccccagccucccaagugcugagauuuaaggcuugggccaccacugcccagcauucugauuuucuuuuauuuacucuuuauuuucagcccgacuuuguggagggaauuaaggagaggaggcagcuuuucuucauguguauugaagauuaggaacuuccuugacacaaagaauuaacuuucaggcuugccuuuuguaagaaguuguuuaguuaugaucuuuugagaaacguaccucugagagggcacaggcuacuucucuguuuuguuuuauuuggugccuagcaagcacguugaaaguuacuugauaacguggaguggauggaugaaugggaagaaaaccuuacaggaaaauuaauaacaggcuguucagaauuguuccuaguagaaauggaaaagaacggacagaugggcgggauauuucaaggaaggauuuauagauuguguuacauagcagacaaagagacaguuaggaaccagaggcgaugcuuacgcuuaagccagagcaacaagaaggauggcaauucucuaaguuuaguaacugagucaaacaguuagguaucuagaucuagaggauugggagggcugugccaaacgagcugcaucuuacuauacucugagguguauggaagggcagugaaugcacagcaaaggacgcuugauguuuuagggacaguuaggaaacauucauuagaaacugucuaguuaugguccuuuaguuaugugucugugugcccgguauaggaauagcuuugcugagagguuucugagaaucacuaagggggcuguuggaccucacgaugguccagaaagcaagcucaguggaaguuggcauaugacuagacucauuugcaguuuacugccauugcucacauccagugcgugggggugugguaggguuccccaguauugggugaagggacacguguaagaggaggacaggacagggauagaccgagaugagggcccuuggcuacguuuuccaaggaaagaguccagcguagucugaagaggaaagaguagugaaauagcaggaaaaaggguguuguggaagccgcggaagaggaaagugccugagaaguaaggaaggguuugcacucuuagcguuaggaagcaguuaacguuccucauuuucuccacacuggccccacuucugcagggugcugcgauuuauugacugcccuuaaaauaccucuagucucuguuaugccucaaacaaacagugcucauuucccucaguuccccacaacugccuuugagagguaaacaggcacauggaccuuuaaccccuuuuagcuacuuguaaguuuuuguaugcgucagauucaugacuguuuccaggguugaggcugguagaguuuuaacuuaugaaaaaaaauguaauauuuuaaauauaauuugaaauaaaaauucccucccuuuugaagaguugcuuguuuuuacccagcaaaguugauccguuguuugugguuuccuagcguauacuuuauagucaggacacugagugucaguuccuuccucuccucauuguuaucugugucacugugagcagugugauucuguccucauuugagaaaagagguaaaaauugucacugaugucaucaacacuuaaauaggacuuaguaugugucaggcagggguuccaagcagcuuaccuauuuaauuagcuucauuuuaggguuaucaacagagcgaauccauagacuuugguuccaggcuguauucuuagccacugugcugugcuaucucuuaagacaguguaugucucacggaauugugggauuagugcuaaggcucuucauuaucaaugcauauauauuaacaucagguaguuuauacaugcaguucuuguuuuuugcuuuuuuacauuuaacuuuuucucacaggugcauaugguguguguguguaggucagagguugauauugggugucuugguugguucuucucuaucuuauaaacuguaguaggguaccucccuugaaucuagaacuugcuaauuuggcuaauguagcuagccaauuuagggauugccuaucucuucuccugagcccugagguuacagggcugcccugccuccugguucucauaguuaauauacucaaacuucauucacauuguagcaugugucaguacuuuauaucuuauugccaaauaacaucccaguuguauagauaugucacauauuuauguagucaucaauuaaugggcauuuugagauguuuccacuuuugucuauuaacuauaauauuauuguggacauucacuuacaggguuuucuuuggacuaaugucuuuaauucucuuuaaugguuauguaggagaauuucugagucacaugguaauguuguuuaaauuuuugaauaacuucccacuggucuuccaaagcgccuauguaaauuuacauuccaaucaaauauaugaagguuccaguuucuucaaacuugugccaauacuuuuuuuuuuuuuuuauuaaagucacccuugacugguuuugacuggcauuuaauuauguuggucacuuuuuaaaaaagguuuaucuuguuuuauauuguaugaaugcuuugccuguauguauguguaccgugugcugccuggugccuuugguggauagaagagguugucagaucuccuggaaccggaguuacggaugguuguaaaacaacauguagguugugggaauugaacucagguucucaggaagaacagcaaggguucuuaaccacugagccaucucaccaguccccauauugacaaucucuucuuuuuaugugcuuauuuaccaucugcaguaucuuauuuggagauaccuauucaagaccuaugcccacuuaaauuugguuguuugacuaguccaguuaugagaauuuuuuauguauauucuagauaccggguaagugauuugcaaauaacuuuugccacugcauuagguaucuuuucacuuuuuuugauuauaccuuugaguacaauauuuaaaauuuuugaugaacccaacuguccucccuacaucuugguuucuugugcuuuuggcucuguucuccagccugaccuaggguucacagcucuuuacacucaugcuuucuucuaauagucauacaguuuuaguucugacauuuuaauauaugacuucauguuauaugcuaauuuuuguacccuguaugagguaggagucggacuuuuucaaaggaauauugaaaacagugcucuuugaagugaauugcuuuggcaccuuguuggaauauuagugucuguaaaugcagugguucauuuugacuuuugucuguuccauguccgguuaagugcuggcuguguuucuacugcaagugaacuucacaguugguuaacucuuugccccuuaguuuccucaucuauaaaaugaguaaguaguaagcacuucauggagcuguuguaauaagagacuaauaggugcaaagagcuuaggacagucugcauguaguaagaaccuagacugccuuagccgaccuucguugcuuccgcuacagcggcuacuggcaucaccacuguaagacuuaguuguuggcgacagaugaugcugagaaggucuuguuucuacguacaacugcaaccagaucccuucccccacuuuguaaaacuucuguucagacuugaucaguagccuuaauggaaggugaugugaagccaggaaaacucucaagauacaggcacaggcagaaucuuucugugugagacuguugacaaaugugugcugaugagcugcccgguggauuuugcuaccaauguuuaucccugacgucuacauggugguaggaggaaaccaacuccugcaaacuguucucuggcccucauguguacagugcgcaugugcuccuucuucaccccagagauaagcaaguaaagguaaugaaaggauugacagagauguuaggcccuuucaaaaaguugcacacuuggaacucaaagaggaagaaauaaccuucaauguggguaaaaguacuucccuauuguauuguaguuauuugacagggcauugauaaccagaauauagaacuuugaaaaaacuaaacacacacacacacacacacacacacacacacaaaagacaucgacuaauuagugggcaaaugaaccaaacaguuuucaaaacaaguacaaaugaccaauaaauacaagagaaaaauguuccggagcuggauggauggcucaguacuauucuucugaaggacuggcugaguuugguucauggcacccauauugggugguucaugaucacccauaacucugacuuuagggguucugacauccucuucuggccucuguauacacagaaauaguuuuuuuuuuauuuuuauuuuuuaauacucaguaucuucagacaucagugaaaugcaaacaaagccccauugagagucucccucaccagaaugacuauuuucaucaagaaaaaugacaaauacugugaggauauugggagcugaagaggagccccuguaugucgcuguugggaauguaauuaguacaaccaauauagagguucuucaaacuaaaaacacugaaaggaccaccuuaugauugugguuguaccacuccuggcuauguacccaaaggagucugaggccaccacaggcauaccugugcauccguguuuauuaugauacuguucucaguagaagucaagccaggcugugaauucagccuagauauccaucaacagauaaguagguaaagaaaaugugauguauauagagaauauuuauccagccacaaaaagaaugaaauccuaugugcaggaaaauagaacuaaguggaaauaaaccagacucagagagaaguauuacuuguuuucucuggaguucagaaacagaugugaaaguaggagggaaacacuugauuguuugugaagagggaggggaccaguuggagggggaggagagaggacaguugguggauagaaucaaaguauguauguacauguaugaaaacauuacaaaacucauauaaguuaacaaaguuugaaauaaaaauagguaaaccaagucugaauuguuggucugccauaggggucagugugaggaaacuugccuggcauaguuuacaccugggcaucaauuuaagccuagcaccacaggaaaaaacaaaauaaguagucaucgugacuuaccuccuuugcuggauuguaagcucugaaauuagacaacacguuuagagaguaagaaguagcaagagaaagacaguauagagagcuggaaagacuguguuagggaaacacuggaguguaggcaucguugucacaguaaauuauuuuauuaaaaguacuuaauggaaggggaagggguagcuuaagaguaccacacuugccuagcaugugcaagggucuguggucuccacuggggagagagacagguaugggcgagggacagugaugacagcaggacagucggcuaguaaggaguaugaggguuagccucacaguucugaaguuauuuugguggguggauaauaugucuuagugauggacuuugaguuaccaauaacgugugaauacaugaaggaaagaagcgcaagcacuuccuuuuggggucauuuaagcaagagggaguacagauuugaauccuccacuccauacugccugugucuucguccucugucuguuuauaagucugaauuugugcuugcccaaagccuggcuuguaaaucuguccaagugucuguauguaugggugugcaauuaucuguauuuguauuugugugugugugucuuguguguuucuguuugucugucucuaacaaagguuugcucuuuguuuccugaacagcauagaaagcaucacacggaauaaaauguaauucuuuuaaagaaugggauacuuuacggaaaucuuuaaaagacucuacaagggauuaagucacugccucuaaaugauccuaacugacccacauaacaaacuacuaccaacaccguugcuuaucaaccagucuuccuaagugggaauuuauuugagaagguugcuacaaccucugaauuuguugcuuucaccaaaggguguacaugcacuguccugggucagggucaugaaaagguaccuaauuuaagaucaugccuaugccauuaguuuugguugcacaaguugauuacuuggaaaauccaaggaaaguaggguuuauuguuacauaguucucuuaaaggcggauuaaacaaacaggaugaguacauguaagacagacagcuucuaagagauuucagaguuauguuacuaagaacuuuggcugugaggcccaguaagaguuccagucucuuugaauguaagggauauuuucgugguauuggguugccacagaaggcaaagagacccagaaguagaagucaugcauacuuugguuuuuacagucaaauguguggacuguaaaaaccuuagcuuucaagcacgguggacugggggucuuucccuaacuuuuuaugauguuuagcccccgcauggcgauuuugauugccaggcuauugcugguaauguacaaaaucaccuccauuuagugcugcaugaagauuuaguagaacuggaagagacgcuaacguucucuaaaacauguaugcuucugaggugagcacaugugugccuggcagggaugugcuacguuagcaugcuuagagcugcacuucucacgcacugcacagcucuggcguuuccucuguuaauugugaacuuuaucugcugacaaagauacaaccauuuucauuucuauuuuaggucauacuuucuauauuuaucaaguucuuuauuaagcaaaagguuuuguuauuuaaaaccuuuuuguugugguuauuggcuuugcuuuaauauuaacuguaaaaugagaaagccaagcauucagagagccuauuccugucaucaugaccaaauucuccugauauucugagagugguuucguuuguccuauagaugugcccaugaugcauaauuauuacuuuaaccuuuauuuaaaaauuaauguuuucagaugucauugaucagagugaaccgcuuugguccccggggagguggaagaaaaacucugaaaguaaagaagaaagcugcagugaggcaagaaugggaugugagucugggcccacagcagcguguucuggaggguggccucaguacuccuguccaguguggcuggaguggcgcucaggcucaaguagggucggguggguuucuuggcaugguuuuggucuuggagggaagagcaggacauuugccccguucuccuuuaaguguacaggauuaaggguaauaacuucuaguucuuugcaagaguuagagcugcugugagacugaaacucuauccccaaagauguuccucugcagcuugccauagugagcacaguuucauuguuaaaaugcuuuacaguugccucauggaauccuagucucuggaaacugucgcuucaguuaaguuuacucacaacaugcacccuguuuuuauuccuuguuuuaaaauaauagagccuuauuuccaguguaacaccuaaaaaauagccuauuuucuagaagauacucaaaaguaaccuguuuuaacguuauauugacaguacugguuucugaggaaaaaaggacuguggcccuuaggauucugaaucgauuuucagcuacugaaacugaauaacuguuagaaauuuauaaggaaacuuuaaaaaagcucacucuguccuucuuuuuaaagaauacugugaaugaucuaacaguucaccgggcaacuccugaagaucuaguaaguugaccacugaaaguucaauccugcuuucuguauuuuauuugguaucugguuucuaaucugcagaacagaaaccaucgucgcuccuugggacuuguuuaguuacaguuaaucuuguucacgccuguauaaaaccugaaaggauauccugcggaauuuuugauuuuacuaaggcuuagcagccaccguuagaauucuacucaggaguuuuggucuguaguccugucacuuaucuagaaucuccuguggucucugucugcacuuccucagcauuuuuccauuguugucauugcuguuacuuucacgacagguuugggcuguguagcccugguuagccugcccacgacaauguggcuaaucuuucugucuccguggauuugccuagccuugauugcucuuucagauggacuacaggauguggucuguuauuuauagccucuuugucuagcauauuuuguagauucauccauguuauaguauguaucucugcuucguuccuuacuauuguaagacaguauuccauugaauggcaguucuagauuuaucuguuugucaguuguacaucugguuuauuucugcugcuuuucuguuauaaaguaacaccauagcggauauucauguacaagucucugugagcauaugcaggcagcuguguguguaucuggaauggcuaggucaugcauccauauuggcucuuauaaaucacugccaaacuguuuuccaaagugcuuaccugucuuaaauuccaccaguguguguggagcuuccaggccacacgccccauuauugucaccuuuuaauuuuaauucuccugcuggguauaaaguacugccucauugugauucugauaugcaugcucacaauucuugauuguuaguccuuugguagugugcaugucugcaugauuauaacuuuauuagaugacccgaguuuuguucauauuuucaguucugagcacuagcguauuuguaaagacaaaugucuacuuuuauuccucagucacccccguggacucuucccuuccaauucuuuuaggagcucuggcuccugucucuucugccucaggaacucuccuuccuuggaugucuacaucaucugugaccucaguuccacaugaagccacuucagagcuguacaaacagcauugacuuagaaguaaugcaguuacugugaaaggggugugcuuugacaaagcugacuuagguggauuuuauacccuuuccaucaugugugaagugucagugcugaccacuaauugauauuuuagcacucauugcaugaguuuuaacuugugaguuaaagaacaguagguguuuugguuucuguaccaaugaaggagaaguuaauauuuuuguaugucuuuaagauagaccuccaaguucucaauacuuuuucucuuagaucauuuugaaaacuuagacuaugaaaguguuagcuaugaauguacacacauacugaaccauaaaggaauaggaaguggugaacuaguguaaguggucuugcauagcagcaggcaaugucuuuguuacugaaagcauuucuuuacaguuuucguucuguauaggugcgccgucaugagaugcacaagucaaagaauagagcauuggugcacugggaacuucaagaaaaagcuuugaagagaaaauggaagaagcagaaaccagaaacuucaagucuugaaaaaagaaaguuaucuaucaugaaggagguauugugaaaauccacugucuuuagagguuuuuucucuuggauugguuucaguggaaagacucuaguucuuacacgaccuugcacagugagcuguuugguagacucuucagagagcagcaggauggguggggucaagugcagagagcagcaggauggguggggccuagugcagagagcagcaggauggguggggucuagugcagagagcagcaggauggguggagccuagugcagagagcagcaggauggguggggucuacuuugcugcuuuaaauguacuuuccacaacucaucaacucuguaggcuuagauuauauaacuccuuggccuggguuuguuuguuuguuuuuguuuguuuguuuguuuguuuuuccucucuuuucucuuucaaccuuuuaaaaaguagcauacaaaguagcagguuccuccugccacuguccucauacuaaguuguggaugguuggucucuucccccuuucccauuccuaccguuccccugucccacugaauccgcuaucuccagcauuucgaguuuccuuucauaucauauguucuucccacuccuuuugccaguuucauggccccauaagaaaauguuuugacuucuauacauacuuacucccaccuagauacacauaauuaauuaaguagaagccaggauucacacaugagcaagcauauccaguucucaucuaucuggguugccuaacuuaaugucauauuuuucaguucuauccauuuuccuacagauuuguaacaucauuuuccuuacauuagcuuagcuuuauauccuuaaauuuuuggcuguguuguuaugagaguuuaauugcauaauacuuaaauuguuuucuuaauuucauuauaugacguuuuguguucauguaugucuguguaccauguugcuugcauaggccagaagaaggugucaaaucccugagaacuucaguugcagccaauugcgaguugccauguggugcugacaauugaagcugaguccucuagaagagcagcuaguacucuuagccacugagccaucuuuccaguccugcuuuuaaagagauuaccacagucuugggcaaaauaauuaguacuauguaucuguaaacuucuguaauuaugucucaguucaacagcauaguagaauuaccuggaaaaaaugaaauaaaaucagauaauuuuguaugcguguuuaccuaggucuuaagccauuuuucucuggcuuaaccuuuugccugccuggguguuugaagaagcaaucagauauguagggugaacagugugucaagcaagaaggagcuacaauagagcagccuuuuuuauuuggacugcaguccuaauaaaggaaugugucgugcauguggccccuuacccaggguuagcguacagugcuugccaucugcguggccuuucacgguggcuuuaagccauaggcugccuuuugagaaguuccuuagaguucuuagaaaaaucugcaucgaggaaaacugugucucccaaauaaauguuuauaagacaugaggaaggaacaguggaucagagaauacgacuucucauguuauaaucgugagccagucaugcacacauguuaauucucauugaacagucuaaaaccacagaucugaccucgagacccucuuugggagguuuucuuuuucuaguuuuaaucuucuuuuccuuuuaauuuuugaagauuuaguuucauuuguuuucuuuuuuguauaaggguguuugccugcaucucugucugucugucugucugccugucugucugucugugugucugugugucuggugccaguggaggucagaagaggcugucagauuucuuaaaacuaagucacagagaauucugaguuacuagaugggugcugggacuccagccucggcaagagccaugagcauucuuuuuuuuuuuuuuaaauuauuuauuuaauguauaugaguacacuguagaaguauacuucuucagacacaccagaagaggguaucugaucccauuacagaguguuuugagccaccaugugguugcugggaauugaacucaggaucuuuggaagagcagucaaugcucuuaaccacugagccaucucuccagccuucauuuuauuuuauuuuauuucuuguugccauaagcauucuuagccugugauaaccacugagccaucucugcagcucccguagcuuuucauacaaguacuaaauguaggugaaguaaggggacaagaagaguaaugaggggacaggugcagggucucaucugugguguggugauucucaguccugacugcacaugagacuucaucauggccaagaugcuccugaggaggguggggaaccacuguaccucaacucuaagauucagaguuagugaagcuagguggggagguuuccccaguucccguguguuuuuguguucugcaggguguuagaacuguagcuuuuggugagauuuagauguuuucuuuuacugucuuacuuaguacagugaucuuuggccucaugaacaaucuacuccgaggaaugugacggagacucaguaggagaaggcaaagugguggcuuuacuugaggucugacuguaauuaauacccagugucaacagauuaguaagauuauuccucuacuuucugccuuugucaguuucuacuguagccauagccauguugauuuauuauauauuuauuauauauauccauuauaaguuacgcuuccuaagcucuuaauuauauggacuuggaagauauuucaccaaagguagaaauuugguucauaagacaguauaauauguauuuuaauaacccucgaagcaucauacagguuuucaguguauccacacacuaggacaucccuguaggguggagguggugauuagauucuauugauaugccaguguaucuugaaagucaguaguuagaaauaaauuuaccuuuuuaaugucuagguuuggauguagauuugccauaauuuauuauuguucuauuuguggacacuuagcuucugggaauaaaagaacucaauauaguaacuuaaacaaaacacagauuuaguucucucauggagagcucagagguagcugguagagggucccgcaguucuucagcauccugaacacaggguggcugcuacaguguccuucaguuguuugcagggcaacagcaaguggaaguagagagugucugcuacuccuuuuaugccagccauuggcacugugugcuguucuccaggacacuauugcuuggaggcuccuguauucaaagauggguuggaacuugagcugcuuccuugauuaaaaugcaggagucggcucaggcauuguggcccaugccuuuagucccagcacucaucaccaggaggcagaggcaggucggucucugugaguuugaggccagccuggucuacaaagcaaguuccaggacauccagggcuguuacagaaaaaaaaccugugucaaaaacucaccacaaccaccaccaccaccgccaccaggaacuuaggaguugcuauuaaagggcaguauuagggauaaguaguagugugugccacucagauugcaucuuaucuuggcaugauaaauaauccagcagauagucuucauuguguuuuuggguacaggcuuguuuguuggguuaauuauuaacagaagcacuaagucaagggcuggugcuuuagcucaguguuagagcacuuaccuaggguguuucaggguuuacucucaaguacugggggaaggaagaaaagaaaacuaaggaucaaagagcaugcgcauauuuuguuucagucacuaaauuuuucugugcuuguguugucuguauuuaauggauaugauaggacgguaggcauaucccugauacaaaggcaugguuguuaccauguuagaaaaauaacacagcuuauuuucuauugauaauuugaagaauuuacuacuuuuuguuuuuaaggcauuacccuguuaggguuucauugaugugaagagacaccaugaccaaggcaacucuuaaaagggacaacauucaauugggucuggcuugcagguuagguucagagguucaguccauuaucaagguggggcagggcagcaucuaucuaggcaagcaugguguuggaggaguugagaauucuacaucaucaucugaaggcugcuagaagacugucucccacgugguuaggagaugggucucauugcucacuccccacaaugacacacuuccuccaacaagaucgcaccuacuccaucaagaccacaccuccuacuagugccacucccugggcaaagcauagacaaaccaccacacacccucugucaaaguaaagucauggagcugacagagcaguuaaguggaaaaacaaucuuauuaacaacuacaugcccggugucaacuauaaucaggucucaaguaaaacccaugcugugcgccauugacgucgcaggaaacuaacuaaagugguuagaguuuauuuacuauuucuagugugggcccuaagcccaguauucuguacggugugugcucuuggccuuugcaguucuaaaguuacucuauggaagguacaaauggcaaucucauuaacugaccuagccggccggcccacuuggccauggcagaaaggauagcagaagaaugcuacucacuuauauuucuguauuguaaaauaguaauugccaugugaugugauuuucucuauuacagagaaauuccacucagcguguuugauauuagaugcuuuauugauuugagucaggguuagaaaaggagcugccuugauuuuaagauuccuuucagcucaagaaugccaucugguggcaguaggcagaguugacucaucuguagcauauggcuuuggguuuuguuguuguuguuguuguuguuguuuguauuuauuuauuuauuuagguauuuauuucauuuacauuucuaaugcuaccccaaaaguccccuacccucucccucacccacucccccacccacccacucccacuucuuggcccugacauuccccuguacugaggcagauaaaguuugcacgaccaaugggccucucuuuccacugauggccgacuaggccaucuucugauacauaugcagcuagagacaugagcucuggugggguacuggguaguucauauuguuccaccuauaggguugaagaucccuuuagcuccuugguuacuuucucuagcuccuccauugggggcccugugguccauccacuagcugacugugagcauccacuucuguguuugcuaggccccggcauagucucacaagagagagcuauaucuggguccuuucagcaaaaucuugcuaguguaugcaauggugucagcauuuggaugcugauuaugggguggaucccuggauauggcagucucuacaugguccauccuuucgucucagcuccaaacugugucucuguaacuccuuccauggguguuuuguucccaauuauaagaaggggcaaaauguccacacuuuggucuucauucuucuugagcauguguuuagcaaauuguaucuuauaucuuggguauucuaaguuucugggcuaauauccacuuaucagugaguacauauugugugaguucuuuugugauuggguuaccucaagauccauccauuugccuaggaauuucauaaauucauucuuuuucauagcugaguaguacuccauuguguagauguaccacauuuucuauauccauuccucuguugaggggcaucuggguuccuuccagcuucuggcuauuauaaacaaggcugcuaugaacauaguggagcauguguccuucuuacugauuggaacaucuucuggauauaugcccaggagagguauugcgggauccucagguaguacuauguccaauuuucugaggaaccgccagacugauuuccagagugguuguacaagcuugcaaucccaccaacaauggaggaguguuccucuuucuccacauccucgccagcaucugcugucaccugaauuuugaucuuagccauucugacuggugugagguggaaucucaggguuguuuugauuugcauuucccugaugauuaaggauguugaacauuuuuucaggugcuucucagccauuugguauuccucaggugagaauuguuuagcucugagccccauuuuuuuuaauguaguuauuugauuuucuggaguccaccuucuugaguucuuuauauauauuggauauuaguccccuaucugauuuaggauagguaaagauccuuucccaaacuguugguggccuuuuugucuuauugagggugucuuuugccuuacagaagcuuugcaguuucaugaggucccauuugucaauuuuugaucuuacagcacaagccauugauguucuauucaggaauuuucccccuguacccauaucuucgaggguuuucccuacuuucuucucuauaaguuucagugucucugguuuuauguggaguuccuuaauccacuuagauuugaccuuaguacaaggagauaggaauggaucaauucgcauucuucuacaugauaaccgccaguugugccagcaccauuuguugaaaaugccgucuuuuuuccccuggaugguuuuagcucccuugucaaagaucaagugaccauagguguguggguucauuucugggucuucaauucuauuccauuggucuacuuuucugucacuauaccaguaccaugcaguuuuuaucacaauugcucuguagugcaucucaaaauauuuuuaaaccauuuaaagagauuuaguaauucucuuuagugucuauuguggauauauauauauauauauauauauauauauauauauacacaauauauguauauguauauauacacacacaauauauguauauauauauuagaaaauuuauauauauuauauauauaauauauauauuagaaauuuuaaauagaacaauaaucaagccuuguccauaucuuuuuguuuuuuuguacauuaaaguccuucaauagaaaguacauagucagaggcacgacuguaaugguguuuaguuuaacgaucucuccauaauaaaaaaccaacuuguuuauaaauaccuaagcauggcuuuguuuaauccuaaaagcuauacuguguuuuucuaagucauaggucuguuaguggauuaucagaauacuucagugguggaaacaccuugaguuuauggcucaaagauucuuaucuuugguauguguuuuucaacuguauacuuuauuuaauggguuauaaaaucaaguuaguggaguacaacuaucacuuaaaacuagaauggaauaaaacuuaaauauaguuauucucaugaggcaaggcuauaugaauuacagucuuacuuuuaaaaaguauguauuuguauguguguauauaucugaucauguguguguauuuuuguguguacaucuguguguaccagaucacaauguaauauguauuuuuucaagcuacuaauaucuguaguagucucaccuacuguuaucuaaguauauugucauuggaggguuuuaggauggucauggcccaugguuaagaggaaauuuagcaaccacaaucaauaaggauugaaaauuaaacuuucaaaaugucauguuuggugccuucccuuauucuuuuuucuuaguaauuugauaaguaagcguauuuuucucuaaucaguauuuuucuucacacauguguagauucucucugaucaauaccugacacaggaugugcuggaaaaguccgaucaucugauggcugcagccaaaggucuguuugcugauguuccucguaagcgcacagguaagcguucaguccacacacagcuugcauaucucccggaaacacagcucaggagagauuagaggaauucacucuguuaucaggagucaugcuccugcugcauagucuagauggcuaguauaugaagagccaagaaucauaauucacuugcuguuuauaggaguauuacaaguuucucaauuaagggaacuaucuacuaacauacaguguaaaguacagcauuuuguaaccgcaaaacauggcucaauuuucagcuuauuaaguuaccauauaauuaaaauaugugcauuuacuuguaguuugaguaagccuagcuuaaaaucuaaagcaacuucaguuucuugccaaaagaaacuuugcuuuucuuuaguuacauaggauuaucccugcccuccacccucacaauccauguagccgagacuggcuuugaucuccugaucguccuuccucuuaacuccuuagugcuggcauuaaaggcguauaucaucauucucggcuccagcauuauuaaucauaauggaauauaacuuguuuaaucuuuuagaaacauaugauuuauuuuuagugggacguuugaaucccacaucucccauuuacuagcguaacugggcuaauuacuuaauuuuuccaaguuucaguuugcuggccuguaaaauaauaaaaucuaucucauggaguuugugaagguaaaagugaguuuagauguggcugguacauauccauguaaguggagcugcuguuuggaauuucucugaggugaagggagccuguggcaguauagaaauagugaagccucuucaagcagacgaaauaaaaucgugaugacuuguguuuguuccucugcaggguuuccaaauguaacaagggcuccagauuccucacagagccacacuggaauaaaucaagacccugucacccagucuauccuuaaugaaucaaucauagagccucagguaguccauugcacucacaaccaagugcccaugcugaaaugaaguucagcuugauacaggcaucucggaaaacauuguaaaagcuuaaaugucagccauuguccugucagcuauaaagagacaguagaaaaagaaacuaacaaagauugggaaagaugagcuagagaaaacauagaacauccaagaagauaagauaugaaguugaaggaugaguguaaacuucaguauuuggugugugugugugugugugugcgcgcgcgcgcgcacaauuggaagucauaggacaaccucaggaauacuguccccuccuuugagacagggucucucauuggucuggaguucacccacuaagccuagcuugacuggcaaggagccuccacagugcagaagugaaaagcaugcacccccauuuuauuguguguuauugugcgugugauuuggguacuggauugaauuccuugugcaugugccauccuucucuaagcuguuaggaagggaacaagggauguguaagguguaaugagggaaagaccaacuugucuguggaagaguaagcaagcugaacucgaccuuguagaaaguaucuugaguggaguggcaggacacaagccaaauugcagaauuggagaugaaucuuuaaagagauugguggagcccauagcuuuagaaaggcugagacagaaguaguugugaauuuggggccagcauuagauacauaauauauuggguuagcaugggcuaaacaaaaaaacauaagacaaacaggagauaauguaucaaggugggguaagaagaaacaggcucucuuacacucaaauacugauagcugaagcaggcaagcagcugaagauaauuaggauaguagaagacugagagaguuugguaguuugcacacaugagggugucaacauuaggaggagaaaugccuguuaugacuagugcccuauuaugggugaguauauaaucacuugugcuguuuuacuguugagguaggcucuuaaugaagucgacgaugcaggggagcagagcacugcucacagccagucagaagacagcgagaaugaauugccuaacucccucagccagcauucuaacaggaguacagagagguacgugugucccacgaguacacaggcucggccaguguucccagaguauucaaagugugugcuuauugcauuauuccuuaaaaauaaaccagcaaaaaaagaaccagcuggguguauaguuuuaucuaaauguuuaaaauuguucuauaauguuuuaaaaguuguaguaggaguguaaaaagguuuuuauuucuccuguacuucuuucuguaaguaaagcagcuauauaaauauauaucucacuuccucuuguuucacacauuaaaaauggcaaugcuguauuugaauuugucaccaguuaugaccuagagucagcucacagccuucuguaagguuuuaggggucacuugcuuuguuuuuacagcacagugaaguagcugggcuguaaacugagugcuagcugacuggccacucuccuggauacaugaccauuuacauuauugcuaguucuuuguaguaacaaaaacacuauaguaaauaucuucauauuuuuauaguauuugaaguccauauuuaagaaaaauuauuagaaguggaacuugagguuuaaagcauaagcacuguacaauuuugcuuuaaauugcugaauucuauuuuaugaagaacuuugaaguucaugcccaggguacagagcacuucccacauuauuuuauaggaaggcgccguugcguuugaggucuaaucucuuacaguuacaguuuguuuuugguacacaggaugagauacgcaccuaugcccuuaaacuauuaggaaagacuucccuuuugucccauugucacagccuccaucugaguguggacuugcucuucuagugaugcuggccucuuuucuccagucuccuggagugcaacagaguuuugcuuagagaggacuuguaggcuuuauagauaccuauggcuuuucuuucuuuguucuguuuguuuguuuugagacaagguuucucuauguagcccuggcuguucuagaacuugcuauguagaccagguuggccuugaauggccuaccucugccucccaagugcugugauuaaaggugugugccaccauacccaccauauagcguuucuuaaaauuuuaggguguuccuaauaauuuuaaucuauuuuuauaugaaaauuaguaucaauuuguuuaacuucauaaaacaaaacuuacugguauuuucuguuaugaugcaauguuuccccuuuguuaaaaagugugcuuuuuguuuuugaggagugcuuugacauuuuucuuacauagugugugcuccuugcucaguuuauucuuaaauauuguuuguuucucguuuaauuucuuugucuuccacuaugucuuuuauaucucuguguccuuaggcuccucuuuugacuccugccccauuucuggugcaaaaccuuuucuucaauaugagcaaacugucugcuguacagacacuggcucuccugaagggaagagaaacuacaagggcagaaccauagauaaauaauuacuuuagagagagaaagaagggugagacuauauauacaaaggcaaacacuauuguguuagggaccaugggaccauagaaacuggaaggcagauggacuguuuucuuuccuaagaugaugggccuuuuggcuucuuacccgucuguauuagcaucauucuuuugcuaugauaaaagacucagacaaaagcagccuaaggaagagugaguuuauuuuggcuucaaguugcagaggggaugccauccacugugacagggaaggcauggcccaggagcaggagcaggagcaggagcaggaggccagccugucacauuguauuggcagucuggaagcacaacauaggaggaggaagcggggcagggcgacuaaaagccuuaaucuguccccagugacagacuuacucuugcaaagucaccuuucauaaagguuccacaaucuuuccaaacagcuccaauagcuggggacuaaaaugugaauauauacaccuaugggagacauuuaucauucaaucuccacauugucuugucagauaaaguugguaacauuguuuuuuuuuuuuuuuuaauugugaauuucuaaaaacuuguaaagcaaacacaugaacaguuggacaguuuaaaugauagcaccuauuaauucuaauugucccauaauuuauagguuucuucaccaacuaaaggaagagaauuccgaguuaaucaaucaacuguggacugauauucagcagaaaaucgcuacccagucacaaagaacuccuccaggaucuccguccucggagcuuucagccgaggaucagaaaggcuaguuccuccuuugcuguauuucuaguagcagacuugcuuagguuugcuuguuugucuguuuuguuguuguuguuuguuuugaacacaauaguuuucaaacuuaacuuuuggagucucuauauggugauuaaaauccugaugacucuauuaguggaacuguuuuuagagaaagcuuauucucuugaaaugcuuucugcuguguucuuccuuuccagcugcucugaaugcaacggaugcugucaagagaauccaggcugggccucagccugaggaggcugcugagccuguagacuucagcuccagcuaccugggacaggugcuaaacacaaggaagcaaaagccgcugcuagcuaaaggugcacgccucccacuuuacccagaugaguuguuacacauguccuuucagcugggccaacuggcuguauuuaaguaugagucucaugaggggaagcaagaaaccccucugucccacacagugugucacagaauguuauguuagcuauggauaauguaaacguguuucaaauuuuguagguuuguguuauaaagaucgugguaacuucuuuuuaaaaacugugaacaaucaaaccuuuuuuugguaaauuuguacuugugaucuuccugguuuugacguagaaugacuuuugucauccucagugaaaagaaaacaagauaugcaugcugccuccaagcagaagacaaacaugcuguccuccagcacagccucugcagacagacccaguagcacuggcuccagccuggacguucucaaacacgugauccaugaaguggagcacgagauggaagaguaugagcggugcacagggcgugaggucacggggcugcaggguggucagggacucacaggcuucacccugucccuggugagcucucucugccgccugguucgguaccuuaaagagguaagggugcaaguuaugggaauccucuuuucaggcaaaaauauauguagauugguuucuccuugcuuaauuuauugcaaccucuaaguaaggacaguuaaauuugaauauuuuuauuuuacucaguuuuaguauaucuaguaaaauuuaugcuuguagucccccgcuaucauuagauauauggugagguaaauauugcugauguugcuauggauaaagaaauaucuuaugccaguuguaaguauuacuguuuggguauuuuggguuaaauagcacugcuagcuauagcuuugcuaugucgcuuuccucugcuggcugcugcuccugugucagcucugcuggcagaguugcuuugccuguaaucuguaaauuucauaggcaggaaaaguguggucucuguagaaugggaguugucaucuuauugugaaaauaauuuuauagaauaaagaauuguuugcuacuaaauaauaaucgguccuuaggugguauagaauuaguaguucauuuuaauuuucuauaaggucuacuaaaggauccgaggagauagcucagcugcucaaguguuugcuuugaaagcguguguacuugaguuuaauccccaaaucaaaaauucuggggaagugacgaugguggucuccucggggcuccugagccagccagucuagccgaauuggcaagcuccacucuaggucagugagagagagccccugccuuuauuucugagaauggcacuugagguuuccaugcaugcacacccucauacacauguacaugcagacauuaaaacaucuacauacagguuacuuaugugcuuaaauauguugaacaaauaugacaaaaauguuaagaaacuuuacuuuaagcaguagcugugucacugugguugaugugucaucugggguuguuuucgucagagugccuuauaaugagcgguuucugcgcugucagacaugggaacgucuuuucaguagaccccuuccacuccuguuauccucccaccucccaggauucuuuuccagucagucuggaguccuugaaagugugcuagugcuuaggaacaacagcaggccuaugacaugcgccuuguaacuguucacauacuuucaaagcuaugauaguucguagaguagucaauauaguaccuguuucaaaguauauuuuaacaaucagguuuugauuggcgguauaucacacaacaugaaauagaagcauacagaagaguguagaguggaaagccuaauucucauuccuagcuuguaaccagccugcuuguuuccauguagcucacugucauggucagacaccaaugagucguucuagagacgggcuuuguguucaaacuguauucaugcacagcccuucacuuuuuaaaugaaaaaaaaaaaaguaguucuuuaagauggaacuagaacaaaaaaaguacguuuuuaugaauuaaauguagccuucuaaugaaaguuuuaagucucaucgcugucgugguuguugcuucucuguaaguguccuugcuaucuugucuguguagaaguggaguugucaguaugugaucccacuggugggaguuuacuuuucuucuugucuuuugcagagugaaauccaacuucggaaagaaguagagacaaggcagcagcuggaacagauguuaggugaucaccgagagcucauugaugcccugacagcugaaauccucucccucagagaagagaauaguaccaugcagguauucacuugcccucccaaaggcuccauguuugauagugagcaugucuacgugcauguaagcgucuccuggagcugcggguggcuuagcugcucugaugugacuaccugucacgucggcagcagcaguggguaguaaugagcguuuguuaugccaggguucuguagucaaaacauaagcugcauauaauacauaggauaaguuugcuauuucuaagaaauaugcuauggaguggggauagcaggaucuacauuucaauaccuaccaauaccguggucauuuaaagugugaaggaguguucugguagccacuugucauuuuagaggaaaggguauuagaggaaaggaugacagccuuugaacccuucugcacugguauuagguacucuuugugauugcuuuuggugacucuauaaaaaggcauauaauauccuuccuagaacacugacugcuugcgugcuucuuuaaauauucuuucuuuguaugcauuaugugacuauagguauucauguguauguacaagucuguguggaggacagagguugauguuggugucagcuucagucacucuucaucuuacuuuuugagguugggguccccaugaaugugaagcucaccaguuugacuggacucuggccagugagcucugagaaucuaccugucucugcccccacacugaugcuauaaacaugugcugcuguaccuagcauuuuacauuggagcuggggauuugaacucagguccuuauguuuguguggugagcacuguacugacugagccauauccuuaccuccuuaggacucuuugcaugcugaguuuaaagaauuaggcaaaagaaguggggaaccaccgaaggcaagagucaugaugugacuuaagucuuagaagggucaucugagcuacuaagcaugcacugugcucugcugugcuaauccaccugaagacuacuucaccgcacugugcugcgugggccauagcagagagggcugccuuuguugggccacuuaguguccccugacuccgguucuaaccacuuaggagcuguuugacaauaauauaccuaauuaauauuuauaaauacuuaauauauauguagaaaugaagagucauauauuuauuuuguucuuaaaugacuacaguuauuuaccagugagguaugcguucuuuucugauucuguguaacuauccuuaguuauauuggacaucauuguccuuauuucuuaucccacaauguguuucuacccaaaacguuuuuaaacauagcugcuuccagaaaaccagccaucagaagauuggauggcuuuuugguugucuuucuuguuacuguuugagagugggucucacuauguauguagcuuaauguggccuuggcuuugugguccuccugucucaacuucuugcaugauagaaaugcagacgugugcugccaugcuggccuaagaagauauuaaacuaccaaaaagaauauaaugaaaucuuauuuucaaacugaauugcuuccagcuaauagauggcugaugcugcauagucggugucuucacugcuuucucuucucuugagaacugaagcuguucucugguggcccugugaaaucacuguguugucucagacuacagguugaggacagaacuagggaugguagcagaguacaucuaggcguugugagauuaauucagguagggaauagcagcguggccagagcagaagugggaaaugguguacagauggagcaaauucaaaguguauugugaaggccaaccaaacgcacuggaaauggagcaaaggaaaggacgugagggaaaaagccaaagguaauugugcaguuugggauuuggauuuaaaagaugaagcugccguguauguuguaggaggcaagaggagcuuggcuuugucuagguugaguuugaagucuauuugaguccuacauggggaaacuuaaaagaccacugaacauacgagggugaaacuugaggagaaaguuguuuuguacgcuguauucauugauacuacacauugguacucucucugacgucuggaccacaccuacuuuuacucguugucugcauuuauaagcacuuauggcaugugucaccagcugugucacugguuucucuugucuuuguuauaagguuuuggcaggccauagaacuuugcuuucuucccuuucaccugccaucuucuauaccuguaaggacuauaugccaauauuuaugaaaggccugcauuuugugauuguagucagacuuguugauuuuacauuaccuauuuacaucuacaguaugaaacagauaaagaaaaaaacaaauccaucuaaacuucuagacagugaaguugacuuuuaaugugagaguggaauuccaaacauguucaguuauaugauagaugauaagcuaaucaguuggugugauauugucuuuauuuugaauuggaaaauucuauaacauuaguagguauauacacauccauagacaauucugaguauacauuaacuacaguuacuuucauagaaagcuguaauuauccuacauagagaaugcugugcuuuucuuuugcucuucacauuguuucacauacaugaagauauguuuuuaugacauuagaguuuauccacuuugguguccaugaaugcucuguugaguuucccccaccuaauguaucacucucuuauuguagcuagucaguagagagcaucuaugugaaaagauuuugcaaauuaaaagcucuauaaaaagacuuaauuuugauagcagaguacuuaguaauaguaguuaguuauuuaacuacuacuucaucaccaugauucgucuaggacauuucuaauuaugaauaacauugcuuuaggguagguauuuaaaaugauaacacacacacacacacacacacacacacucacucacacacacucacaugucuguauggcuuacucuuuagauaaugacugcuguuuguuaugccagugaugugugguuuucuuuaggcgagacuucagcaguacaugguuaccacagaugagcagcucauaucgcucacacaugccauuaagaacuguccugugauaaauaacuccagacaagaaagucaagcaccagaaagggcagcuauggguagaagacuuguggauaauguagguagguggagucuuauuauuccccgucuguuaucaaauuaccuaauaucuuuagaguaguaauaagcaaaaaagaucgagcuuguggauuagaggaaguggugggauggaauguaguuuguaugaggucacucuuuucuggugggcuuugcuguugauaucucaucacuauaauguuggugaguuaacuuugcuacuaagaaaccuuuaguuacucaaaggugagaaacccagggcuuaugguacuucacaguuauugggaauuauuauugccugugggaaaguuagaaauguuauagagaugaaaauugguucacaucuuccuaagucucacccuuacaacccuguuaggguagcacagaaugcaccacacuguugacccauaacucaccaagugaucuuguuguggaaugaugcuugcauacagaagucaguauauuacaguuuucuucuugucuuauuugucaugaccauugggaagcuagugcugugggugguggggucugcuuucugaagauagcuuugagucuuuaacagcuuuuccuacugaaacgaguuuucugccucugaguuucuggcaaaggaggguauaguugagagagugaggaauuuuccuacuacuuaaaugcauuuaagaauaaauaccuggaggcuggagagauggcugcaugguuaagaaaacuuaaauaauccuccauaagacacagguucaguucaugguaccccugugguagcucauaacuccugccuguacaguuccagggcaucugaaacccucuuccagccuuugugagcuucuaaaagcaugcaguguacacacacacacagacacacacggacacauaaagaauuacauagaauaaauacaggauuuucacuugaaugucucuucuagcucucugacuuaguaguuuauacgcuuugcaugggucuggggaguuauuuaagugugggcccauguguccuuucuguuccuuucauguuaauguccucuuaucuuucucagaggguccuguuauaagcaguaauggcuccaugccauugauguucagaggggaagaagugguugaauucccacaggaagaguugccuguuaaacuaucucaggggccaacccccacagaaaacuugaaucuggccaauaauuucccaacccauauuuucgagccagcugugaugcuaacaccacccaggcagaagagcaacucagaauucucuccucuccaggaugguaagcaugcuucuccuauauuuauauggaagcugugauuuuuuuuuuccucuucacuuauaugauaauguauauauguguguauguuguauguguguguguguauguauauauguaaagugaguuguaauguauguguacauuacauacauacacgcacaugcacacacaugcauuuuuuaggguaguuccccugcacccagccaucacucugaaaguaacaggauaacuugaagaaggaaggacuugcuuuuuguuccuggauucgguggucugugaccagcuagcucugcucuuucugaaugcugguagaacaagauauggcagaggaaagccucucaccucauggcagcccagagacagugugagaaggaucugaaaaugaacacucuucaaagacaugccacugcugaccaaugugcacaugcgugugugugcgugugcgugcgcaugcgcgugcgugugcaaagguccaugauacacauauggaggucagagagaacuugugguaauagauuugccuucuaccacgugguuccuagguaucaaauccaggucaucaggcuuaguggcaaggacuuuaacccacuuaacucugugucacuaguccuugaaaaauauuuuuaauuauuuuuguuuauuuguguguuggaggggggguguguucccucacccaugugagccuguguggaggccaacaguugacaacauuauauuccuuuaucacuuuccaccuuuuaaauuuuugauuaauuaauuuugagagagagagagaacuaggccuguggaugcuguggcuuguacaaggaggucaaaggacaucucuggggagucaguucucuccuguguggugucagacuggaacuccggccugugugcuagugacuucugcugaggcagcuuucuagcuccucuuuucaaagauaguuuucacagguuggucagcagcgcacgucuuugaaggaugugcuuuuaaagauccuucucucuuuuuuuuuuuuuuuuuuuucaugaguguacauuuuuugcauggauuuuuuuucuuuaaaaauuauaguagaagcuaaguuauaucuuuggaacccuaaguuccucagauugucuguacuuugauguguuuucaguaaggaacugaggagguugcagagguuaaagaaaguggcaaagccuuguuacuagaagugcacuuugcuguuucuauggcaaauuggucauugucagaccagcucaggggaaguggagaugauacugggcuggagccacguacuggugguuugcccacuccuuagucacuuggggggaguuucggacuaagacgccucuucucuaacucaguaguuuaguauuucuuagaggucuggggaguuauuaauuaugucuagaauaaggaaguaagccuugaauugugauguuuguuuauauuagauuuuuaauccuuauaguaauuauucaaucccccccccccacacacacacacacacauacacacacacucgugucucacuaggcagcccaggcuggccuuaaacucacgaucauuccuucucaauugugauuacaggcaugcaucacuguuucuggguaggagguacauaugucaaaguauauuaaaaacgauugugacacaugguuuuucagaaugcuacuaaguggucucaggaauaugaaaguuuuugugcgugauuguccauauuccuuuaugagacuacuuuaggcacucggaggcuaaacccuucuauugcauauuuccuaugacagcaugaugcugugauuauagcacugacugauuaaaaaauaagaugcauaugacuguuuuaaaauugguacucacaguucugaggaggacuguucagacucguccggccccacgaauuccccccacuguggaaguuauagagaaggagcagaacugggaaaagaaggcccugccuauugauccagacauucagaacucaagugaggaaaaccgucucuucacucagagguggagagucucgcacaugggagaagaccuggagaacaaagggcagccagcauuuguuagccugucacagccgccuuguaguucccuucccagcacucagcagccaagaaaccccguguugucagaggagcccacugugcuuggagaugggcagcagcucagaacaucggaggcccuggugcagaggaaggacauuauggcccggaucgccgagcucacacugcagaauucagccaucaaggcccaccugaacaauauuaccagcucagggggagagcaaggugauggacugcgggagccacgcaaacagggaagugccagugaagugucuacuguaaguaccagcugagacugccugggacacagcaggagugagauaggguuggacacugugagaccugucacugcagucuaaaggggccgcaaagggaauaaagauuuguuuucccucaugguuucagacucccugugucagaaucuauugcucuggcccuuagguuagacaaacagacuuucaugguggccagaacacgugguccguaagggucagaggauaagguacaugucuguaagaugugcccaggugaugaaauucuucuagcuaagcccugccuccucccagucaccgccuacccauaauacuuucacguuauagauccuucauuaaagcccucagaagccggucacucccuaaagcccaggggcuggcaagcaagcccccaguguaugaguugggacauuucauaucaggcuuuaacagacauccaaagagguuucuucucagaagugacucugaauagcuuugacauaucuuccuuacaaguagaucaaacuuaccuguuagcuuguuuuacaacaugaaaaucaaaauacaugaacacaugaaaaaagaaaacuaacuaaacuguaggagggcugaggcuaagcuaggagugaaugagauggaguugggaggaccuagagcgcuugcugcacaacuggauuuuaauuaaaaguaauuuacucuuaauggggccuauuaaagaagaguuggcccuuaacucuugaauaacuuuuucuagggcacagaaugaguuuuccuauagaaauuacacuuaaagaaucagucagacuucagugugcauaggaacggucugaggaucuggcuaaacuguagugccugacugaguaggucugggauucagccaguuccuuuguaauacguuccuccgugaugccagaguggcuggucugcucacauuuggaggagcagcggucuuacauagagagcaggugguuuuguuuuguuuuguuuguuuuuuauucuguguaacuaguggcagguauguuggcucagcaaucuucaagagacacaaggcaggauugacauguguuugaggacaaccagggcugcuuuagugagugccagaccauucugggcuagagugugagcucugucuuuuaaaacaaacaaauaauaaaacgagaaaacgauuaaacagagcaucccuaacuguucugaguccccucuggaaaagcuucccugccccuccuagcuccugugaggucagcuuuuguaggcucucuccaugagugagaacaugugggucugucuuucugucagugaagacauuuauaaguaaaguugacgagucugaucacuuaagccuuuauuucauuguucguggggagaaacgugagucugaguccccgacaggaguguccauggcacacccggucacgcagggugcuuucuuugacccguuuugagcaaaggugacgccuguaaggaucugacagcagcuacacugcucuugcagucggaaggcggaaggcgcggggcagccuggggcagccuggggcagccuggggcugggggguuucugagcuagccacguuccuaggggcuuucaaaucaugaccgagugcuuuggugaggaaagugggagguggaaguaggagccaccucuguuaucauuggcucaagagugcaggccaggaaggagcuucaguggugggcagcagccauguacaggcacaaguguguuugcauauuauguuauguguuuguagaguuuugaagaucauuugaaacagaucacuguugcuuuugaaaaguuaacacaauuaaauguugagccuguggccuuucuaaauaauacucccugggaagggaggucugaugcugcugccuuuaccacccccuuucuauuuuaaucagaaauacaaaauagccucugacucuuauugguuuacuuaccuuuaaaauauaaacagacaaaagcaaaaaaacacuaguucaaauuagucauuuuugucauguauuuguuuuuccccucaaagggaucuauuuaacuaaauaaaauuauuaugaauggucaaaguacauuuuucuugggcuuuucaaauuaaacuuauauuguaucgcuggaguaguuuuuguuuuguauuguuugggcuuuuacucucuauuuagaccauuuuacugucuuaugcuccuuucuaaucacagauauucuuaaaucagaucucugaagcuaaaagcaaaggaauaguaugcuuaagagucuuugccagauaacucacgaagcuuguuugaagauugaaguuuuaaaagcagucuuuucagauucagagauauuccuguguagucuguccccacucugaucugucaucgauaggagugugccauuuaccucccuggcagaugugucuuugcucuugugauucauucucauucucucuccucuccuccccucccccucccccucccccucccccucccucccucuuucagcugaggcaaguaguaggagcugcaggcgccgggcggcuucguucaugcagcaguggaaaaauuuguguaugccuuugcuuuagcccucaugcuucaauuacaugauuuguaaacuauuuuaccccaucauucauuuauguuuauaucaaggcucauaaauacugaauugcugguacuuaguagaaaaaucagaguugagugguuuuaaugauggauuuauaccuuucccccuaaagaauuucccagcaguucagucuuuaacgccaaguagcauggaggagcggauugcagaguugaaccgacagagcauggaggcgcgcagcaaacugcuccagcugauagagcagcagaaacuugugggcuugaaccuuuccucaucaccggugucacccguggagucaccucucagagcgugggccgguaggucacagugugauuccugacuuacaaauguagaagugugguuucacucucccaacugugaaaguuccugcugagucaacauaaccuccauaacauuccauguccuagucccccaguucugugccacaggacgcuggcuuggggcagagaguaaguggcuuggcagaaauagugguagaaagcugccucuuagguggauuucugaguucaaggccagcuuggucuacagaguaaguuccauccaggacagccagggcuacacagagaaacccuguauccaaaaaaaaaaaaaaaaaaaaaaaaaaaaaaaugcaagcaagcaaacaagcaaagcugccucuuguucuauaguuagucucuggcaucuagggagacaccaucgaagucacauacaguaugugacucgcuuaggauauaugcugcauaaaguaucuauaaauguuaucacaucagauuacaaauaauugcucucuuaaaaccaggaacauauuuccacucaauugaguuuuuacauuauuuuguuacauuuaagaauauauaaagaaauuaaaaaauaauugaguuuucauaguaguccuguucaaacagugcugaauaaaugaaguagcucaaaguugcuuuuagccaaaaauacauuuaugcccucaaggguggugcuacaucaaagauauugauuggaucccagucuaaagcuaauugugacgaacugaaaggcauuccugagaugcuaaagcuauggugcuuacagggacccaccuuaguguccugcaugacuggguuaccacuaagaguuuucaccucuguuggaaauuauuuauuuuuugaaaauuugaacaagagacucuuggggauuucuagaaaguaacagguaauuuauuuucccuaaagccuuuccuuuguauuuauucuagguuuccucaguugaccaauagcugucuucaguucuucauagucaugaaggcuggaggcaaauucuggcucaaauacguaaauuguucacauaugaauccugcaaggugccugccauguguggucuuaaauauuccagcaccaaacuggggaccacacagaaacaauaaguguagaaaaugucagcugguucugagaauaguuggggacauaaagcaaaacagccuaacgugugauucugugaaugugacauugcuuucuguaagcuugaaaauuaucuuuauuucugcuaucucaucuaguauucaacacacccaaaauagaauucuugauuuuauagucaccucugugggguauaauaaaaauuagaguaaacagugucaugguuuuguaguauaacugggggaauuuaaaaaaauuaguuagcuuuguuguuugacaauuuuauacgugaauaauacauucuggcucuucucacccucagucugcuauucucucuucucuuacagcccccugccuuucucucuucuccuacagcccuggcagcccccugccuacugucccuuucucaugcugauaacuuguuuucccuccagcuauuacauuuguucuacccucuuccaagguuuucucugagccuugaaggaggagcuauagagguccuuuugagagguacuuuacuggcucuuauucucagcacugugagcagccaagagucuguauucaccacaguuuucugccgagccaagcugcucugaauaaggcugagaguggcauuuuuuuucuguggcuguaaagagagauacuuagaaggcagcuugacauaacaguuuagccagacaaccguaguaacucucuucuacucgggaccuacgaccuucccugccgugugguuuugaucagauauauuguaccauggacuuggauauggccaaagcaaagccuaauuaugugaaucuucaggguuuccuaaguagauaaacagucaauagacauuuauuaguaaaauacuuuauagccaucauaaucauagaggaucccgcaagucauucuuaagaucagacuucauagcuguaaggguaaaagaaacccuauuuaguuuuaucaaauucaaaaauuaaacuuuacggcuagcucucuuuuaauuaaaaaaaaaauuuuauucugugacaauuucacaaaugcauguauuuuaacuauauucacccccccccauacacacauacacaccccuucucuucauccucuuuccuguuccccaauguaucguagggcccacugguugucacugcuugcucugauaugauaccacuuguuggaagauucuggcauucuguaaacuggcaugcugcccaauugacaaguagcuaaaguuuccuguuguaacaguucauuuuuuaaaaaccaucucucaagugcuucuguaagccaucaugacaaaacuauauaaacaccuaaaauuguaacaaauaauuucuaauaauguugaaauuuaacaaagauauuacuucucuuagugagaaguaaggacauuaaauuuuacuuuuauauuuuagaagaaggaaagcgaaccaucgaggugucuguuccaggaauggaggcuucagagaguucaaaaugcaauacugugucuccugucagugggaacaguucaagaagguagggccacagggcuguugguacucaaagcaucaauagugucugugugccuuucucucugcacuagguuucuuuuuaacuuaaguucagacagacucacucauacagagagaauaaggugagaaguaagcuugaccgaguaggguugucugcuuaaaacagaaaugggcugaucuuuaugcauuuauggcuacaaaauuaggagaugcuaucucccaggguagauacauugacugguagcacuuucauccuugcaauaagugaacacaaagcugauuggccuagaugagccacgugauugguaggcgagucaggaaggaguucccuggcuuuccugucuccacccugcauccuuguaucuaccguucugcuccaguucucaucgcucccaggcuacccugaccaccuucccacuccugcacagccuuuaaaagucguaccuguaugguauuauuuauggaaggcaugcgcaguuaucugucaaaaucugcagaauguaucucauacagagagaccccaguggaaacuggacuuuguuaguagugagucaggcuuggguggucaguggugauguauuaauucaggauguuauaaauaagagaagcaguauuagagauggaggugacaggcacaugagaaugccgaaccuucacucuuucuauaaagcuaaacuacgcugagaguaaacuauuaguuuuaagcuuuguguuggucaaguguaacgacccguuuuggaccugucagccaaacccuuuccaggucuucccaguaaagagagcaguugcacgaucgauggcucgugguaaaucucccccucugacugccugcuuauuucuccuugauagaucgucaggggcgaucagcaauucuuguucuccacuaaacgccaccucaggaagugggaaguucacaccaguuaauccaagaacaaagguauguuauaaaauauuaucaguguacuauguaggguugagagagugcagguggaagaugacuaacguccauuacuauucuuagugucuuuaacaugauagaaacugugcaaggaaaagaaagacuauaauuuaucuucauuugaaaaacaagucauuuguuugucuuguaugguaacuaagagauaagcuagaauuugguaggauuucaagugucuuccuucagagacuaggaguuaacuaguuucaggauugauucccaagucuugagugggucauagauuugagguauugcuccugccauuguuggggugacuaaguagaguuugggauagccaguccugggucuggguacuuacaccaguguaccacagcugaggguaccuuuuuuagaugggugauaacaccgagggcaaaugaaugcuuuguaugcuuucauaaguucugguuugguccagacuguuuggaagcuaaacauuuacaauuuauguagaucuuuucacaggaggcauuuuuauuuguuuugauaauguugaaaauucaguguuuaucauagaagauuaaaaaaaugucuuuagaauuguaaaaguuguuucuccagagguaaacugcuaagagauauggaaggcauuggaucauagagaucgacacagcccaaaugcaccaacugccuuaguuaguuagcugccccaguugccuggcuuuacaauuuuguccuuucugauuuuacauucugaaaagcuuaaaguuaucucuuugauacaguuauccaugguucauggaacuugguaucauuuaauuugccaagauccaguaacuuuauuuuuuucaucauguuucaaauuguaucuacaguugaauaaauguuggauuucuccuucugaaaguuagguuuuuacuaggacaccugcugaacaggcaaccagcugucuggugucuucgugggcaggagcuuugccaguagagcugacacuucaaagccauuuaacacaugcgacuuuguugaauguacucgguuuaaaugucucugagucucuagugggcucaugucuaacuccucucugcaucuuuguucaacagacugaaaaaaaaaaugaagaagguugguuugcucucucugcccacauaccguaagugaagccccagcagagaguguccucagugacuuauuccuggccuuuccuucgcacuucacagauuccauuucaaguuaauaacauuuuucuucagauaaaaccugcauagguauccuguauuuauggaaacagaaaaaagaauuauuuuaauauuuuaccuuuucaaauguuuuuucaacaaagcaccucuaauucccugugaguaaagcuuugcaggaguuuaaguuuuauauuuguuuagccuuguuaaaugcauuagugauacauuguuacuuuugucauuuugguugaauguuuguuuguuauuuagugcaucuuaaaugcaaucaccuucccacaagaacuaauuggcuuuauguauaacuuaaaauaaaguuguucuggcuuucagaaaaacgugauacuuuuuuuuucuauuauccaucauuucaaauugaauguacagcuuuaagaaaacuaaaggcuggggcuguggugcacaccuauaaucuuaauguugacuuagaagccggaggcaagggcuguguaguauauaaugaguuccacaccagucugagcuccguagagaacccugucucaacaaaagaacgggaaguggguggaggaaugucuauuuucuuuaagcacguaaaaguagcuauguguuuaauaaaaaucuuauggaguuuuuaagugugaaaauuucaaaaugauaaugcccaucuaguaaguaaugauuguugggguccaguaguugccccacaaaccacacagucacugcccucagucagacaggaaugguuaauugaacgcacacccugaaacugaucagucaaggccauagcuuagaguucagggcugaggcuaugacccugagcaucuuucucugucagcuuauuaaggcuaaaacuguaaaaaccacagugagcucauaugcaggagcagaaagugcugcccaguaggcugacucaagccauuucagaucuaacaguucauacugaccuuuaauuugauggguccuaccuaaagcuuuguggcauuucuuaagauaaacaaaccucagaacauaggaaacauaacaggguauguggucagcaugaaccugcucugagucaauuauuuuucugugucaguaacuggcaagcauauuauagcaacgauaugaaguuguuggcaggcauggaacaaaauggcuacagcuauccuggggguugggccggccucaacaaugguaaugaccauuuuguucaaaugucuaaaugcaguacacugauuuuaugauuauguuagaaacuuagaaaaagaaauauaaaaaacuguuagucauuuccuugcccuaacuuaccuaaaauggauugucuuucauguacugacuguuucucaaauguuggcuucuguuuucaguuugucucagugauaacugccaugcuauguuaguaauuuucaacuugagugaguugggagggggaaagggucacacugaagcuccccugacucagcgcuccccuccccuccccucccugggcuucuaaauuacagcaaaaaguaaaaugauuuucuucuggcacuggugaaguuguguggagucuguauuuguuuuacgucuugcagaugucguccccucguccuguacauuuuguaaguuguuuaauaaagacugucugguggcuuga

SEQ ID NO: 8252 - RNA, 1559 nt, Mus musculus
caccgcacacgaguggcgcauccacacggaguguuuucuuuugcuguuacgagcucucucgcugggugacaggaaaugagcacaggccgacucaggcucucgcaccuacaguagacccggcggucaaccucaccuccggcugcugcaaacucggggcguggucgaggcggacggcggagcugagguacucgaugcgguuccgggcgguggccucaaagaugcucuccgcccgcccgauguccuccaggcucgggucgaagagucucuguucgauaaggccaggccccgaguccgcggcgaggugcugccccaguucccgcagcggguacacuaccuucguuagcuguuucuguggcagccuuagcacuucugcgaaggcaggggacgugcuguaaacccggguccaaggccccagugcuggcgcuuucucaaggagccuucccauucuaugacucaaccuagccgcugccauuuuccucucccagaauccucgcgacuggauuuuauuaguagggucuggacagcgccagacagaaagcucgcugccgcagcgccugcugggaauuguaguuuucuagggucuccucaccugcucaagcuucucaccaccuccgggcagaaagggggaaaccccacugacuuucuuuaacaccuuggcuuuaccaacuauguaucagauuggcguguucuggucuucagcgguuuccagaugcgaaaaacuuaccuuguccugugaucuuugagucucaagggaaggaaccauagggacaaacuaguggauuccaagcccgcuuugccuucuguuuccggucguuuuaucgucgauugacauuuaucauaaguucacgucaccgagaaaaacacguuugcaaaauuaaauaagcuggugagaaaugugguuggaauugcaacucguuuucagagaagggacgguaucucucugacaggcagagcguuggagcagcaguugagaacugacaaagauccauaaaccagaaacagaacugggaacaacuggaguccuuugaagcccccaaauacacacccccuuccuccaauacagucauaccuucuaauccuacaaggccccacuuuccaacccuuuccaaacaguucccuaaacucgggagcaacuauucaaauggcucaugggagccauucucauuuaaaccaccacaagcauuuaaucauuccgugcccugucacuccauuauuuucuuuuuaaagcaucugcauauagcaggcacauaaacuuuagagucaacauaugcuguguuuuccauggacacuuguaaucaaacucuucccuagucucuacuguaggcagaagaucaaagagccagagccagguugacuccaugacaggcuguaaacuggcaguuugggagucuaggccuauuucuguuucccagaaaugaggacccagauucaggagcccauggccauccaaccacagcugcagacagccaauccaagggugccuuaccaccuuggaaaguccccagagcccuaacaaaucacaaaggacucauaucccuggagauagagccaacuaauca

SEQ ID NO: 8253 - RNA, 3112 nt, Mus musculus
gacauuucugggauggaauccagaugaggaaaaaauagaaggagaagggggagaaaagggagaagagaagguggggggaaauaaagggaggagagacggaagggaagggggaaauugucccuuuucacauucaggcuucucuguuuucccucagccuggaaaacauauuaauccugguguuuuuuuuuuuuuuuuuuuuuuuuuuuuuuuuuuacgcucggaaacaaagggacucggccagacugcaggaggggaagggugauaagaaguucugggaaaacuccacagaagggaagagcgagauucagaaaucacuaggacuucacuuucaggaagaucccuguggcaaccaaggaccggcacacacagacccaggagaaacugcagacaaauggagauacaaacggucccaaggacagcagcguucaccuccucccacuggaccagaagguaaaagacacagccagcaaaaggaaucggcccaggcugggcucccuggggcugcuuugcagacagacaaggagacagagagcaggaaggaaccgaucucaccuaggaaacuguccuggggaccaaccuucacguuucucuggaaagccucugcaagcaucuccaugaaccacuguguaagugugccaaccuugcucucugguguuuguuuccuuguugcuuguuugaagacaugaagugugaaugcacauucacaguuagaauucauaauuagcaugcucaguuuacacagucucuggugcaucugggcacagcugaggcagagcaggcgugccucaugccugccgccuguaaaucaaagcuggauuuccugcuuaaagacugacucugcuaagcacugacaaucgcagcaguuuaagagaagcccucucucuguuugcccuccucugcuugcccuccuuuuucuucuuuaacuaucuccugcccuuucuuuuuggccaaguuagagaaagagaucaugcccagcucugcuugcaauuaaugacuuuuuuucuuuucuuuuucucccuucucauuuuauguuauuuucauuuuuguauuauacccccucugcguccccaaguggauaauacaaugauguggaaaaugggaccccacuucaccacgcucuuggccauguggcugguguguggcucagcaucucauucuccugccuuggauagcgacagccacacuggacggaaaguaccuuugguuucuccaaucagcaguaggucagcucgguaucugaggcacaccgggaggucugguggaguugagaaauccacccaggaagaaccaaauccucagccuuuccaaaggaggaagaguguaccaguguugagauuagcucacccgaccaugagaccaccccccucagguaucaauggaguuccagucagaccugaggugagacccauagcuaggagcucggcgcgugagaugguccgagaugaggggucuucugcucggacaagaauguugcgauuccccucuggaucuagcucucccaauauccuggccagcuuugcaggaaagaacaggguaugggucaucucagccccucacgccucagagggcuacuaccgccucaugaugagccuccugaaggacgacguguauugugagcuggcagaaaggcacauccaacagauugugcucuuccaccaggcaggcgaggaagggggcaagguacggaggaucaccaaugaagggcagauccuggagcagccucuggaccccaaucucaucccaaagcugaugagcuucuugaaacuggagaagggcaaguuuagcauggugcuguuaaaaaagacucugcagguggaggagcgcuacccuuacccggucaggcuggaagccauguaugaggucauugaucaaggucccauccgcaggaucgagaaaaucaggcagaaggguuuuguccaaaaguguaaggccucgggcauagagggccauguaguccaggaaggaaacgagggcgguggaggagcaggagguacaggccugggcggugauaagaggaaagaggacccaaggagaacacaaguccaccccaccagagaggcuccgagaaagcaggccaccagcaaggcagccacuccucagccucccccaacuccaagggccaccacccuuccuccugcuccagucacgacagccacucgggccacaucccggguagugacaauagccgcaagaccuacaaccaccacugccuauccagcuacccagaggcccuggacaucccgguugcaucccuucucagucucccacaggcccccugcaacagcagaggugaccacugccaggggccccuccgucucagagcagcuauacccucuaccucggaaggagcaacagagagagaagccacaggccaccaggaggcccagcaaagccaccaacuauggaagcuucacagccaccccaccucccacccucugggaggucagcgcaagaguugugggcacaagccguuuccgggacaaccggacagacaaacgggaacauggccaucaggacccaaaugcggugccagguccucacaagccaguaaaggggaagcugcccaaaaagaaggacagaauucucagcaacgaauaugaagacaaguaugaccucagccagcccaccuccucucagggggaggaggagcggcagguggauagcguucccucgcagaaugccaaggagucgaaaaagcuugaaaagcucgagaaaccugagaaggagaagaagaaaaaagggaagagugcaaaacaagacaaguuacucaagagugaaaagcaagcgaagaaagcugagaaaaagaccaaacaggagaaagacaagaauaagaagaaaaaggcggguaagacagagcaggaugacaaucagaagcccaccgcaaaacaucucgcuccaagucccaagaagucaguggccgaccuguuggggucuuucgaaggcaaacgaagacuccucguaaguaaccuguuuggcauuuuccucugugugcugaggugggggcguugacguguuuguuguguaugcgaaaucacuucuuggacgacggacugaggcuucauguucaagcagguuuggaggcaguguauggugguucaugccuuugauacua

SEQ ID NO: 8254 - RNA, 3112 nt, Mus musculus
uaguaucaaaggcaugaaccaccauacacugccuccaaaccugcuugaacaugaagccucaguccgucguccaagaagugauuucgcauacacaacaaacacgucaacgcccccaccucagcacacagaggaaaaugccaaacagguuacuuacgaggagucuucguuugccuucgaaagaccccaacaggucggccacugacuucuugggacuuggagcgagauguuuugcggugggcuucugauugucauccugcucugucuuacccgccuuuuucuucuuauucuugucuuucuccuguuuggucuuuuucucagcuuucuucgcuugcuuuucacucuugaguaacuugucuuguuuugcacucuucccuuuuuucuucuucuccuucucagguuucucgagcuuuucaagcuuuuucgacuccuuggcauucugcgagggaacgcuauccaccugccgcuccuccucccccugagaggaggugggcuggcugaggucauacuugucuucauauucguugcugagaauucuguccuucuuuuugggcagcuuccccuuuacuggcuugugaggaccuggcaccgcauuuggguccugauggccauguucccguuugucuguccgguugucccggaaacggcuugugcccacaacucuugcgcugaccucccagagggugggaggugggguggcugugaagcuuccauaguugguggcuuugcugggccuccugguggccuguggcuucucucucuguugcuccuuccgagguagaggguauagcugcucugagacggaggggccccuggcaguggucaccucugcuguugcagggggccugugggagacugagaagggaugcaaccgggauguccagggccucuggguagcuggauaggcaguggugguuguaggucuugcggcuauugucacuacccgggauguggcccgaguggcugucgugacuggagcaggaggaagggugguggcccuuggaguugggggaggcugaggaguggcugccuugcugguggccugcuuucucggagccucucuggugggguggacuuguguucuccuuggguccucuuuccucuuaucaccgcccaggccuguaccuccugcuccuccaccgcccucguuuccuuccuggacuacauggcccucuaugcccgaggccuuacacuuuuggacaaaacccuucugccugauuuucucgauccugcggaugggaccuugaucaaugaccucauacauggcuuccagccugaccggguaaggguagcgcuccuccaccugcagagucuuuuuuaacagcaccaugcuaaacuugcccuucuccaguuucaagaagcucaucagcuuugggaugagauugggguccagaggcugcuccaggaucugcccuucauuggugauccuccguaccuugcccccuuccucgccugccugguggaagagcacaaucuguuggaugugccuuucugccagcucacaauacacgucguccuucaggaggcucaucaugaggcgguaguagcccucugaggcgugaggggcugagaugacccauacccuguucuuuccugcaaagcuggccaggauauugggagagcuagauccagaggggaaucgcaacauucuuguccgagcagaagaccccucaucucggaccaucucacgcgccgagcuccuagcuaugggucucaccucaggucugacuggaacuccauugauaccugagggggguggucucauggucgggugagcuaaucucaacacugguacacucuuccuccuuuggaaaggcugaggauuugguucuuccuggguggauuucucaacuccaccagaccucccggugugccucagauaccgagcugaccuacugcugauuggagaaaccaaagguacuuuccguccaguguggcugucgcuauccaaggcaggagaaugagaugcugagccacacaccagccacauggccaagagcguggugaaguggggucccauuuuccacaucauuguauuauccacuuggggacgcagaggggguauaauacaaaaaugaaaauaacauaaaaugagaagggagaaaaagaaaagaaaaaaagucauuaauugcaagcagagcugggcaugaucucuuucucuaacuuggccaaaaagaaagggcaggagauaguuaaagaagaaaaaggagggcaagcagaggagggcaaacagagagagggcuucucuuaaacugcugcgauugucagugcuuagcagagucagucuuuaagcaggaaauccagcuuugauuuacaggcggcaggcaugaggcacgccugcucugccucagcugugcccagaugcaccagagacuguguaaacugagcaugcuaauuaugaauucuaacugugaaugugcauucacacuucaugucuucaaacaagcaacaaggaaacaaacaccagagagcaagguuggcacacuuacacagugguucauggagaugcuugcagaggcuuuccagagaaacgugaagguugguccccaggacaguuuccuaggugagaucgguuccuuccugcucucugucuccuugucugucugcaaagcagccccagggagcccagccugggccgauuccuuuugcuggcugugucuuuuaccuucugguccagugggaggaggugaacgcugcuguccuugggaccguuuguaucuccauuugucugcaguuucuccugggucugugugugccgguccuugguugccacagggaucuuccugaaagugaaguccuagugauuucugaaucucgcucuucccuucuguggaguuuucccagaacuucuuaucacccuuccccuccugcagucuggccgagucccuuuguuuccgagcguaaaaaaaaaaaaaaaaaaaaaaaaaaaaaaaaaacaccaggauuaauauguuuuccaggcugagggaaaacagagaagccugaaugugaaaagggacaauuucccccuucccuuccgucucuccucccuuuauuuccccccaccuucucuucucccuuuucucccccuucuccuucuauuuuuuccucaucuggauuccaucccagaaauguc

SEQ ID NO: 8255 - RNA, 29880 nt, Mus musculus
cauuccagcgcuuccggggggcgggccggagggagcagaggccggccggucccgcccccgcgggccuccuuuugucacguguccugggagagucgagucacgugaggccuuagguggcggcggggcuguugggagagugugagaagaggaaggggaagccggaagggguguucaguggagcuccggggaagagagacagcuuggagaaggccgggggcugcgcgcgcacccgccucucgcucagccggcuugggcccucugcgguggcggccaggugacagcugggccgggccuccgcgugucgccgccccucccccccggccgggccggugccgcugcgagguucgaugccagucgggcacguccggggcaguuuuugacuccccuguggcccggauugcgacagucccuccgugcccuaucgcugcuccagccccaggaugcagaaugugaucaacacggugaagggaaaggcucuggaaguggccgaguaccugaccccgguccucaagguaagcggggagggucuggcuugcucugcccugguugcccaagucccgguccccagcguggacgggguguagaagguggaggggcgagucgcgcggccgggugcugccucuugccuugggcuccugggccagucccaaggcuugcuggcuuccccgcuuccacuagagugaaacugggugccugcugucuccacugaucagugccgccuuggagugcacggcuagguggugcggagcagagguacgaacguucugacauccauagucuuuuaaauagguagacuggguuaaccuuugaaaagaugacagcuugguggcuaaacagcaugccacguuuccuuccaaguuucauaggaaguuuugcuuuucgggugaucuaauucccaacuugcuuagguuucagaggaacauaguaaacugugacauguuaguaacucugagccgaacuagagcgaaacuugacguuucucaagccuuuaagguagccguaagugauuauuaaucuuggacuugagugauccuacagcaacaguucagcacagccgauuguauauuguauagauuggaaacacuauugacauuuuuaggugaaaguugugauagguuagcuguuagcacagauuggauuacuugcuuucaaaaguaaaauuucagggcuucauucagagcuuucuuacaccuucuaggcuacauacgguaacuugauuuugcuuuguaaaaagcaagcaguaaaagagaaacagauaauuuugcguaguuuuuguucuguacuuagcuuucaguuagaauuuuaccaaucuuagugcaggggugaaaucugcugaugggcagaguaggcuguucgaucuuuccuuggcaaggggggaaugcuuuccaauaauuauuaccaaaauacuuuugggccaggcguugggguugcacaccuuuaaucccagcacuugagagguagaggcaggcggauuucugaguucaaggccagccuggucuacagagugaguuccaggacagccagugcuacacagagaaacccugucucgaaaaauaccaaaaaauaaaguaaaauaaaauaaaauacuuuugaaaaaaauacauuuuuggaucaaguuugaagaaucuggaacaauugcgaauguuucuuuuauauguauacagugacagucauuuuaguuaagauuuacucuuuuacuuaagaauuggaaaauaauuucuacauugacaucaaaugcuucuuuuguauguuauacuuccagaauauuguaucuguguagauucacaguguuuuaauaauguaccaucaauuuaacuuuuagucugagggagagaugagcaaaacacuucucaauuaaauauaacauggcuaucuuguauagcacuugcauuuuguugaacuuguagaauaguucucgaggaaucaaaaauacauacacacacacacacacacacacacacacacacacacacacacacacacacacacacacacacuguguagacuuaguugguuuggaccgcacuguguagcucagacuaaccuugaauucuuagagauccaccuuccucugccucccaaguucugagguuaaaguguuuugccgaccugccuggaggcaauguguagcauauguuuuuaguauaaaagagaauuaauggccccuccuugugacuccugucacuccuguaaagagaauccuuauagaugagggaagggaaagagaaaaagagagauaauccagaaagaaaugaugcuuuguuaggaagugaagguuuagagauggcuuuguuuagauggcagcuguguaguaaagccgaaauccuuagagugaucuugaagggucucuggucacuacaagucccagucuccucuaacuugugaguacuguggcguagccucccuccuuaguacacaaucaagcagacuuugcuucuauaauuuuucuuucucccuuagccagcaauccuuuuacuccaaacagccuuaugguuuuagucuuuuuucuauccuuuauuuauuuauaauauauuuuguucuuauuucuugagaauuucauagauguguacauuguauuuugguuauauccaucucuaccuccccaccuccaauuucuuccagaucacccccagcauauaccucugccaacuuaguguuuucuuuuuaauucucugagcacagucacugcugccuaggugugugugggcauagggucacccauuggagaguggacaaccuaccaaagaccacaacuugaagaaaagagacuuaucuucuccuagagaaacugcuagaggcugggaggacugcuuucaaaguaucagucuuugaaagagacugauacacucaaacucagagugccagucauucacuaccugaacaagaucaagccaaucaaaauuccauuggguucuggaggugcuaaguuggacccuuagccgaggaguuauuuuaauaccaccucuccccuaccuaguuuuuuuuccucuucaugcuauaaagaucaguuugauuuauuuuucaggcauguagcacauugucucaaauuguacugucauauaaugguaaauauuuguugaauaaauaauauucacaaauggaugucuuauguuguagacuauaccacaaaaaucuuguaaguaaaauuguggaacaaaaauuaguuaauagcauuguugcuucagaggagaaaauacuguuaaaaguuuaaugaagcuggugguagugacacagugccuagaauguucuggagccugaggcuggaagcuuuugaguuacacaccagcuuggccucaguaacaaaacccaaucuagaagaaaauaaaucaaaacaaaagaagaaaguuaugauggggaugagaauaauagaaaauaugaaguacuaaaugauuucuucugcuggcuucuaauauauccguuuauuuaaucauugucugagauagagugcugcagaaugacuuguuccucaacaagggccacucugaucuaaaucuuggcaugcuuuuuaaaaacuguacugauuaaauuauacugcaagugauuucuuguaauucaucuacaguauaccuguuugucucuguuagcaaggacuaguguuauuauacacaguauauuuagguuuaguguuuuguuaguuucauauucauauucuucauuguccgggaggggcaaauauuugucccuaagacauuuuuuaguugaaugugaacauggucuaauacuuuuauucuuucugcccucuuuaggaaucaaaauuuaaggaaacggguguaaucaccccagaagaggugaguguugaagauacccuaaagccuuuauauuucuacaauuauuuuagacuagugccuuuucuuccuuguuagaaaacaucuugauuuucuuuuuuuuuuuuuuuuuuuuuuaguaaauuacauuuagguaacuauaauaauuagguuaagagaauuccuacuucccuuagcagaugauauagaacaucuuuucauuuuucugcuucucauauuucuccguaguugaacucuuuguggaagugacagugggaaaagggagaugaaaagauaguuguguuuacuuaucuuuuauugcugcgaggaugugcccuggcucuggcauuugcugucuuggcucuguuuagaccaaauguauauuuuaugauauuguguuaaaacuuugauagugauuuuucuccuaucauuuagcuuaauuuuacauaguugacacugaguauuuuaccauguuuucacuuugucugcuaaacagauuguguugacaguuaagugcuguuagagcuaugaagaguuuaccugcucccuguacuuuuuaaacuuuucagauagagcaacauuuugaaugucacuucauuuuauuugcucaacaaguuuguguuguuaucucauucauuuagauaguucacccccagacagauuuauuccaggggauaaauuuuaugaaugaacacuugcuuacuugcucuuaauaaaagcaacagauuuauuuaaaauugaucuucgguuuuauuauaauucauuagcaguagaaucauauuccuuguuuugauagaaacauaaaaugagcuuuuuuucccccuucucuuucuuccaccaccucucucucuccccccgccccuuucucucuuucucuuuucuucaccuccucucuuucuucugccaccuuuucucucccaauaaaaccucuuccacguggaaaaaaaaagaaacauaaaaugagcuguguugcaugaugaggcacugggucuagcuauaaacuaacuuuaaagcaguuuccaguuauggcgcuacucucugcaguccaguucauuggaggccuaauaauggcuugcuguacugauuggacuugguuuuuuuauauuuuuaaauugccuuuauucuuaauaaagaacugggguguuguggaaagagccuaaggaauguacuuuuuagaaccaucugucuaaucucuuacuuuagcaaaucagcuauauagggcuaggcaucacguuuaccccgcuguaaaaugaggggcuuggaugggaaauucuuugaaagcacuuacuuugcuuuagaugucaugauuguaaucuguucaaugccaauuaaaagucaguuuuguucuuaagggucucauuaauuuucuuccugaacaggcauuguuuagcuguggauuuuuaauuaccugaaaucaagagcaaagauaaucauaugcuaugcuugcauauuuugcuuuaucuuuacugugugaauauaacuaauuguuggcugcagugcuauagaaucaaucgguuuucaaacaaaaauucauccuaacgugaauaaauuaauggccucaugaaguaugaauuuucccuuaaaaaaaaaaaagaacuaaggcaaaauuagcuuaauuugauacaaagcuguaaugcuaggcuuagauagaacuuaauuaaaggauugaacuaaauuagaaugagccugagggaagacaaugagaagguaugauuugcuugggauaaauacuacacacugaauugaguuguuaauuuguuucuucuuauuucugggcucuuacccaccaguuuccagcucucuuugucuucauugagaaauguggaaauacucuuguuucaagagaggcagcaugauacuguaucuguuggguacaagcaaaugcuggcauaacuaauuuaaauagugauaaacgaauuaaaggucaauugaggaauagugucugcuaaaaugcaaauauugcauguaucuuguuggaucgaguacugaccaguauuguguauugagaaacaccacagaagaauuucugcuaugagaaagcuacuauaagcaauuguuaauuugacuguaauaaguuauuucacuugaguuuugaaacuaguaauaauggcuuuugcuaaugaggacagacauccacaugugcuaauuguuggugcaguucuguggguuucuuuuuucaguuuuauuucauaauguuuuguuauauuuaaauaguuacuaucaggagaccacuagauaaaauuaaugucuuaugauuugaagacaauauaauuaaagaauuuucauuuuuaauaaucucuuuggcuugcauuuuguuaauuuguuacucugauguguuaaauuucugacaaccacacagcuaaaaaagcaacacuugguugugguaacccccaaaugcauuaaaugaaagaagaaaaguuuauguuuggaauaaaguugccauaucuuaacuuuggugauauaucaucuuaaguaggcuauuuucugagugcuuauacagcugaauuuuacucugucaauugaacauggacuuuuggauagauagacuuuuucaaaagguauugagaauaugaaaagucuccuaauuuugugcuguguaauaacccacaaaugauagaguucuaaguuaaaagggaaacugauaggccagucucucuacagagugaguuccaggacagccagggauacacagaacacaaaacaaaauagaaauagaggcaauugggaaagcauuuucaaaucuuuccagugguuacaauguagcucugcuuagcugacucuuguuuucugcauuuaaagguaagccagguuaguauucuucagccagauuaccuuauauucaugugaacuagaacauuuucaaauauuaaauuguuuuucccugagucugauuuuuauuugugauaaaaaaugaaagcugauguaauggucagccugcucagaaagcccaaggaauccauuagaucuuuccuuuuucuccuccuccucucccucuauaccucucccucuaaaaauuuuuugcacgggucucauguaucccaggccaaucuggaauguaccggguggcugacaaggcccuugaacucuuugguccuccugcuuccaccucagaaguacugggauuacaugugugugccaccagguuugcugcuggaaagccaaccuggaccccagaucugauuuugcagaugcuuucuuaguuaguuauaacuuaaguuucuucccccccccaucucauguuguuuguuacuauaguauaauuguuuuuuuuaagauuuauuuauuuuauguauauauaaguauacuguagcugucuucacacacaccagaagagggcaucaggucccauucauuacagaugguuuugagccaccaugugguugcugggaauugaacucaggaccucuggaagagcagucagugcucuuaaccgcugagccaucucucaagcccccauaauuuuuuuuuaaugaguccuucuaagaauauaauaaagcucucuuucaauauugguccagggcugggggagacauagaaugcuuguuuaauaugccccaggguugauaccacaaaaaaaaaaaaaagguuucuuaaaaaauagagggcuaaagaggugccucaguguuaaaagaucacuagauauugcagaaaaccugagugugguuuccagcaaccacaugauggcacacaaccaucaguuaacuucaguuccaggggaccucaugucuuuuucugacccccauggacaccaggaaugcaaagacaugcauaugcaggcaaagcaggaugugccuaguccugaagugacuugaugugccaggguggguugguccccagggguccucccccuucucagaggagaagggaaugggaugugggaggagggacugugugagagggggaguaaagugauaagagaucuggauguaaagggaauaaauaaauaaauuaauggaaagagcuaagaaauaacacaggaggaagaagaaaccuccacuguaaugaaauagguugacauuagaccuauaucuguaucuuuaaacuucuuccuugaguuuccaguccuuaacaggacucuauugaauugcaagauagauuuugacacuugauguucguugccuugcccuccggcaaugucaggguuucaauuuuaaaguuugaaacaugauuugaugaugaaaauugaauuaaagauaaguguuugccugccgguugugauggugccucccugggacacagagucagcagauagaccaaucucucuacaaagugaguuccaggacagccagggauacacagaacacaaaacaaaaugauagcaguguuuuuuuucuuccaaaauugagguuuuuauaggugcuaaacaaaacuuuuuuaaguuaacuaauuguaauucuucagcuugauaaagcagguuuugggcuauuuucauuuuaauugauuauugagucucagaguuacccagggugaucaguuugguauuuugccauccuguauucagugauguucaauguaucuuuuccgcuuuuuccauauuccuugcaaucccugcauaguuuguggcagcuggagaucacuuaguccaccacuguccaacauggcaaugguaaguauuguugagugaaaauuggaacacugcugagccuuaggauuacaggcaguuuguaaagugguuaacacaugaaaagucgggagaugagcuagcauagccuucuucacuagguucuucuccugaaacagugaacccccaaggaaaauaaagggugaggggugggggaggguaggugucauguauuuuacuuuguucuuuuagcacaaaguguagacauacucaaauccacuuaacuuccuuugcuaguauuuucuuuguuuucccuaaaucugaucugugauucuuuuaaaaauaugauuaagaguuuaauaaauuugaacauuuuugugaugaaugcagagauuuuauggagcuuauguuuuuuaagauauaauaccugaacuuuaacaucacaggugaaugucccgcuuuggaaauugucugggacuagguccauaaagaauuagaaagaauuuuucaauaacauuauucuuaaauaucaaaguaauuuaacauaaauaugcuuuacaaugaaugaaaguuuauuacuuuuuaguacuaacaaaugguuuuuuuucuaaaaucuuauuucagugcuggcugaccuguuguguuuggauaacaguugucuguacauaauaagcuaguuucauguguauguuguagggauguuuuaacaugcuguaucuucuuguuaaugauguuuuucaguuauacuugaaagauacaguucuaauuauuggauucuaggaugacaagguuguaguucguuccaguuuucuuuuuagcuaaagaauuuaaucaccucaauuauuuuaaaccaaaguuagaaaauucuuucacuugugacccguuuuaguuccuuucauuuuuguuuuuaacauguaccugaaauaguugucuuugguuuuuaucauuugcuguguaucuuauagggcauaaauucuuauguaccaagaaaugacagauugucagcuucauuuauuuauaugugcacaugucuguauuuuugcccuaaaauauaaaaauccauagaugcucucugauuuaguguguucuaaauuucuugcuauaauuaguuccugguguguauuuauacacauuagaaauaagguaacacuuauuugaaccaaauaacuuauuugccuuuucuuuacuaugauagacccauauuucuuuauuaaaggucuuuuguuguuuuugccuuaaauuacccagguaguuaagguguugcaaguuuagcacagugaggaggagcuguguauaaauaggcaguaucuuuuaacagguauucguaguuaagauuacuguaguuagacuuuuaaaaaacuacucugugugugugugugugugugugugugugcgcgcgcgcgcgcgcgcgugcgcgcacagcaugcuagagcaugcauguggcagucacaggauaauauguggggucauuucccuccuucugccucauggaugccaaagauugagcucaggugguugcagcacccuuagccacugagauaaaccucgccagcuucacuuuuauaaauugugauuguugaaauaauuaaacuguaacugagaacccaguuauacuccaugccagagccuacacuuuugucugaauugcugggaccaaggaauauuuauuuuaaaguagucccauaagcaaauauuuacauaaguagucccagaagcaaauauuuacaugcuaauauguuuguguacauaagccaucgugguccugacucuccuucccuuacaacuuaggcacugguguugaaucugauagcugagcuuauugaaagaugaucauaagguuuauaaauaauauuccuggcuuuaucuuauucucaauucugugggguuuaaauugaagaaucuugaaaaggcaauguagcuuacaagucuuguguugauacuugcgaaggcaccacaugccagcucuguccuggccaagucuaguagauggugcacagaagacagagagggguucagagcacucagaaucacuaguugcuccugacucauaguagaagugcuugaagaagaaccuacagucacuugacuugaucccagcucuuccagccucuuuuacugauugugagcacucugacccuuuucaacuucaguuuuguuauuuauaagaugggaauaguagugauaguaacauuuuaaagaauguauugauaauuaauagcucauguuggagcuggagguccuguaguuacaugcuauaacaggauuuuguuuguauuaagcauuauuuucaguacuaccaucuuugauucaauaccuuuuaucuuuuaguuucaauuuuagacauaguagggagagggauauuauuauuuuauuuuaaguuuuuaguguauagucauuguacaaagugauagguuuuaucacuacgcccuuccuuaccuuccccaacucauucccacuucuagggcauaagggaucuugcugauugucuacguuguauguaauagcauacggcuuuuuccauccccaucccuuacccuuaucucaaaugaucaguacuuugauauugacugucugagagguuauaugaugggaugcauuaugaaagaccugcauuuuuuuuuguuuagaaccaaguauaauaguuuccuaguucuauuauucuaccauuuaagcuuaauguuaaauacaaauuccuucugucugcaucucccaauauauuuuauaugcuuuucugugcccuuacuuaauggcagacuugccuaauagugcuaaaacaauuuccacagaaguacauccuuaauagauuuucaugugauuuugucuguuacacauuugacuuuuacaacauuuuguauuuuuguguuuuccacuguuuuuaaagggcuacaggggaagaauugaaagugaaggcauaucuuccgacagacaaacaauuuuugguaaccaaaaaugguaagaauuauaucacuguauucauuaguaaauuuugcauaguauacauauguuuuuuaaagauuuauuuauuauauguaaguacaguguaguugucuucagacacuccagaaaagggagucacaucucauuacagaugguugugagccaccaugugguugcugggaauugaacucaggaccuucagaagagcagucagugcucuuaacugcucucuccagccuugcauaguauacugaaauaacaaaaucccauuuauaguuauugauucuaauaugugucugaaguuaggcuucuugcagaugaaaauaugaaaaugucaugaagaguuggguuuuuuaucccaguaauguuuucugauuuuuaucucuuccuuuuuaguucuuuuuaucaaaaagaucuaauugucaugguauggaagaaguccucaggaaaacuuagauuccucuuaauaguuuuuucuaaguugauuucauaaucacaauauacuuagcuguuugucuuuaauguuuagaugugaacuuucauggaacaugaaauugauuucacuugugacauauaaaaucuuaagauuaaagauuuuauuauccacugugccaucaaaaguuuacccacaggcacaacucuuuuaaaauagaagucaucauauuuaugaaguuaauuuguaaaacaucagaagauugugauggucuuaaaauaaccauguaacaauauauagacuucuauuguauuuuaaccuaaacuuggaaggcagauaauauguaacgcguagcaguuuugcaggcacaugccugugugcauuuucuugcauauggggaugaaagaaugcuaucuggacugcaugguaagugcaaggcuagccugagcuauauaaggagaccuaaggagaucacauagucuccuucaguuccagugaucauauuccaguucaauuucagugguuaaaaaggcagaaugcuggcucuuacucggcucaaagcccuguguuugaugcacaguaccaaaaacacaagcaaaaaauccagacguucuuccuaugcuguauauauuuuuaagguugauaauuuauauccugguuguuuaaucaggaaauuaaugaugaugucuugagcauaauguuuauaccacauguuaucgauaauuauagguuuaugaaauaauaguacucauuaauuaauacaucuauauaaacauuuggcaccuuuauuaaaguaaaauuuagcagguuauugaauuuuaaucuguuuauccuugguaaauaauuggaacuuaaauaugaaauucacuuuaaccguuacuuuagccuugcauuccagaggucaccuuuaccaccuuucagugugacaggugguguuugcuauucugagacuagagccguuagugugaaauauuauucauuagcuuggaacugagcaccaucaucuggcuucagccagcuguuccucacagaucaugguaaaggaagacagacaugcucacaccagagccuuuuuacuugucuucugauacagcagacuggggaaggauuaauggggcuagauaaugaugugucugugggcugaguguaacucugaaaauaucagucucauugggagggaaagguuuacuuaauacugaguuuuuuucuuuuuaagauagacgacuucucuuucuaauggauuuauuauuaguggguuauauauuaguaauuuguuuguuuguuuuaacaguuccaugcuacaagcgguguaaacagauggaguauucggaugaauuggaagcuaucauugaagaagaugauggugaugggggauggguagauacauaucacaacacaggugagacguguacagaauagcacguauuuaguuuaaacuauuuuaaaguuuuucacaaucuuuuuauaacaggcuugauuuaaaauuuaaaaaaggauacauaaguuacaauuuuguccccaaagucaaaaaagaaaagguagcgucugcugcuucaguuacagugggaaauagucacuuauuuucauuauuucuaaauagaagagaaaauaaaucuauacaaaguacugacggcacaugcauuugcucugaaucucuugugcuaaagucuagaagagguaggcucagcauccgucauucuucgucuguccauguugucaugcuucccucaccuccagcccccguccuucagagaauuuucaauacucuucauuaguuuucucaagguuggaagauaaagguagcauguugguaguaaauuaccuggugacugacuaaaaugauuauuuauaguguaguuucucugaaaagcuggaaagauauuguauuuucuaguuguauuuuauuuuagaaacacuauccuaaacuuugaaccuacauauaggguccuaaugcacagagcuaaguagguguuaguaugcuugacuggcaaaagucuacaaaauguugacugcuaaaaaauguuuacuuaaagauacagaacaaguagcaccauuuuuuccucugugggaaauagcaguaguauugcuuuucaguuuauuaaaugcauguaauuaauucuuaucuuuauuagagauacuuaaagaauuaaaacuuugaacugugucucaggauaaggcaguacucccaacucccaauaagugccuugcuucaccucauccagguuucauuguuguuuuuuccuauuaauuagccucuguauuggucaguucuuuagaggugcagaaccaauaggggugugcuggaaggauagguaugacaggagaaauggagcuuucugucacgcuagaggaaaaccacaggacauagaaauggauuuauuuacaguugugacuagaccugaaauagaaaagaucucuuccuucucuucagugaugcuaugauuuuacagaaaagaugagacaaaguucaggaaauguaauguagauuuagcuaggacauaaauugucaggccuaagugaauacucucccucuuccucuauagccaggacuuacauccuacucucucccaggauaggaucucuuguggaaauuuuaauucuccagugcucauucuuugaggaucacugcuacacuguaauauaaguagauauaauauauuuuaaggaauugguuuauaugacaguugaacuuugcagagcaugccccaacaggcuggagcaccaaggagcgguugauacugugggcaguucuuuaguggcuuucauuuucuuuucucuccuuuacuugauuggaugcaauuuaccuacuuuuugaaagaugauuugcuuuauuuaauacugguuuuaauauuuauucaaagucucuuaaaaaguaccuccacugcaaccuuuggacuaguuuuugacgagcuagcuagcuaacccaacacuaaccagauugacagaauagaacaucacaagucuggagugugacuauuuauaaacauuugagcuuucuuuugcuuugucaggugugcuauacuuuuaaaauuaagaauauuuuaaaaauuaucuuuuugacaauuuuacauauaugucuaguauacccuguucauauccuugguuaccccucucacuuuauguccuuuuuaaaaaguucucauguccuuauuguuuuuauguguaugaugucuuaucaauauguauguuugcauugugugcacacaguggagugccuggggaggccagaagaaagaguauaggauuuccuaaaacaggaguuagaaacaguucuuauuuaccacgugugcugggaaccuaaccuccauccucuggaagagcuaucagugcacuuaaccucuaagcagccccuccuuuguuuucuuuuuaaaugauuucacugaguugaauuaauguaggcuacauguacauggaugugggaccaaccgccagagcuugggcaauccaccaguggugccugccugcaaaacaaacacaaaucuuuaucuaccucccugagcagccaucaacaccagugguacucacuugggguggaaccucaugaguaccuuccccauccaugaugugagcuuaauuggcuuaaaucuuauguaggucuugugcagauaagcagagaguugcugugagaucaugaguacauuguccaugucagaauacagcaccccucagcauuccuucccaacccaccagcuucuccuuucuuucuaccacuuccucccugaaguucccuaagccuuggggauaaagagucauacugagggcugagcagcuaccuaguagucacuuagucuuagcccuuugaccaucaggaaucucugcaugacugcuucccacugcagagagaggcuucuccagcuagugccuggggguugguguaaugggaugcuacuacauuauuauauuuuggcagguugaugagguuucuuuuuauguucaguaaauaauucuguauuuuuaguuugauuggauagauuuggguuuuaccgucuugauugaucauaucuauuguaggaugauagccaaacugcuaugaaauaaagacuuguaaugcuggucuuuggagggugccaucuuccauuugugaaggugagcucauaauccuuugguuuaggacuguuaaaggcaugccaacuuuagaguaagaaaauacgcugcauuuauugggagcuaaaugcauuuugaauuuaggacuuuaaaucuguuguaacauuagguacugagucucccauccugguuaaacuguccuuuugagaacugauaggugccugggauugaauuguuaugcaggacucugguguagugcugcugcuuaucugcacuguaccuuucugugacaagggacuucugaggauguaccgcugaguaauacacuuaaaauaguuagccaaagucugacugucaacuucauucuucauagggagaaacuguuacucucuuuuacagauggaauuauauggauaaaauguagacauacuuggugaaguaaaaggucuguacgagugugguauggucuuacuacauucagauggccaauguuuuugaagcaaauagugugugucaacaaaaccaaaaccuaauuuugaugcagcucuaauuaaaguguaaacagaagucauauacucucuugauuguaguguguguugugaaaaaauucaaaugaagaauagaaaauggaccaagucauggugauauagauacguugcuaaauuagaguuuuugaggcauauuuuuggagguaccuuuggauuauuuggaaaaguucauuuguaaagaaucugucaaaauaugccuguuucaguguuguuauaagcaguuaaauaaauguuuuauucacauaacugaaauguuugcagcuuaauuuuaguuauuuuuuuuucugcugaauucuaaacagguauuacaggaauuacugaagcaguuaaggagauuacacuggaaagcaagguauuacuuaacguuucuaaagucagugacccuaguuuuugccuauauuuaaauuuuaaauuguauuuguguauuuauuuuggguguguguaugugaauguguguauaucaaggcaaggauguagaaaucugguggauaccuugggguaguugguucucuuguuucgugaggugggcccagcagauagaauucagguaaucaggcuuguaacuaaugaauugcaauaaaaguccuaguguaauaaauaaaaguccuaguguaacuccacuggacaguaaaugcuuaaaaggaagauuugggagagguugccuuugcugaugagcaggugcuaauguuauauuaguacuacauuuuguaguuuauucuaaccaauuuuauuguuuuguuucuuaaauuacugguaguaacuucuaaaauucuguuuuuagagguuucacuguguacuuuaguaucagccaaaauggugacauuuugaaaaaucguuuaaguuuguguggguaaacauaaguaugauugggugaagcuuuugugcgacuacauuugcauucgauuuaggucagacguuucagcccuuuucucagauugauugcaucugcuuuauauuuuuaugauuguuugaaaugcuaugaaaaaaaaaaaacaaaacagaauacuuguuuuucuuuucucuuuuuuuccccaagacaggguuuuucucuguagcccuggcuguuuugaaacucacuaaguagaacuuaagaaaucuaccugcuuuugccuccuaagugcugggauuaaagcuaugcuccaccacugcccagcuacuuuucuuuuuuuaacaaaugaagauauggauugcuuucuuaauuuccauuucacuuuuauguagggaucauauaaauguucuuuguauugguuuuaguuuuaauauauguguugcugcuuuuuuccauccauccaucaaucaaucaaucagucaguucucuccuccccccaccaaccucccuguguuucccuacauaaauuacuaauuuaaggccuguguguguguguguguguguguguguguuuuagucacuguaucuuuggggauuuauuaccuggaacuuaaagaauaagaaagucaaauaugcuuuguaauuugggagugauaguucauuggccuaggcauuuauccuuuugauuuucuaauuuuuggaaguaugacggagaagaaaucuuacaaauuguguuguugcuucacaacauguuguuuauuuugucuguuguuguggcucagauuuguagugacagauggcaagguacuaugauugguguuugguuuuauacugggaauugaaggcggaaccuguugcauagggugcuaggcaagagcuucacugcugagcugcuugucucucucgguagccagacagcaucugacuagguuucccuuguuggccuaaaacuugcuaugaauguagcucagagaaacuuaaacuuuaauucuuucugccauaggcucccaguuagcuggaguuacuuguuuuaagccagcaggccugccuaaaaaauuuuuaacaaauacgguaaugguuauuuugauacuuaacuuucuuguucuaaagaggaaguggugaacuaauuuuuuuagcuagguaugugccuucuguaauuuauuauaaauagaacuuucuuuuuuuguaauuuagucuuuacaauauucuccaucugaacucaaguguuguuuauuucuacccuguugugucaaugacaucugacauuggaaaguucauuaaauaauuauccaaguacugacaaucuucuuugguuuacauuuuaaguguaauagagauauauuucauuuguuucuagugguaaauaagcccuaaguaggcucucacuggcauuauucuuucuuauauaauacuauuaauaaggugaaugaaaauguaauuguaagcucuuauaacuuuagauuuauccagcuaggauauucuuaguaaguuagcauauaauaaagcuucacacuucauuucaaguuacaauguguuuggcuuauaaauauguaguuuuucuuuacguuguaaauaggcagguuaacauaacuuugaacuagcuuuuuuaauaccaaugcauuauugguaguuagcaguaaaauacuuuuuggcacuugugagaugacucagugagugaaggugcugacugccaggucugaugagcugaauucaaucccuacaacaaacauuggugggaagagagaaccagcuucuaaaaauuuccucugaacuccauacauguguacacacaccaaguaaauaaguauuuacaguauguacuguugcagugaggcuuugguuggaaaugacuuuuaaaauggucaccuaagguaauaauagugauacaaugauacgugcccucugauacuucucaaucacagcaucuagcaugguacuuccagugaauuauuuauggguuagucguugucauuggugugugaauuucuagggaacauaaacugccugauuagaugauucugauuuuuuuacuguggucaguuaccauugugcucaguguugaguaugaguauuuaugaggauggccacacuacugcuggaguuucuguaagauaacaucuucugguuaugucaaggcuaccuuagcuacacucuguggucuucucuuggugaaaucaccuagcagugauuucucagaauguguccucaucacuagauggugcauggucguaaaacuauucacauaagaagcacaggcagucagaggaaggagauuucuucuguuuucuuccuucugaaucagcaacaccaagaauagaaccauguaugugacgggcugucuaauaaugguuuugaaggaaauaaauacugcugauaaauaucucauguuaaguaugcuuaauguugaauuaaugagcauacacuuucauaacuuaaguguaauuaauuucaaaggacaguauaaaacuccaagauugcucagcacugugugaugaagaagacgaggaagaugaaggggaagcugcagacauggaagguauugcuaguuuagauugcuuuaauuagacuguugauuuuugaauauuuauaugucauguggacuaagaauucuuuucuguuggcuuaacauuuaagagccuugugaauauuuaguuuguuuuauauuuuaucaggucaggauaaaaacuuauuuugguuuuacguucuucuguuuuaauuagaacaugauuuugacagaauuauuuuuacuaggaugauuagugauaaaucccaaacuggacaacuggacauugucuuguuauauugucuuggcucaaaauucucccaccuccguuaggacugcagucaguccugugcuuuuagacauagaaagauagcuuuuuuguuguuuuguuuuguuuuuaagcaggaucuuacguaauucaguuuggccuaauaagauucaugauccuauugccucagccuuuuugagugcuggaauuacaagugugugucaugcaugggcagagagacuuaaugucuguuuaauguggacuuuggagcugugcagaauccuuuguuccuuuagauuuugaaauaaucuugguuaccagauaagaaucaucaaccaaauaacucccacaucuaauacucagaaaucauuaccauagaagagauggaaagauuguaagagccaaaggauuaggggguuugcuaugagauugugacaggagcuauguccacuuaaagucucaccagcaugacugcccaaaugugagcugaacaaggauaacaacaguagacaugcugaguggguggagggaaagcccacgaguccucaacccuacacaggaacuacaggcaacuaaggaugcugagaaugggagaaauagucuuuccccagggaagaacacaccaacugguuauccaauaccaaauagucuugcaaacauauuuuauaaguaacauuauacagacauaaguaguuuauauucugauacuauacuuguugcugcauauaacaacaguuaaugagaaaagaggccacgaauuugaaagagcagggugguauauuaaugaaacauuauuacaaaaaucaaaaccaaucauucuaacagaauaguguauuaguuacuuuuacaucaccaugauauaugacagaagcaaggaaauaagaucuauuuugguucaguuuuaagagcuuucaguucaucaguaguggaaaaaccugguggaguugcccuguugauuggaggaacauguagcaaaauggcuguuuacacaguagcaggcuaggaaacagaggaguuaaaaccaagggcuaagcuauagaaacccacgcccucugacuuguuccacaagucagucccuaccuccucaaggcuucacagccuccugaaacagugcugucagaagggaaacacucagaacaggaaccucuacuggggaugcugcagauucaaagcauaguggagcacuagaaauguuucuaaguacacggcuagucaaaauuccuauuuuaucguuuuacauuuauuugguguguaugaguguuuugcuugcauguaugaaugugcaucauauucaugaaggggauuagaaaaggguguuggauccuagcguuaccaauaauuuugagccaccauguagauguaggaaacuaggcccuaguucuuuacgagagcagcuagugcuuuuaaccacugagcuaccucuguuuaauuaaucuuuaauagaaguuaaaucucaguuaaagauagaugaaggaauugcugucaccaugugauaaccuccuuguuauauaauacagcaauccuacugcauuuaguggcuuuauuguuugauuguguuaauacauccucuugguuuuuucucccuuuauuuuugugacugauuuuucuuucuuaauguuuaugucuuccguugggccuuuuauucuuuugcauagcuguuaaauacuacuacaucauugcuagccuccagcccucagauuuuuuuuuuuaaguaaauguauguugagauaccauuuagggcuaaagaugaaacagauauuaugaucuuuuggaauucuugauuuaacuagauaaaaaauuuagaaaauagauaaaauauauuauguugaauuauuuucaguguuaaaagagaaagaugacguaagagaauaauuuaucuuagggaguaccauuucuauauuuugcuaaguuagucaaggaauauacuuugagaauauaucugcaaugaagggaguaaacaaaggucuugagaagggaacauguaugacuuauauaaaguauucuauagcuagagaauaagaagaagauaguggagucagacaaguaacugggagccaaaugguauaguguccuaacuagagagaagucacugaagcaguuuucuagguaaaaugaguuaacauuugaacagaaucgcugugacuguaaauuugugguuguguuagucaaaauucuauagaguaacagaacauauagaaugaguauguaugucugucugacuaucuaucuaucgaucuauaauauaaagggcauuuauuagaauaacuuacagggugguucaccuaauacaacaauggcugucuaugaacagaagguccaagaauccaguaguuguucaguccgugaggacacaugucucugcuaaucuucagugcauaccagaaucuugagagaaguaguaucuaaugccagugacgaaaugggcuugcaaauaagggugagaguaagcaaacaaaaaggaguguccuucuucccuguccuuuaucuaggcugcuagcagaagguaugacccagauuaaaggugcaucuucucaccucagagaucuguauuagaagugggucuucccugucaaauaauaggaaaaaucucucacaggugugucuagccauuucauuuuuaguuaauuccauauuuaaucaaguugaaaaccaagaauagaagaauagugagaggaaaaagaaaauaggaaacuuuuuauaacauauacuaaauaaaauaaaaaugcaaaauaauaguagcuugggcuaggauaauaacauugguagcagugagaaaaauaauaauguaaauauuuugaggguagggugaaagcaauuugaugcuggauuagaugugaaaugugaaaggcaggguagacaaaugugaccugaaugucuggagaaaugccauuaacugagaguaauuaccuugaaaggagucaggucaguuuuagauauaugauuuguaauuccccuuagucauauaguaguguugcaaaauaaaguuuguguccauguuacacacccuaacccuaaugaugauuucugaguacaaggccagccuggucuauauaguuaguuccagaacagccagagcuacacagagaaacccugucucaaacaaaacaaaacaaaacaaaacaaaacaaaacaaaacaacaacaaaacccacacaauggaugugaugaguuuaucuuuaauggcaauguauuugaaaagacaaugucccaggcuugaaaucuuuccuacuucuguuacuaaaacauuguuuaguaaauugcugggcuuuuuuguuuuguuuuguuuuguuuuuaaguagaugcaauaaaagaagcagaguagaaaauacugaagaagcagcaucaggaaaguuaggagaaaggcaauacaaaauaaugugaaaggcaaggaaagaaagugucugacugugauaaguuauguugguuuauaagcggccucugaguucacgaagguggaaacuagucauauagacuugggcauaguaaaaccgaaaccacuuuuaacuuuaaagaaugcaguguagguggucagcugugguguuaccuuauaacacgacuucaggggucucaguaccugccaucagcugucuugaaaauauuaaauaugaaauuaauuccagaaauaugauaguuuaaguuuugaauugcagguuuucuaaguaaaacgauggcaucuuaugcugagcaaugucuuucauccaugauaccuaaaucaucccuuuguccagcauaucugugcugcaugcuauguggcuuccauuguaagcaccucagugauaucauggccauuaucagucaccacagugcuuguguucaaguaaggcuuauuuuauuuuacuuaauaauggccucgaagggcacuugaugccacuuggguaugucugagagagucugggaaguauuuaagugagaaggugaaagcccaugauguggucagaauagaaaauuuuauaccggggguguagguucuauggugagaacaaagcuguuuauuaaauuucaagaagaaaaaagaucaugcuacuuggugauaauauaucaaacuaaaaagauuaaagucuugauacauuauaacucaguuaacuuuuuucuuuuucuuuuuucuguaagaauaugaagagaguggauuguuggaaacagaugagguuuguaaauuugauguauuuuuaagauaguucuuaugagugaacuuggguguuaguguuuucaauaauggcaauagucuuacagaacaauuuuuacuggcucuaaguuuuugucauuguugugugacaggcuacccuagacacaaggaaaauaguggaagccugcaaagcuaaggcugacgcuggaggugaagaugcuauuuuacaaacaagaacauacgaccuguacaucacuuacgacaaauauuaccagacaccacggcuaugguuguuuggcuaugaugagguaaaguagaaagaaauagaaaguaaagacuuuaaacugguggauuuaauucaauuucuuuauuugauccaugaguauauauggucuuuuaaauuuuugaagucauuuuuuacaguucuauuauuauugaacuugauuugcauuuagaauaaacuauucagugugacagugcuagggauuaaauacaaauacuauguuguauacugacuccugagucuuuuccucuaagcuuauugcuucaaaauucaagaaguucaacucuguauaacuccuuauauuuugucagaauccaucuguggaguauauaaacauuuacaaacagauuauguccuauaguauuucccuuaccaauuuuuauucugcugauauuggauuacagaauaauugaaguuagaucaacucauuuaacuugccauuuuaugacuucauaaaaggaaguaaaaaaugaaaugggcuuaagggauaaauucuuaaaauuugaaaauguuuggcaucuauaaacuuacuuacuugugccauauuuucaacauuaacgauggcuccuguuauagagcccaaguguucaggauccuuucucaaacaaucuggcaauucugaauaaucuggaaucguaaauuccaaaugauuuugaaggaauuaauauuuauaaauaggcguaggcuacaagcuucaauaguggauucacagcaccuuuuaugcuuucagcaacggcagccuuuaacaguugagcacauguaugaagacaucagucaagaucaugugaagaaaacagugaccauugaaaaccauccucaucucccaccaccuccuauguguucaguucacccaugcaggucuggguguauauguguguggggcaagugagagugucuguguuguccguguggagauguguaaacaucaguaaaagaaaauuuuacuuuauaagcaaaauucucuuucaucuuuagaaauguuuuucuuuugcuuaauuaaauauccaagagaaaggaggauaaacauuaccuauuuuuuuaauuaauuaauuaauuaauuaauuaauuuagagacaggguuucucuguguagcccuggcuguucuggaacucacuguagaccaggcuggccuugaacucagaaaucugccugccucugccucccaagugcugggauuaaagaugugugccaccacugcucgacuaccuacuuauuuuaaauguaguacuaagaauuuuguuuugguuuucuuuguuuagcuauagauuagauuuguugaucaaucucauuugaucaguagcuuaggcagcuuguuguaaauucauagcacucaucuuuuagacuugguguacaguguugcgagggccucuuuacaucaguguggaguauaaacucuuccuuuaggaagucuuuagccuucccaaggcaacucaguuuugagcuuuggcauucucuccuuuucaauguguuuucaugaguccacaaaaagucaagcugaaccaagauacaugauuugucucaaaugguccuuauagaaaagcaucaugcuugcuucuuuggauuaguaauuuauaacaaguaacauucugaauauacugaggaugcugauaaucuauugaaaauuauaugauaauuuuuccaaaaaaaauuguuuaggugagcaugguggguuacacuaauaauccuaccacccuuacuugggaggcugaggcaggaggauugcaaauucuagcccaucuugggcugcacaguauguaucaaagcuaaaaccuugauggcauccuuuuauuuugugcaacuuuuuuuuuuuuuuuuuuacugagcuucuuacccccagagaaagcuugcuuccacuucucaguguauuuaugucaagaauuuuaauauuucuauaaaguaauucauuaggguuucauuguuguuuuguguuugauuuucuucuccuguuuccccacuuauuuaccaugaacaagacuugggcuaaguguauauauguagauuugccccgccuuuccuuucucuguagugagaacagccuauaauaagcaccagguggccaacguuuaauuuuaaauuaucuaaagcugaucauuuuuugagucaaucuguucuaugaguuugaaauuuuaauaggcucuaauugaguggaaugugugucuguggcauaaguuuacucuauugagaagaagagauaaguaccugauaauuacauuaaacauucuaguaaaacaaaugauuauauaaaguagaaugagauaagauauaaaaucugaugccauaugcaagaaauggggacauuuuuaggacugccuugggcuguacuuguuuucugaggaucuucuucuguguaaaggauuguugauaagaacugaaauagcaccguauaaauuagggugaagagcuguuuuguuuucuauauuaauuuuucccuuuagcugauucacucuauuugcagcauagaagauacuugaauuauguauaugucugugcauaggacagaaucuugagauaauauguuuucauguaaauccaaaguuguuguuguuuuuaaauagaaucagauaaauaauacucaucaauacagaguuggcucugauucuuagcuuuuauugagccuuucagcuauaguuuuuuccuaagcugaauaaauauuuaaacauuuaaggggcuggcaggauggcuuauugguaaaaucucuugcucaaggagccuggaaccaacuagggaagggagagaaucacguccugaaaauugcccuaugaccucacauguucauggugugcauauacccauguucaugcauguggugucacaugccuacgcacaugcacacacuguagcaauaacagacauuuaaaaugacaaaguuaugggggggucucagagcuuuuuucuuuguuuuguauauacagacccugcuauuuauguuuccagagcaaauagcccuagcuucccauuuacucuuuggcaugauuuucccuugggguuuucugccucuaguaucaaaaagcuaacugaugcuauuggguuuauggugacuauaacuuucagaaauccuuuccaauggaagucuuuucauagcucagcaguugacagcauuuuauaguucaguaauuuuauauuaaaaauuaccuugagcaauuacaguagacuuuuuaaauuuuguucauuuugcucaaauugucccaugcuaauaagauuuguuugcuuucaggcaugcugaagugaugaagaaaauuauugagacaguugcagaaggcgggggagagcuugguguucauauguauccuuauguguauauacgauugguggcaaauggcuccuauagauuuguuuuguucauuuuggagauuuaguguaacuuucauaacagaaccuauaguuuauuuuagcuccucauguauggaaguucuugugaaaaucuaguuucucuaggauguguuauauuaugaaaaguaugcugcacucagugguuauacucugugugcgugugugcgugugcacacacgugcaugcacgcacauguucaugagcgccaguuaacccugccuuguuacagagguaauguuuagcacagugaguucccaucaggugaaggucaaguuaagguuguaucaaccuuagcccucccugaagcaaauaagucaaguuaaacagguugauuagacguaaaguacaacugugcagcuuuucuccugugcaaaagcaucuucuuuuggcuuucuugcucagucucuggguggacaggaagcacaaaugaguauugauguccaagcaauuugucacaccucuccgagauacgaguauccauauuagggguuuucagagcacucaccgugagcgaugacaugccaaguaaacugaauuaguuggacauagguuuguauugaauuuugugauuuauaccauucagugagagacagggguuacucauaccuuaaauguaugaaaaccuaaccuguguguugcuaauaacacauauucugcagaggcacuuuggguuuuuuuguaauggaaacaaacacuuuuuuuccaguccaauaagauuuauuucuggaaucucaauguacauuaucuuucacauuuaucuccaugcuaaaggcuagguagcagcuuagagugcuauaggugauucauaauaauuuucuuauugaaaacuaaguaagcuugcaauguuucuagguacaauaaaagaaaauuucaccauuuuauuaaaugaaaaugguacaauauaguccauucuaugguuguuaaaugccccuuaugaguuuagaaucccuuaugaaguguuugcaucugauuuguuuuucauuugcuacaguguuugcauacuuguuucacuuuaaguucguauaaauucuagaaaauuuguaagcaguaaaggggcaaaguaaaugaaugagguuuauacuuaucugaauacauuaaagacaacauugccuuauaaauauuguaguaauucaacauauaugaacuucucauuuagaaaguucaauucaaauauugcagcaaauagcugcaucuuuagaugucagauagucaucuuuagagcaccucucuuaaacagauacaaauuugcuuggcuaggugacuuuuaauagacucuauaagauuuuaucauaguucugauaaauuaaaauugauaauuauuauggauuuagaucaauacuguuuacaaaucuuauuuuccuuagccaaggacauucagguaucuuuuaauuuuuuugaaauuuguucaagcugucauuccaacaauagaauaugacuacacaagacacuucacaauguaguggagaggcuauagagucuauccuaauuacugcuucugauuuuuaaagaauuaauacauagcugugaccauugaccauauuuaccaauaagaauaauuucucuaauaaugggauuauauguuuaugcauuaaauaaaaacuguucuacuaccagccuuauuuguuuaauaaaaauguuugugaagagauguuuucauuuccugucagaagguucuaguaggguuuccccugucagacgaugauugcagagucagggugcuauugaacaucuaccagugucagaacuagcucuagaaaguguuccaugccagccugugugucucucccuacuccauucccagccuuguccucucccuacaucugcucugugcuuguaguucauguuucugaagugcuaacuguaugccaagaaacaugcucagaaacauuaccuguuucaugauuuauugccaucacccagauuacuucuuauuaacgauauggggauguuuuucuuaacaugauugucaguagaauagugggacuugaaggggaaucuuugcuuguauugugucaguucauagaucugaaaaugggaguuuaaaaagcagauuuuucugaaacauacuuuaagcuguggaggagaauccugaucuuugguuuuguuuuuuuauuuguuuuuaaccuuugccuaaaaucccuguuaugccucucagucuccauauuagucugugucaagugugauaucuucccuugucuuccauuuuguuuacaucaucuaagaauaucccucuuaauuaaaaacuuuugaaaauguca

SEQ ID NO: 8256 - RNA, 953 nt, Mus musculus
uggguaggagcggcgcuugaggccuggaagcguuccguggccugccgggucagcaccaugagcuccauuggcacuggguaugacuugucagccucuauguucucuccugauggaagaguuuuccaaauugaauaugccaugaaggcuauggaaaacaguaguacagcuauugggaucagauguaaagacgauguuguguuuggaguagaaaaaguaguccuuucuaaacuuuaugaagaaggcuccaguaaacgucuuuuuaauguugaucgacauguugcaauggcaguugcaggauggcuggcagaugcucguucacuagcagacauagcaagagaagaagcauccaacuuuagguccaacuuuggcuauaacauuccucuaaaacgucuugcacacagaguggccauguauguacacgccuauacacucuacagcgcuguuagaccuuuuggcugcaguuucuuguuggggucuuacagugcgaaugauggugcacagcucuauaugaucgacccaucagguguuucauaugguugcuggggcugugcgauuggcgaagccaggcaggcugcaaagacagagauagaaaagcuucagaugaaggaaaugacuugccgugauguaguuaaagaaguugcaaaaaauaauuuacauaguacacgauggaguuaaggauaaagcuuuugaacuggagcucagcuggguuggugaauuaacuaaaggaagacaugaaauuguucccaaagacauaagcgaggaagcagaaaaaugugccaaggaaccuuugaaggaagaagaugaaucagauggugacaauauguaauauuuucuucaccauccacugguuuacaucucuguaacaguugcauauggcuagcaccauggauuauauauacccacugaccgauuuucauuaaauuuugucuuauaaacauaaaaaaaaaaugagc

SEQ ID NO: 8257 - RNA, 953 nt, Mus musculus
gcucauuuuuuuuuuauguuuauaagacaaaauuuaaugaaaaucggucaguggguauauauaauccauggugcuagccauaugcaacuguuacagagauguaaaccaguggauggugaagaaaauauuacauauugucaccaucugauucaucuucuuccuucaaagguuccuuggcacauuuuucugcuuccucgcuuaugucuuugggaacaauuucaugucuuccuuuaguuaauucaccaacccagcugagcuccaguucaaaagcuuuauccuuaacuccaucguguacuauguaaauuauuuuuugcaacuucuuuaacuacaucacggcaagucauuuccuucaucugaagcuuuucuaucucugucuuugcagccugccuggcuucgccaaucgcacagccccagcaaccauaugaaacaccugaugggucgaucauauagagcugugcaccaucauucgcacuguaagaccccaacaagaaacugcagccaaaaggucuaacagcgcuguagaguguauaggcguguacauacauggccacucugugugcaagacguuuuagaggaauguuauagccaaaguuggaccuaaaguuggaugcuucuucucuugcuaugucugcuagugaacgagcaucugccagccauccugcaacugccauugcaacaugucgaucaacauuaaaaagacguuuacuggagccuucuucauaaaguuuagaaaggacuacuuuuucuacuccaaacacaacaucgucuuuacaucugaucccaauagcuguacuacuguuuuccauagccuucauggcauauucaauuuggaaaacucuuccaucaggagagaacauagaggcugacaagucauacccagugccaauggagcucauggugcugacccggcaggccacggaacgcuuccaggccucaagcgccgcuccuaccca

SEQ ID NO: 8258 - RNA, 3500 nt, Mus musculus
ugucucgugugugugaccacguagggaagucugcaggcccguguucacucgcuuccucccaugcuagcuugaaaagaauggagaggcaguugccguuuguucagcuagcuuacaggggaacggaaucagcuuaccacccggguccaguucagaaacugaagcugucuuccugcuucacuguaaaguuaaagggaccuagcaugcagcaggucacugacaaggauggguuucuguauguagcucuaugaugagccaaggacucaguuccuaucggaaaggcaauccaucagucccaacauauugacaagucuuauuaagauugaguuaaccaagcacacagcuuccuacugaccucucuguguccucaucuuaaauauaacgucagaaugguccacuugcauuugcucuucacaucugccuucuucaagccuuucugagucuacaacaccuggcucguuugcucagacuaccagcaggauuauucuucuuaugccaagaagucuucacugguuauacuauagaaaaagcaagccauuaaaccgggcaugguucuuaauccuagaacuuuggagacagaaacugaaggacaggaacuuuauguggacucgauggguuauauuuagcaauguacacauacauauaugucuguaaugacaauugauuaauaaagagaaagaacauuaauuugaaggaacucaaggaugggguguaugggaggcuugaggggaggaaagagaagagagaaaagucacuaaaauacaaucucaaaaacaaacaaaaaaacaaaauacaguccaguuugagugaagagauauaugccaagacaagcaucugacuguuaaggguagacucuagaugugggcagauuuacugaugacauuaaguucguucaaugcaaaguucuaaauguuucuugcuaagacgcuaugauguccuuacaggcaggagccuagcauggcugcccucugagaggcccaacaagcagcugucagagacagaugcaaauacucacacccaaccaguggacggaagucuggggccccugugguugaauuagggaaaggcuggaagggauuguggaggagggcagccccauaggaagaccagcauucucaaccaaucuggaccccuaagaucccucagacacugagccaccaaccaagcagcauacccuagcuggucaaaagcucccaacacguauauagcagaggacugccuggucuguccucagugagaaaagaagcaccaaacuguuggagagacuugaggcuccagggaguggggaggucuggaguagggcagggugggaguggggaggaagaaugggaugagaaacuuucagaucuggugaaucuugaauaguauaaugacuggacuguaaaaaaaaagauuauauauauaugaugcuggucaggaaaggaucauuucuggagugaaauacaccagacagccauagaucugaauagaugugaggaaagcuggaguacaagacagauaagcugguaagcaguuuggagaacaagcauucuucaaccuccuuauuguuuugacuguuacugauguucugggaaagaguuccuuaaauuccagaacauaucacaaaagacaacauaaagaucaaaugcaggcuaauguucccaucacgaacagcuugaaaggcagucccuaucaucaguagagguccugugcagagggaagcaaugcaagcagagagcucgcaguggccuagcuccagggagaaauaucucuccauuagggucagcaguugccauggagaaaacaaccuuaaccucaggguaaauucaacccauaaaaaccuugcaaguguuucaacucucugcaccaaagcuacugcacacugaaggcuugacuuagcccugagucaugcauccagcauaggcaagguucugagaccuuggcacagaggcacccugcagugggaggugacucguccaucuuugccuuaacugcgggugaggccagcuuugcagcagcuaagaagugcauuuccaucacuuaggcuccucuucccccugcuaugauaaaugcacacacacagagagcugccaucugacugucgcucacugccaagcccucgggauggggugggaaugucaagguuguucuggucaucgcuagugcucgguaauaaacugaugacuuuccuuuccuuuuugacccacaagaaggacugugaucauaaugcuuccagucauaucccauggaucuuuaaaaaaggaaaaaaucaucuuugaucuggaggacucugugucuuuaacgggguucccuccuuuaggccccacccaugcugaagcugacguguguguucaauacugaaaaacaaagcuuccagccucacuuuauuccuuuaugaacagaagcucuuuucaucugccccugcauucugcuauugaagagcuuucuuagugugacaccaaaacaccugacuguguccuucugucgcagaaacacauccaucaaaucaugcauuucagacuuuauuucucaaugucccccuccauccaucugcuuauacccuucuugcuuggcauucggugacacauagcaaguauuuuuaaaugauaaaauauuuuacuuuuuuguuacugcuuuugguugguuugguuugguuuuccaagacaggguuucucuguguagccuuggcuguccuagaacucacuuuauaggccaggaugcccucgaacucagagauccaccugccucugccuccugagugcugggauucaaggugugcauggcuuaugucauuguuuaauggagguaugcaagcugccaauuacaccauacgguaagauguaugaucccagagauguaaagauuagccugagccauagagaaggaugacaucagcagcacuccuucuagcacuucugcaagguaugcauuccaacccaaagcaaucucuugcuauuuugcuucuuuucuuuucuuuucuuuuucucuuuuuucuuuuucuuuuucuuuuucuuuuuuuuuuuuuguuuggcuuuaaaagcucugcaaugcaugcuacuauuugagaccucaauuagaagaauucaucaagcuguacuuuauggcaccucucacauugccuuguucaugaauuaucauaucuauuucaaucuccaaccuuacaucaggcaaagcuaucaucuuccacacaauagccuugauagauaggaaggagagagagccuugacagaauuuuauuagguuuugggcuugguuccacccuauuuacaagcuagucaguuagccucuuacagucucacggguucuggcagaacacauaaaaguugggcuucaaaagcaggaugagcaucggcucauuuaaguuacuucucuuuuccccuuaagugucaugaguguugcaacaugguccagguagaugcuguucucacacuguguccacaucacaacugagggaaucagcgcaugagaacuguaugacuuuuacaugaagcaauagacacacaguugaagaugaagggauuccc

SEQ ID NO: 8259 - RNA, 13599 nt, Mus musculus
ccuccuuagccgugagaaaaucaaauccagggcgccuugcuuccaaucuccugcaccauccgcggcguaauguugagacauccuuucucccgccuguuaauuaccugcucugggcaucucuagcaaagugcugcugagagcggaagcaagcaaccaucgcccaccacccaccgucugucugggggcuuaugcucacgaaugagucccauguacaucauccggucugccugacaggcaggacugagaaagggggguuccagccccccgugggcuggccagggcuuuauucuagaguccagagcggcgcguggcugcgcuuuucuuucccguuuguaggugaaaccccauuggcuucauuggcuccuugauuuuaaaccacgcccggcuuucugcccgcuuugcugcugcuggguucggccucccugccacaucccagccggguucucaggaaacccgggggcuccuguggcugcuauuguguggaugccgcguguguccucucuucucuuccagagauggcuaacagggguccgagcuauggcuuaagccgagaggugcaggagaagauugagcagaaguaugacgcggaucuggagaacaagcugguggacuggaucauccugcagugugcugaggauauagagcacccgcccccgggcagggcccauuuucagaaaugguugauggacgggacgguaaggcgggcaaggauauugguuguuggggcgcugggcagggaaacccugcuagggccuuuucuuuccaugugaggcccggggagauccccuguugccaaggucugggucucaccgggagagaugagcaugccuuuauuucuccagggcuggcugcaauucugagggcucucugcacaauuuccuagcuaguuuagaggauucuccaccuauaugagacucaagcuuccuucugagcuguaagcaaaacuggagcccuuuugauguuuccauucagaguagggcuaagcgcugcugcugugugaucuccuuagccuucuugggcuguucuuacccccaagggaaccagcugguuacacggugaaacaaaggaagggggucaggcuagccaacuugucauccuccauggaagcuguaucccuuggaggugcucaggaucucuugagcagaugaguuccccugaacaggaagggaauccuuaugugauaagugccuuucuguccagauacuguguguuuggguuccaggaggacagcugagcuaagucaaagaagcccaucuuuucuggcaagcugugauuuacuguuacauaacugcuaucccaccuauuuguugggcaucguagggcuuggcuucuaagagucucugagaagacccaauucaguucuuugacgcaucacaaacuuagauaggaugaguuagugaaaacagcagaucccagagagcagaucagaauccucccgguuccccgugagccuccaaugcauccuccauuaagaaugggagaucauguccucaucauccaggauuuucaaggagggaacuagguucuggcugcaagauuguggucagcuauugucugugaaugggcucccugggggucuucuguggugugggugugugucuguguguguguguguguguguguguguguguguguguguguagaugcaccacucacuucugaccugugacauuuauugcaaagggaaacacacuaacccucugucccccacacucccuuuuuagguccugugcaagcugauaaacaguuuauauccaccagggcaagaacccauccccaagaucucagagucaaagauggcuuuuaagcagauggagcaaaucucucaguuccugaaagcugccgaggucuauggugucaggaccacugacauuuuucaaacaguggaucucugggaagguaaacugcccuccuggcuuuaggucugucuccccuggacucuugucccaguaccucuucuuuucucuguccucuauuugcaaaagccacuuacacagggauucccugugcugcuugggggaggggaaguguguucucagcugucaucccagggacagugcuggccuuccuguuugugaugcuuucuggguagggguccugucguacagaaggacacauauugaggcuagggcaagaaccucagccaaguaguggcuaagugugauaguggaaguguccacagagaagaagggaacuggcuacacgcaugucuuuuccucuagucggccuuccaucacaaaucacacuuaguggaagagaaaggaggcaggagugagugaguguucuccugacucaccaucacuggggcuuacagacaaagccaucuggugcuccucugucauucaaucugagggagaaaaacagcacuccaucuuucuguuaaacaauuaucuagagaauggugacuguaucuucuagaugaguagucugcucagggagacuacuaaaugacuuuucacucgcauuugugaauugacucagugagaagaaucucacaaagcuacuuagauuggaucuuaucucuggacauauauagauagcaauccaccacuguuggggaaaaugacguggaaugaagauauugcugaaggauuugagugaccaauagucauaaggcuucaagucccuuuuagugauaaugugcauauuaauucauauagccacgaguaggccugccugaggcacaaagagacuaacugucuaacugacagauugacugacaugcucauugucacucacuggcugucaucgcagugcaaccaacagaaucuccuagauagugacccaaauggcucugcugacagugacaguggaauaaugcaacuuugaucaaaguguggguauucuaagggucauuaccucaagacucuauucacagagaguuuuaugcaucuucaauggguaaguaguucugaccugaagaggccaggggauugaucuuguauuuauuacucagaaacuccaguaucugaaaugcuagccacugcauuaaguccucauagauaccuuccucuaauucuucaugagauguccugauugaggcuugguuuccaggucaaaauuauggugguuuuccacagauaguaacaguuucuuuucccugaucuucuccaucacgagcagcccagagauaagagcuuuucuggacagggucacacaguucuucucacugaacuaugaaggaaauauuuucaaccuccccauuccacagacagugacaccugccugccccugguuaugugugucugccagagagcucauaaccucucagaccugagacuccacccuagguccuagugcuaaagcacaagaggguacucaacaggccacagcguucuucaucuauaccauggaugagcuguugagucacagcagugacuaacuguugaugccagggaggcagaggaggauggaggaggaggaggaaucaaagcuaugggaaaccaauaggguguuagagcaaaugagagggugaacagucuaaugcagggaguauguaagaggcaggaugcuugagguguguggggauggggucuagagguugccuucccaucuacaucacggaagggccagcuuugcucccuuuccugguuacccaaauaccauggagaggagcuuuaagcugugggagggaggagcaaacucuauggagcucuacacaccugccauagccuguguguuagauccuccuggaggaagaagaaagcuacaaugcauaaauaugccuggagcaaccugagauaucucucugaauaugauaaugcuucuagaucaagagagcaagacagacgauaaaagccauucuucucuguacccugcaccguccccagugcaggacaggacuuuaaaggaaauaaggaggauuuuucuaaaggugcugggauuggcaggucacaaaaacacuaggugaacaaaauguagggaugggccagagaccuaagaacagggaagcagacaugaguguccuaaugacuuccuggaagccucugggguggggguggaaggcugagauuuaagaagcuggcuuagacuugauguuucccaggaccuuugucugaagcccaggcuagaacuguuugcugcggaguguaggagcagaaagcagguugcuuugcacagagaagugggugggagauggcauugguggcauagaucguggccugagcaugugaggcucuggucccuccugcagcaguuguuuguauuggaggaugacuaaacuguaaucacagagcagggcuggcguguguuuaggugacaggucuguguaaggaugcauacacucuaugucacguagauaucagucaucagacuagccauuuacauagcucaucacauucucucuacaacucuacuccccgacuggggaugaaaucccgcccucccauuucaguuacuacugcuaauucgggauucccugcaccacauuuguggcggguggcuaugguugcuguaagcccccacccccuuuccuagucauugcuuucuccucugcggguacuuuaugcuuggcugcucucaguaccccauuuccuuugcuuggcaugcgcuuccuaaguaugacucuguuuucccacuguuguccagugccuuuccaagcugcuucuguauugcugaccaguaaagcggcagggacccagguuugccaaaugccuuuucguuugagcuucaauuacucauguaggcagggccccagaagcacccaucacccaauacacuguuuggaagagaccuggagggaauaaggauacaagauucuuccaaaagaaacccaugugacagcuugaucauagagacagaugaucaacucagacaaaaggcuauuggggaagggccagagugaccaucauguagggguguuggggaaaggcaaggaccauugaaaagaagggaagggaagugcagaaauguuccucuaugaggagaaaaaaguaagugauccagcagguuucuuuuacauuugucacagaugccuauaaagggcaggguggggcugaaucagcugacucagaggacaguacacuccaggcaagccugcagaaucuuggcuaggaauacuaaaggagaaacuggagaaagggagcaacaaugauuuacaugugcauguguguaagaggaagaaaccacacgagagaaaguggguauucuggucugagguuuggucagaaaaccugcagcaaguaucuuggguggugcaguggagagcaggcucccaaggcagaaaauagggagccuggaccaaaccugugugcuagcuaucacuuaucaguuaaaaugucuaugccuugaauuugcccugcaucaaauggggauaauaaaauccauuucaaagaacugauugggagaacaaaggaggugauguaucagagaugcucagauggcgucugcuaaguuguacuguaaguauugucccuagccugcccuuucuaaaacuaauagaaggggcagggacuggaaaggcacagauuucucauaaaacaauggacuugauuaauagccauacuuaggagcugauagaguugccuggaugaucuucaccuucucagccauucauacaggagacuuuauugacauuuccacucauugacuuugucaucuuucccucugauacauugcauugccaauuucagacccaggagaccuugguagaaugauaauagcauggguuuuagagcagauguauugaaacucuucuuuccagugcauccuaguugugugacucuguuuauggcguucagcugccuggguucucuucugugcauugaucugacacucccaaccccuagaaggauuauauggagccaucacauucagucuccugcccgauauaugauuccugguugccuaaucaauucugacuuuucuccugccaccauaagcucaucagcagugaccuuuugggccucuuugcagaaccacgcagugucaaauguuccgaauucuccaaugccagagcagacaggacucaaagagcaaucaacccaauucaucuucucaacaguugcagugauggaggcuaauggaugcaugguuuugugaugccuguucuugucuacugauccugggaaucuagaagguguuguuuacagggaaguguagagccucucaagaggugucacuaugugugcuuuuccucaaaggcaggcacugaaggcacauuucaccuagccugggaugauuugggggaugcugcaagguaccggcagggcuaucacaagugccugcuccuccacacgugccucucccaaugcagcguccucagcugccuuuacucugaagggcugcuggcaacuguauuuugugagcuucuccuuaugcagugacugucaaacuccagcaugcaucacaggcaugugguaugacugacaggcacuugucugacauguuaagucugcaacaaggcccaagaguuuguauaucuuaccgaucuguuggugacacugcuucagcaggccugggagccccaccuugagagccacuaccuuacaauuucucuucccucaggccagaaggcaagcaacaaaaacccauagaacccagagagaacacucagucuauuuucugacauuucucccuggacuguagcaauauuuucucaaggagaugggaaauuauuuuucuuuuacaguuugcuuucucuguggcguauauauuuuuuuuuaaaaaaucacuuuguaagaguuccagacuggguugaaaccaaugaaaaauaguagucaugaaacaaauaauuuuagacugacuuuuaguguuccauuaccuuuucaacuaaaaugacuucuccauuaccccuguuuaccccuguauccucuuauuucuuccuuccuuuuuauugacaauagagucuucucucauacaauauauuccaauuguaguuuccuuucccuccacuccuccuaguuucuucccaccuuucuuccccuccagaucuacccccuuucuggucucucacuaggaaaccauaggcuucuaagagcuaacaacugaacauggcaaaauaaacuauacuaagaugaaggaaaaccuuucauacugaaguucgacauggaaacccaacaggaagaaaagagucucaaaaagcaggcacaagacucagagacccacucauucuuccagucaggagucccauaaagauacuaagcugacagcuaugguauauacacaaaggaccccaugcagaccuauguaaggugugcauaggaaucuugaguguaaauuuaagagaauaaacuccucacuagagugucuuuauguaaaacucaaauuuuauaaguacuaauggucuuucagaguugggacauuacaaggcagagcucuaagcucuauucuuuaagacuuauuguuuaguaguuugggguuuauggcuauuuuggaggugcuauuccuucuugugauaauacagcauuacaguacauaguggguauagugacacuuaggaggcugaggcaggaggaucuucauaaguucaaggucuguuugggcuacagugugaggccugcuuuaagaagaaacaaagaaggggguagcuaaggagagaaaacagggcaacaaugacuccucauuguugcauuuacgugcccaccacugccugacacuaaaaaggcuugcuggaugacacaacccaagcugucagucauccagucaacuccuuuuccuuaagaguucguuguucaauuuggguuggcgauacaauuaagaggaaguuacagauaccgccuacaugcccugaugcacacauaaccuccccauaucauccugaccauguggguggaacaggcauuaugauuccuaagucuugacugauggauugcuuauaacugaaggucacacucuacaauagggcucauccaugcugauguacagucaaugaguuuggacaaauguguauagcaucaugcugccuaugaucccuaccuuaauaaucuguggaccaucccuucauccuuuuccaucaucuuccccagugaucauugcucuuccuacugucucccugguuuuucccuuucuaagaugucacauaguuggugugaccuaguggguggucuguucagauucuauuagcucuuuuuuuuuuaaacccucaagucugauauuaacuuauugugauaaagaaauagaagaauccagacggcguguuuguacaagcuuggcuucuuccugcaucaguuuccuuuucgcagccaguggcauacucuuaggucaucaccaggacuguccccuucauucuaugcuugcauuuggaaaauggucagcauuggauuguaugucuuuauuuucuugggagaacaguauugagcagaaguacuugaagagucauaagcauuugccaaaguguccagcauggcucucaggaagcaaagugcuucuaugcaggcagacuuccagcuuggaucaaagugcuucuagugaucagcuuuauucacuugauuuuguggaagaugucuccaaaggaaggaguuaguacuuaacaaauuuuguauaauucuuagcaugugucagacauuauuauguuaaaaaaaaugggacuaaaaaguucagagugaggcuuccauguccaucuguauguaaggguugucaugggagauuaccccagaaucuggauauuuaggaugcuuaggucauucugauagugaggcuagcugggagucaccagcuaaaguguguuucucagacugaugguuugaaucaccuguagaucauuuaccaagcuuagcuuauugcaguguagacucuuaaggcuuuccaaaucaauuuuucauaggaaaaaaaccaucaauauuuguauacuaaauuuggagaggugccccacucugcccacucccauaaauagacaacaaaacuuggaaaugugcuuugaaucaagcuguaauggccauuuuuacacuugcauaagaaggcaaaugauuggccaugauacagcaguuuagcucuuguuauuuuauacccagcacacuguacagaucauucucgaucucacuauuucuaaccauauuuacauaccugaugccuucugacagaaauaagguucuauaaguggcccugauuccugccacuugucccuucuaucuaacaugacucauuugaucuccauuucuaaucuggaaagaggccaguuuggacaaguacucucuuucucaucuaaucaguccaagaauucuggaauucuucacaaaagucucuaucagaagacacaccagacaugaugagaaaaugaaccagcugugagcugucuacgacagacgauuucuacuuacugaaucauauauaaucuuccugauuaacuugauuagcauauggacuccaaauauuuucauuuaaguucuuuaauuuaagacauagcaaaauuacuucagacaaaaauauccaaugacuuagaaccauuugguuguaagguugguguccuuaauugaaugguacccaagaucagugcccagacuuagauuuccuguguuccuaauggccuuacuccuuugguuaucucugaucacugguuccugccaaggaaugugguuccauacccauuuugcaaggggcagggguauggggaauggcagugaagaggagugacuguccaacagaagccugagcugggcucugguuuacuugcugugugccuuugagggugcuagcaaaucuccuugaauuagucucgcuguccacaguuggagaggguuggucuccacucuguaauguuaagaucacaugugauuaaggcaucuagcccauaauuuacauuaaaucucuugcuuugaaaccuuucuuuagaaaacaaacuuucuagcuuguucuugucagauaacaccuccuucccuccaaugugucuaacucagucguacaggcacuuccaggucugcugugcugacaggagcgugggugguguugaacuuguguuucuagguuccuggaucuccuacccuugccugaagcucaguucuuucugaguuuaugugugcucacaauagccagcuauuugugaaggaggccugcacuaugguaggaaaaaacuuauguuucaucucuuucuucaaggcaauguuuauggguggcuugcuaaguggccuuccacauugcuccagauccuguacacgucagacccacuccuuccugcuaucauaauuguauuccuccugcucugugugaaagcuaagcugauuggcagauucuagcuaagacuuccuguacuuauucauuuucuucuagguucucuuuaaucgcucacuguguaagagcacacccacgaugucuuuuugaaugccauuacuacaagugcauuuuaaaaagcagccuguuauauagugacaaguugcagaaagguguuucaucucugaaagaaaaaacuuguucuaauaguuaugucugcauuucuucuccaaguucuuaguguuucuuguaccaauccccuuccagcuccuauggaaacuccaccaauccaucaguucucugagucugagagaaucuccacugacagcaucuuucccaguccuauuagccauccucaccugcacaaacugcagccaaucacccaguagugagugagugcugaacuauggggcagggggggcucaugggggaaggacauucuucccugucuucucagaauacaugaacauccugaacagaacuuccuugaaggcuauuauuguugauuucauuacaguuuaugcuacauucucucacucugucugccuuucugcuguaaaucuguauuccccaguggccgagcuggaggaagcaugcugagaccacagauggcucacugggucugacuuugaauuuggcucuuaaccuuucucaggcucccacuagccucucucuguuucucugucucugucucugucuuugucucugucucucuccccaccccccacaauaccuuucaguauuugcaguucuccauuccugcuuuguacacaucucagacuuugaucugcuucuaaguugcagccuacucaggaagguagcaccuucucuaaguuugaggcuaccaguuaucugaaaaagacaggagagaagauagaaggagcuggcugauuugaaggcucaacugccuucacuaugggcaaucuuaugaccaugucuuuaugcaugccugccccaucaccaccaccaccaccaccaccaccaccaccaccaccaccaccaccaccaccaccaccacccguucuguuugcucucucacaccggccagugauuuaucgucuccauuaguuccuuucaugcaucacauaauagagggcugucacuugugucuugagugcucucuguggugauuugcuuucucccuuugccuguggaccagagugccacgugcauacucaauuugaugaacauggaugauuuuuaaacccuguuaacccagauagaauaaaagagugaagcccccuggggucugaagccaaaugacuauaagcaaccaaucugugcaguuucccauucgcuggccacucaugaggaaagcgcucuucugcaggccaucacccagaaccuccugaucagaucacaucacauagcuugcugaagccaugagagccaggccaaggcuagagauggagcuguaugugagcuguaaaccuuuggaguguuaauuacacauacacucgaaugagaagggcccugugguguaaaugcaauaauuaacaagguuggggaagggcuuuacaccagggccacucugggagaguuagugagucucucuugacuguacucauccauagccucuguuacagcuucuccuuccaaaauuccugcccugacaggcuuggcuuucaucucuuaacugaauuccagggaaggacauggcagcugugcagaggacucugauggccuugggcaguguugcaguuaccaaggaugauggcugcuaccggggagagccauccugguuucacagguaagucuuucccugccucucauagaagggcagagggagggccugaccccuuagcuaccagaugccgucuacccagaaguaaacaaagaagugccaccacaaggcccacugagcaaggaaggcugacgcugcuguuccagacaacacccaaccgaagcagagguucuugaguuuuccuguuaguucccugcauccccucucccuuguuccuuuccuucuuuuaucuuuuuaauuuucuuugaugcaccuaaugaaaauuaaauaugucccucugccaaguaccaucucaguuuauaacuauuacccagcaaguugacuaauggcuuccucuuugccucucaaaagaguccugaucugagugaugaauuaugugauuauuucaguccugaaagggccuuuagaaccuuucucuuaagugaucuuuuuggcugugagaacagagacagagaugugcaaacugaagacuuugguggcagaugaaaggggugcuauuagcagcuacuggauaauucacuuuauucgucuuucuaauguuuuuuuuuucucauccagcagaaauauagaaggaucuaaccuauguccuuuguauuaccuugaccuaaaauccucugggaaacucaucaaagaccuggucuuagucucagaauuauuuaaacgauccaccauguuccaaaguuauuuacaauucaguucuuuaccaaaauuuggcauucucuaaugaggaaauauaaauugucccuugaaaauuccuaaauugauugggcagcacaacagagaucaaucguuggucuuguaugggaaggguggaauggaaccuaugacauguugugcaagaggaguuagcuuugugagaaguaccugagaaugaaggcugaggcagccuaaaggggaagcugaagggaaagagagaagcugagggaaaguuuuccagaagggcagccagccauggauucauggauucuccucccccucccucucccccucccccucccccucucauucuuucuuuuugcaagaaauucucagacucaucuugguuccuaagggauaggaaaguuauauguacuuaucagccauagcgcaugguggcccauagcuuaagguagcguuguaggucaggacucgaguguuuguuugucucagauagagccuguguaacccugucuugagaaggauuugaaacggucacaugaccuagucccaucucccucuuucuguccaggaaagcccagcagaaucggagaggauuuucagaggagcaacuucgccagggacagaaugucauaggccugcagaugggcagcaacaagggugccucccaggcgggcaugacgggguacgggaugcccaggcagaucauguaagaugcuguauagugagugcccccugguagagaggacggauguuccgcaccacagcccgugacaaagaaauagguagucaccugcucaccuucuccucuuucuugaagccuucuguccccuguccuugcaagugcugcauuucugcucagacuccacgcugccuacugcugccuacugcugccaccuucuguuccuuuagaacuaugcaaagacucccuuuccucucugaccuccugugcccuaaggucuugguuuguuugauuauuuauuuauuuauuugccaaaaaguuucucuccuugacucacagaacguauccuaauaaacaaauuagucuguguuccaga

SEQ ID NO: 8260 - RNA, 51157 nt, Mus musculus
cagagucccggggcugccgguuacucuucugagagcccuucagaaaagcacagggcagugggcagagaagccagggggcgggggugcaggcaggcccagccuguguaccagcccggggaaacccacggaagcacccaugaacaagagauggugcaacccgggugcgcacgugugugcagcccgcuggcacgucucuaugcccugugggcaccugucgugugaguagcuccggguguggcuguuccuggauguuguggguuucaggaagguuuguaucuucgggccugccucccccgucuccagaggggaacuaagaaguuuaacugaccagggacugaggagauuaaaggaguggaucucaguggcaaggcgaagaggguggggacugcgggagcagcaggcaggggagcaccuauuugacccaucucccagcuagaaaaggaucuugaaaagacuggcgugacccaugugcucugaaauguuuagagagccccgagcggugaugaccacagagugaguggcacuagacugagccugucuaaaucguggacgacagggaugcuugcauuuagaaaggccagaaggaaacucaggauggguaccaucugcucucccaaucccagcgggacaaagacagccucggaggucugcaaugccgacuggauggccucgcuccccgcucaccuccacaacgucccccuuuccaaucuggcaaucccagguauucgucuauaacuacuuguucgcacuguguuuaaugcugccauuuuaguguuugcuaguggguugguuguuuucuguuguguugaaaaacaauugucagugaucucuuuuuauuuccaaauuaaaaaaaaaaaaaaaaaacuuaacaggaagguagcugcuguaaagagagucagucaagccgacugcaucacuggcaaaagggacaguugagagaauggaaucacugcgcuguuguuuuguuguuuuuauuuuguuuacaccauacggccucagucuaagaauguuaaccaucuugaugcagaggccuggguaugugaaaggcucgcugacuugaaucauuuaagggaaagggggagagaucaagaauaauggguagaaaguccuuaacaaucuuagcucugggucaacauugaagcugaaaagaauauuuuucucauuuaucugaccuuucuugaaaacaaaaaucagauaaguguuagaaaauagguucagauucuaggcugggcaucaaggcacauaguuuuguuguuggaaaugccagaaauagaggaugcagucuguccucacaggcagucauuaggugugaugaagugacgguguuugaagcuuugucuauauauacacaggugucugccuagcugauguagaacuggagccuugagaagcaccucuguucuugcugcauuccucugccagaggcuucaaagcuugacagugcucucgggcaauugguugaucuuuccacugaaaggcuugcuaaaacauaguuaucuugggcaggauguuuagaccacacugagcucagguuggugaggugggugaaauccuacaaugcugguacuuaagaagcacucagggagcaagcgguggaccaguucuuucucuugcuuggggacauagcaauuaaaguuuagacucucagacaagcccacaugcauucccuggaccuacuugcuuuucucuucugccuuaaaagaugaccucaagacaccuccaucugcuuucuaugcaugggacagagagguuugggguuuuuuguuguuguuguuguuuuggguuuugggagguuuuuguuuugguuuguuuuuguuugccuugcucaccucucuuggagcucuuccagguucacuguccucaugggcccuaacugcuguuaaacaagagaaagauugaaagauuuuguuacagcuacaagucccuucugucuuacuggcccuuaacuacaguuccuggggaaaugccagauggccaugcuucagaacaugucuccuccauguuuaauugaugccuauggagucacugccaaacgaugcaugggacacuucuaacaugagucauuugccuucgggcucuccgauggaauuauuuugcugagugauauggcagguaguucauguuugcaaacagaauggcaucuaaggcaggcccuaaaugacccugucauccacggcauguccggguaggcugugcucccuccuuccugguacuuuggacaguucaaacugcagcuccacugggcugugaguucuggcuggacucuacaaaggaucuggguguuuguuuuugaucuauaguauauuucaggcacuaggauuucuagaugaaacaaaauucuugagacccauugccauaccugaaacucaguaugagcucuacgaagcacucagacauucguugaccuugcuuuauaaagcaaaauucuccugauaagcagaaagagaaaaugguagucccaucuccccaauacaugcuguauuuuuaucaugaaaugucuucuuuccaggaaagagagagacauauguagguaugucaugucagaacuggaaauacacauucaagaacuauccauuuacaaccuuccaucccccauuucugguuaugguuacugcaaucugacuucuagcacuucccagagaaaggcuuacagucagguucagucuggccuugaugagaaauuagaauguaugggaugaauucaggaagugggguccauccuguuccuuccucugcaguauuguacacuugccuuugacucucucucucucucucucucucucacacacacacacacacacacacacacuuuauuguucuagccuuucuucgagacacauuucuacuaucuagccuagccugacuucaaccuugagggcauccugcucauccuuccaaauguagcuauagaccaccaugccuggugguaaauauucauuacugaccuccacccugauguacccgcuggcauacauuuccucaagaacuuauaugucccauaaaaucaauagaucuuaguacccuuguuuuugacauggaaauuagggguuugggauguacucuugguagaguacuuggcuaguacucgguccucacucugaucccagcagcacauaagggaggcauacaagcaaaaagacugggaguucaaggucacccucugcugcauagugagcuugaaaucuacucucccacccccacccaacaaagagaaauaaggaaauugucacccagaaaauuuacauuguuuucuaaagauugcaaauaugcugagugucugagcuaguguucaaaccuuuauguaaugaaaacacucauuuacugccacagugcccuugaggggccuugggcaguacagaggaguagaggcaguuccuggaugaaaagcagguuucagagaccauacucugcagcauguggaagaaguuguaaaaacugggugguuuuguuguuguugucguuguugcuguucuuucguuuguuugugacagggucucauauagccuuggcuggcuugggaguucugauucucuugugucugaugucacucaagugcccaggauugcaggccaauuccagcacaccuaaccugaccuugguuucaucugagcaauuauauaucaguguggacauuugauagaugcagagggaacgcugucuagauagauguauacauuuuauacauaugaaugauaauaggcacaaagauacuagauaugugauagauaaaauagaugguagguagguagguagauauagauagcaguggagauaaacuugcuaugaacuggagcccagucaagauugaaauucaacaucagugcuuugucaccauguguuuguaugcugaguuagcgccaucaggaggggcagccuacagcagcagugacaagggaaaagucagggcaagggugagggagggaucuggccaucaaagagcuggauaaaguuugugaugucagaugugggugcaccugcugcgugugcccaggcguggaugggagacagcacgugcggaugugcgcucucucucucucucucuccgugagcccugggguguuacuuuacuuccggaacugcugccaccaccuguuaagcuccaccgucacccuaaacacauugaaauaucucggaggagaaccuccaagcuauucuccuucccaacugugucuaggcauuggaucucuaaaggguaaacgauccuggccucauggaugccacuuuuuaagguuaaaguauugauaguauugacauuuucugagaagaaagucuuucuuuuuaauauauauaugauguauacuguuuucucucucucucucucucucucucucucucaaaacagagucuugagaggcugaggugccaaggagaucucuaugggugugaggcaagccuggccuauggagugaauucuaagucugggcuucaugagauccuacaagggaggggaggggaggggaggggaggggaggggaggggagaaaggagagagagagaauucuuaguaaguaugggcugcaugagacccuacaagggagaggagggaaagaagaagggagaaagggggacagagagagagagagagagagagagagagagagagagggagagggagagagggagaaggagagagaguaggugggucaggacugcaagagauacuaccugaagauuaggguugggagggggccuuuccaaaaacauagugccauugagguaaaugaugagggaugugaauggauggcccuuuuuccuacccugucaugacccuccucaguccuuuuauuguggcauuucucauuucugaacauacugcuuuuagucccuuaguugcuggaaguaucucuauaucuccugugaccccaggucuucugagucgguuguagcagcucagacacuggccacuguucacacugcuccaagaauaacacagaaagcagcagaauacgaauguacaugucugcuguucaucauuuucuguuguguuauguuguuuguuuuuaguuuuaguguucugacacgaggacucacacggaguccaugcuggccuugaagucacuaaauagccacaucuagcuuccauuugaagcuauccuccugccucaguuuccugagcccaggucauucuccaguguggucagagcuaaacucaauagacugcuuagguuccccguagguaaaaagccccagaaggucauguaacaacuacccaccccauuccuuguugcuauacacugugcuacugaaguguuagagaagccucaucacaagcgccuuuggaaaugagaagucuaggccaaagagaugggugggagaguuaggaaagaaacaggcuugugguccagcauccuuucuguccucuuucuccccuugccacuuggagcaucucaucuucccugccacugucucucccugcccugguuucuccuuccaagucucaccuuucucccacugaccuggcccgcccccguuacucaccuucuucagggccauccugccuugggugacugucacuucuccaguucccaggaggcuccgucuucccagguugugggcauuuacuuaagaaaccaaauagugcuaacuccucccccuuacucuucuggcauccugugcuuuucuaugaaguugaacucacgcacgacuacucugugauuucuguaacucucuccccuguggguauacacuuuuccucaccugggugacauggaaacaaaaaucacuugggaaagagggaccaggauaaagaggccauugcucagauugggaagguagaccaaguguguugcaucuaaaagagauucaggggucauuucaacgguggacaugggagacuguauaacagcauuggguuggaacauagcugucuuagucaggguuucuauuccugcacaaacaucaugaccaagaagcaaguugaggaggaaaggguuuauucggcuuacacuuccauacugcuguucaucaccaaaggaagucaggacuggaacucaagcaggucaggaagcaggagcugaugcagaagccauggagggauguuacuuacuggcuugcuuccccuggcuugcucagccugcucucuuauagaaccaagacuaccagccccgagauggucccacccacaagcggccuuucccccuugaucacuaauugagaaaaugccuuacaguuggaucucacggaggcauuuucucaacugaagcuccuuucucugugauaacuccagcugugucaaguugacacaaaacuagccaguacaauagcucugaguuggacccagaaucaagccauucuucugguggacuugaggcuguggaaaagcaagagcaaaguaaaccaaauagugcuaacuccauaauaauuaagacuuaucacaagacaccaagugaucucucaagcagcagugcuuuguuguugguggugauguuggugguggugguuuuguuucugcaguguuguagaaugaacccagagcuaaauaagcacuuuaccuauauuccuagccauuauuuucacguuuuguuuugaggacgggucuuguuagauugcacaggcccauuuaaacuugcugucuuguugcucggccucuugaguaccuagugacaggaaccugugccgccagcccagcuguguuucacucuggauagucaugguggagaacagugagacacaacauuggcauucccacagggacacuuucucuccuuacuccuguauaccucccucaccaucacaccaaaaagagcuagaauucaggagucaucucuuucuguuagaagugggaucauggacuagcugcagggguccauaaucucaaucuuagcauggcugagacaaaaagaucucaaguucaaggccagccugggcuauguagcaagacagcgacucaaagcaccaaaagaugaaaggauauaacuucgguagagcacuugccuaccaugcacaaggccuuugguuccauucccaauugcaccauaaaauauaaauaagugaaagaauaaauaaauaaauaaauaaaggcaggguugugaauuaguuaagaguguaaccacucagccacacugcuuggauuuucuccucccaaguauugaaacccugggcuucaugugagaacuaauucauacaguaugcuuuccaguauaaaauaagcucuauacaauuauuauuauuauuauuauuauuauuauuauuauuauuauuaugcaucuuuuuaaaaacaaucacacuaucuaaaacugaagccuagauggaacaggaggccuaagaugcaaucuguacccucagguaauuuacagucuaguuaaggagcccacuauccaauuaagcccugagagucccucugaucacauuaccauaauuugaccaggcauacccuaggaggguuagaguuauggacaagauaggagccuauggcugccuagcuguaaacaccaagucuaaaaugcagaucaagagagcuggaaaaaaaauccccuuuaguuauugacuguuucuuguccacugaccccaaauucagcugccagaccuggucaacuacagacuuccaaagcuuccaggaaagagcucuuugcacuuugcaacauaacaggccagguuguuauugcuucuucuggucucauaucccuagcaaucgcucuccuguucuagaaugaagcauuacagaaugcuuuccuauaaacuugugugccaguguguguguguguguaauacauacauaucauagguguguauaucuaucuaucuaucuaucuaucuaucuaucuaucuaucuaucuaucuaucuacaccauauuugcaaacagaugcuucagacuccacacaccaacacgugugcuaccccacacuugcuaugcaauugcuaugaucuuggccuccccuuaaaugucucuuauuguucacccuucauaaacauccuaccaucuuuuccacugacugcuugaagguucuuuccugcauguuccucugccagacauucuucagaagccagagauuugguuucuaacgcauguucugaccugaucuccagcaggugugacagaucaccuaccuccacaucucugucucuagucccuagggcagagauugucugugggucgggacuccuuggggucgcauaucagauauuuauauuaugauacuuaacaguggcaaaauuauggcuaugaaguagcacggacauaacuuugugguuggagagucaccacagcacgaggagcuacauuaaaggguggcagcauuaggaagguuaagaaccacugcccuaggagauucugagcccaggcacacuaaagauaauguggaugaagcuuccaauaacuuugccuuuaggaaggaucugaaaccacucuacacaugcagacuagccccaauuacaguuucaaaccaggcuuccggagcagagauuauuuauagacauuauaauaagugggcguguuugugugaaaagaauuugaacaugcaucagggaacaaauuuagguggugggaagccgucacuagaucuguguguuuacgcauauggcuagggaggaggucccccguguccuacuugugacguuaaaguuggaaggguuuagaugcuauugcugaacaacccugaggcgcaaagaguguaggaggccuacauuugcagcucuuugggugacucuaagagaaaagcucuuggguuaaagaggccagcaggacugucuaagccugacaccuaagucaugucauuuccaagauggagucuuuccugugugguuacauugucuaccagaaccgaaaauuuucuauaaaaauaacuguuagcaauuucugcuugcucuaggguugcugugcucgcgugugugugugugugugugugugugugugucugucagucugucugucugucugucuguguauguguacacucuguauucucuuaguauuuuuuuuuucugagcagauccaacaauauuaacuuuaaaaauaaauagagccaaaugugauccacaugacuuggaaaucuaagacaggugaauugcugcagauuguuagacagcccgggcuacacagugagcuccaaggcagugaggauauaagaaagagagaagaagccauuuguaccucauaaguguuuuggaguacagcuauagucugcaguaauggaccaacucagauauucaagacucugucagaccaagaugaauauuuuaugaacauguauuguuugaagucuuauguucuaaaagcaauauucuuaaagagcaacugaaaacagaugggggaaaugcccaccggaaacaggugagaguggaaacaaugucucaaucgcuguugaguuuagaucaagagcaaagaguccauuuagagucuccugggaauuaaugagcaugcuuauuaauuugacuuuaguuguugguguuuaaccccuuuugccucuuccgguuuucauugccuauguagaaaaacagacuuguauaaaggaaaaucaggaauucaaaagaugccuauuuuugugccucguaccauaucagaucagacgaaacguucucccccuacucuucaugaaaugacuaucuuagaaaaaaauccuaaaauucaaaacugauggagaagaguacacggcaucuuugauacccaggaaaccugcucccaguucugauuuagaaggcaaggcaaggcaagaaauuguccguggcaguggagcagggaucagaaaccguuaccggcugcugagcgguccuucuaggaaacuacgcacacaaaguuuaguuuauaacucuuguugcugaaaagauuaaaaauuacauguguuuaucuggaaaggagagaggccgcacgugaaagucauauacauucagccuuaauuauuuaucuuccagggccauuuuaacauucccauuuggaaugaucucuguauaaaaggaacaugguauaggcaacuuuaacaucuauuauuaauuaugcugagacuuuuaacucucagcuacuaggaaacuucgggcagacucugggguuggugggagggggcuccuuucucuuccuauacccccuaaucauuuuuuugucuuuuuacccuacuuuaagaugaccuuugguuggaaucacaaaaaacuagaagaagguguuagagaggggaagaggaacugagguauagaagaucauggugaccuugaagaaacccagacaaucuggugagaucagaauagaguucauuugaauaaaggaauggagaugagacuggaaaagcaggcaggaaaacaggauccuaaagagcuucauaugucgugccagaauugaaugcugugccaaagucagccacuggaaggaagcuuuguucagcaguggcugaagggcugcuagcugccuuagagcaaaaugaauuaaaaugacccgucaucgucagcuguuagaguuagcuuggggugggggugggaguggggacaacuuuggcauuguuucuuuuaccaugcucaaaccauguguccaucaccuucuguacagcaggcucucuccuaggcgcuagucauucaaagacugucaauaaggacacggucccugccuucaaagagcuagugggagaaaugcacacuuaaugaaccuguuacaacauaauaugcauguaagauaaucgggaagguucaggcuggaucuggaagagcauauggcaggggcauccuaacaagaucugggagcauagacaggcacauuaacacauugacaauucauuauagaugugucacauuugacaaaagggaaagaauaggagccaaggucauaaaguacuuagagguccaauaaucuguguuaggggcuuagcuucuccuuaacaagggugugaagaguaugaaggggguggaguuuagucgugagagcucuggguaagcacacacaguguucuagcguaacuguaaaauagggcaucgugguauaaagcuguaaucccagcacuugggaaaaggucauccuagucuccauagugagagugggaccagcaaaggccaugagacucugucucaaaacaaacaaacaaacaaccuaguggggugaggagggugaaggauuuuaagcgcauagaugaaaaugucagccuuguaauuugaaaaggucacucagucugcaguacaaaauguauggggacgaguaagagcuguaaccaaggcacacaucacuggggucauccaaguacgaagcaacaugacccggaagcaguaaguaacaguguggaccacagaaaggacgcagaugcuggaggcaaugaggaggaagugucaacuggacuuagugacuagccaggggaagcaggugggaaagcgacucggguagccaggaggaggagacauucccagaauaccuguacuggugaaccagauggugugaggaguucugcuuagucuaggccuguagggcuucagguaccuggggaacaccucagaauugagagauggcacaguggagaugaugucagagcuaaaucuugacugcacaguuagcccaucuccccauauccaccaaaggaugguauuauauccaauaucacaugauucaaguuuuaaccuggcacucggguuguuuuauuuauuuauguauuuauuuauuuuuaaagcagauuccugugcaucccaggccggccuugaacuggauauguagccagggauccuccuggcucuagcacuugaucggucugugcuaucaagcuuacuuuaugccgugcuagggaacaaacccagaacuccaggaguguuauguaaaugucacuacugagccacucucucagugcccuuuaaaggaguccuuuaaccuauauaacuuuucaacuaagauuauuuuuacaaugucagggcucacagaguugguccuuuuguguacguuugagucuucuaccuguuuuucuugaguccuguccuuuccugcugaacuguuuccccagccaugguuugucguugcuguuguugguuuuguuuuguucuguuuuucuuuguuuuuuuugcaguacugaggguguggggugcaccacacaagccuucugugaaguagaaacgacucgguuuaccacaaucaucaaauaccacguuuucccacacauugacaucugagguugcaucaagagguuccaugaaagugggggaauuuuuuaguacaauauuuaaugucacguaauucugcuucuaccuugaacauuugccugguuuuccacacucuuacuuuuucuuucacguuaaaauguuauggaaaacaggauuaccucagaggugagaaggcuacccagaggcuacauagagaacaagcacuucugugagggaugauuccacaaaaggugguguucucugcuuaaagacagagugagguauaagguccacaacagaggaggaauuucuuuuaaguucuggacauucaaagaccaggaaacccuucugaaagaccauagauccccaggaauacagagugcuuuuacaaugccucucaggcaugccauugaaaccccuuguacuuuacuuauaggauauaggggcuugauuggagacugucugugguaaaggcauaguugugugcccugcagaggcacagagaaggaaggguucaguucguucaaucuuucuguuucuuaggacagcucagggaaggacuguggccuguggagagugcuuggacccagagaagcuugucuuauauguguuucacacagaaauauuucauuugacaaucacuuaaaucuggaaagcauccuggaaaccacuccuuggaacuuccucccaggcagacauugguagacuaggauccugggcccugucucuccucagacaauaggaggccucuuggcuucucuacacauaaaaggaauguguugauuaaggcccucugcuuccagguuuuggcuuuacacauugcuuugguguauugugaauaauuaugaauucaauaggcaacugauuaaaaauuaaauuggccacauggcucucuugaauuuugcuggcaguaugaugguuauuauuaacacucucccauagggcucaugaaaaauaaucaagccugagaguugaaguuuaucccuuuggauuggcaauaagguauuaagauguccuuuggcuugggagacugcuuagugguucccuugauccugaaucuugguucuguuggcuagcucugagcaucccaaagaugcuuagccuucacacacuuauuaauaggaaguccuguucuuuacaaaugcugccuuucuccaaggaccuaacagguguaugaugugggaggccccaggagauguuauuagaaaacaacucaggaaaucuagucucuagaacuuuucuuuuuggaaugcucagugcagauuuuuauuauagcugcuguuuuagucauccuaacugguuuauuuuugucuucuaugucuucuggcauauuccucuucauugcccuagauaacucaacccagaaggaccaguuacaauaauggagcuggggauaaacaggcauauaggguaaaaagacagcuagaaggaggagcucugcuuguaagaagauggauagaccuaagauccaucuuuuugcagaaagaucaagggccccacauuggcuggcauuuagcaauucuuuacgcaucuguuccuucagauagcugugcuugugguccucuguacgcauguacucaguacuguagacaacauggagagaugggcacgcauuacuuaugaccccguccugacugccuuauagugauggagacugcucuggagcuccuccucacacagugaccuuaguucaucaaggauguacuaaguaccagcagaggaucgagggaagagagggcacuuaacagggcagacuggagucagacgacuccagauaaugguuuucaacugggucacauagacguaauuaagacagaaaggacaagucuaauaaaauagcgcccaagaauaguaaggaauuuucaaagugaaucuuuuccuguauucacuacccauaaggcucauuucucacguauaacucuguaaauuacuauauuuugagcucaggccacugaaauaguuuaacaugugaauuauguuuuauucauaucaaaguuguagagauuaaaugccuggguugugagacaaaauacuuuucucuacucacuguccuugccaggcauggcggcuuaagcugauaaaccagcagagccauuguuacgagugugaggccauucuggucuacauaacaaguuccaggccaggucagccuacagaguaagacccugcuccccaaaaauccaaacauggaacaaacaaaacugcucuaguaucuucuaauccuagaacugcaaagugaaggcaagagcuucccaaguaugaggucagucugcguuaggcuaugacaccuuaccuugaucuguuuccugucagaagcaccuuacccuaaacaccaccauuuaagaauacauggccauuuuugcaucuguuccauuuuuuugugucuuguucuauuuucucauuauuuuaauugauauaaaacaauuacacauauuuaucagucacacugugucauuguauauauuaggauacauguauacauuguguccauccuuuuuauuucuguguguguguguguguguguguguguguguguguguguguguguguguaugauuuuugucuggggccauacacgccucuaucagcuuggagaguucagaggacaacuuuguggaguuggcucuucucuuccaccuauguaugggucccaaggaucaacugcagguuaccaggcuugcuuaacaaaucccuuuacccaaagcuaaccacugggcuauuuuuaauuuuuauuuguuuggaaagaaguacagagaaguccauacuucagaguugaacuccugcuccuagcgccugucgaguuaacucagcacuuacuugaccucaaauacaaagccucaccuuucuggagcuuaguuucccugucuguaaaauggagccaauuaaaguauuugcaccacaagugccaaguugaggaagcacaaucuggccgcuuacccaacucagauaacccaggauucccuguaucacguccaauacucugcuaagacucguagaacucacugacagcugugugcuuacaguuauuguucauuuccaugaaaggcuaugaauuauaaucaacucagaggaaggcuuuauagggcguuacaaauauguaguuucuaguggaccacucaccaugagauuguggacaguacuacuuccuuuggauugaugugugacaauuuacaaagcauuguucagcaccuggucuccaguguccacauguaacugaucccaauacauaacccugucaaagauccuaccuuaggucauacucuuagacuuuuccaugaggccacggagccccuagacagcaaggaagcagacuagaccucuaguaaagucaaauucuuguguuuguuggcuggagggacagacucuuauuauauagccuuggcugaucugaaacuucuuauaugcaucaugcugccucaaacuugcaacaacaauccuccugccucuaccuccugaguggugggauuacaauuguucaucacuaaaccugguggguuuuuggcuuauuuguuuguuugagaugagccuugagauugccucuugacaacccccaccccaccuguuagcauucugucuaaacuccaccccauaguuaccuggcaacuauaaaaggggcugcuugcccccuccucccucucuuguucucuuguuccuuucuugcucucuugagcuuuucccuuucuccccucucuccccacucccuccccccacuaccugcucauggccagccuucccuucccuucccuucccuucccuucccuucccuucccuucccuucccuucccuucccuucccuucccuucccuucccuucccuucccuucccuucccuucuucccuucccuucccuucccuuucccccucucugauuuucucugccucuacuacucucucaacuccccucccaugccugaauaaacucuauucuuuacuauacugucuugcggcuggucccucagggggaagggaugccuuggcauaggcccgcugagacauccccuuccccauaucucaacccccccccauauaacauauucuuuuucucuguaucuuuuuauaaacacaucaccaccccgaccccuaccucccaaguccuaagagaauaggaaacaccaugucuaguuagauacgguuaaaccuuuuuuuaauggcuaaacucuuuaaguugaaaaauuauuaauuaaauggauaaauagaacaucacgguacaugucuauaaucucagcauucaagaggcugaggcagaacugguaccguaaacgugaggccaccuugagcuauagagugagcaauagaccaguuagggcuguauagcuagaccaugcuucaaaacgaacaaacaaacaaauaaacaaaaacaaaagauaaaauaaaauuaaguacaguuaauuacuaagaaacaaaucuaauauuuuauauaucaauuaguaaccauccuuucugauuaccuaauuuaauaccuaauaucauaguagauacuguaacaaauuuggagugagugaucuacaguucauauaccuuguaggcaauauauggcaguuggaaugaggccaguaaagacagaacauggccaaugccuccuaagucaacaaccacguugcuuccuaguagaauuggcuaaagaguagcuuugaggaaggugacauguaagagcagccuuugaaaguguacagggaagggcacaucagaaaaggaacagaaggaaguaaaugagaauaaucagaaauggggacacagggaaccuucagggaaccaaaaagggcugccauguggaaaugcagaagagacagguuaaggaaaugugggggagggaggaucugguaaaaauagaggccagccccacuaaagaaguguccagcauugugcuuuguugugcauccuauauggagucugugacaauauagggaagaccuaaagaaaaccccugaaguaaauaugcucguuguuugaucccagucugugaacuguucucuucucuacccuaacccccugccaauacccugcuccaguuggccaguuacaauucacccugcagcaggcagcucaggaguaacuucuguguguauccccuuuaccuccucaucuuaguauacacuuggagucuggugucaucucaguauauacuuggugucugguucaaaaugggcaucgguaggaaaaguaguagggagggacagaggagaaggagagagacaggagaauuugaaauacugacggagaauuuaggcauggaggauugguguuucuaguugucuuaagggaaacuacgacaugcagaaagcaagucuugaugcucaagguaagacaagugcuaaugacugcauugcaaagucuuaagaugcccaucacuucagauaaggaguaugaaaauacuaacagaagcagaaggauaacccacuuagucacacuaagauuaacuaagcuucuagcauugguuucuuugccuuccauaagccuaaaccagggauauagauagguacauggcuccccaauuuucagauugagaaauugaggcacaaagaaacuaaacauguugccaaaaacaagaaucuaguuaucagugcuggaacugugauaaccagcucuuguugaauucacuuuaucgcaucuuaaucaaaggcauguacgaagcugguauccaagccagugucgcaccaaaccuucacuucuguuuguugguuguaauaaagccaauuuuauuuuucacucuagacuguccaauuucaugccaggucucuaacguaugguacuaugaggaugguuauguauaaaggacacccacugacccauucccaggaacaaguugcauuuuuuucuuuucaagaccagacauccaagaggcuuuuuauugacagggaacaaaagcaacacagcgguuuaaaugguguguauaguaacgacccaggcuucugcagcggaaacuccuucugcacuagacagaaagagcauacugaagcuuuuagcaggcacagcucuucagaaagcuggucuucaagggugaggcauguggcuguacagguccucuuuaauaccaucguuuuguguaauuuagaugcuacuugcuggcuuuucccuccuucucucaucugaaggugcauguggcuuacucuuucauucacaaaauagaaagaagacccuggcuugucuuggaagagaucuaagacacuucccucucucaaaaguagccacucuucaguuugucacaugaauuuaauuuuuuaaaauuuuuuauuuuuuggaguugagguccaaacccaaggucuugcacuuacuaggcaaguacucuaccacugagcuaaauccccaaauuaaagauauuauuuuaauuuuaguauggggaagaagguauguguguaugaauaugggugcccccagucucuauuagaggugauggaucgucuggagcuggagggacgggugaaaacaaaugaacgcaaccucaguuugggguacgcuuuuuguuguuuugcaaauauggccagucagaucgguaagcauguuucuguguaugcguuguuagaaauauaguuauauaucuuaaaauacuuaauuuauguguaggcaaaucacauguaugcagaggcccauagaaaccagaggagggcaucagaucccuuggaacuggaguuacaggggguugugagcugcuggauguaggugcugggaacugaacccagcucuuccucaauagcaguaaggaugugugugaaugcacagagccaccucuccagccucacaaaucaugucgguggaacaguaaauagagccagcaaugauuuuaaaugagcagcuagaagguggaaguagacaacuccuaagggagaggaguggauaagagucauccccuuaccuucccgagauuaggaacaaggggugggggaggggcacugaccuccaggaaccuugcuugugucaaagcugugaacgguggaauucaaagaaaacgguucuuuaacugagagaagguuugagcgcccucauguguuccuacaugagguuuuuuuuuuuuuuuuuuuuuuuuuuugcaucucuuuuucaagauuuuuaaaagcuguugugaucuuccugaguuggggugaggaacggacauuuagcaauagaggucagccaagggguaaaugagcaauguauagcaccacuucuaaagacccauucuagguagccuuuugcgaacuuagcagcuccgaagccauggcaaagccaggccgagccucagcuuccccaucuguauauaauaagcacauguaacugcugccuucaggauuggggcaaaguucaaauuacacaagcacaauauccaagccugccauugguaggaagaacucuagaaacugagaccgcuauugcuaagaaccaaugacagguuagugacagagccuaagguucaagcacuggggaggugagaucuuucuauucuugaauaaaaguuuucaacaagaacuguggauaagagcaagagaugcuucuagaagauauguggcugaguaugugauuuuuuuuccagagguaaauuacuccuucaaacagggagauguaggugaggcuggcuauguguccuucccauaaauaguggcuucuaucuaccuaaucucuagcacuaaagcaaucaaaaagauucugaagggauggccauguaucucagugguagagcuugccucauauccuaagaccuugaguuucauaucaccucaaaaaggaaaagaaacaagccaaaacaaaacaacaaaaagaggccuguuaugaaauaagauauuucaaaacucaguccaauuucugucauugaucaguucccaaaauucuuugagaaauaucuauugauuaaggggcuaaccauauuaaaaucaauaaaaucaggaggaaaagaauaguugggugggucuguccuuuuaccuuauuuuucagugugugacauaagcuuucucagcuauagcauccaucagaauugcaguaagugaaggccuuuuccuguuugggcccagugaacuuucaaaggugcccucucccaccaauaauccucacugcucuccguuucaauauguguggaugggaaauauuauuauuuaugauacaaggagaccugaccuuuaaaugucaauacaaaugcaagggucuggccauuccucuguaucgucuuccugccuaucagagaauugagggaggugguucagugguauauaaacuggggugggacauuaaaggaacacggccuggcuuccacggucuaaagucuuacucuggguagcaucaucauagggagggagggagguuuagagacuuguuuggggagaacagguagaaagcuucccagagcugguaaacuucuccccucaccccaguggcuuguccaccauuucuggcaauguguuaccuuucaagacaacaaaggcagcccaugagugaggcugaggcagucauuauuuauaggaagcuccucaucagcuccaucucuggucccagaccacagaagccugauggagcugcaguaccucagucuccuucagggcagugugaagcuucagacggaccuucucugugcucagaaaucugccuucagcugcuacagugauauccucugucacaugcuuggacaaguuaacugaaccacacauuuucaugauguuuuucuuuuuuuucgauaauauuggccaaaugcuguaucuggcaguugucuguaaguccccauuuugucuuuguaacuuuaugguguauauuacuuuuguucuuaggaugccuccccaaucuauauaagcugauugugauguuucauacugccagccuuuauauaagaaauauuuuaauucuggcauaccaaaaaaggaaauuuuguuuaugagccuuggaagagaccauccugaucacaggaucuuucuucuuacacuuaaccaccgugucuccucuuuauggcgccacauucuaucugacauagaucugcagcugccuuaggaccccaguucaaauacaaccagccucgagguacagccccacagaguauagcuucugauaggcagggacccccaaacagauucagacugagacccaagugcacuuucagacaaauuaaagaucagcuacccauucacauuguuacuuucaaaacauucuucauuuugguagaaacggaggaguggaacuguacugacucucuuagauguacugacuagcuauauccccaaccuugagcaggagugagcauauuuuuaacacuucaauuuuaauaaauuugaauuuuggaggcauuuccuaagaacuguaagccauuaagcacuuugagauaauguauuugaggaccugaaucccaucuuaguucaugcaguucuggggcucagacucacaaacuuguaagugcuuuaccauugagccacacuuggauuuuagaaagugguacuuaucaauaaccuagauuagccucaaacucugaaaacuuucuucugcaggguccuggaugcuucagucacaggcaugguccaucacucccuccauugagauuucuuuaaugcuauauggacacucuuucagucucuguuuaaaucaagcaugaacuccaagcuagcaggccaucaacccugaaacuuagugcuagaacauccaucugggccugccauuucagaucccaguuucacuuagagccaaucuucuauuuucuaucucuucuuuaggaaaugggagcgaaucacuugucauucucuggcuuagauucuauugguuugucucugcacaguaugccacugcuucaucucuugcucuuuccacagagcaucacaaagccccuauuugccuuuauugcuacccagagugacacugaucaucauguggcuaacauagcuuaacuaagagaaaguaugagcaaggguuuugguuuucuguguuugggaacuuuuaaugucuucuuaauauuguugguuugggacaggauaaguuacccuguggcucaaaucuuauuaauuuucucaggagauauaauuuguauauucuacauuaauuuagaaaaaaaugugacauucagugacauuuuaugcaccaccaucuccaggagaaaguuggcugucuuccaaagugauuauauuugaugcuaaauuuuauauguaauaaaaaauguaucacuuaaacuugacuuccucccuccaaacuuuaaauguuagccauuuaguagcuugguaguuccccaacuauaaauacuugcugagauuucaauucuuguuuuuuuggauauaauuggcagaugggaagcaauaaauaauaaguaauaaugagucugaucuuguucuguugccagcgaugccaccaugugcucacuuagucuuuacaacaaacuaguguguggcuagugucauucccauuucacagaugaggaaacuaaggcccaguauuucugucacauggcacguaagcacuagaucuaggauuaugaacucaugucgcaugguaccagaucuuguacucuuagccacaugggaacucuccauuucacucagcacuuuggcuguuucccaaaccagucuucaucacuuguaaaaauguccuaaauugacaucuuuugaaaauugcuaguuuggguccuuugguauugaauagacauagaaaugaaugacuuauuccugggaaaaauguuuggggauacuugaaagaaaacuggagacgagagaguugaauaguccuguaauauuguucuggggcaggagaugggaagaacauuuucucuauagggucaucugauggaugacaagugaaaaagcauuucugaaggggguaagaaagauguucaugaggaauaaggcugucaaaguaccauccagacaaaccagggaugcagucaugaauagcaucccucagcauuuuacucacaauaauguucccacaaugaguccuuuuaaacauuucugcacugcucuaaacaaauacauuucaguaguaaagaucuagagauugcucagugguuaagggcuuauacugcucuugcagaagaccagaguucaauuccuagcacucaugaugggcagcucacaaccuccuguaacuccagccccagggaauccaaugauguccuguguucuggucucccugaauggugcccacacaugauacacacucacagaaacacagauaaauuaaggaaagucuuuuugaaauuaaaaauaaaaaucacuguaaaucuguuuguaugccaugcauauagcuguguuuaaaacauagaguaggagggguuuuaaaccgcuguuauuuuguuuuguuguuuuuguggagguuccuacccccucugugaaccaguuuuauuauagcugccucuagggaccaugcccaagaacaaugaaaaaucaggccagggaaggcaggaccagugagccacuuggagggacuuuugagcuucagaguugacucccaaagacagaguugggacagaaaguuuccuaaauauguggguucaaggguuccuugaugugggcaucaccaucccuagcucccuggucaugacccaggcaugaugaagaaguucaccauccucauagcuuccagcuuccucuuccucuauucaugcuucuguggcuacgaggaaugccacuuuauucugaaaugucaccguaguauaauggcaugugccauggcugacuauguugucugaauucuucuuguguuauuuagaagccagguuccuaggaaaucugcuuuaaauucuuuuuaauugugcuuggaaaaaggcuacuacuccaguuugugagaucuggguaaugacaaugugguaauaaugaaaaccagguaauaacuaaaccuugagcucucacauccccaagaaaagaucagaagaagcacccauguugggcaauuuguguuucagaaaaagaacaaacuggcuguuccuggaacucacaaggccaucuuguugguuuuuuuuuuuuuuuuuuuuuuuuuuuuuugguuuuuguuuuguuuuguuuuucuuugucccuggccucuuacaugacucuguccagcaaugcuguccaagagggaguuaccauaacucugaaccaagacacuauuaaucguuucccauuccagucucucuucccuugugacucagcuacccuugugucuuuguucagaacucuaacauaacugagugcacauacaaaaggcccuaauuaaucugaggcaaccuauccagucaucccuaggaggcacauuagggaaagcaaggccuccugaggaaaagaaagguaaguggcuauugaugguaugaaaaacaggaagaaauaaauauaacuauaaaaauaaagagauugccaacaucuagguugcuaguacuuagaaaaaaauccucaccuuuuaaaaaaugucuuuuuugauguuauuuggguauaugucugugagcuuuuaugaguauguacacuguauguguacaggaacacacaggucaggagaaguuguuagaucccuuagaacuagaguuacaggugguagggagccaccauauugggugcgaugaauugaauucugauugucugcaacagcagaaagaguuuuuacagcugagucaucucuucagcuccacccucaccuuucuaagggcuaaaauuaguccuggguggaauagaccaugaaggagggacucacauguucaauuuucuugcuauucauuauguaguccagguagccugaaauucauggcaacccuccugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccugaguacugggaucauaggcagaguucuaccuuuccagcuuccuggggaggacucugccuaauggucugaacacacaaugaauuguuuauuuccaaagucuauguugaugucgcccagcaaguauuuguuaucuccagcaaagagcccuugaacuucugucaauaguuaauaauuaacgagacuggauuuaaagucuuuucucccuaucaaccaguuaccaaaacuuuauauugacuugacuguuauuuuauugauucuauguuaacaaaccuuuucuaggggaaaaauaagcagaaagggcaaaguauugagaaaaccuauuacuggggauuuugauucuguggaccuagaagacaacccugugaugcauuaagcagccuccaccaauaucccauccugcaggcaacaguggugcacaggguuauaggaaggacgaggugggaauuaaaaggaagacucagggugaaauugauccuucucaagaacucagugcacaaucgcuccuguggcaugggcucuccuuucuucaguagaguggacugggaaugguguguguccugugcaaucagaaauggccccuggggucccauggcugucacauuucugcacaguucucagacugagcaaagcaucagagauuguuagcacauuucccaguggaucugaaacugggcucaguaccagcaagcacacuccagagauuugucucuccuccaugcuuggcuaacagcuauucccuggugcccaggcaagaauuaaguagaguguaugccuugcacuguuacauacuguguccccaacagcuggcucauuaaugcaauuuagaaggaagagagaacuggcuguucaccaugauauguaagguauuuguaauaaaucucucaauaaggagguauaaaaauucccuguuucugggcagccaaaagaagcagaacauuaagcaggagccagugagccucauuagcaacaggauccaaugcagaagguccagggggacgcgccccacauuucuaucgguaauagcuuuucuuuuaccugaaauaugcugguaauuuucucgcuugugaaauucaguucaccuaaagauuaauaaauauacugguucuuaauauuuaacuaaaucccuuccaagcucuggaagcuacauaaaaguaaagcaucuuuuguaacugguccuucuuuugcucacuuuccugagaugcagggauagccaagucaauauagaaugauuuauucugagaagaaggaaauaguaugacaaaccauuucauauaacuuuguuauauauauauuucauaugaauauguauguguacaaguauacuuauauguauaauguaguuaucaaggucaaaaaaagggccugaggccagaggcaagagaauuucugggccuugauaggugccauccuagguucuggguucaaugagucuguaucaagguucuggccucuguuaacaaauagagaugucucacacacacacacacacacacacacacacacacacacacacuccacgcgcuuacacuacagauauguacaccacauacucuccaauauacaucaaagaaauuaaaauuuuuuaaauucauuaaaaaaaaaaaaaaaacaacaaaaccaagacucuuuauucaucuaaaauacagauucuuuacccagaauguagccacaucuguauugucccuaaccauagagccaguaugaacaccagccaaguucgccugcaccacaagaaccaaauauggcagcugacccaggauggaaagcaguaacacagugagagucaauuggucauuugccccuaagcauuuucuaauacaguuggaaacguccccauccuaaacuuuggaaccuuggugaucacacacacacacacacacacacacacacacacaccacauacacacacaucaucaucaccaucaccaucaccaucaucaucuccucagugucuaggagggcauuuccccuuucugcuguaaggcacaggguuggaaugacagcuucagaacaugucuccaugaguucacgaaggauaccaugcuaaugugggucaagucaaggcauuuuuccugucucagauuuguaugagaguaaaguaguauauacauuuacuucuuuacuuguaucgauauuaagcauaaaguggagaagugaguuugcugugucauuguggaugcuuuguucuguaccuaguccuggugccuucugguuagacacaggacaaggcuagugaguacaauugguagggcuauuuuauuuugaaauuaagaaaaaauaagauaaguguuuaagaaaaaccagauuauagagaaucaaaauuaugguuccaguuauacauaaguuagcaugagauucaauaaaccuuccuuuuuuauaucauuguauagucaaauguauucacauauuacuuauagauauauucauuuauguuuuauuuacuauauuuugaacaaauaggaaggagaagucuauuuuauuaguuccaccaaaauauuugagcugauuauaggaaacuauaaugcacuguauauuugagaaguauacaaggacuuucuguuuuguuaaauuccauuguguauucauugcucaugguacuaugugacacucagccauuuucauaccaguguguauuguacauugagccuccuuuuaccccucucucaccccucucccacauuagucuccucuguucccugauuggcuugugcuucugauucaaugucaugugagcauaugugauuuuacguguugaauuaagaucuaggaaucacaaaugagagagaauaugcugguuguguuuuagaggcugccaaaauucccuuaaugugacuuucucuagugaggcuuguguguuccugaagcugacauaaauuaauucuucuuugugguugaaagaguucuguuguggauauauaccacauguucuuuaaccaucccuccccuguuggguaccuagacuggcuccaugauggucguucuguauugcacugcaauggaugcugggcaaguguuucugugauguguugacuuagggacuuucaguaaauacccagaagugauguaguuggggcauguggguuuugcauuauuuuuagaaaacucuugcugauuuccaucaugacuauaccacacauuucugucauugguacauaaagguuccauuaugucuacauacuuaccagcauuuguuguuguuuucuuaauggcugucauucagaauagaaugagaagaaauugcgauguauuuuuaauuugcauuucucugauggcuagugagcuuauacauauuuuauguuuacuggccauuuguauucaccuuuugaaaacuguccgcccuuucauuauucugacaauccaugggcauaaaaggucauucuguuuuccagcauuuuccucaauguuucaauguuugcaauuuuuuacuauuagauccuuuacuuccuucuucagguuuaucacaagaaaauuugcuugcuugcuuugaggcuacuauaaauaguauuguuuuccuauuucucucccuggauguuugcuauucguauuaauauugucuguuaauauuguauccugccacucugcugggggaaaauaucacugucugugcugacuggucuuaugucagcuugacacauaaacuagaguuaucugaaaggaaggagcccuaguugagaaaacaucuccagaaaauguggcuguaaggcauuuucauaguuaacgagugauaggggagggccuagaccauugugggugguaccaucccuggcuaguguggugguccugaguucuacaagaaagcugacugagcaagcgagggggagcaagucaguaagcugcaccccuccauggccucugcaucagcuccugccucuagguucuugcccuguuugaguuccaguccugacuuccuuuagugauaaacagcaaugugaaaguauaagcugaauaaacccuuuccucuccaacuuuuugcuuuugggucaugguguuucauugcagcaguagaauuccuaaauaaaacacuaucaguuuaagaaguuuuucugaggaaccuucaggguaucuuacgaacaaaauuauaucaucugcagacaaggcugucuugucuauucccuaucauuuucuuucugguuauaguguccccgcuaagacugaagaaacuacauuggauaagaacgguuccccauuugacauaaugguggcugcagguugauuuaugcagucuuuacuggguuccuucuaguccuagucuucccaggcuuuucuuauaaaggaaccagauacgucuuuuuauucuuuacugagauuucugccccagcacuucugagguccgcacaagcgucccuauaugauuucacauuucacuggacugaggaacacagaugaacacccugugagaggggccuaagccuccucugcuuugccuuuguugcgauagucucuggcagccaucuuuguuuuuuuuuuuuuuuccaaagguuugaguuuauuuccuccagaauagcuucccugaaaugaaauuacuagaucaaagugcuaugaauauuuuaaagcucugauuucugagcauauuucuaaauagcuuugcaaaaaguuaguaauuuaccuuauacuagcaauaugugagaauuauaguauuacccuaggcuuaaagagccgcuaauaagaccacauuacuguuauuuguguuuauuccauucccagcaagcuagaacauuuuugcaaguacuuacauauaauguauuugugcucuuguuucucaucguuguugucgcaucaguuggauuauugucucauccuuuauugcuuuauccaggcucccaugauucauucagcuacuggguagaugaaaaguccccaguggggccugaccaaacccaagcugucauacgccuugcccggaucuccuuggugaaaaaguuaaugaagaaauggucuguaacucagaaccugaccuucagggagcagcuggaggcugggauccgcuacuuugaccuacgggugucuuccaagccuggagacacugaccaggagaucuacuucauccacgggcucuuuggcaucaagguuugggauggguugauggagauugaugccuuccucacucagcacccucaagagaucaucuuccuggauuucaaccacuucuaugccauggaugagagccaccacaaaugccugguucugcggauccaggaggccuuugggaacaagcugugcccagccugcagcguggaaagcaugacacugcggagucugugggagaaaaaguaccagguaagaggaaggagggaugcacuuccgagagcaagaacucaacucuuggcuuuccuagguugacagcugugacauaacaacccaaggcaugggagcugaacaaguagauugcuugaaguacugagcaugugcaguagaguaccuagacucugagauuuaaccguccuggugggacugggcuuaaugcuugaugucuuagcuauuuuucuguugcugugcuaaaacaucaugacuaaggcaacugaugaaagaaagcauuggauuuggcuuaugauuucaaaggguuagagucagugauggcagagcaaaggaauagaagagcuaagggcucccaucucgaugagcauucaucagagacagagacagagacagagacagcacuccgaauguuacaagucuuuugaaaccuuaauccaucaaacacuucuaccaucuuggaccuaaaacucaaauauauaagccuccaugggcugcauucaacuucccuggacuucauagauuguagacauaucauaaugcaaaguccauuugacccaaauucaaaagguccuauagucuuucacagucucaaaccuguuuaaaagucugaagucucaucugagacucaaggcagucucuuagcuguaacccauauaaaaacaaaagcccaaagcaaaugacauacguucaacaugcaaugguacagaauauacauuaccauuuuuaaagggaagaaagaggacauggugaagaaaugcuagaccaaagccagacugaaacccagaagagcaaacuccaaauccuuuuccuucaugauuagugucaaaggacuuccaugguuuuguccugucuacaaaauacuucuuucuugagcuuguuccacugcuuauauguagcucgcuuugucagaaaucucaugacucugccaccucuaacuucuucaacacacucuuggguuaacuuucacagcuucaugcaguggucucuuggagccuugagccuggcuucaguuucuccccuuaacuauggagaaagauuccauaacccuccauucccauagccuucguggcuuaaaguccaaacaacaugaaugagacugccaagugugacuaccagcuuggcacccagaaaucacacuugucgaagaagcuuugauuuguucuugcuuguuucaagcaggagauuccauuuuagaacuugaaagcuuaucuggguggagucuugcccugaggccacuccucccuuuauucuauuuaagaccaaguuucucuuuaaucuucucaagucuuucagaacaaaucuuggcaccaccauuacauuuggugcccccuuuccucuuuaaaauguacaguuuguauuucuuuuuguccugcuugcucauugcaaauguagaccugugugauuaccacaggauagggacaauauuaaaaguuuucuugaaaucuccucggccaaagaaauuagucuaaaacucugugauuuagccuuaggaaaauucauaggacaaggacaaaaagcagcugcauuccuugccaaaauauggucucuagccccauuguuaauauuauuccccucugaccuggacugguccaugaacuggaccuuuauagucuaucuugaucucagcaucuacuaggaaugcccacuaagcccucuuccuagugcucuacauuuuucucagccugaaaucccaaauucuuccccauuccuccaaaucccagcacagucaggcucgccacaguaauuccucacuuccggugccagugucugucuuugcuauauuucuauugcuaugauaaaaggucaggaccaaagcaacuuauaaaaaaaaaguguuugauuuggcuuaugguuucagagaguccaugaugguggaacaaagccacagaggcaagaguuagcagagggcucacaaagcagauccucaacagugaggcagagagagagagagagagagagagagagagagagagagagagagagagagagagagagagagagaaaacacuaggaauugcacaugcuuuuugaaaccucaaaucccacccucaguaacgaaccuucuccaccaaguccacacuuucuaauccuuuccaaaucuuuccaaccaagcggggaccaaauauucaaauagaugagcuaagggggacauucucauucagacugccacacuaccaaauacuuaaaguuugccugcagucuaucugacaucuaaauuaacuuuuaaugggguggccgaugucugcgcaaggcaaaguugugaaauaagccaauuguucaguagaucauuauucugucuuaucuaaggucugcuuaaugcccucuauccacgcucuucuccuaguaaggauaaaccuccaaaccugaggcgcaugcucagcaaaaacacaggccuuaaaugccaaggcgugcugguagcaaaugagagcuuugagaaaggacagccucugacuucaacuuaauccaagaaaaacaaaaaggguacauuuauucagaguuguuccuaccccauuaaguacauugagaaaaaugucuuuaaaaaauguccuuacacaugcaaggcaaacagcucucccacuguuccacaucccuggcccuaagaaaaacuuacuaaaguaguauuuucagggaccagagcggugucuaagcaguuaaaagcacuugcuuuacaaugauaaugauagauguucuggucccagcaucaacaaaacaagugaaauguccccuacaagugaccauaacuucaggucuguguggggguguagacaggugggucacuggacacuuccagauuagcgaagaaauugugagccucgaguucagagagagacugccucaaaugaauagaugaagagaaauaguggacgcugguguucucaucuggccucagugugcauucaaggcucacauguacuuacacucauaggugugcaugcauaugcacacacacacacacacacacacacacacacauacguacuuacacucauaggugugcaugcauaugcacacacacacacacacacacacacacaaacaaauaaauaaauaauaaaaaauuaaaaacaaacauuuaacucuaggaggaacuucauguuuaaaaggagcucaguuauuuaucuuaaaauauuuguugaguaccaaguauaagugauauuuucucaaguauguaucacaucucuucucccacaccuaaguauaauacuggucagacucacaggucuaauuuaguuuaaucuacuuaguuauuuguugugggggucaugcuuuauuauagcccaggcuugccuggaacucuuuaaaugccaacucaguuuuacuaagccaccagaaucagaugaacuguuugaucuucucaacaacacuaggagauaggcauuugauauugcccccuccccccacuuugcagaugggaaaauugaggaauggagauacugcagcagcuugccaagaaagcccugugagugagagugugcgucaggguucccucauuggcuaguuucucucuaguauucccauaggccuugaugacugucacaacugccuuccuguguucugaaauaaaaacacuuucauuucacuaagaauauucaaagacugaucauaagugugacacuguuccagcauggggccauugacucauggcucuccuugagugcuccugugucagcuguuaaagagacauuaguuggggauacuuuauuuucaacaggccucauuguucccauugagaaaaggggacggcauuugaaugaggggguaagguaagguuaaauaugaggucaguaacauuguguaauuugguacacagguaaaauucugcaugguugacagauugcacaaaaaaaacaaaaaaaaaacaggcagaucccuggaagucauuggccacccagucuggcuaaauagaacuuuagauucaccaagagacuguaucucaaaaaguaaugguucugggaacagaagaggauccagaaaguuaaggaacuugcugccaaccaagugacaaccacaacaacaugaauucgagccucaggacccacugggaggaaauagagaauugaacccaggugcuguucucugaccucuacuuaaaaggaggugggaagcuaugaagggaagauacccaaggucaaccucgagcuagccuccacacaugugcacaggggcgcaccugcaccuacaugcacauaugaacacacccucacuaacaaguacacauacacacaacacacacacucauauacacacacaugcuuacacacccacaugcacaggcuaauuuagcagcagcguuauccacuauagauaguccuaugguuauggaggaaagagacuggaaugauauauugaaaagagaaaguauccccaacuuaaugucacuuuaagagcuggaacaggagcacucaaggagagccaccagucauugccccaugcuggggcagugucacacuugugaucaggcuuugaauauucauuaugugaugaguugccgugaaaucuccccaaccccucguacccucucccccaguguuuuauuacuggaauuuaguaucaggaaguacucuaccaccagucacauuucauuuacucaccauguaauuauaucacagcucacagauuauagaugcauacccuagagacaaggcuuaaaggguacaauaaauuggaggauuuagccuacaguuuggaaauauuugagaucuaaaugagaaaguaggaaaucuauaacccaccaggccaugguggcacauaacucuccccccuuuuauuuauuuauuuauuuauucccuauacauacauaucacacaccuccucaccucccagucccacccucacacagccccucccccaucccucacugcccuucaucucugagaagggugagguccccuuuggguaccaacacaaacugagaucucaagucauuacaggacuaggucaauuuucgcccacugaagucaacuaagacagcccaguuagaacaacaggaaccacagauacacaucuuuagucccaggacucaggagaaagaaguaggcaagucucuuaaguuuaaggucaucuugguucaaccccucgaacccauaguagaaguugagaaccaacuccugaaaguuauauucuuauguccacgccccugcaaacaacaagaagaagaauuaauagaaauaauauaucaacauaauguaauaaucaacaacacgauuaguaugcaaucguaagauaagaucaagccugguguccuacaugguaugaagaaaggaguuuuauaauccauugagaaguggagcacaccaugagcuggcaccccagagaccccaguaaaggaaccaucacaguaugaagagaucgccugagggacuguucuuaaaagaaaugggauuuuuuucaucuuagugucaagaggaaaacugaacaugaacugcugaacuggacuggagauauuucagggcaaaguggcacaaggggauggggaaggagaugcucuacacaggcugggugagagucucuacaccuguguuuuauaagcagagauuccccaauaacccucagaucagacucuccaagaagaccaagggggaaagaacagaaagcgccucucgugugauauguacucauuacacauuuucugaggcagaauaaaguugaguacugcccucuaguguguggacgcacagccuggaggcaggugucuuggguaccaccugcuaagccugucacaggguugcugggcuuccugcccaccccacccccagcuccccaaccuugcugcccagggcagcucucuuucgggcuucacccuuccaaccuaaccaguuucagugccagcaggaagucuuugggucuccccagcaaucugcuuacagugagccugugauuaaccucauuaacgccuguguuuaccaccgucaccaucagagcucagcauuacucagaaccccuaagaaccaggaggguagacauuacuccauuggcagccccugccucugggcauucaccaggucuggcgccuucaucaucaccugaacacacuggaaauggaaugaacauauagaaucccacccccauccugagugccugaaagguuacucagaagauuacaguccacaugguaaaugugagccaggcauuccucucggaagaguucacccgugccccuaaggggaaaacuacagcucuccuagaaaaccacacaacagagcucagaacuggggcaaccagaauagcaauccucuggcccccagcugccucccagaaacuaauuaaugcuguggcuauagcuugcuaauuauuuucagaauuacuggccccacuggaggcucguggccuuuaccaggucuucccugguacugguggcacauugcuccccucuccugggauggguaacucuuucaucagagucagugcauacaauugaaaaaucuauucacucucaaauaaguucucacuguuuaucuaaacuccgagagcuauggcuacuccaagugucaaugucaugagcacuggaaacaugauuucugaaccagacuggauucagccugauacucugagacuucccagggacugugugaggacagaauguaaugaggcugugucugguugguuaaaaaaaaauaaccacaauuaaaaacuacaucucuucaacucaccuugaauaagcaccagucauauacacugccaguaggaucuuguuucugcaggguugacccugccugucaaguuuccucaaggauguagccuggucacguucucugcagauugccuuaaaauauguucaugcuucucacuaacuccuaguuaauggagcuuauuagacccuaucaaaaucauuuaauguauuuaucauaaggcuucuacauuaauuucuuacaaauauguucguuauccaaauaggcauaguccuuuauuucuuaucaguuuccuuuauaaucuuguccauuuugugcauuuauuaaagaaauaucugugagaaguuggucaauggccuuaucaugugcaugaccaacaagguaauacccucugagugagacagcaaguucucaguaacucuuuguuucuuuacuuuuuaaaaauaauauauagggccaaggagguggcucaguggguaaggcacacuaccauaaccuaggucccauuugcuugaaggugagaacuaacuccccaaaagcuguguucugacuacuacgcauguucugcaacaguuuguguaccacugcaucucucugccauuguacuaaauaaauaaauaaauaaauaaauaaauacaugugauaaaaaaaaacauuaucuaggcaaaacacaguucucaccucaaagagaauaagaaauaguuuguuauugagccaaauaggaaugggaugggaacagagacucagguugccuggaacaacuuauguauuugauuagccaagaaacuaaagaaagcccuaagacaagacauuucuuaacauuaguagagaccacaaguaggcaggguauagcaagagaagucauuacagguuuaggaugcagccuauggacauuucuguucuuggaagcuggugaucugcucugaauacaugacaaaggcuuuaaccugauaguuaaaaggaugucaggucaggcacaggugugaacaaugaauggcuauugaaaggagcaaggcuagccuaagauaguuugacuguagacuccaaccuucuuacguuccacagucaugaaguucuaaucugucguuuagccauguaaaaccuugcacagagauaaggcuccccgacacacacacacacacacacacacacacacaccucccaguuuuugugaacaauucugcuacuucugagcauguuuguccaccucucucucucacuguucaacuacucagcuuuuaaaugcuucuguccuuuuucugcucugaacauuuuagguucucauuuucuaccacugucccuucuacaagcaauacccauuccuguggccagggaagaagauuccggcacccugggcaaacaccacgagugugcagaaacugauccucuucuuggagaccacccugagugagcgagcuccacguggggccuuccaugucucccaggccauccucacgccaagagugaagacuauugcucgaggccugguggggggccucaagaacacacuaguucacagguaagagguggcuccuaccccacggguaggguuugucuuauuguuucauugguggugguagcugguugauuguuugguuugguuugguugauugguugggugguugaguugauugguugauuaguugacauuuuuguacaguuucgacuggccuugaacucacaaucuuccugucuuugcuucccugauacuggacuuacaggcuuacauacuuagugcuaucccccagaagaaguuucacacauacaaacucccucucccucucccccucucccucuccuccucccuccucucccuccuccucuucuuuuucuccuccuccuccucuucuucuucuuccuccuccuccucuuccucucacccccucucucucccucucccccccccuuaggcuguggagauagcuccauuaguaaacuucucuuacaagcaugaagaucugauuucuagaacccuugcaaaaacaauucagagcacagugagcccacgugaucccagaaaccaacaaguagagaaguagagacagcugggugccugaggcuaacugucugacaaaccuaacuuaauuggcaaguuccaggccagcaagagacucucuaaaaccaaauggauuauaucuaaagaaugagagccaugguugucuucuggccucccacacaaguacauacacauguaccuacacacaacuauaucugcacacacaucucacacacacacacacacacacacacacacaaacauuuaaauugauuuuauucugaauaaacaacaguaaaacuuugagaauuacaaaaacauaaaacacaccauuuuguaaagcuguggauucuagggguaguauaggaauagcacucuaagaauccuuugauacuuuauuaaaauguuugcacuauuccauaaauauucacuauauuuugauacuaugacaaguacucugagccaaugucacccaguggcuuuuuuuguuguuguugacacacacccauggugauccucuuacugcccacacagcugacugggauaaucacuguuaaaaagcacuaaauaaaguuugucaugcuucaugcuagggacggugggaugguccuccaggaguuuguucuuucuucuuucaugaccaugauugagucuugaguaccaugccacagccucaaauacuugggcuaggauuaggucugauauacguauaaacgaggaugauccaguuauuuuguaugagaugauauucuucguccugggcaccagugaaugauggauagaggauggcaagaaagcauauuacauguauaugaacauuuggguauauauguagauuguuuauguguauaaguguguauguguauacauauuuguacauguauguguauaauguauauguguauauauguauaugacaaauauguauguagagggauauuauaaauucacuuuucaguaggcuauccuuuguaaaacaaguugaagagacauguauuuagguuuuuuaaaaaagauauuuacaaguaucuguuuaguucuugaguucuagguagugacuagaauuugaauaaugaaagguguguuuagucacaucacauguccaguuacaugcccagucauaugcccaguccgucagucacaugaccauuuacaugacagucacaugaccagucaguuacaugcccagucagucauccacaugcccagucagucacaugcccagucacaugacagucacaugcccagucacacgacagucacaugcccagucacaugaccagucugucacaugucuagucaguuacaugcccagucacaugccuagucacacucauuugguucugaguuugagaaacaugguuucauauaauagccaugugcuuagucagguguuuuaaaggcaagcaagaacaguguucuugcuuugugcugagaacuccugauaaugucaaccauggacugaagaugggcucauuuccacgcagcccuucaaagucuuaacgaaauuaacuguguucagcuggccauggugcugcacaccugcaauccccagcaguuggaaggcugaggcaagggauugugaguucaaagccaggagaagcuaugacuaggcuagaugcuaacacucuuugggaacaaggguaugguagagugaaacccugucuguagcccaggcuggccucaaacugacugcuugcaguccuccugacucagucuucaagaguguugggauucuaagugugagcuaacaagcgaaccaaaugaaaucaaaucaaaucaaacaaucaaccuuaauucagugugauaucucuuaaaaggaccuagaauuaugcguuuuuuuaaaaauauauguucaaguuccuauuccauuuucuucauucuuuguagcuuaauguuacuuacucauucaguaaaagugaaguuuucuguauguucagaaaaacagaaagaguaccugggaagaggcagauggagagacacagaggacuccuguagccuuugccccauagucuuuuagcaaaaucuaacaugaacauuucuauaccugagugaagaccaguccacugcaagucugugugggccgccaaagaggcuauuucacacgaaggauagguccuuuauucugaauaaaaggcacccuuuugcaaaugcuuuuauuugauucuuaaauccgggccaguguuuugacguggagaaggggcaugccauguaaggccccuuguggguccuaauauacgacaguauucagggaagcuaaaugauccagcaucacagauuacaacuaagauuacagccccugugagagccaagagccugucaggucugccgggcuuccgucuguguagugcugggcacugcugugagcagaaagaaugucuaagcuuaauuuccuaguguuucuaggcccccgugauugaguuaguagucccuggaucuagucaguucacacuaguuacagcugguaauccacacucucacuagucucauguccugcuuucuuagucuugcugccaaugaaugaugccucucuguuuaauggucaagaagaugagcgcaaaggcaaugucucccagcugguagugagaaugugucccucaaaugaguagcucucuuggcauccucacuguuucuggucaugggaauauuaggagugugauccuacauuccugugccuacacaucaguggagcaggaacguggcugugguuaggagucuguucccaagugccagcaaaucacaugacugucauuucacaacugaauaaucgugggcucucccccugagcaccagcgcccugaaggcugucuguacuggcuaacugaacagggaugcuacauagcugauuccgagcacugaucaacagcucaaagccagggaagauccagugugucuuccuacuggggaccagguaguuuccuugguaggaagcuaauucccaacuuucagauccacuuggaacaugagagucucuuguucacguugguucaucacccuggaagaaagccacaaacauauauagacaauucagccuggauuucuguuguagcuuuccucagacuggaaaacaccugauccaaaaggcucgcagugagucagaaugcagucaggaggccuggaguugaaaccuguagggucccuacuaaugucauugaauuauguccccucucuucaaauuaaccaguuuuaaaauaauaauauuaaaauaauaauucaaccagguuuaguggugcauaccuuuagaccuagcacuccaguggcagaggcagacagaucuuugcgaguucaaggccacccagagcuauguacugagccccucccucaaguuaaggugaguacauuuagagacauugcauuuuaaagagagaauuaaguuaaaaggcuauuacgguggguucuaaucuacucacauugaaguccaaaggaaacuuaaacccagagacaauagaagagaagcaagacaguguaagccugcaaucccagcauccaugcagaggaggggacagucaaggucaucuuugaaaauguaauaagaucuccaaaagcacgcaaaaggcaagagacuacaggaauaugugugugcauacagagaaaaugacacauagguugcugaggggagggcaugaggaggaggaaaucuccugcaauagagaauaagggcuucagaaaaaacccagcccaauagcaucucaaccuugacuuguagccucuagaacaggggaaaauaacuccaguucuuugaagucaacaguguauaugcuguuaugacagaguaagugagcuaacacaguccucuggacaaucgggugucccugcacauguccuugaggucucugagaugagcuuuucuucaccacuuaaucuggaaaguauggauuuauagucugcaaagggucggggcugccucuaccuggcaaguaucauucccccagaaugaccagcagguggcgcaggaucuccaaacauagguucuggccagggauccuuugaauccuaaauguuacaagcucacuacuacugugucuuucacgugggacggaugggaaauuuuggccuuugucugagaguucuguguucuucaaccccgcuucccaacuucacaacuucguuguguggauauauaagagguuuccuaucccuacucccccaaauguuucucuuucgaccucuuuacucuuuccuuuaugauaccuuuccuuugccaaauacacgacacugcucuaagcagccauugcucugaacacuuuccauauacuaucuuucugauugauccuguuucacagggaagaguagcugacagacaaggaauuguagucaguuaagaucaucaagcgucccaacuaaaaguagaaggacuuuuguaccacaaccagcuaauacaauuuuuuucuaaaaaagugauuugaucaauaagacuauuucaacucauggcagugaagucucugcugacugagagaagagcugaggucuuaacaucacuuuuucuagaagacuacgaaaugaggguacaucaagcuucaguggaggauagaaauggggugcggggagagccagagaguaacagaagagagggacggaccauggauguuagcuagagcaaauccaacccaagggauuccuagacgugcaauaaucaacuguaggccaguuucuaccuuccuuugcuggguauuucgugagcuguguuuacuguuacaagauagccaguagccuugaugguucuucucuuccucuguggcuccucacacguaggucacacuggaaugaaaguguuauuuacaucaugagcucugagccucugacacaccggaagucuucuguuuaucaaauaaccccagcaacuguauucaagagacagcugauuaaauauuaaucuacuaaagagccaugagcaguacgaggauaacuaucucuguggaaagugaacccuggccuuuuguaaaaaaaauuaacugguaguuuuuaaaaaguaagauaaaggugaauccgcugaagcuuucagaaggaacuguggaaggaaggaaaucuuugugaauuggaagugaauguguuucuuaagcaaaucacagaaauuuaaaaaaaaaaaaugaugggggauuggagggauggcgggaguuacgagcacucacuggagagguggcuaagccgaagacacaaguucagcucucagccuauaacuucagcuccaggggauccaacucccucuucuagauucugugaacaccucugcacacacaugcacauaccaccaugaggucacacacacacacacacacaugcauacauacacauguacaugcccccauaaggacauagccacauaaauaaaucuuuuuaaagaaaaaagauaacaaauugcacuccaucaaaauuaagaaauccaggcuuaucaaaauauuuuguugagaaaaauacaagguaaaagaaaugucugccaaauauaucugacaaaaggcuaguaucccagauguaaaaauguuucuaaaacuuaacauuuaaaagaagaaagaaggaauaauaucaagccauauugugugaaacucucagagaacaaauacaaaacuggaaaauaauaaaaaaugauuaaaaaguagguggaagaauuguuaaagugaugaauacauggauacuugcaagaaaagggcacacaaauccagucuguauucccagcaauccuucugcuucaaucuuccauaggcuaggaucacagacaugcaugaguggccacacuuauuuuagaaugacuagauuucacaacaguaaugggaccaauuuuuagggagaacuuuaacgguccggagcuuuccuguucuguuguugcaacuguaaagugggguggcccccucgaggaaagcucuggcaguuucuuauaaaacuaaauauaaauaaacccuugauuuuuauccaaguaaaauaaaagaugaugcccauaaaaaagacucauaaaagaaugcccauaauaguuuauucauaaugacugcgaauuaaaaacagucugugugccuaucaauaggaaaauggauagguuguguuguauucauacagaacgacggugaugugcugauagauacguggcaagcaaaauaguaaaauagcaagagauaggggcggguccauuuacuguaaaaccucauucaauuugccaucuguuugaauuuuuuuaugaggaacccuaagaaccuaacaauagaggacugauggacucuguguuacgagguccuuccuguuaauguggcuguccauuugaugcuagaagcagauagucauuugcauaacagaaaccuuggagagguuaguucugguggaagccugaucaguaugcauggagauauaaggcuuauguguuucugacacacauugugucgugacagaagcggcucaugcccuuugcugcucuugucacuuuaacccuaacuaucuguuuauccucuuuucaccuaacccuuucuccauguaggaaucucccugccauccuugauugggugaagacucaaaagccuggcgccaugggugucaacaucaucacaucugacuucguggaccugauagacuuugccacgacugugauugaguugaacgaccuccuagaggaucgagcucugacuaaguguugaauucaugcuuuguuuaauuugagguugagguuguugauauaagguaggauucuagaggguucuaggaaagaugacucacuuguaggcagucacggggaagugaggaaggaaaagaaggcccucucuuuccucacauagcuacuuggacuuaaaaaaaaaucuaagggguuuccaugcauuuucccccaaagacacuuuuacaaacuuaagucuaagagaagaaugcauguuuccuaugguuaacaucaggaucuccccaguggcuugugguggcaaauggaagauggaagcauccuuuucagguucugugggcuaugcaacauccuaacuggcccagcuuccucuugucuucuguggucauuugagccugugugaagacuaagucagaaaggcauuccuggucagaagaauggcacaugugagcguggaccauccugagagcucucugccaucaacccagagcucuaaggggcuccuauggagccaagaaccaggucucucaugaacuguacaguaucaccacuuucuacgagagcaagauauguuuauuaucacagugcucagccacaggcuggcucugcauaucuugggcuagaagugggcaccuuuauucuucauauaagcagugcacccuacccuuggcaucagaaaaaguauuuucuuauuuuaauguauuuugggcccuaucuuuaaaaugauagggacaguaguuggaaagucuuuucugugagggcccaauacagacuaaacaugcauguugguugcaugccagaguucuuugauuucguucuguauccuucuccccaaacgacuaucaggcaaguaccuggaucauuuuggccaaguccucuggagugaggucuucaagccugagagcagaauccugucuuauugauuaucugucugggaccuggucugcugcacgacacaaugcuugucuaugacaccauggaggaggcugacacaggaugcgugggaacgugcaauggaauugaaggacgaugguccaaguggguuuggagccagucuguaacuccuugcaaacaagacuaccucggggacauuuagcaugacucguaugucauccagugagggaaaaaaaaagcaaugcuggacauuucugcuuguuuuuccauuuagucuacuuccugugaguuguucagccaacugccuuugcaugagggcuuggagacacaaggggaacuuuuuuuuuuaauugauaagaggugcuuuuuauugauaagagcccucuuuuguuucauuugcuuuguuugaguauuuauuaauuuauuuauucauagaguaaggaucugcaguguucccugccugaagaacacucacagauguuugcuggacuuuuccuacccaggaugcugcuguggucauccacucaugcacugcauggcgcaucucaggggcugugagugaccucguaacuuugcuguaggugcccuaccgcaaccccaguccugcuggggacaauguauagguguggaugugauccagauauaggaagcuacugccaaaggcaugcacagggacagaagugaaagggucaugagaaacuauacuacacaggcguauagagcauugggaagaguagaacuaggaauaauggcugagcauacacgugagugugcuuugcuaaccuucagcccuauuugagaaucccuaaggagugucagauuccacauuccuaaggaggaauauaaacaggcagggcugggugggcaugcauauuuacagagauugcuggaccuucuaguacuucucacgucucucccuuugauugccuugucaguugugcaugcugccugccgguggggauaucuugggugagcuauugaaaacaugcaugccccgaauggcugaccaucugaccuuucuuucccuaauguaauuuaggccuugacuuuuuacuuccauaguucacggaggccacagcacaaaggccucugagaaaaccugauuuggcuucuccuguucuugaguuugaauccugcccagagguggcuucuggaauguucuugucaaacuuggcagagccuuucugcacagggcuuccucauuguguaggagugcauacccucaccaucuucauuucccuuccguugugaugcucuacagagaggcucccaaaaccuuagccuacccucagguuuuuauuuuuguuuuuuuauuguugcauucuuuuuugguuuugguuuuaacuaucaguuaguuacaagggacuagaucacucccuucuguuaacccuuuguuacuuggcaaagagauaaggaggcaacaggagaggcauucugcucuguuuuauuugcgccucagcuuuguccgggugcuuggugcuauggagccuggugugucagcaccaaauggauaccaguuucacuuuaaggcugcagacuguucugugaacuguuuacuucguuuucucccuuugcucuuaaauacacaguuguauuucacuucugacauuuaaguacaccucaguguuugcauccugcaccaucaagucuaacacagaagcacagagcacuuccaaggccacguguaugggccccuucucccacagugaguacaugaauguauaucaccggcucauccaugcugcguuagggucccagccucgcuguuauucugaacaucugagagguagggagaggauuauucacaguuccucccagggauuacucaacucugccccaagaacaggcuuccaauguuggaaaagcugcaugcauugaagcugugccuugaagaccaggcagaaacuuaagugaauuggacagagaaaaaguagaacaugggccccagagcucauucugccauaguuuucaagugagagcucugacccaaauauaucacauguucucuaauaucgggggagucauucagauuuuaaaaaaagguucucauaguuauucagaaucaacuucaagagcagcuaaaaugcugcuugauuaacuuaguugggguucauuccuguuuggaaauuuaacuggguucuuccugaacucuacaccauuccaacacagccauauuuucuuaauggcccagaccuagaugccccuaggucucuguggcuuagaauggugucucagggcuugaauacugaguuuaucagaaguuccaaguauguuauggauggagacaauuuucuucggauugaauggagaagucaggauggaugugauggaagagauuggugaguguuuaaggauuuggucugagaucauggcagaucuuagaagucaugcaaaaaaaauacuuauauuugcugcauaagauuugauagugauuguuuucucuagugcuggguccagacccugaauuuuuuagaacuguuaaucuagaguuuagaguucaaauccaauauuuuauaugcaugcaaagaaaagcacaugaccugaggagagauaaugacagaccuuaagaauccuggauauuuuuuuauagucucauguucaugucuggaaauucaugcuucuauuuaggaaggcaaugaaaugaagcauucugagaugaaaugaagcuuucugaugugucuggauauuugcauuuuuuccaguuguuaggguuagggucaagggucagggguuaggguuguggucaguggucagagguuaggaggcaucuccaaagagacauaauacacauaagcacaaaguguaagguggagacccagaagaaauccaggcugaaaggaaacugcuguuuccucugagaagcaaaaggacugcaugcugacaucauuuuuaugauguccuugauuguuuguuauguucugggaaacagaacugacuaaugaaugagccacggucacgagaucucccuuaacugagcaacugguccugggcuaagcugucauugguucuuccaucuuuaauaaugacacaaaucucagguggcugauucauaaauuacgagguccuagagcucagccugaaugccuugugcucuagggaugcacccuuagcaugauucucccuuuugugcacaugugcagagaauaugguuagagucaugcaagaauguggugcaggccgauggaguucaacgauguguuguacguuucaggguggacauaauguguggggcucaaugaaaucugccaaaauguacaugggccccugggaggcagguuuucucuagaggaaacaguagacauugagaguaucaaacauccaagcugacaggaaucucauuuggugcagcauagaagagcauagauguccuugucaauuucauuaccugucuagcgaaucuuaacccucuaccacagcugcuuccuuguaggugauuccacaguuucauuucucaguagugucaccuuaggacacagggagaguggacugauugaauagcaaguggugucaguauaaacuucuccucaauuccagaagguucuaaucagcuugugacugccccaagagaccuccuacguccacagccuuuggauuccccagcuuccugcugcacacacugacacuaacggccaugucucuugagcuagccuaacuccgaagcaacccuacaaugaugcuauugauucuuccuuuaaaaaaaaaaaaaggaaaaaaaaaacuaugucuuagacaguguaaaaauauucuaaauuuuaucaaacucauuuuaaaacaaaaugguucgaauaagacaauucucucuucucuuugggcgaaauucggaagcacauuuguugaggcaacugcaucagucgacucgaggcaguuucccaucguccuuccucauucccuucauagaaagcuacuuuucccccucuugucacuagcaucuccaucaucugccaaugaccgcgucacaagaugcugacagagacucugcucuguccauguuggugguugcucuuuagccuucuccaaugcacuauucugccuccugaucccacccagucauuagaacuaugcuuaauuagagcccugaaauugggaccaauguucaauucauauagcacaggcuugcucacaguguuaagcccacuaagaagcauaacacuuugaaaagucauauaggccuuuggcaacucuguauaguugcaaugucacaccuguuaucgguuuauagcacuaauaauaugucaaagauagaucuauaguaucaagaugauaacucuuagaucauguucuagaaauaauaauaccuugcugcuauuauuaccccaguaugaauaaguauuaaaugcagauuguauaugcauuauuuguauuauguacauaccaacuguaauacuuagccucccugaucaguaauuuaaaauuacagaaauugucauaguaaaaaucagucuuggucaguucagauaauuugugcaucugauaaaugcuguaauggagauuauauuuugucuucuauucauugauuuacacuacgaugcaugugguuugcuaaacuuaagaaauaauaaucaauuuuuaccaauuuuaagguuagagauaaaauugugcauauaugcuacuugacacucugagauguaucuuguggccugauugucaaugucauauacacuucaccugccuucuuucccucuaggaaguaguuguugaauugcaucucuucuuucuugaaaccuggauuaaaucacuugauucauccuaaacuauugugaagccacaguaccucauuuuaacugugaaaaaaaaaaguguuaauagauuugaccauaugauguguuuccuuguguuugacuugagccaguuaaaaagguuuaaaccuaguaauaaacaugaaucuuuaauagcc

SEQ ID NO: 8261 - RNA, 455 nt, Mus musculus
uagagaggaagcucaacuuuguuucaggggugaggggaauauagaggaagagggcagcagcugggggcaggggguguugcuugauaggugugcacaguaugcuucauuugcauuaagcggcacaagccuauccucacaauggaagcacagcacuuaauuaucauaaggucagcaggcagaggguguagguaacugugucgaaggucacacuuaagauuagccaggcacaguuauucaucuucgaaguaaagucaggcagagaauaggaagccccacugggugaaggaaguccuccauuuugcucagagcuuggagagcugcuuugguugauugaggcaugcuccguagacccaguagaaaauucuacaggccacauucccagagacaggugccugacaccacagagcccccaacuucauaauuaugugacuaucaagucaggcagacaaagcccc

SEQ ID NO: 8262 - RNA, 15848 nt, Mus musculus
ucauaacuuuaccucuuaacgccaggcauccaucugcuagggcaucuucaggucagugcuuccccacuggccaggcagaaaugauuccagagucaucuagaaaccaucagacaggacuugugaaaacagaagucuagaaccaacuguuuccagcucgcuuugaucccaauacucggaaggcagaggaaggaagaucucugugaguuccaaguuagccuuaucugaacucaaaaaaaaaaaaaaaaaaaaaaaaaaaaaaaaaaaauucaagcuuagacugccagcagucagaaaccagacaaacagcagacauucuucaguugucucaagguaugcauggaauguuccuaaauggcuggugcugaccuaagaggaaacuaucugucuaucuguccuuuugcccaaggcauccagacuuguaagggagaaccuaacagcugcuauauuuggggagucaaguuacucccccgaaaaccaucuuugccuauuagaaaaaugguuaucaggaaugcuuacuaaugcaaauuuauuuuauuuauuuuuuuaaagauuuauuuauauauauguaaguacacuauagcuagcuaucuucagacacaccagaagagggcaucagaucucauuacagauaacuaugagccaccaugugguugcugggauuugaacucuggaagagcagucaguguucuuaacugcugagucaucucuccagcccacuaaugcaaauuuaaagaacuaaugauaaacacuaaaaauagugaaauuuaggcaaaucuuaacagugcuuaaccccucaagugcuuuggaaacaguggugugcaccaucucuaccagugggcuauaucccuagccuaaucuaugugguuguuguuacuuugaaauaggcucaaauaggcuuggguuauauuuggcccaagcugauguggaacuuggauucauagcugaguacgacuuugaacuucauacuuugaccugcccagcacugagauagcaggugucugucacuacaagcugccccccagcacaccugcuuugcaaggugauggggauugaagccagacccucaugcaugcuaaggcaagcaccaggugagcuacagugccagaaccaaccuagaaauucuuaacaccaaaauucagcuacuucaaggagacaugaauucaucuuucuauucuagucuguuuaacaaacuguucucuuucauaggaaacauccugaggaaaagcuccaaauacagaaagaaagaaaaaagagcucauggcucauuucccucccucccucccuuccuccuuuuaucucuuuucuuuucuucucuucucuucucuucucuucucuucucuucucuucucuucucuuuuccuucuuccuuccuuccuuccuuucuuuucuuccuuccuuucuuucuuucuuuuuucuuuucuuucuggugcuggggauccaacuuggugccuuauguaugcuagguaugcauuguaccacugaagaacauaaccaggccaagaacucaauguauucuuucuuugagacaggucucacuaugucaucuugggugaccuuauagaccaggcucgccuugagcucucagagauucaucugccucugccuccagagugcugggauuaaaggucugugucaccacuauauccugcuauauuuauuuuuaaauacguaauuuuuauuugugugugugugugucugucugucugucugucugucugucuuucuguuggucugucuguguagugugugcauaagcuggcucucauggaggcuagagguguuagauccucaggagcuagagucacacguagaugaucaugacccacccaacaagagugcuaggaauccaaauuugguaugcuuucaaccaccagggcaucccuguagaccucagaaaucaaguuuaaaaauuauguuuuuagccuugcaugguagauuuuaauauaauaaagagagucuuuaauccugcccuugggaugcagaggauggcaaggguacauagaaagacccuguuauauuugggggagaaaaaguuauguuuuuaguuuguuuguuugguuuuguuugaagcaucucacuauguagaccaggcuggccuugaacuuagagagauccaccugccucuaccucugccuccugagugcugggaucaacgguguaugcccucaccaccugacucuguuaugguuaaggguuuuaauuuuuuauuuuuuuauauuuuagacagacuugaauguaguaguugucuacagaucuucuucauacccccuuaguugguuaauucugcccccaccuucuucuccauccuugcuuagagcuccuugcagcuaacacugcuucccuucacuuccagaucaaggguguuaugcuguguccucugcaccuucaggccuuuugccucaucucucucauaugaacccacucccaagugcauccugggaaagcagccuacuaauaagucgcaacucuagcgccuccauucccacuuuuauuauaucauuguugcugggaaccaaacucaaaacuuggugugcgcuuggcaagcauucuaccagcccuccauucccaaccccaaaucuuacccuuuuugaggggugggaaaggagaccagagguguuuaggaggguuucucauguaacccuggcugcuguaaacuauacagaccauucuggccuugaacuuguugcugcuugcaaccugugucuuccaagugcugugauuaaaggcuugagcugccccaccuaguuuaaaugggcucuuguuaccugggagugggucuuaccuuuaaucccagcuguacugagaaaggcaggaagaacugugugaauuuuaggccagucugguguacauaucaagugccaggccagucggggcuacacagugagaccuguuccccccaccaccaccaaaaagaaagaaaacaagaaaacuuuuuuuuauuuuuauuuauuuuuuauuuuucuguuuuacuuaaccagucuugaacaacaguugugcaagagaguccucuagucccacaucuugucaaucauuucuuucuauauuugcccuuuuucuucuccaaguuggcuggcuugccuucccaggaaaguuuugcugcugcugcuguuguuguuuguuuguguuuguuuuuguccuuguuagucuguugauauuuacccaggguguuggauucccugggacuugaugccaggugagugcuaagauucgacccugaguccugugagugcugagauucgaacuccaguccuugacaugaguacuuguaaccaccuagucaucucuccagccccucagccaggcaaaacaacuaagaucucagggugacccaccuagcaaacugagcagacacaggccaggcgugguggcacgugccuuuaaucccagcacucaggaggcagaggcagguggauuucugaguucgaggccagccuggacuacaaagugaguuccaggauagccagagcuauacagagaaacccugucgaaacccugucucgaaaaacaaacaaacaaaaaaacccaaaaaaacaaaaacaaaaaccccaaacaaaaaaccugagcagacagggcuacaugaggcuugaaaguaaugcuugcuuugugcuuguuuguuugcuuucuuuuuguuguuguuguuguuguugcuacuuuggguuuuuuuguuguuaguuuguuuagaaagaacaaaaugauccaaaaacaagcagaaagaaauaaauguaagacuaugaaauugaauaaauaaaagaaaaauuuuuguuaggguuuuguuugguugguugguuuuugguuuuucuuuuuucuuuuuuuuuuuuaaauuauuuauuuauuuuaugugaguacacuguagcugucuucagacacaccagaagagggcaucagaucccauuacagaugguugugagccaccaugugguugcugggaauugaacucaggaccucuggaagagcagucagugcucuuaacugcugagccaccucuccaucccgguuuuugguuuuucgagacaggguuucacuguagcccugacuguccuggaacucacuuuguagaccaggcuggccucaaacucagaaaucugccuaccucugccucccaagugcugggauuaaaggcaugcgccaccacugucugacuuuguuuguuuuugagacaaggucucagcuguagccaacaggauaacccugacugggcuacauaacuuggugggguggcccagaaaagugucaaacucaggguucugcuggccucugccuccugccugaaugcuaaagcgaaggacaggugacaucaugccucacugguuuauuauuauuuuuuaaacaagaagacaaagaaaauuugaguguuugucuuuauuuccacugcccagucacauuaacccaggcauuucguauguucccugguugucuguccugcccugugugugcugauguagugcccuagaaggggaucauacagcuuuaauguuauacaccuggcuaaacuauuuauuuugugugucucagacaggucucacuguguauucucggcugaucuggaacucuacggauagaccaggcuacagucuacuuugguuuugcaagcaccgagcuuaaacguguguaccaccacacccaaccuuagagaaaagucguuugucuuuuuuuuuuaauuuauuuauuuaugcauaugaguacacuguagcuguacugaugguugugagccaucauaugguuugcugggaaugaagguugcucgaugcucuggucugcaccgcucgcuaaagauuuacuuauuguaucugaguacacuguagcugucaccaaagagggcaucaaaucucauugugguugcugggauuugaacucaggaccuucugaagagcagucagugcuuuuaaccgcugagccaucucuccagccccauuguuugucuuuuuuuuuuuuuuuuuugguuuguuuguuuguuuguuuucgagacaggguuucucuguguagcccuggcuguccuggagcucacuuuguagaucaggcugaccucgaacucagaaauccgccugccucugccuccggagugcugggauuaaaggugugcgccaccauacccggcuuguuugucuuuuaaauuccaauuuaaacuuaauuuuacauauagauguuuuccuguguguaugcacaaauggaccaucagaaagucucacucagaaagaacucuagcaugugaaagggguggugaucucuguacuugggagguugaggcaaaagcauggucaacaguucaaggacagcugggcgugguggcgcacgccuuuagucccagcacuccggagucagaagcaggcggauuucugaguucaaggccagccuggucuacagagugaguuccaagacagccaggacuacaaagagaaacccugucucgaaaaaacaaaacaaacaaaaaauucaaggacaaccugggcuuugucucaaauaccacaaaccuuaggcaacuagguucccuuucuuaaucauccaaagcaggaauauagacccaugugggaaugaggaguccuuacuuguccauaacucccuggacauuauucaauuucucucccacaaaggcggagcaaggguuauuugcuauuauuggccuacuucuagaaccaguguuacuagacugucaagaaacaccugagggaaucauggaaauacagauuccugggacacacccucaaagaagugauucaggagauagguacagcuugguaauuuagauuuccagacaauuccucaauaaauuaaagauuacuuuuucuuuuuucuuuuucuuuucuuucuuugguuuuucaagacaggauuucucuguauagccuuggcuguccugaaacucacccuguugacgaccaggcuggccucgaacucagaaauccaccugccucugccucccaaaugcugggauuaaaggcgugugcuacuguuuccccggccuggcaagauuacuuuuuuuuuuuuuuuuuuaggcuguccuuucuuucuuucuuucuuucuuucuuucuuucuuucuuucuauuauuuuauuuacuuauuuauuuguuuuuuuagacacucuguaacacagaaggaguggaaagguuuguuuuucauuauuucuaggucucuugucucucuugucaugucuugcccuggauuuaaaacguccaauuugaagguuuaagcuuccaucuuuccuggcucagccuccccggcacugggaucacuagcaugcgccacccugagggaggguccuccugugucuuccagucagaacucuaggucaugacccuccugcugcuauuucugcauccggagcacugagguuauaaacauuuaccaggaggacaaagcucgagacuaauuuuauuuauuuauuuauuuauuuauuuauuuuuuaaaggagaagguguggcuggcuuuugauuuacuuaagaacucagcuuuuugcuaucaauuaucuacugagacccagagaacugauaaaaucacgucaaagagaagaggguggagagaggaggagggggaagagcuuaauugggccacaggaagacaggaagcagucauuuacuuauaaaagaagucggcauucauucagcggcugccuuugucuucuuccaagccugccugaaaaugucauacuucggccuggagacuuucaacgagguaagagaauugauucucuaagagaauugguuuucucuugggaguucuuuuucacucuagggcuccugucuggcuuccgaggaacugcguggguuuaaggccucaaucuuggaacccucucugcuugauacuccacucccccccccccacccccacccccacacacacguuugacacuauguauuuccugggaguaaaaugaaacuguuuccuugcuaaaggaguaaaucgucucagacuaggaaggcugaagcuaggauuaaaaucuaccgagaaggugagcugaaauuaaguggaaauuuuugauaauuuacauuuaaaaaacaaaguagccauuuuucccccuaaggagaaguaaccaguucccaauaccucuaaugccuaguugguggguuuccccaucucggauugugugauucugggccagguaaggaccacuagccugucaauauugcuuuuaggccucaccauguucguuucguuugguuuuuguucuuguuuuuuuguuuuguuuguuuuggcuuuuguuguuaccguuguuuguuuugugguuguuauuugguuuuucgagacuggguuucacuggcucuccuggaacuuguuccauagauuaagcuggccuagaucugccugccucugccuccuaagugcugggauugaaggccuuugucauuaguccccaccccuaacccccagcucaguguuuuuuaugguaacagaaguggauuugugucuggggaacuuugauaaggcgcuauacaaauggaaaaagaaauccuuauuucuaguuuggaaguauugguguugagauuuccauaggagaaggaaggggaggggaccaaaucuucaggaacuuccuccaggaggugucacucucuaguugaugccuugcuuuucugagcguuuagaaagcccuuccacagugguuugguaguucccagccgccugcuuccugagguuaucuucuuuauuucaacacuaagacucugaugguaaaugaauucagcagaaaccccucacugcuucucuuugcagaaccaaucugaggaaaacuuggaugaagaaagugugauuuuaacgcugguccccuuuaaggaggaggaggagccaaacacagacuacgcuacgcaaucaaauguuucuucuucaaccuuagaccacacaccaccagguaucuaucauccaaugucagaauccuggcgaaaauaguguagguuugagauggauuucucaguaagacucuggaaagccaagauaaaguauacaguuuugauacaaggaccacucccuccgcccaccaacacaccuccaguuuuaccucccugcagcugguuaaaggugcacaccaccauaucaggcaggcuucuuaaaccucacugagauuuucaaauuccacucaucucaguuguuaagcccugugaacugcuuuauuuaaggugggaauugggcaagguaccugggaagcugucaccccacagcuaggcagaaguucaaaaacacugauccacaguaguaugacuuuuuccaaaaaaaaaaaauugagguuaaaggacagggcugugggggcuggacauuugccuagcauauaggaagguugagagugguacacucucuuuaagaaaagguuaacuuggugacucagugccuuuaaucccaacacuugggaggcagaggcagaguauauuaaauaucuugcuuacuaaaaggacaugguagcaaaagccuguagucccaacacuucguaggcugagacaggaaaaucaagucccaggucuucaauuguguaucgagugucaguggaggucuuaaaauaagugaccaaaaugaacacaccaaccacaaaaccugccuauuaguucuuaaaaagucucaguguuucaaagaaagguaugccacgcuagccucagagcagcuggggacuggggugugcuauguauagaaaaugacacauagguagaguucuggagcaaugcugauuugcggugcauuuuagaagggguucuuuugauucuguagaaacaacugggugaggggugggggagugcuucaaaaccuagacuuuugggcucauuuuugaguaauuuuccccccucaaggcugaguuuugcugcuuaguccugacuggcuuggaacucacucuguagaacaggcuggccucgaacuuagaaagcugccugacucugccuucaaaguacuaggauuaaagauguguuccaucacaucuggcuugcuaucagacuuuuuauuuagcugaggauggagugaacugcuggcccuaggcuguaggugcugccauuacacucuugacauuaugugaaguuuuugugaggcuggggaugaaaccuaguccccuccuguagugggcgugucuccaacugaaugacagccauagccccugaaucuagacacaggaucagccaaaaguauuugcuccuguaguugcugaagccaauaaaacaagcaaacaaacaugcuaaauauucuuuuuuuuuuuuuuuuuuuuuuuuuuuugguuuuuucgagacaggguuucucuguguagcccuggcuguccuggaacucacuuuguagaccaggcuggcucagaacucagaaauccgccugccucugccucccgagugcugggauuaaaggcgugcgccgccaccacccggccaugcuaaguauucuuaaacacgccuuuaaucucagcucuugggaagcaggcaguucucugaguuugagaccaccuugguuuacaaagcaaguuccaggacagccagggcuacacagaaauccugucuccaaaacaaaacaaaaacaauaaaaaccagagagagagaggagagaagaggaggaggggaggggagaggagaggaggaggggagaggagaggggaggggagggggagggaggggaagggagagggaauauuucagcugucuagaaugcauauggcagauucacagcaagcauaugauuaaaauaagauagaaucuuauuaggauuuauuauguaaauaugucuuacugucccaggucuccuauuuuaaggggucugugaucuuggucaagugaauuccucauuuucuuuuucauaauuggaggaaaacaaaaagcuuucuuuuuuuuugagacaggguuucucuguguagcccuggcuguccuggaauucacucuguagaccaggcuggccucagaacucagaaauccaccugccuccgccucccaagugcugggauuaaaggugugcgccaccacugcccagcccgagaagcuaucuuuauguacaaagugguuugugagaaaaaucuuaaagcaaucacugaguacuacugcuuucucccuguuccuccuuaucucagcccguucucuggugaggcaugcuggaaucaaacacccaaccagaaccauaccaagcaccuguccuccgcccagccugccuccuauuagggacgugucccggaacacucuucgggaguggugucgguaucauaacuugaguacggauggcaagguuaguaccucccauuuggauuugcuauuacauagacuaaguauggacacuuuggucaugucuuuuaacauuacuuuuuucuuaauuuccuuagaaaguugaggucuauuugagacuucggagacacuccuauucuaaacaagaauguguaagugacagcuguggugacgggguggggggaugggcucucccuguggagugagcugucuuacugaaauuguucuagguaaucucccuugaaggcaggguuccaggcauacauuggggagaacccaaugugugccuggagcucagagauccaucuaccucugccuccugagauuaaagaugugugccaacacacauagcaggaugucuggaaaaggucucuuaagugucuuaggcuggucuucuaccucccacguuccucaauuacaggcuugagccauuguccuuagcgguaaacuucugaggcaaucccguaucacgugauccuccuaccuuagucucccagucuaauagcugcgagcugcgauuacagcccucaucucucuggccccacaugaauuaugauucaaauguaauccaguaagauuauuucauauucagaaccaucugaacccccugagacaacaguaguuuuccaucucugggggguuuuguugcuuucaaaucugaguaugacagcuaagcaugacacacacccuggggucccagaacugggaaugugggggcaguggugucuacagcucaaggucuuccucagcuacacaguaggucauuaugagugucaccucaaaacaagaggagcuaggugggugauaaauuucagucccaguacuugggagacugaggcaggaaaagggcaggcaacaaauccaaggucagccugggcuauaaaguaagaccgaaaacaaaacaaaaccuggggcauaaaaaggaacaaaaacaaaucucccaaaaacaaaggagugauugcacucuuaucugucuggucuugaaccagugaucuuaucucuuuuuuugcuuguuuguuuuuuguuuuuuuuuuuuuuuuuuuuuuuuuuugagacaggguuucucuguuuagcccuagcuguccuggaacuuacucuguaggccaggcuggucucggaacucagaaaucagccugccucugccucccaaguguugggauuaaaggcauguaccaccacgcccggggccagugaucucaucucgaucuucaguuuugugcaguguguacauuacguaccugugugcacauggagguuagaagggagggaggcuuuucguauccuaucaguguaucuaccccuuuguggugcuccaguuuucucagcuauucugaaagccagcuagcaccaacaaaaaccugucuccaucccccuuaggagcuauuguuauaggcauuuguuggggacacccggccaauuacacacuguugcuggagucagugauuuguccccacugagccaucugaccagaccaaucugugcuuuugcuuuuaucugccaaaauucucucuccuuagagaaccaacacucuagagagaaguaguguuuccaaaauugccacccagugugaacuugugaaauuugcauaccaagccugagcacuuaggcaugcuggugaauuuccuuugcaguauauucccaauacaucucgggaggccagaaugaagcagggucccaagaaauccaagauagucuucagaggaaucgggccuccaagcgggugccaaaggaaaaaggaggagagugguguccuggaaauucuaacuucaccuaaggaguccacauuugcagccugggcaaggauugccaugagagcagcucagucaaugucuaagaaucgauguccucuuccgucuaauguggaggccuuucugccacaagccacugguaagaccucccuaaagaugugaaugcuacucuuucagaagcgugguuaaccucagcaggagacagaaaggcauaaaguagcaggggguuaaagucugaagacuaaccugguaggguggugccuauguggaauuucggcacuugggagguggaggcuggugggccaguaguucagugccacuuuucauuuuaugcugaggucaaggacacaccugggaagucaaagaccaccucacaaaaugaaucgaacuuaacagauugcuuaucaaucuuccugaugugaccccuaaccacacaauuuuuguuguuguuguugcuacuguauaacugauuuugcuacuguuaugaauuguaauguaaauauuuuuggauaucgaaguuuaucauagggaucaagacugguauagguggagaaccacugauguagaggauaaauuugacuccgguaaggcuucauuuuuaagcugggccugguggcacaugccuugcaaagacagguggaucucugcauucaaggccuuccuggucuacagagugaguuccaggacagccauaguuacacagaaaaacccuaucucaaacaacacaacaaaagucuggguggucauaacuacacagguucauuauguuggcaucuucuauuccacuaaucuauagguuaagaccgcagcaccuuaguauagcucuggagggucucuugaaaucagaucccucuaggaucauuauuucacuuccuugguuccuuuuauuccacaguauguagguauguaugcauuggggaaauuguauaugaaaaauuuccccuugauuuagcagucauggcucuuuuagucagaucaguacaaaguaguguacuacagacaaguggacuaugagucagaauaccugugucaguucauuggagaaaaugguauugaauaccauaaauccuggcuaccucuacuguuauagggaaaacaaagguuuguggggcuuggcucagugguaaagucuugcuuagcauuugugagguccuagauuuaaucuccaguauuggggaaagaaacacaaguagaauaccaguauuaacaauaaguauauuaauauauaaaccauuuagcaaggucuugaacacaaagugagcauucugcaaagugacuaggagguucuuguggucagaaacagucaucugacugguuuuccaugcauuguucucaauuuacuuuguuccaauacuuguuuuuuucagugcacauuguauaaaggguuuuugacaguuuaugagccagcagaaaaugcauuggauuuuuagcaaagaguaguugacugagagguaguggagaguugucuugauuuuucuugcuuguuacuuuuuuguuucuaccccucaggauccagaugguguguuguccauggcaggcagcucccugcagauaagaaagguuggguucgccugcaauuucuugcuggacagaccuggguuccagacacuccccaaaggaugaauuuucucuuccuguuaccggccuguauuaucccagaaccaggaguggaagauaauuugcuauguccugaauguguucacagguaaucccuuaguaccucucuuggcaugggaaacugaaaaaggaagaugucuagaugaauuuuucugauaacugaacagaagccaaagagcaaacauucuauuuuucuaauuccccauauugaucaggugaaaauagaaaacagcuuagaacugcauaagggugauuuauucucauaagucugaauaaugugccugagaaguguggaacccaguccaaaaucaagacuguuaaaaggggcuggcaauuuagugcagugggcauagugcuugccucccuugaauaagacccuagauuugauccccagcacaguauagagccagagguagaagccagccuaggcuaugugagcccaagccccaaggaaaguguaccuuggccuuauacauagugcuuuugauuugaguuauuuauuuauugguuuagaucacugauguuugaggacccaggcaugucacagcauacgugcauugguacaugugaucacaaucaaaaaccagguccucauggucccaguggccagcccugaauuagaucagaacucagcaucuaugcaugaguacaaaaacaaccuucuaugcauugagaauauucgggcacauagaacauaugaacuaaccaaaaaaaaaaaaccaaaaacaaaaacaaaaaacccaauaaaacaaaaagcugggcaugguggcgcacaccuuuaaucccagcacucgggaggcagaggcaggcagauuucugaguuccaggcuagccuggucuacagagugaguuccaggacagcuagggcuauguagagaaacccugucucaaaaaaccaaaaccaaaaacaaacaaaaaaacaaaagaacaugugaacucugagcagccuugacuguagcucuucauucaucaaucucagcauucaggcaagccaucucagggacuccagaaauggaaaagggucucuuauuuauuguaugugcucauuuugcuuggguuuugagucaaaaagucuaggcuggcuucaaagucuauagagauccaccuaccuaccuuuguuagugcugggauuaaagaugugccccaccgcccccagcuuuugucucuguuaagggaaaacucuggcuucucccccuugcaacuuuaaaaaauguuuucuuuaacauuugucuuacagcaacaagaagauccuaagaaacuuuaaaauuagaagccgugcaaagaaaaaugcccuacccccaaauaugccgccguagacaagauuuuacucugaucuaaagggaauggaagaauauucugugaucccuauaauggcuaaaaacaaacaaaacaaaacaaacaaacaaaaaccuggcugucagucaucagaagccccuccuccugucucccagcagaguggagacucuguugacaaaucagcauccaucucucuaacaacagcccguugcauuuuaacaucucugacugacagcuccucauggccucgugcuggauuugcaucacucuaacaacaccucgcuguaucuuaacaucucugacagcuccucauggccucgugcuggauuggcuaaaugcuuagcuaccugagaaaugauucgguuuuacuggguuuguuuugcuguacuuuuuuuauauaaauuuuuuuuuggaggggggagauggggagcaguuucaaauuagcaaagcagaaaguacuuuuuuuaaaaauauauauaauuuuuuuugaguauggcuuuaucauguagcaacuccaguggaccuggaaauucuagguagaccagacacguguuggguuuuacaugccuguacaauaccacuuagccaguacugauguauguuugacuaguauagaguucauugcuugugcuaaacaaccuggguguugacaaguguuuauagagugccauacauuugaaaucauauaguaugcuaccguucagauuggcuuuuaccuagcaauaugccugugagaaauauccauguccucgauugauuuuucuuaauguugagauuccauuguccaagaugugccuuaugaauugaugcuauuacauauggauaucugguugguuuuuauauauccaagacagggucuuuugcagcacaggcuggucuugaguauuuuaauuuuuuuaaaguguuauuacuugacauuucccacuccgaucacacucaccaucccugucuucucuuauugugccuguagcccuaccaauuuggccuuuggggccacucacacagacaugaauacaguguauuuaccagugua

SEQ ID NO: 8263 - RNA, 199901 nt, Mus musculus
ugcaagugagccaggccguacgcguggacguaggcgugggcgugggccaacaguuuccggucagacauccacgucuucuguuguccgcagguggugccugaagacauggacaaauaugccuugcugcagagggcuaaacugcaucuggauuucauccacgcgaauucgugaguuuccagagggguuggaacgggguaguuuuuguccacgugccaccaccauacucaauuggaaaacaaaagcuuaaugaacuugguaggacugcuuuaagaauguauuuaugcugugugugaggacuuagcagggaagucguaacucuauaucuggggauaauaacugaauaauuuugauguucuucagguaaagccgaguggaaggauggucccauguuuaucauuuaacaaauuuaaauauuggccagaaaaauuggaacacuuaucccccauccuuucuauccuuacuccgacacucuggaagacacuguuaaaaaaaaaaaaaacaacaaaaaaccaaaaacagaguaauucgcuuguguagauuucaacagcagugggcaguaaucgguacuuuuccuuuugugcugagucacauguguuugcugucuaacuagcuguuaugcugucagacuagaggcaagacaaggcaguugggagaaccagcugcucucccaggggacugggguucaauuugaaacacucacagggagacucacaacccucuguaacuccuaacaccauguucuggccuccuuggguaccaggcaugcacugugauacuccgauguacauauaccgaaacaccuuugcacaaaaaauuaaaaauagaaaagaaauaucacagucuguuccuaaccaugacaauggaccaaaaucccccaagugcaucuuuaaaauuuggguuaauacagaacuacaaaugaaaauaaagaucugacuguguugguauaucuucagcucuuccuaugcauagaggccuguuguaaaguugaagauggagacaagaguaagagaugaacuaggauaauaauacagaccacuugcaaccauacaccaugaugagcagagcaaagcaaggucaugauccuacuuagauggguacaccacuuaaaguauggacagcuuauuucuggaacuuuccaguuaauauuuuuggagugauacaaaggguaaugaagauccgcaaaaaaguaaaaccauggguuagaaaaggcuacugcaguuagguugcagaggcaagugacugaauuuugucacuucgaguucggcacaguacaacaguggaugguaugucugucauucaugcgguguguugguguuuaggaauuaccuaguaguuuguuauuuacugaaaguaccaacugauaagauggauggagcagguuuuaaggacaggaauggaaguguguagagauccaggagaggguugucguauuuuguaggacacucugagauucuaagguaacagaggagaauaggcugugcuaagcagaugcauaccugccauggagagugguuuuaagcuggaaggaugggcugucuucucaacuccuuggcugaccuucauccauagaaauagggguaaaacuuuuugcuuaauauuugaaauaggguuuuguuuuguaacccagaguggucucaaacuucaaaucccucugacuucgccucucacauucugggauggcuauaugcaguauucuguuuccauaccccagaaucauacccuauaauuaagcucgugcuuucucuaaugcacucaacaauucuuuccauccuuucugccuuugacuucagcccaagccacacgaucucucuugugacccgcccuccacacggccuuuuaaccagugcugugcuucagaccccagcuccuccuaggcccguguuuucugaagcuuccaggcugaacuuuugaaaagugaaccggauagaaaggccauucaucaaaaacuauuaacagcgcucuccacuuggucuuaaacacuucuccucaggggcuggaauuccuauaugauccagacaugccuuuauuuuagccuguucucuguauccaucaaagguuuaguguggucucaaccacucuuuccugcuuugggaucuuuaccuguuuggagaguuuccaccuuggcccuucaaaagauagaguucugucugcaggggucagaugagguauuagagucuucggugacuuuccauuccauccuuuguagucacucuuucuuguuacugcucugaaaauagcccugcccaagcucuggaaacuugucuucauguguuuguguauuuucuauguaccccaugauuuccuuguagauuaugacuugaauuccaagaaggaaagacccagucuguacacaggggggacacggcuaauguuuauaaaaaucucuugaaugagcuagcacagaaaggccguuagggucagaaguuuuacacuuuaaagagucagggacauagcuuaguguuagaaugguugccuagcacugaggcaggagugcguggguggguggcagaacaccuucauagaggcgggagagaggggaggagacagggaguuuguggaggggaaacugggaaggaagugggauaacauuugaaaggucaauaaauaaaauaaccaauaaaaaaugaaaaaaagaaugcuugccuagaauuacugugaauuucuaguggguugguuauauuuuagacaaaaaaaaauauuuauaguuugugcguguguguacaaguguguguccauggaugucagaagaacaugucagaccccuugggacuagaauuauugacaaucauagcauccgguuuggauguuggaacugaauucagacucagauucuuuagucuagaagaauggcaagugccuugagccacagggccgcaucaccagccccugcacuucaguuuuaaauucucugugcuugugcuguagagcaugucuuuuauuuaaaacaguguuuuauauuuuuauacuaguuuccucccaugaaggacagcugucuauugguggcuuaagaaagcuaauuuaaaaguagcuuacagaauacugaguuuaauaagguauuuuaugcacauaugccauuguacuuugcuuauauggcccccuucauuacacucuagucuuccugccuccuuccuguuggucuuccaccucccccuucuagacuguacauaugagaaaagacacaugaaauuucucuugucuuuagccacucccauuacucucucauucuccuuuugcuaaugcuuauuuuaaaauaaauuagaaaauuuaaagaauaagugacucaaaaguccuuuucuuagcaucugaauuugaaguuaaauuuggcuuaugugugugcauuuuguuuucuuugagacaagguuucucuguauagcccugacuguccuagaacucacuuuguagaccaggcugcccucaaacucagagaucuaccugcugccuucugagugcugggguuaaaagcaugcaccaucauggccuggcauguuuauuuuuauuaaguauauuuaagcuaaggugcugcccaaggcuugaaguucccauuaauuuauuuauucacuuuacauucugauugcaacccuccuuucucucuguccuucuuucacacagccccccuuccucccuuuuuccucugagaaaggggaggcacccuggauaccacuccaucuuggcauaucaagucacugugggacuaggcacauucucuuccagugaggccaaacaaggcagcucaguuaggggaaugggauccagucaggcaaugguuucagggacaguccccauuccagucauuggggaaccuucaugaagaccacguugcacauuugcuccauauucuuguggugggaggauggguccagcccauguuugcucuuuuguugguaguucagucucugguagcccccaaggguccagguuaguugacucugguggucuuccuguggagucccuguccccuuagauucccucaaucuuucccccaacucuuccacaagauucccugagcuccaucuaauguuuggcugugggucucugaaucuguuuccaucaucuguuggguggagcucucagaggaugguuguacuaagcuccucucugcaagccuaacagaguaucauuaauagugucagggauuagaacuugccuaugggguggaucucaaguugggcugguuacugguuggccguuucucaguuucugcuccaucuuuaugccuucacaucuuguaggcaggacacauuuuggguuaaaaguuuuguggguguguugauguucuuaucccuccacugggagucuugucuggcugcaggaaguggccaguucaagauccuuaugcaccacugcuagaagucucagcuaaagucaccucccugaaaccucuccucuguuacuuccuagaaaugcugcccccaccccguuuugauucccuuucccccagccugaaguuuuuaacauuucaauggugauuuuccccccuugugugcaugcacugugggguguguguguggggugugugugugugcaaaguuauguaaauaucucuuuuguuucugcucucuugcuucugcuacauguuuacuacacauaaagaaaaaauugcaagcuagauuuuugugcugaaguugguggcuguguguccacaucaggaaauggaaagcaagcaccugaugcugucaggagccugcuaucacccacagaucacccuucccugcaaguauuggaaguggggaacacagagaaaggccagccaccauguucuggagaaaauauagcauuagggcugaggagggaguccauaggcaucugggaagcccacucacaagugccuucucaacuuuggaaaggcuccauacaaaauuauagacagugggguugaagagggugccugcuaacuucuguauccacagguuuuuaauauucuccaaaaaugauuuguucauaaauacuauuauuuauuaaauauuuaaaagaaacaaaaacucuacuugaauauuuaagaggugacuuuaaaagaucaaagugauuuguagcaauaauacauuccuuggugucucccuuuuacuaggauauuugguaagaccuguuuguagaacaaaauauaaccauaugaauauaugaaaaucaugcagugaagcccauuucuuugugugcuaacaaaaugcuaauguugaaauaagcuaaggggcuggagagauagcucagcaguuaggagcacugacagcuguuccagaggaccccaguucaauuccuagcaucugcaugguagcuuacagccaucuguaacuacaauuccagggaaucacuuauuuucuucuaguuucugcaggaaccaggaauucacauagagcacacacuuacuaacaaaaggcccauauacauagaaauauaaacaaauauuaucuuuaaaugguaagccagggaguggugguacaugcuuucaaccccagcacaggggacagaggcagguagaacucuguguuugaggccagcccugucuacagagugaaugaguuccaggacagccaggacuauuuagagacacucugucucagaaaaaaacaaagacuaaaucaaccaaccaaucaaaaacaacaacaacaaagcccacaaacaaacaaaaaccaaaaauaaaaccaacaaaaaacuuaaaauuaacugaaaaauguguucuuccuuuagcuuuaaaauauauaggaucuauuucagaaucuuagcaaguaguuuuuuuuaagauaucuuaaaacuaaauuugauuaaaauagaauucaucaucuauguguuacacacuuauacauacuaguuguauguuagguaaauaucauuauugccuguauauuuuccaagcauacuuaguguugguuaucccuccucccucccucuccuucuguauuguucuuccuccccuguccauaauugaaucccucaucuccucuuaauuggugagcuguuuagaguggcagaauguuugacuguaucugaaacccuacucugauuacauacuggccucacuuuuuucuucucccuuuauuuccucaucagcacaacacacaguuuccucuuuggagcacuggcugaguugcuggacaacgcaagguaagauguaucugugaacaaaggucacuggggaaauuucaagacacaacuauagucuauuuauauuugaaauaaaacuauaaugcuauugaauaaaaaaagcaaauaaaagguggacauggcuguucccuaaggggaugaaggaguuuuguuguugcuguuauuguugcuguuguuuuaacuauagauacaagauagaacagagagggagagacaucugggagaguuuagaaugaacaugggcuggcagauugaaagggggccaugugaggagaggggagaaaggggccaggagccaaauaggccaggagcaacucagagaccaagagauuggcauagccccaaauggcuggguuagauaggaaagagaagcugggggaagggcagcccaggaggaccuuguaacagggaggaaggcuggcagccagagugcaccuagauaaguuaauaggcaccucaguuaggcaggcauuuguccuggguuugagaccuaagaacuauuaucucccauuuggaauguacuauaauuugcuuuccuauacaauccaaguaguauacaaaaagaccaaauaagagcaucccauaucuuuacuuaauuuguggugucacaucugaagcucuaggaacauggaugucugcuuuucucuuagcaguuguguaaaagcagguauucauuuagcuguuucuugaauuauguaucagugcaugcuaugucugaagccaguugacuuugaagccaguuguacuuaccaguagcuguugcuuauauaaauguguuuguacacaucuauauaugcaucucaacuuguccuaguuggcuuucuguugcugggacaaagcacugaucaaaugcaacuugaggggaaacaggguuuuauuuggcuuucacuuccaagucacagucugucacugcagggagcauaggcaggaauuuggagguaggaagugaagcagaggccauggagaggugcugcuuacuagcaugcuccuguugguuguuuuuauauggcugaggcucaucugccuagggauauacuacccacaguggacugggccauccuacauuaacuaguuaucaagaaauacccucuaaagccaugcccauagaacucugugauagaagcuucuagacuaagguucccucuucccaggcgagucaaguugacaaccaugacuugacaucgcauaacuccugcaucucuucagugucacucugaggugggggaucauuauaccaucucuacucacguaggcaugguguauaggcagacuagguggcuuauuaaaaguuaugacaugguuauuuggcacaacugcuaaaaguuauucaguagccauguggcuguagaaucuaguaccaaauuuaaugagucuggugaagguaaugaagcuuaaguucccucuuuaugaguuuaagauccaucuaguaguguguuuuggaagacuugagaaagacucaguuuuguuuugguuugguuguuucccuugagacaaguucucauuaugcagaacagccugccucaggcuuccucuauaguccagguuggcuucaaauucaugguuucuugcugccuccaucucccaaguguugggauugugggaacacacgaccacaccuagcucacaccuccaugucucagcucaggugaauacugacuuguguauauuucuauuucuuguuuaaaaaauugcuuacuuucucugcagcaagaaaagucaagaaacacccugaugaaguuuucugaugaaggcucuuaaugggggagcuaaauucccugucacuaguugauaagauaucagguucuugagcuuccucucaauuugacccuuagaaguaagauggccuugugagagcccauagagaguggaguaauuagcuaacuaccuagaaauuccuccaugcaccaagaggggaaucggaugcuagcacuuuuuuguuuuuuaauucuuuuucuguaaguuagaaaauaauaaguuguucaguguagaaggauuuaauccaaguauggagcuaccagggauggggcuaggaucaaguuuggggugacugaugcuccuacaaggauucccuaucuacccuuagauacugacugcuucugaacacuguuucccagagcuucauuagcucugacucugaaagaaacacauuuucaggaguugccagcuuucucuucuccuguguuuuacaucgucauuuaagcgagaaggguaguuaaaagccgaauguagucggaaggguucugggagaauacucuuuacauggcagaggauacggggugacgggggugggggggugggugaugggugggggaggaauggaagacugacuuggccucaggcaugagggagaaaauggaggaaacuucucugggcugccuuugugaacccccaacuccagcccaucucuucuuugcacugagccuggaaagaaaaggaagauaagguucaaguagcaagaggcaggcuggggguguggugggggcuuguucaauaaaggacuggccucaugaaauccacgguggggucacauacuccccccaccccccaccccccugcgauaguugcaauuccagugcuggggguggagacagcggcauuuccacgcuuacuggccggcuggucuauucuaauugguggugagauuuuuuucuugaaagggauaaauaguguuguugaagaugacugugagauuuccuccauacucuacauacccuugugaacaugcacguagacacugacaccuacccauaugagcaugcaccaucucucccuuccucugccucucccuuccccuucccucuuucucucuacucccucccucuuccucuaccccugcccaucuccauuuccccuaucuugucuccuacuuucccugaagugacauauggcagguaucuucauaggacugggcuguuccuucagccuugcuuuauaccacuguugcccuugggggaccgcccacauuggucuuuuuuuuuuuuuuucuggcuuugacagacacuauguuuuuuuuuuaccuuugauuagaugcugauauuaaauaucaaaagaaaauguacauuuauuauuuuauuuaagaugcucaguuggucucaugaaggauuuucuaaacaucgcuguuacucuaauaaauaauuuugcgucauauucaagacuuuagugauuuccuguggauguauauauuagaacuuauguaucuuuuuuuaaaaaguuuuuauuuauuuauuauuuauaugaguacacuguugcugucuucagacacaccagaagggagcauuagauuccauuacagaugguugugagccaccaugugguugcugggaauugaacucaggaccucuggaagagcagucacugaaccaucuuaaccacugagagccauuucuccagcccccagaacuaacguauccuaaaggaauaucguauagagaagaggaaggaaggcugguggcagagaaagcagcgcuggagguggcuaguacaguaaugauccaaagagaacauuuccugggccgaagcagaaacacuuuauaaagcauccagugaagagucuauauaaacaaacuguuucuuuaaaaccuuuagucucugcugggaguggggcuuagugaaggaauauuuauucccaugugccuggucuuauauuaguugucuaacacacaagaagagaaaaacaaacaaagaaagaaacaaaccuaucaaacauuuagcuuuaauccaguggcauuuacugagcgccugauguguccacaguucuuagcaaaaggcacaaguguauaguggaaggauugacaacuacauacaggaucuggugaggacuagaagagaauaaagucaguaucccacucagugcuugcuuuauauacagggaauacuugagaaauggcugggauucuugcagaauuuguauguuaugaaagccuuacgguauuuuuagcuauaggguaaagcaggacuccccaccaggcuggcugacugagugcuggaugcgguauauuagguguaguacucacucucccccucugacucuugcaucugcacugagcugaugcagccccaccugucccucagacucucuuuuucuuuagcacauagcuuuggccaucagcugagaacuuguuccccauugucagcauggcugcucuuucaccugauauggaagccaggauuuggcauuagaguuuuuuacuuuuacaaauccugaaauacaagaaauagauaugaauuuacaaagcugagaaaauaaggaagaagaagaaaaaaaaaaaagaaccaaaacacucacuguuaaucucaucucauacaguagcagucagaauauuuuucuguggaaggccagaaaauaaauaaauuugucucugaaggcuguccagcaucugcugaaauaauucaguucugcuguugaagggcuaagaaauccauacucaguacuugaaugaacaagugugauuggguucuaauaaaacuuuauuuauagaaacaguugaugagcaagacuccaugggccauaguucaccuuuauaggaaaaacuuuuauugacauuuugaggggccgguaaagcauuuuccuagcaugaauggagccugaacccucaucuccaccauuucaaagaaacacauuucauuugaacauguauauaacauaugccuuuaaaaauauggucauauggcacaaaugacauaguaauuucccuuuucuuuucagguuuucaacuggaauaugucaugaaaagucauccuauggcuuuuuauuauucucugggaaguuuuaaaauauaaauacuguauuuauguucacuugaaccuuuucuuuauaacuaccacgaaauuccauaugcagucuuuuaaauguacuaaguuuuagcuuuuguaauauuuguaaauuacgggugaugacaguucuuuguauauaaauguacaaugaaccaucuuagaaauuuaccuuaagugauuuaugauuucuguauugaugucugacaauagguuacaccucacauaagcuauggagauuaauguuauuuuuaagacacauuuuuuuuuuucugugaaucaauguuauaucuguauuguuuccagagaugccggggcuguaagacucgauguguuuucaggugagcacacauuuucuuuucuuguuuuuuuuuuuuuuuucuucuaagaaaaagccuguagcuacuuugguuuuauuuucuuucaucaaaucacaccacauucugcagcuuuuuauuguaaucuaagugcuuugugaacaccgugacccuguggggagccagacugagaaauacauacucugagggucaaaucacucacuugcuggagggucuguguacagaaugaugucuucuggaguuuccugaaaaccucugagugauuuggggccaugaauuuauuugccauaaaaagcaguuuuauuuuuaaaaaucacauuaacguaauaguuauucauaauuaagcauacaucauuucugauuuauugaagucuuaaaaaugcuuaagugacuauguggugcagauaauugucuaacugcuacaaagcacaagccaaguguguuuucuuuauugacuucauuugugguuccucagugucuugugugcuuauuauuuagucuugguagauugugaugcuaacgaccuuaguuucugagaugaaguuaaugcugccuugcugcaccaacacagccuuccuuccguuaguuucuggucccacaagaggggauauuguccaugaugcgauuccgucucugagaaaaaugcaucucaucacgucucaugucugaacuuguugcaacgagugcuuaguguucaugagauauguagacguugaaaucccaagacaugggacacaguaagugguacucucuuuguucguccuguucacaucaugaaaagucugagaaacgaauggacaagugaaucucugucgcugagacauaagauuaggucgggguguugugccggcugguuuugugugucaacuugacacaagcuggaguuaucacagagaaaggagcuuccucccuugaggauaugccuccaugagaucuagauguaaggcauuuugagagagcuccuuguggguggugccaucucugggcugguagucuuggguucuauaagagagcaggcugagcaagccaggggaagcaagccaguaaggaacaucccuccauggccucugcaucagcuccugcuuccugaccugcuugaguuccaguucugacuucccuuggugaugaacagcagcauggaaguguaagcugaauaaacccuuuccuccucaacugcuucuuguucaugauguuuuugcaggaauagaaacccuaacuaagacaguuuguuauguggcuuggauuuuuuuuuuuuuucuugagagcagugggaagucaggacaggauuuuagcaguaggggugacaugaacugcugaccaaaaucaggcugcacauugugauuaggggaggaagaaauuagggagcuguugcuaccauccggaaaauccagaucgucugagugaagucaacacagcagaauagaguggccuaaucccagaggcagggagaagcagaggacacugagggugcauaaccugguagaggagggggcaaaaggcuugauagccaugaugucuugacuuggccaaagcccagggcaaauaagaaacacuagagaaagaaguagucuuguggaagugauggugguguuggcuuagggaaauacauaguuagcaggagauagaaaucugagcccccagccuucuaaagaaaaauuuauucuauuguuuuucaguuaugcauguauauauuccucuguguguguggcuuugugcaugugagagaaggugccugaaguauccagaaaugaauguuggauuccucuagagcuggaguuauagucaaccgugagccgccugcugugugugugggacccagaugugggcccucugcaagaacagccugugguguaaagcacugaggcaucucucuagccccagacugauugcuuuagggaacugucauaaggcugucuccaugggcauaacagggaugcccagauuuuugaggucacaucugcuuaacccuaagaccccaauuugcauaugaauauaugucuuuaguguaucugucuuggggauuuuggucuuuuaaagcuguuuuggaagaaauauauuuugugucugcuugcuucuucuauacuuuguuguuuguuuguuuaaaucuucaaauuuagcuuuggcuacuguauauugcugcugaggcuaagcaacauccugagccagguguaucuuaguucuagaugacaaaaaauaaugaggaauggcucuuagcaugaguacaaaaucaaauuacuaugaaugcccucaaauuaguuuuaugguuugaaugugguuuguccucugaaaguuccucuuagacacuuuggccucucuggaugaugggacuuugacgggcaagccaaguggagaugaucagagcauuggggaucuuguccuugaaagagauuaauguuagccagguaugguggcgcacgccguuaaucccagcacucagggggcagaggcagucagauuucugaguucgaggccagccuggucuacagagugaguuccaggacagccagggcuacacagagaaacccugucucaaggaaaaaaaaaaaaaaaagaaagaaagagauuaauguuguucuaacacagaguuuaugaugaaauuugacucuuggcuuuugguuuccuuacuugcuaggucucacucugucacaugcuuucucauucagccuuccuucccacuggcauuugguauaccaugaagcccuuacagagcugagcagaaaauggcacccugcucuuagaccugcagcaucaugagauaaauaaguguuuuccuccucacaaauuauccagccucaaguauuuuauucuaauaacaaaacuggguaaauacaacuaggugcaucuuuuagauauuuauucuuuggcggucuugagcauuaucucaauuuuaaaugugaauuaagugugaauucuaauugaacuuugaacacauagguugauuuaaaugugcuaaaaagcaaaagaaaggaugucaaugauugugggggacuaucaaugauaaugaugaucggguauggaaggaggaaauauguggggugcagauguguucucugcuugugauauuuucacacauacaccaaaauuagccaaauuauauacucuaagcauguguauguauuaugcauauguuauucaucgguugcacuauuaucaaaaaaugaagugugucauuuuucauagccagcuguugaaauucuuuucagagcugcuuuccagacuuggcacuaaaguuuguuuuauuaguuuuaguuacaccucuaacaccuuaaaugggagauuagauuauguaauuuaauggcaucucuucaucaucaaaauugacuucaaaugacuucccccuuuuccgaaaucaaaagcaucauuaagaagcaaauauuugcugcuacagagaaacacucaccagaggcucucagaggaauuagcuacuuagaaaggagccugaugaaguuaauaagaccggcccugaucuguuguagaacuacuguguugugggaagggcauaagggacggucagguugaaagagagacccuggagcuuaccucacacaguuaccuuuuuccccucucccaggggaaaguuaccugaaguugaaagggccaagccagguccugagcagggcccauccuccuggaugcauacguugcucaccugcagauacugcauguuaauuuaaaucuguuuugcugugugauuguuuuccuccugcaguuucuuaggaaguuauagccaagauuucauucagagcccaucucuauucuguaccuggagcuccaggccugccguggaggagaacaaauaauuacgggagcagcaugauuuuucugacgaacaaauuaagcccaauauuuauuaggaauaacugcuuucucuuacaguggauaaugaaacacugcagggaggauucauguuguguuuccuggaugauggauguggcaugagcccugguaaguuaauuaucuagcuaccuaacuggcuauggaaggaugccgucugcagacccagaaaauaaaaauaaauugaacuaucuauuccaaacagagauauggagcaauuagggcaaauagauugcagacaaacucguuuugaaaaagauuuuucuuuuuagguuuaaauauucuagcugguaaacuaaauccauuuuaaccaccuaaaccaagacacaaaaugacuauaccuucuauagucaggucacaugaaagacaaaucagacugauuguaauacaaaagcaccuaggaaggaacagauuacaaauaguaacugaacagacuccgagcucuuuuucuugcucaucuuuuaccucuccgaugcaggagcccugaggcaauuuccaaugccuuuaggcuauuauuaauuuucugcauaaccuugagagagagguuguuucuccuuguuuuuaacaguuucugggucuuuuuccuccucuucuucaaaggcuuaguuucuuuuacugaauguucccaucauagcaaauacauccacgauauauuuuaggauuuaucuugucuauuuaaggguaaucccugagucagcacaucauggguccacagugcagacuccaggcaacugaaaugauguuuccucugaucugggcuguguguucuuuuggaucuaaucuggacuucuuaggaugcuuuauguaucuuaagauaggguucugacugcucugcuuaaagaaugucagaggaguccaagcagauuggucaggcacacacauaagaaaaggguggccaucucaauggacugagaacaaggaaagcaguuaacuuccuuuagcuuugaugccaccucgugaucccaauagccauugggaaaguuuaaaaaaauguacuacuaucccacgaagugcuuguuuauacuuuguuuagauaguuuuuccuggucucuuuugauuaaagugguggguuuuuuuuuuuuuucucaguguuucaguaggaagugguagagggaagccacagugaagaaugucucuaauuacauguagccugaguuacaaguuuauuuuccugaguuuuuguuuguuuguuuugaggcaggcuuucuugauuaaugauugaugugugcaugcccagaccauugggaguccugccucccauaggcaugugggccuggaugcucugagaaugcaagaugagcaagcuaguagaaagcacuuccccaaggccucugcuccagcuccugucuccagauuccugauuuaguuccuguccucauuuucucugaugauggacugguguggaagugugagcaacauaaacccccacccucaccacacccaccaaguugcuuugggucaugguguuuuaucacagcaauagaaacccuagcuaagacaguuggaaaucaagaauuuaucuuggaugacauuugucuguugucuaaacuaagcaucuugacccauagaugauggcuguaccaauuuccaggaugcuuugguccuucauucuuucauagucuuccauaucaaaggcaucuaucugcucaauguuccgugacuuuaucuugggcuucuuguuguuguuuauucuuuugagaccguuucauuauguaguccugacagaccuggaacucacuauuuagaccaagcucuguauguuuaaaguuagcacaaaccaacacaguaggugcucaguucaaauacugugccgugaaaauauuguucccuguggucagggcuuugaugucaaugauauuucacuuuaccaaugaaaacccucagagaaugcccauggcuucagaauaggauucagagccacucccucacggucagcauuuccuagucuuacacucagcuccauccaguucuugggucuucucuuagaguacuugcuuucuugcuuauagcucuccagccauagccaaugggacccuccccacuccacuccggggcugaccuucuucaaugccacuccccagucauuccauccuaaggacacaccucugugcuucucugucacaucccuuguuucccucacuuaauccucuaggacaugaucuuguauuucuuucucuuuuuccuuccacugugcuaauacagauuuuaauaucuuccuguaaguguguuguaaaugugaaguagaaaugcauaugaggcauauaaccuuccucauacauaggaaacugaauaagugcuggcuaacauugucacggacuuacuccuguaugaaaacaugugaccaaauguuuuuagcuuuagacuaacaggguguuaguggcuuuuaaauaucuugcaccaugugaugcugaacuauggcaugucuguacccagacggacacaggacucagcauccacuuggcaggccaauagggagaacauucauugucagaagaucacacagucugaguucccaggaucuugaaugcuuuagagagacgagaacaacaacucuacaagucuggaaacaaaucuccuuccucccuaggcagcagcaucgaaaucucucuguccuuaguguuacaugaaccagaaccaggaccaacaccaugagauaguuacuagcuagcaggcaacugcaacauuuacauuaacacuuauacucaaggccacgugugaagcaguucaggauauaucagcucauuugucuucuuugucuuugucgcuaugguggugguagcccuucucuuuuagaaacgaggaagccgaggcucacaguucuaaacugucacaugguuaugucugucugaccuccaggacuucaccuugaggaucuuagugauucugggucaugacaccaguccuuguggacugucccaaaggcuauggucuuaucuuaggguccugacgcauggacagaauucugacaccugaacucagugcugacaucagacuuuuccuaacuaccuuaagaaaucguugucgauuacagaugaagcuucagacguaauuuacuuuggaacauccaagaaacgcuugucgaccuugaaguucaucgggcaauaugguaacgggcuuaagaggugagaauuguuuuuccuuaaguuauccauuauuugcgcauacugaaaacauuaugcaagcaaaauuuucuuucuaacaaccuggcaccuuaaacucaguggcugaguuuuagggaccaucaaaacucacuuuggaaucuuuauacccauaacugacgcagcucuuugcaacaugaaaaagcuuuucguguagaacaaggugagucuuucacaggcacccagaagcgguccagugucacugggucuuuacaucugcuugcuucucaaagcauauuugagcaucggugugguauccacagcuuucuuuaguuuguuucaauguaagugacacgugugugguuccauccagggcccaguaauuauucuuuugugccuuggcuggaacuucucucaggcagcuguaucucaagcaagagugucaagccggaucugcuaaaguucguauguucuccucugagaaguaaaggaauauucgugcaccccuggggaugaguccagcagcuggguuauggaaaagaacaaccuguuauagucaacaaaaucaugccccggcuacuucucuauuacugucuguauguaaaccacugugcucccauuuuuaauauagcggcuccaugagaaucggcaaagacuguauucuuuucacaaagaaggaagagaccaugaccugucuguucuucucucagacuuucugugaaaaagaaggucucacugagguaagagauggggcuuucuuuuuauuaccauggcaacagugcaguuuucauuuacccucucaggaggugaaggaggcuguaacuccuugcagauuaugacuuagaaauuugggcauauguuugaggaauggacagaaggugucuguaugcacuggggucaccagaggccuuucuggagaacuuaauuuuguucuccuugugcccgaauuuccuagaauaagaagcugucucuggcacaguaauauuucuuggagaagccuccagagaccuuucugccguuuugugacacacacaguuuaucaguucuuaaauaaauaaaccauuggguuccgagauuuagagcacaucuauaaagaaacugaaugcaaaauagauuuaaauugcuaauucuaguggccacauuuucaacucuuagcugaucuucagacaguguguuaauuuacacuguuugaguucuguuaugaaugucaauuguaauccaacauaccauaugcauauuacaaauacuaucugcuuagcaaugguuagauucuguggauggaaaaaaaaaacacagcuaaagacucugucucuaaucaaauguuuucauucagugucaucacaagauaagucagacacacagaaauugguuaaauaauaaaacuggaggguugugggcaaaaaaaugcugcucaaugagcauguguggcuguucuucccaaaaugucaaaaagcagcaauauggagggagagauuagagggccuuggguagccagugaggguuuuauggagacaguaugacuuguaucugagcaagcugcucugugaagaugggugugggauuugaacaguguggcaguucgagccugcugcagggguugggucuggaccacagcaacagccuuucaucaaagaggaccuuaaacacacauacacacacauacacacucucauguguauuucuguguucaggcugugaagagugacaucacgucaccuuagaguacaucaccagugauuccauguuuguuuuccuuuuaugcacuuuuugucuuaucuagaauaaacaauuauuuggcauugugugugcuuacuguggucacugguaaugugcuuaguuuuccagguuuguauccguugguucaccccagucucacacugcagucagauccaccuuucccaguaaacucugcuagugagcccuucccucccuguggcucaugucucugccuccuaaggaguuggcauucagcugccuucauucuaugugucaaccucucccuaccucucugauucuaaaucucaugugugugugugugugugugugugugugugugugucugugugucugugugucugugugucuguguucuuccauuuugguguaacacacuguauacuugauuccugagccagagagcacgucagacucucuaugcacaaacaucuuaaccuaccuuuaccucagcuuaauuuuaaaaaaaaauuacuuugacaaguuuuauuaaguuaccaggguuggccuugaacuugugacuccucuaccucuaccuuaguagagggcuuacaggcauguaccaucaagacaaauuuacacucaagguuuuaacaauuuucucuugagauuuuugucuucuugaaaucuaauggcucuguuucuacagguuuuuuuuaaaccuuguuucuauuuaucauagcagaagcuuuuaaaaagacuuuuuauuuauucuuuaagaguuuuccacaauauauuuugaucauauccauuugccucaccuuaaacucucccagauucucugcucccucccggccuacccaccuucauguucucugucauaucagagagguuuuaugccuaucaauccccaguacuucaaagguuaacuuacugaaagcacugagauugugggcggggauuggcagcuggagugcuguagucuaaccagcuguuuucuugugggaauuguuuauuuuuuuuuccacccugugugucauucccagggguugagcucaaggcuugguggcaaauauuuuuccccacugagccaccuuggcagcucuaauaauggaaauuaaacaaacaaacaaacaaaaaaaacaacccugaguaaacacacagacacacagacagacacacacacacacagacacacagacacacacacaccgacacacauacacacacacauacacacaugucugucuccuaaaucuaggcuucaggaggaagauuacuuuuaacuuaguguuuuguaauuuggaagaagaauggaauaaauuggaauaaaacaaaggaauguuaguguguguauauuucauaauauguuguguuuuuuaacacuagguuguaguuccaauaccuucauggcuaacgagaaccagagagaguaucacagaugacccgcagaaguucuucacagaauuguccaucauuuucaaguacuccccauuuaagaccgaagcugaauugaugcagcaguuugauaugaucuacgggagaugugguaagguuaucagaagcaacauuuuugaccugagcauuucuuuucauacuuuuuagcaucagugaccucaggugcaguaucgcaugagggcagccguucacuuuauccgugugaguguuaccuugaaagaauccagauaggacuuauuguaaguucuugacacccggagaaagguucagacuugagcuucugaaugagcggagggugacaaaggcugugcccacagggacccucgguccugacccucauagcagaguuagcuguccauugcaucauccgaguucaugugaugcuauuuugcuaauagaguuagcaauagagaaucugagagugcauucccaucuuggggagggggaguaagcaagccuuuaucuacacucuucuccccggcugacagaucuuuuauucuuuuccuucagcugccuucauuuccuuugcuuucucucuugaugucuagacugcauuaguuacuggagauuuccuugugucggucuuucucuagacauucccuauuuucacuucuggaaagauaaaaagaugucuacuuuagaggaagccacaugugcucugccugcucuuagcgauguuuuggcuaauauaauauuuguagaaagauuuugauaauuuuauuuacaacuugaucugcuuuaucauuaagauaccuucuguaacccauggcaucauuuuuuuuccccaaaaguauucuacuucuucugucauugagaaaaaaugguggugauuaaauuaguauuuacauauuauauaaauacuauaaucuuacuguuuuagguuagacuguggaguaaugguuuucaugauaucuucagauguggccucacaguuucuucucauccuuacccugucguggccuccucugugcuccagcuggucgcuuucaaucccugaguuacucccacaucugcuuccuaucauuacacuccacuccacucucugcccuuaauagcuguuccuccccugucauaauuuucuuuuuucaucuuaccccuucacauacauaaauaauuguauauacacacguauauguagugcuaaguugaggaccuucagauaagggaaaacaaggacuuuacaucuuaaugaucauuuagucucucagaggacuucuuguuuuguuuuuguuuuuguuuuuguuuuuguuuuuguuuuuguuuuuguuuuuguuuuucgagacaggguuucucuguguagcccuggccguccuggaacucacuuuguagaccaggcuggccucgaacucagaaauuugccugccucugccucccaaaagcugggauuaaaggcaugcgccaccacugcccagcucucagaggacuucuaauugugaagcacucacauaaauauuaguaaaauguuuauuuuugcuuauuuuauuaugcuuaugaauucuauuggauagauuaggaaagugaggguuuuguuaguuuuauguguguauauaugguuuuaaaaucauuuuacuccuccauuacuaucucguguccucuuuuuacugcucugcacuccuuucuucucaacuagucucugccuacuuuuaugucuuuggaguggagcucuuaaggucacaccacuguucagugguuaauccagaauuuagaaacaggcauuuugacuauaaacuucucauucuucuccccuaugcuguucuccccaccaagagaaguguaauucauuucccuuuuuaauuucauugaaacucacauuugugcucauauugugcucaaacaguuuugugaacaguuuggucacuuuugguuaaugaugccuuggagcaggagucacaagacauagccaaaggccaaguuugacacuuuguguuuguuuguuuauccuuuauuuuauuaaaaaaacaaauauaagaauauuaaaaaaaacauuguauugaaguuaaacaagacaagccaucaaaaaauaaaagagccccaagaaaugggacaagaauuagaaacccacuuguuuuuaccagaagucccauaaaaguacuaaacagaaagcuauaguauauaugauguggaggaccugguacagacccauauagaccucagucucugaguucauaugagcuuuguucaguuguuuuaaagagcuuuguucuccugauguccugucuccccaacucuuucugccuccuuuucugugguguucccugagcuacgaggggaggccuuugauagagacaucuccuuuagagcuauguguuucaagguguguaauggcuuccugugggucucuccauuuguucccaucugcugcaggaggaagcccucugaugauggauuagguaccaaucuaugaauauagaaggauaucauuccuuuuuuuaaaucaguauuauuugguuuuaccuuaggucccugggcuaucuagucucuguuucuuggucacaaaagcaguguuagguaugaauucaauaucauagagugggcuauagucaaaucagauaucaguugguuacuccacagguuugugcugugguugcgcuagccuuauuuuuucaggcaggacugauuguagagcauaaguuuuaugguugggcugguguuuuuucuacuuuucucuuuuaguaguccacagaauaccuuuuugugucauagacaccagaacauuggggugaagguucuauguaggcaccaacucaaccucuccauguucagugaguugugugcguguugucuucagcaguggggccuugcugucaguuuauagaaaacaacuuauugucuuggcaacagccuggcuuguauggggauuucugugcaaucacuuugcccagcaaccccacuggauaaaacccagucccacuccuggaaccuuuauuuggugacaagagauggucaguagggguuccgucuccuucauuauuuggagucuucauuaguaucaccuuguauauuauaggaaguuucuacuucacuguuuccguucugccccuuaaacguuccucaaaugcuccucaguucuagcugugucugcccucauucccucccucaaucccaucucuucucuucucccuauuccuaccccuaccguauccuccuguucuugucucccugccuuuaauccacccauaaagucuauucuauuuuucucuuccagggagauccaugccucuaugccuaagauuucuggguauauggauuguagcauggcuuucauuuauuuaauggcuaauauauagaaacaagugaauacauuccauauuuauguuucugcgucuggguuaccucacuuagaaugauuuaauuuuacuuccauccauuugccugcaaguaccauaauauuauuuuuaaauauuauuuauuuuuguuuauaugaguacacuguagcugucuucagacacacaccagaagaguaugcaucagaucccauuacagaugguugugagccaccaugugguugcugggaauagaauucaggaccucuggaagagcacucagugcucuuaacuguugagucaucucuccagccccccaugaugcaauuuuuuaaaaaagagcuagaguaauauacauuuuguaaacaugccacauuuucuuuaugcauucuucuguugagagacauuuagguaauuucucauuucuggcuauuaugaaaagaauaggagcaaacaugguucaacaaguauccuugugguaggaugagguggccuuuguuauaugaccaagagugauguagcuggaucuugagguagauggauugucaucuuucugaggaaccaccuacugauuuccauaguggcuguacaaauuuccacucccaccaacaagagaagaguggucccuaugcuccacaucaucaccagcgugagcugucacuuguguuauugaucuuagcuguucuggcagguguaagauggcaucucacaguaguuuugauuuucauuucccugaugucuaaguuaguuguauaguucuucuaguguuucucacccauuuugaguuuucucuuuugagauuucucuguuuagauauguaccccauuuuuaaauugaguuauuugguuucuugauaucaaguuuuuuuugaguucuucacauauuuuauauauuagcgcucuauuauauauggaguugguuuaaaccuccucccauacuuuagguuguugcuucauucaaaugcugguaucauuugccaugcaaaagcuuuucaguuccaugaggucccauuauugauuaauuguugaucuuagugucuguauuaacaauguucuccucaggaaguugucuccuguaucaaugaccucaaaacuuuuucuuacuuucucuucuaucagguuuaguguaccugguuauauguucagcuuuuugacccauuuguaguagaguuucacauggggggauaaauauggauguauuugcauucuucuacauguuaucauccuguuuguccagcaucauuuguggaaggugucauuuuuccagaguguauuucuggauuuuuuuuuuuuuucuugucaaaaaguaaguguccauaggugugugggcugauucugggucuucaguuugaucucuuugauuaacaucuguuuuuauaccaauaccauguugguuuaacuguagcucuguaguauaacuugagaucaggaauggugagacuucucaggguuucuuuauuguucaggauuauuuuagcuaucuggacuuuagcuauccuggguuuuuauuuuuuucuuaugaagcugagaauuauccuuuacagauuugugaagaauugucuugggauuuugauggggacugcauugaauuuguagauuacauuugaccauuuuuacugcaauaauucuaccaauuaauaacauagaagcucuuucuaucuucugauagcuucuucaaauucucucuuuaaagacuugaagcuuuuaucacacaugucuuuaacaugcuuggaaagaauuacuccaagauauuuuauguuguuuaaggcuauuaccaaaaauguuauuuccuugacuucuuucucagucucuuugucauuuguauuuaggagaacgacuaauuuuuguggguuaaucuugugucuagucacuuugcugaagguguuuacuuguuguaggagcuccuuaguagaauuuuuagggucacuuauauacauauuaucauaucaucugcaaaaaauaaugcuuugacuucuuccuuucuaauuuguaucgcugucuuagucaggguuucuauuccugcacaaacauaugaccaagaagcaaguuggggaggaaaggguuuauucggcuuacacuuccauacugcuguucaucaccaaggaagucaggacuagaacucaagcaggucagggaccaggagcugaugcagagccauggagggauguuccuuacuggcuugccuccccuggcuugcucagccugcucucuuauagaccccaagacuaccagccccaagauggucccacccacaaggggccuuucccccuugaucacuaauugagaaaaugccuuacgguuggaucucauggaggcauuuccucaacugaagcgccuuucucugugauaacuccagcugugucaaguugacacaauccccuugaccuccuucagauuucuuauugcucuagcuaacacuuaaagugcuacauugaguaaguauggagagaguagacagccgugucuucuuccugauuuuagaagcuuugcuuugaguuucucuucauuuaagcugauauugacaaggcuugcuguaaacugcuuuuuuuauguugagguaugucucauguaucccugcauuuucaugguuguaguuaacuuccuuugguuggaguuuuucuucuagcaccuucuguaaggcuggauuuguagauaaauauugcuuauauuuuguuuuauaaugaagcuuuuuuuuucauuuauagugauugagaauuuuguuggguauaauagucugggauggaaucuguggucucuuagagucuacagcacaucuauucagaacuuucuagcuuuuaaacgcucccuggagaagcaggguguaauucugauaggucugccuuuauaugguacuuggucuuuuuccuuugcagcuuuucauauucuuucuuugcucuguauauucagcauuuugauuauuauaugccaagcaaacuuucuuuucugguucaaucuacuucguguucuguauguuucuuguacuuuucuaagccucuuuuucuuuaacuucggaauuuuuucuucuuccuuuauuccuauuauuuuuagauuuacucuuuucauagugucacaaauugaauuuuuuuuuggaguguguggauuuaacauucucuuugaccaacguauucauuuuuucucucauacauuuuaauuccugagauuguuucuuccacccccuguaaucugaugaugaugcuugccucuguaguucuauuuaaaugcccaagauuuucacuuccaaaauuuccucaguuuauauuuucuucauugauucuacuuccaucuuaagaucuugaacaauuuuauucacuuccuggcacugucuguguuccccuggguuucuuuagggcuuuauuaauuuucucuuuaaggacuucuaucauucucacacaggcuguuuauaggucucuuuauuggccuucagcuauuuuguaaugaucagugccugcugugguagaguagcuggguuccaguggagacauauauuccuggauguuauugacuguauuuuuaugcugacaucuaggcaucugggauuggggugauuauaggucuggguaaugguaucuggcuuuguuccuugguucaugcuuccucccuaguugugguggcuauaugcuaccuggaaagaaaauuuccauggaccuguuuucccagacuguucagcugguaugugcccagugauugcuugcugguguuagaagcuggaaugaugggaugcguuuuggguaaugaaagcugggggagaagauauuugugauuuguuggguuaggggaucagagagaaaagggaaacuggagcaaguguggcucugccaucagccuacuuguugcacuggcauggguggucuuuggauuaguuaguaucggcugccugcuuggguuggggucugagacaaagcaaugagucggguagggauguuaagggggaagaucuguguugguguccacaggagaugagaguagggcgacagggaaggcuuccacagguguucagaugcagaaccgcgguugaggcugggggauuagaucucagagaauggagggagaagagaauaucugcagguagccuaccugguuuucuuggagcucuguacuuacaaaucacauuuuauuggaacacaacugcauuuauguuccucuaucuuuucucuaucugguuucaugguacaacagugaccaaguugaguuugaguaacuaugacagcaacaauauagacuacaaacccuaaaauauauacugauugucuuauaaagaauaguuugucggugccagcucuagaaucaaaaaucaacacucaguacacgguuuuaaacuaauauuuccucauaacuuuuucacugcaugguuucaguuucaccaaugagagcuccaucuacaauacaaacuuggcucaggcuccuaaaaauugucaucaugcaaauuauaaaaagcggaccaauguuugaaagacuuacaguguauuuaauaguacuuggagcaguguauuauggaaguacagcagucucagacagauaguauaauuucccagaaagcauggcuugcauuuuauccaaaugauuuggcugaagccaaaaagaaauuugaucuagaguagcaauccucaacuugugugucauaaccucuuuuuuuggggggguggggggagcggcgaaugacccuuucacagaggucacauaucagacauccugcauaguagauauuuacauuacaauucauaauaguagcagaaucagagagguaaaguaacaauaaaaauaaacaucugucaccacaacaugaggaucugcauugaagggucacagcauuagggggguugagaaccauugcucuagagucagcugaagugauucgaaaugucuagaagugucuugaagaacugacgagucaauauuuccuuuuucccuuuuuuacaggaacuuugcugauuauuuauaacuugaagcugcugcuuagcggagaaccagaguuggauguuacaaccgacaaagaagauauacugauggccgaggcuccggaggagugaguacuaguguaucuaagagcauccuucccccauagcacugggcuggagcugggagcacuguauuccagcugcagaccugaggccccuaaugguaccacagugacaguucauuuuauuuuauuuuauuuuauuuuuauuuuuauuauuuuuauuagguauuuauuucauuuacauuuccaaugcuaucccaaaaguccucgacacgcugccccacccacccacucccacuucuuggcccuggaguuccucuguacugaggcauauaaaguuugcacgaccagugggccucucuuuccacugauggccgaauaggucaucuucugauacauaugcagcuagagacacgaacucugggggguacuguuuaguucauauuguuguuccaccuauaggguuccagaucccuuuagcuccuugggacuuucucuagcuccuccauugggggcccugugauccaucagauagcugacugugagcauccauuucuguguuugcuaggucucggcauagucucacaagagacaacuauaucaggguccuuugagcaaaaucuugcuaguguaugcaauggugucagcgauuggaggcugauuaugggauggaucccuggauauggcagucucuagaugguccauccuuuugucucagcuccaaacuuugucucuguaacuccuuccauggguguuuuguucccaauucuaagaaggggcaaaguguccacacuuuggucuucguucuucuugaguuucauguguuuugcaaauuguaucuuauaucuuagguauucuaaguuucugggguaauauccacuuaucagugaguacauauugugugaguucuuuugugauuguguuaccucacucaggaugaugcccuccagguccauccauuugccuggaauuuuauaaauuuauucuuuuuaauagcugaguaauacuccauuguguaaauguaccacauuuucuguauccauuccucuguugagggacaucuggguucuuuacagcuucuggcuauuauaguuuuguucauuuccaucaccuuuugcauguguuuuccuguuuuucuuuaaggauuuuuaacucuuuagcaguguucuccuguauuucuuuaagugaguuauuaaaguccuucuugaugucuucuaccuccaucaugagauaugccuuuaaauccgggucuagguuuuuggguguguuuggguucccaggacuggcugaggugggagugcugcguucugaugauggugaguggucuugguuucuguuaguaagauucuuaugucugccuuucaccaucugguaaucucuggagucaguuguuauaguugucucugguuagagguuguuccucuugugauucuguuauucucuaccaacagaccugggagacuagcucucuccugaguuucaauggucagagcacucucuacaggcaggcucaccucuuucagggaaggugcacagauaucuggcauucagacuugccuccuggcacaagaugaagaccugaaacaggaccugucccagaagcuguuagcuucuguaguccacacucucaacuguguauacuagucucagcaggauccagggaccgagguggcucccucagguacuccagcaaaccccuccgggacugggcggacaccucuguucuggcagggaaggugucuugaugucuggagcccgaaaaggggucugccucagaagcucugugguucccaccugucccagaagcuguuagcuucuguaguccacacucucaccugcacagacuagucuugguggaaccugggagccaagaugucuccugcagaugcuucggcaacucccucccgagacaguucauuuuauaucauuuauaaagaaggaaauuaggucagacugguggucccccaaaacauguuuaaaccuccaguggccuggucugcuucuuaaacaggccucaccaaacuucauauuccgacucucuggauaucaagguuggagaauaauacauucuagauguuucucaggggacaagaugccagaacaauuggagaucauuggguaauaagacuuaugaagucccuuaaaaguguacuccuauuucacauauauuaaaacaaacaacaacagaguucaguguuaucacaaaucaacaaaguuggguagaugugaguugggucuguagagagaguagggagcaaagaagaguaugaccgaaagugaaaagaauauggagagaaaucaacuauaguguuugucuguucagguguccuugugugaacuccccuuguuucuguaauaaacaaaugaauuagggucaucauucuuauuuauuaugaacccaagguaaacagaaugagagggaacagagagaagguacacguggaaucucuaagaaagugagauugcuguaaaguaacuuaccaaggcuuucaguaacaaaccaaagggcaugagaccucucagugucagacuaaaggacuaaaagggacuucaaaugcaacuuaaggggcuggagaauugcuucugugacuaggaaggcugcugcuucuccagaggagccgagucuuauucccagcagccuaguugggcagcucacaacugucuauauuucugacuccagagcaucaaacgauuucuucuuacuucuacacagucacacacacacacacccacacacacccacacccacacccauacacacagucauacagagucacauguauagcacauaaauaaaaauuguccuuuaaaaaauaauuuacuauaauucaauuuguuuuauguauuguuagcuagucuaaucuuaaauuucuuacuagcuguguauguuaagucaaaagaaacaugaaaaugauuuuaguaucuuuucauuuaaucugauauaucuaaaauaauucaauuucaaucucaauaugaaaaauaccaaaaauguguuucuuguucccucuccccaccccuagucuuugacucuagaguauguuuuagacauacagcccacaggaauucggaguggugcccaguagccacaguagucaauagcuacuguacucaacagaauuguuuuagccugaggugucauuauucuuguaaacacaucagcuuagcagagagcauuguuucuuuuaccuuugaggugaaacuuagaaagucucuuuuagcuuauuguuugaaauauaugcuuuuuuuggauuaccuuuuguaauuuuuccucgguuuuauaacauguggaauucugaauaaauaggaauagggaggauuuuguucauuuagaaaaaagaagaaaaaacacauccagccuaauugcuguagugcugggaacccccuugccagcauuaauaugccaauaucaggauggaggccagaguuguuacgggcaccuccauuacacucuccaugcuucccacugccccugcccuucuguuuaacaguugguuccagaacugauauuucaugcuauuuaaaagcuuugaauacacauuuucaagucguuaucugucagagugccuuggcauuucaacauuaaugucagaaaacaguacauuauuagaggaauaauuugucaaccuaaguugagggagaaaguucucacgcuguuuccagguuguguaaugaugccugaagucucucaagacauuuaugcagucaauacaaaauaaaaugaaucagaccaaagacaucuuauaguuuugaguagggaaauugacagcuuauuuacucauuaauuaauuaauuaauuaauucacuuuacauccugauugcugucuucuguccuggucccucccucccaugagcuccucccccaaccucccucuccuucuccucugagaggguggugauccuuccugguuauccccccaucuuggcaauucaagucucugcagggcuagguacacccucucccuaugaggcagacaaggcuguccagucaagggagcauauuccacagauaggcaacaguuuuagagauagccccugcuccaguuguugggggacucacaugaagauagagcugcacauuugcuacauaugugcagagguucuagguccagcacauguauguucuuugguugguucagucucugagagacccaaagguccauguuaggguccaugauggucuuccucuggaguuccuauccacuucagggcccucaguucuuucaucucuuccauaagaguccccaaacuccauccaauguuuggcugugggucucugcaucuguuuuagucagcugcugauggagugaaccugugagaggaaguuaugugaggcuucagucugcaagcauaacagaguaucauaaauagugucaggaacugguucuuguccaugagaugggucuuaaguugggcugguuacugguuggccauucccucagucucugcuccaucccuuuccuuguacuucuuguacaaggauaaauuuuggguugaaaguuuuguggauauguuggugucccuaucauuccaaaugggguuucugccuggcuauaggaggugaccucuucaggguccauauucccacugcuaugagucucagcuaaggucacucccauugauuccugggaaccucccccccccacccccccaggucucaagcaaguccucaagauggccccucugucagcugcagacuuccauucauucuccuggcccucuggcccucucuucuuucucuuccuacaccugauccugaagcucccccagucccuuccccauccccucucccacccaguucucccccuccaucucccuccuaugaugauuuuaauuaccuuucuaagagagauucaagcaucuuugcuugggucuuccuucuuguuuagcuucuguguguauccuguacuuuauggcuaguauccauuuaucuaauaaaauaaaaauuaaaaaaaaagaaauguaccuggguuugaauuuaaguauguacaguaaaauggcucaucacuauagaauacaucaaauaaaacuuaaaaaucuccuccauccaccucccaagugcuaggcuuguaagacuguaccuguguuuccauuuuuauacauuauaaaauugguugugaaacaauguucuuaaauuuuuuuauuggauauggucuuuauuuacauuucaaauauuauccccuuucccaguccuccaccccugaaaccccuauccuauccucucucccccugcuucuaugaggguguucuccacccacgcacccacucccaccucccuacccuuaguacuccuacacuggggcaucuauugagccuucaaaagaccaaagaccucuccuuccauugaugcaugacaaggccauccucugcuacauaugcagcuggagccauguguacuccuuuguugauggcuuagucccugggagcucuugggcaauugguuguuugauguugauguucuucuugugggguugcaauccccuucaacuccuucaguccuuucucuaacuccuguauuguggaccccacauucagugcaaugguuggcugugagcaucugucucuguauuuauagggcucuggcagggccucgcaggagacagccauaucaggcuccuuucagcauguacuccuuggcauccacaauagugucuggguuuggugacuguauauggggugaauccccaggugggacagucucuggauggccuuuccuucagucucugcucuauacuuuaucuccauaauugcucuuugugaguauuuuguucuccuucuaaggaggaccaaagcacccacacuuuggucuuccuucuuuuugagcuucaugugauuugugaauuguaucuugguuauugggagcuuuugggauaauauccacuuaucagugaguugaaaccauguguguucucuugugacuggguuacuucacuuaggaugauauuuucuaguucuauccauuuauguaaaaaugucaugaauuuaucauuuuuaauagcugaguaguacuccauuguguaaauguaccacguuuucuguauccauuccucuguugaaggacauagggguucguuccaacuucuggcuauuaugaauaaguggagcauguguccuuauugcauguuggaacaucuucuggguauauguccaggaguaguauagcuggguccucagguaauauaugcccaauuuucugaggaacugccaaacugauuucuagagugguuguaccagcuugcaaucccaccagcaauggaggaguguuccucuuucucuauauccucaccagcaucuguugucaccugaguuuuauuucagccauucugacuggugugagguggaaucucagagucguuugacuugcauuucccugaugacuaaggauguugaacauuucuuuagguguuucucagccagucuagauuccucaggugcccuaauuuuuaauaggguuauuugguucucuggagucuaacuucuugaguucuuuguauauauuggauauuagcccucuaucagauguaggguucauaaagaucuuuucccaauuuguugguugccuuuuuguccuauugacaguguccuuugucuuacagaagcuuuguaauuuuuuuaaaaagauuuauuuauuauaugugaguacacuguagcugucuucagacacucuggaagagggugucagaucucauuacagaugguugugagccaccaugugguugcugggauuugaacucaggaccucugaaagagcagucgguacuuuuaaccgcugagccaucucucuaucccugaagcuuugcaauuuuaugagguuucauuugucaauucuugaucuuagagcauaagccauugguguucuauucaggaaauuuuccccugugcccauaugcucgaggcucuuccccacuuucuuuucuauuaguuuuaauguaucugguuuuaugcagagauccuugauccacuuggacuugagcuuuguacaaggagauaagaauggcuccauuugcagacuucuacaugcugaccaccaguugaaccaaaaccauuuguugaaaaugccaucuuuuuuuccacuggaagguuuuagcuccuuugugaaagaucaagugaccguauguguguggguucauuucuagguuuucaauucuaugucauugauccaccugccugucucuguaacaacaccauacaguuuuuagcacaauuacucuguaauacagcuugaggucaaggauagugauucccccagaaguuguuuuauuguugagaauaguuuucaauauccugggguuuuuguuauuccaaaugaauuugcaaauugcucuuucuaacucuaugaagaauugauuugggauuugacggggauugcauagaauauguagauuucuuucagcaggauagccauuuugacuauauuaauccugccauccaugagcaugggagaucuuuccaucuuuugagaucuucgauuucuuucuucagagacuugaaguucuugucauacagaucuuucauuuccuugguuagagucacaccaagguauguaauauuauuugugacuauugugaaggguguuguuuuccuaauaucuuucucagccuguuuauccuuugaguagaggaagacaauugauuucuuugaguuaauuuuguauccagccacuuugcugaaguuguuuauuagcuuuaggcauucucuaguggaauuuuuggggucacuuaaguauacuaucauaucugcaaauagugauaguuugacuuccucuuuuccaauuuguaucucuuugaccuccuuuuguugucuaauugccccagcuagaacuuugaguacuauauugacuagauagggagagagugggcagccuugucuaguuccugauuuuagugugauugcuucaaguuucuccccauuuaguuuaauguuggcuacugguuugcuacauauugcuuuuacuauguuuagguaugggccuugaauuccugaucuuuccaagacuuuuaucaugaagggguguuggauuuugucaaaugcuuucucagcauuuaaugaaauggucaugugggguuuuuuuuguuuuguuuugguuuuuuguuuuuuguuuuuuuuuuuuuguuuuuaguuuguuuauauaguggauuacguugauggauuucuguauacugaaccacccugcaucccugggaugaagccuacuuuaucguggugaaugauuguuuugauguguucuuggauuccauugucgauaauuuuauugaauauuuuuacaucaauguucauaagggaauuuggucugaaguucucuuucuuuguugggucuuugugugguuuagguauaagcguaauuguggcuuuuuagaaugaauugggcaguguucuuucugauucuauuuuguggaauaguuugaagaguauugauauuaggucuucuuugaaagucugauagaacucugcacuaaaccucucuguuccugggcuuuuuuugguugggagacuauuaaugacugcuucuauuucuuuagggguuauaggacuguuuagaucguuuauuugacacugauuuaacuuugguacaugguaccugucuagaaaauuguccauuucauccggguuuuccaguuuuguugaguacaagcuuuuguaguagaaucugaugaguuuuuggauuuccuaagguucuguuguuaugucucccuuuucauuucugauuuuguuaauuuggauacugucccugugcccucuaguuagucuggcuaaagguuuaucuaucuuguugauuuucucaaagaaccacuacugguuugguugauucuuuguauauaucuuuuuguuucuauuugguugauuucagcccugaguuugauuauuucuugcccuguaagccucuuggguuuauuugcuucuuuuuggucuagagcuuucagguguccugucaagcugcuaguguauacucgcuccuguuacuuuuuggaggcacucaaagcuaugaguuuuccucuuagcacugcuuucauugugucccauuaguuuggguuguuguggcuucauuuucauuaaacucuaaaaagucuuuaauuucuuucuuuauuucauccuugaccaagguaucauugaguagaguguuguucagcuuccacauguaugugggcuuucuauuguuuuuguuguuauugaaaaccagccuuaucccauggugaucugacaggaugcaugggguuauuucagucuucuuguauccuuugaggccuguuuugugaccgauuauauggucaauuuugaaucagguaccaugacgugcugaaaagaagguauauucuuucauuuuaggauaaaauguucuauagauaucuguuaagauccaguugguucauaacuucugcuaguuucacugugucucuguuaaguuucuguuuccaugaucugcucauugcugagaguaagguauuuauguuucuauuauuaugugaagugugaugugugcuuuagccuuaguaauguuucuuuuaugaaugugggugcccuugcauuuggagcauagauguucagaauugagaguuauuauugguagauuuuuccuuugacuaguaugaaguguccuuccuuaucuguuuugauaacuuuagguugaaagucgauuuuauuugauauuagaauggcuacuccagcuuguuucuuuggaccauuugcuuggaaaauuguuuuccagccuuuuacucugagguaguuucugucuuugucacugaggugcaguuccuguaugcagcaaaauguuggguccuguuuacauacccagucuauuagucuauaugucuuuuuauugaggaauugaguccacugauguuaagagauauuaaagaaaaguaauuguugcuuccuguuauuuuuguuguuagagguagaauuauguuuucguggcgaucuucuuuuggguuuuuuugaaagaagauuacuucuuugcuuuuccuaaggugucguuucccuucuuguguuggaauuuuccaucuauuaucuuuuggaaggcuggauuuguugaaagauauugugugaauuugguuuugucauggaauacuuugguuucuccaucuauguuaacugagaauuuugcugguauaguauccugggcuggcauuuguguucucuuaaguucuguaugacaacuguccaggaucuucuagauuucacagucuuuggugagaagucugguauaauucugauaggucugcauuaauauguuacuugaccuuuuuucucaugguguuuguaaauucuuucuuuguuuuguguauuugguguuuugacuauuaugcauugggaggaauuucuuuucugauccaaccuauuuggcgaucuguaggcuucucguauguuuaugggcaucucuuucuuuagguuagggaaguuuucuucuauaauuuucuugaaaauauuuauuugcccuuuaaguugugaauguucguucucuucuauaccuauuauucuuagguuuggucuuuucauuguguccuggauuucuuggauauuuuggauuaggacuuucuugcauuuugcauuuucuuugacuguuguguuaauguuuucuaugguaucuucugcaccugagauucucucuucuaccucuuguaucauucuguuggugaugcuugucucuaugacuucugaucucuuucguagguuuucuaucuccaggguugucucccuuuaugauuucuuuauuauuucuguuuauaauuuuagauccuggaugguguuguccaauucugucacuuauuuuguuguguuucacugaaauucuuuaagagauaucuguguuuccucuuuaaggacuucuaccuguuugccuauguucuccuguauuucuuccuguauuaagggaguuauuuauguccuucuuaaaauccucuaucaucaccaugaagugauuuuaaaucagacucuugcuucucugguguguuguuguauccaaggcucacucuggugggagaacuggguucuaaugaugucaaguagccuugauuucuguugcuuauguuuuuguccuuuccucuugcuauccgguaaucucagaucuugcugucucugacuauggcuuuucccuccugcaagccuguguacuccuaggagaucaaauuucucugggaggcauuuggguauggagagcuguagcacagguucaguuccgggcacagauggaaaccagaaggauauauuaagcuuuuuauaaucaucauuuccucuucuaccuuagguagcuuuaagccuuuucucuggaccuuuuauaauuccugcuacauaucacuuguguuucaaauccuugucuuauuuuuaauacucaguuacuucaucgugguuucacucucuagaaagauucacaugcaugcauaauguuccggugcacacccagucaugcccagcuucauuuuugcaacacgacuuccauugucaccugggucucucuccuugguccucuaaaccugucccuguuaccuaaauagcuacuagaccaaucuuuuuuaaccuuuaauaaaacaaaacaaaaagucucuuuggcauucuacuguacuccaacagaaugcuugauuguucuacaguuguauugggugaauaauuuggaugcccagaucuuucaggccagccucaagcccuuagcucucaggccacacuaauaguauccuggguuucagcuggagacuauguguaugcucacucugacaaccugauuuuaugucuuuauuaaaaaauaaauaaauaaauaaagauuccuuuaccuaauagccugggcugccaguagaaacauuaggguuaauuggaugucuaggagcuguuggcugccuaaugugauauaauuuauucuauguauagugauagacaggaucaguaaauggggccaccagaucauuaaauucagaucucuaugaauaaguugaagcaaugcaaguuuauguguacauaggugguuauggagagcuguuguucuggugaccaguugucuaagguucuaaacuucuguguuccuuuguauaaaacacagcucuacagcaucuaguuuaugugaaugucguucagcuaaaagagaugcagcacuugauguguagaagaucucagugcaguuugcucccacucuuguguuccacuucuccccacagcucuucuuucuggcauuuauuucaaugucauuaguuuguacaauaggaaacuaagcuaaacuaagugccugguacauguggagcaacaaauggcuuagauucaagugacuaaugggaaugcuguugucugcgugauuuucuaagcauaugguaggaaggcauugggaagccuuagucauagcuucuauugcccuagcuucuacugcccuccaucccugaagaucacuggagagccauaugaugugagagggauuuuguuauaauuggcgucucuuccauuuuaaacucuggaggucuaaucaccucuaaggcaucuuuugcuaaugcuuugggcuuuguuuguuuguuuguuugucuguuuugaucacaugacuuauuguagcuucucuguuuuacacuaggauuucuugugcucauauuaccuucaaugacauaguguauuauaaacauuauaaauuacauguccugaauauacagaacacuggaugaaagcacugacccccaggagaagaaaauagagcuuguggaauugacuguccuuauaaagcccugcuuuaucuuuagaacucaucaaggcugaggcucuucaacgccaccuccaccagcuucuagaaugucguuauaaugcacagaaauagugaggauuuuguccuaugucacguuuugaaauuaggugccacauugccagcaguuuuuaaaugggcaaucguugggcagccuuccauaaugacccuaguuuacaucuuagccaggcuggcaggaacacaucacugcgacagcuccagaauguucuuacaugcugcugacauccuguggucaucgcaaaaagaagcacuuucguuaccccgugucgcuuaggacucuucuuugaaguuaccucuugcgguugacauuucucuuagguauaaucuacaaccuaacacucaguaagucuguuccaaguucagaauuuacacuaguugaaaaaucuucauggagccuuuugugugcauaauauagacuucguuaaugucacguauaacaacucaucuguuuuaugggaacacaauuuugguugucauauauaacuauuuuauauauaacauauaacaccucugaggcacuauaaaaagacuuagcuuaauguuguaccuggaauucagagcccaagaccuagccauagacuauauaagguaccuuagccuauuuuucuuuugcuauacuagaauacauacagauggguuauuuauugagacuaggauuacuuaacucaugauuuggaagcugagcaaucuaagaccaugggcuuauaucugauaaaggucuucuuucuguuggaaucuuucuacugugccccaaaccaucugaugacaccccaaucagacaaagcugagaggaccacacagugagagagacagagacaaaaguauuuuuauaaaagaccugcacaggagauaaccacuaaccuauuaagccauuaguguaugaauauaugaauggauuuaaugacauaguuuucucuuauaguucccaugggguugucaccaguggacuuuaaguuuuaacauggauuuuugugggacauucauacuauaccacaagaauagcucaguugacggcuuggaugggagucuguugucuggguuccuuugugccuauacacaggaguuagcuuucucagauaguguucuauucccaaacaccuaugaguaugucccccuuucuugugauucucuuccuacauaaccucugccagcuaugucuaccaagcugugacuuccaaacuucauagagggaaggaaucugagggauucaugcuccuaaacuccaacccccagggaucugaaucugaagauaagggcaagacuuggcugugguggcuugcucucacuguccuucccuguucuauuauuacuauuauuauuauuauuauuauuauuuauugugcgaccacuaugucaguccacaugcaucuaagguguacauggaacagccccagaaauagaagaauauggacaggucagguaaagacaacugcacagauggcacagcagaccguggaaaccaaauugcaggcagacuucuaagaauucucaagucuaagcagagaaaaggacacugauucuaaucugcuucuccuacaccauauuccccagacucugcaagcagcagguucagccuuaaaguagccuuuucuuuacgucugcuugucacgugccucugaguggggagggcuggagauggggagaguggcuugcuucaguuucuucuuaucagagcuaauuaaauagaaaaugaaaaaggaaaccacacagugauagagauacgaacuccccuggcaaagcacacagaggcagaaaggauguuuguguagaaaugagacaagaaaagcccuugaagaauuuaugcaaagaggguccuuacagagggagaguugcagacaguccuuugucuucuaaagauauccugacuacaggguguuucuuugucagccccucaagugcacagcuuuauuuacaauuggauagcaucaacacugaagaugaucuuccaugaaaagaccucaccacaggaggaaugcucugcugcuuguucuaaacuaggcaagagaagcugugaaugauccuucauucacacaagaaccaguuauuuaauggaugaggucacuaacugcauggaauuuacaaccugauggagagaaaauuacagagguauagacagucacagggacaggaaguaaagaaggagggacucacacaggcucuagcacucuggagguggggaaguacuucaacagaagugagauuucaagggugcauccagagaggucuaaaagaacuagucaagaguaaacaagagugacaucccgugguugggagaugagauggugugagccauauuugagaacugagaguaguuggcuuauccaagcuggaaagagaugaggcuacaacauuaauuugccuagaacaagaccguuugcauuguguauuuagcccuguuuucuuuauaccucagacuucagaaauuagagcuaguucuguaauguuugucacaaacaggaacuugagaaaagacaggaguagagaagaaguaaaccugcaucaauccucagaagagcugacucaucagcuugaccaauggcuagcuucugguaguucccaauaccaauagaaaccuuucauuuaacugaaaacuugagucacuacaucuagauuaugcaaagagcaggacugcaacuggucaguuuuaauugccaacuugucacacacuacagucaccuaggaaaugaguuuuaauuagaaauuauaucuggcuggccuauguacaugguauggcauauguacaugugguggacaggcuugauuguuaguugauagaggaaggcugggcucauugugggcagcacuauccccuaggcagagaguccugaagucuaugagaaaggaagaagcaagaugagaggaaguaggcaaggauucccauguuauauucucacucggaucuugacaguggaugugaagcuuuaagucccugccaugacuucuuggaagcaauaaacugaccugagacuauaagccaaacacuccuaucuuugcuaaguugcuuuuugucgugauguuuuucacaguuacagaaaugaaacugggauaaugacuuacaauaaaaguccuauuuuccuccuggcccucuggaacuuggacacacaauagguagcaggugcugaugcugcuagagccccacaaaccccgaucuuguauacuaagucuuucaggaacuacccucggaugggacacagugcauauguugcugcguuuucauagcugcggauggcagugcuguguggaccuucaugaaggggaaauguuauacuuugggcauugucucaccaaaaggcucauguacugaauccuuacugaauccuugguuugcagcaugaggcaguauuaccuggagguuguggaagcuuaggaagugaaucggagcugcaggaaguaggucauugugaugggacucucggaaguuuguugacaaggccccgcccuauugggcucucugcuaccugauuaggcauguacuggaaagccacacacucuugccgccaugauguucuuucuaaguguauggggccaagugaucauggagugaagucucuggaauuaggaacccaaauaaauccuuccuccucuaaguuauuuccaucagauauuccaucuuagcaauaaaaaaaaaggauacaaauuaaaaaaaaaguaagaagcuggcaaauggguuuccccagacucccccaccuuccucugcaccuacguguauccucauuacagaccugugauaaagcuuagucaugaguccuuccagagaaggagggcgugaugguuuguauguuuggcccagagaauggcacuauuuggagguguggccuuauuggaguagguguaucacuguaggagugggcuuuaauacucuaguccuagcugccuggaagccaguauucugcuaacaaccuucagaugaagauguagaacucucagcuccuccugcaccaugccugccuggaugcugcugugcuccugccuugauaaugggcugaaccucugaaccuauaaaccagcuccaauuaaauuccuuacaagaguugccuuggucauggugccucuucacaggaguaaaacuguaacuaaaacagaggguuuugaugaccucugacaaacaugcucuguauauuuaccuacauuuuuugaauuaauaaauucagcaucaacggguagaaguauuaucuagauacaguuacauaucuguaaucccaguaauaaggaggccgaggcaaaaggauugcagggccauaguuguccugaggauuggcguggugguacacagccuuuaaucccaguacuccggagccagaggcaggaagaucucugugagauagcaagugccaggacuacacagauuuucuccaaaaaaaguuauccugggccuccaaacaaacagaaauacuacucucauuuugcauauggugugugugucuguguauaucagaacuuugaguucucaccauaccuccccacuucauaaacucugcuauaaauuaugcuguuguuuugcuauacugggaauugaaccaagggcuuugugcgugcuuggcaagcacucgaccacugauugaaauccccaaucucucugaguuacucuugacuuuaaccuugaaguaucaacaauguguccauucugagaaguguacagauaggaguuagcagcuccagggcgauuuacaaucacaggaugggaaaauauuucaacacuggcaggauuccuucggauguuuauaagcaucccaagaacuauuguuuuucuuuucucgacuaagugaagggauacuuaauuguuuaaccccugggguacuaaaugaaacugcagcaucacagugcaauacuguaaugcagauagugucucuuguugcauucaaaguguauuagcaaugacacauaugcaugcacaugcuguaauaaggaaacccauuacuucauaugccaauuuaaaaauaaauuagaaagugcauugauauuuauagcauaacagccacauccuaggcacuuugacaugauuuaugucagaaaauuggaacaauugaaaggaauuccuuugaucuuugaucaagcuucagaugguauccaaaggaaauuauaucuuaccagaaaacccuuggauuacuuagggcuucaccuucaguuuccagagucccuuggaguucugcccuuggacugagugccugcugaacagaucccucagauggaccucagagcuuuaccucaucaucucugucuccuucugaaccagagagagauggcuuccugcuuucucuuuaaucucggagccuuuucugcagcuuagaagcacagaacgccaccucuuaagccuggcuugguuugcuuuugcccagcauuucuugucuauuuggagaauauuuacagcucacaaguggguucuaacauuuaaggucugcuaagaggcacaguguuccagcaaccucccaggagcaugcaguuuacuguuuuuuauuccugguugucuucucuuccgaucuguuuucuuucuucuuugucuucacucauccauccuguuagaguguucucucagcugaccauaagaacuuacucuaauaccugauuacguacggaguuaaguguuauauguccccuucaauguucugaaagcaaaugagacuuuuccccccaauuuuauuucucucuucacaacugauuaguagaaauuccuuuuguucacguggaccuacaaucucuuaguuauguuugaacaggaagauuacauuguuuguuuaguuuuuguucugcgucaauuacuggaccagcuaauguaaaguauuuuuccugugacugauguaucuucuuaguugguuagcugccaacagauuuuaguucugaccaaagcaaauguuaucuguguuugccuucuguucagaggcuuaaugccaugagugugguaagauuugcuuguguuugcagcaucguuaguucugggaaaagguuucuaagagcauacaggaaucugaaagagacugagcccagggcccauaugucugccuauguagugcccaguugguagagcuguuuggaaaggagaaggagguguguccuuauuggaggaggaguaucacuagcgguguggguguggucuuugaaguuucaaaagcccaggccauucccacuuagcacucccucugcuuucugcuugugguuuguuacggaagcucuuaccugcugcccuagccaacaugucugcugcuugcugcccugcugcccuggcgugaugaacucucacccuguguaaccgguuccuuacauucguugccuugaucaugguguuuaaaacuaagacagagugcacuaguagaacauuucuuuuuuuuuuuuuaaucuucccaaagagaaugguacccugcacacugugaccuuucgaauucucuauuuuagaauuccagagagacggucauucagagccuacacagcuguucuguauuuugaaccccggaugaaaauauuuauucaggccaaaagaguucaaacaaagcaucuguguuauucccucuacaaacccagguaacauguuuccuuuauuuccuugauuuuuuuuuuaacauauaaaauugauauaacuccucagguugucaagaggaaggcauugacugaugguaagagugucacguugcucucaggaaagacugaacacuucagggaacaagcaaaguuuggauaaggcucaguaggaauuggcuguucacuuucacgcuuugguugugauucuuuccaagaagagaacccaacuggagguguuuuugaguuuauauaguaguauguuagaacgauuaagcuccauauggucuuguuauauaguaauguucuucagaaugagauuacaagaaagugauuccauaggauuuuuaccacuuaauagugacguaagugucuuaguguuguaaguacacuguggcugcugaccuaguucucagacuguaacauaccaucccuaucauuaagcaauucauggccuacaguuaugcaugguaugcauauaggaugagcagauguauaaaauaccugauccacuuauauuuuacuacauauauuuuuauuuucuuuuaaaaguuauuuuauuuuauuaguuuauaucuguggaucuuucgucugcaugcaugucuauauaccacuuguaugcagcauucacugacagcaggauugggcacuggaucccuggaacugggguuaaagacaguucugaucuguggugcgagaaauugaaccuccgaccucuggaagagcagcaauugcucuuaccuguugagccauuuccccagccccuuauuuuauacacauauuuaauauaaaauuuaagcuugaauuuucauaauauagaaucagucuugcccaaauacuuaugaaguuccaauggucuuuucuuauuuguacuguuuuuuugucuguugguuuguuuuuucuggguagccauugauuuguagagguuagcacauuccaugugucagauuauacagguacagagacuagaaauaaaaaacgagucucacuuaaggaacuuacaauucacuaggagaaacaauguuuuaaugagggcuaaauagguaccuuuuacuuauauuauuuucuacaguggcuuugugguuuuguuuugcuuuaaaccaucaugauguuagagaucugaauaaaaacucaaaucuucugguuccauuuucuuuucuuuuuaccaguccucauuugguguuucucucuauauaucagguuacuuuugguaaaacaucuuugcuaucauguuguuauggugucaugaaaucucaacugcuggccuggugcuugaaaaacuccucaaagagauguaaaauuaaaaauacagauuaauucugugacuucaccaaacaacaguggauuucucaacagcuccaauuuggauuucuguucauucaugucaggcuguucauuuccuaguaaauaucaaacaguguuucaucuccaucaaucucagucuugugggagguaccaagggucuucuggaucugucagcuggucuuuucaaguuauuccugucuuagugaguuugguuaagaaaaauguucaagccacuggaaaauguauuccuuuccauuuucugaagagauuuuaauaagcugaguuuuacaacauaaaacuccuuuuggcgaacacuugcuguuuucaucuuaauauguuugccuucaccuucugaaaagacauuguuagcucuguacuggcagaaguaggcaauaugucaauguguguaugugugugugucgguaucacuagcuuccuuccuacaucauacccucuucaguauuuucaguaguaacuuggauaaaaaaugccaaaugugaauuuuuucaauucauauuugauccugaccuaguggaauauaucuccuaaguaguaccugaaacaaggugugaaaagaguuaaauucaauaaacaaguaugauauggacaagugacagaucgccuuuagauuuuauagaauaauuuauuuauuuuuaucuuauauacauuggcguuuugcuugcauauauaucugugagaggguauuggguccucugcaacuggaguuacagacaguugugaacugcaaugugggcacugggaacugaacccagguccucuggaauagcagucaguacucuuaaucacugaccuaucuaucuuuucaguccuagcuguuagauuuuuaaaacucuauuacauaagcauaggccugauaagcgauugacaugaaaaagugcauacgugccuuaaaugagccagaauguugguuuuaucucauagugugauauauaauaagauaacguguuacuuaaugugguuauggaacuuaguuguagaacuagacagucauagcaacaguuuacagggaaaaguccagaaucagaucuuuugaacggauagagaccauugacagaccagaggauugucccauggaggaaagaacacucugagugaaaccugaaaggcugccaugugguugauagaauuugggaggcagaccuuggauggcugugcagaagacagcguuagcucugcaugucauaguuaggcugcuuucacaaugaagagaugcguaacugaucuuuccccauugcugcuuuauacaacgauauucagagaaccaaguugagggagcccuuauagcugcuuuguguucagcuugccuuugaggugugggcagaaauaggucaauguuagaaaaucccuagccacuaagaggggaggccugaugcaggcagggacugagaaacaaagagcuagaucuuuuccuucaauauuuuauuagcagggaguguguguguguguguguguguguguguguguguguguguguuggggacauguagaggaauuuuaaucuagcaacauggcugcuuugaucacuucuuaaagaccuucuaggucuaggccuagaccuuuagaaugcagacaugucuacaugcacaccuuuaaucccaaacaauugagggacagacaaagugauaaaucagagaaagauuugacaucaugagucagagaaaggaucugcccaacucgcaggagaaaaacuacuuaagggcagcuuggggagagaaauuuuaguuucucagugaguugaguucauuuuaaccagucaguacaggaggcagugcaguagagaugaguucuguucaguucauguagcugaggcaguugaagccaaagaaugagaaggagccagaugauuugaacaaauugucagaguuagucugaggccaaacagagcaauucagugagaagccuagagaagucagauugaaucucuuggcuuggagaggauuugggccaaaagagcugagguaaaacgccagccagagcucaaaaagaacuagaaagugugagcuuauucagcaguaagccucugagaugacauuuacaucaggugaauaaaaguuauauuuaccagggggaggcacauaaaaaaguaucaggguggugauggcuuccauuucuggaauggagauuugaacaauuuuuuuuguuaugaggauguuacuauauuaaacuuuuagaaaugcuugcacaagguuuguuuaaauugucacaagaauucugaaguugcaguuguagacugagaugcagauugucuggggucagguuauaucacucaauugucaguuuauuauuuuaaauuaagcacuagugcagaguuggcaccucuagugccaccuuuacuuccuacaaaaauacuugaauagcuuaauucacauucuuugaaaaaugacuucauuguuuaaacaauaucaccuuaauuucauuuugauuaaaaaauaugauuugaccuaagacgaaugauucaaacuagauaaaauauaugauuagaaccugauuuuuuaaaagcaaaugauaauuuccguauauggucaccgauaauuguaugccuucaaggcuuaacuuugcaguucucugaguauagucaagacuaauuuggacuacaccaagguuaugauuugaaugagcaauauucaguguaaaagaaaaucaagagaacaaacuuauuauaacuucaccuuagauuuuagaaguguuucuucucuguagucagucuuuucucaaguuggacauugaacuuaaugacaguaacuacaaagcuaggccugauaauaaaaugcccauuacaccauugcaguacaagaauacaggauaccauuuggauuugauauuguccuguauuugguuuuuguuuucuuuguuuguuuguuugguugguugguugguuggauguuuuuauucucugaagugauucaagauccuuggauauucuaaauggacauucgcucccugagucuacacagccagucugucuuaguuaggauuccuguugcuaugauaaaauacuaugaccaaaaaaaaauuugggaggauugggauucuuucauuuauauguccagguagccauacaucacugagggaaguuaggacaagaacuuaaacaggacaggaaucuggaggcaggaacugaugcagaagccaugaaggaguacugcuuaccggcuugcucuccauggcuuacucagccuaauuuuguacagcacucaggauuaccagcccacggguggcaccacccaccaugggcugggccuucccacaucagccacgaauuaagaaaaugccuauaggacagucugcagcccaaucuucuggagacauuuuaucacuaaugucccccaccccuccagauaacaaccauaugucaaagggacaagagaaauaaauaaauaaauaaauaaauaaaccuagcacagaguccaaacacguaguuacuuuacaaauauuuguuuuuucauguuauuuacccaucaaauuuuacaggcuuuucauauuauggcaagaaaaguaauucauucucaauccacgauguauuucuucucuaaaacacacauagagggauuagacaauaauaacuuauacugagaaccaacauuguuuuaaguuauuuauuuauuuauuuauuauuagauauuuucuuuauauacauuucaaaugcuauucugaaaguucccuauauccucccuccacccugcuccccuacccacccacuccugcuucuuggcccuagcagucccuuguuuugggccauauaaaguuugcaaaaccaaggggccucucuucccagugauggccaacuaggccaucuucugcuacauaugcagcuacagauacaagcucugaggguacugguuaguucauauuguuguuccaucuauaggguugcagaccccuucagcuccuugugugcuuucucuagcuucuccauugagggcccuguguuccaucuuauagaugacugugucaucuuugccaggcacuggcauagccucauaugagacagcuaucacagggucccuucagcaaaaucuuucuggcauugugcaauagugucuggguuugguggcugauuaugggaugguuccccgggugggguagucucuggauaauccauccuuucaucuuagcuccaaacuuugucucuguaacuccuuucauggauauuuuguucccaaucuaaggaggaaugaaguauccacccauuggucuucccccuucuugauuuucuuguguuuugcaaauuguaucuuggguguucuauguuucugggcucauauccacuuaucagugagugcauaucuaaugacuucuuuugugauuggguuaccucacuaagguugauauccuccagaugcauccauuuguccaagaauuucauaaauucauuguuuuuaauugcugaguaguacuccauuguguaaauguaccacauuuucuguauccauucuucuguugagggacaucuggguucuuuccagcuucuggcuauuauaaauaaggcagcuaugaacauaguggagcauguguucuuauuaccaguuggaacuucuucuggguauaugcccaggagagguauuguuggaucuuccgguaguaguauguccaauuuucugaggaaccuccagacugacuuccaaagugguuguacaagcuugcaaucccaccagcagugggugaauguuccucuuucuccacauucuugccagcaucugcugucaccugaauuuuugaucuuagccauucugacuggugugagguuguuuugauuugcauuucccugaugauuaaggauguugaacauuuuucagaugcuucucagccauucaguauuccucaguugagaauucuuuguuuagcuuugaaccccauuuuuaaugggguuauuugaauuucuggaguccagcuucuugagcucuuuguauauauuggauaucaguucccuaucagauuuaggauugguaaaaauccuuucccaaucuguugguggccuuuuugucuuauugacagugucuuuugccuuauagaagcuuugcaauuuuaugagguaccauuuaucaauucuugaucuuacagcacaagccauugcuguucuguuuaggaauuuuuccucugugcccauaucuuugaggcuuuccccuacuuucuccucuauuaauuucaguaucucuggucuuauguggaggucuuugauccacuuagacuugagcuuuguacaaggagauaagaauggaucaauucacauucuucuacaugauaacugccaguugugccaggaucauuuguugaaaaugcugucuuuuuuccacugggugguuuuagcacccuugucaaagaucaagugaccauagcuguguggauucauuucugggucuucaauucuauuccauugaucuuaaagauuuauuuauuuacuauauguaaguauacuguagcugucuucagacaccccagaauagggcaucagaucucauuacagauaguugugagccaucaugugguugcugggauuugaacucaugaccuucagaagagcagucggcacucuuaaccacugagccaucucuccagccccuuaaguucuuuaaugagcuaaaaauuuuacuuccuauaacaacccugugagaucaguacacuguugucauccaacuacaaaugaugaaacagaaguucugcaaaugugauuggcucaaccuuauauuaauauagaggguacacauuagccugaacccaggcagaaagacucucugaaguccaauuuguguucauuuguucaugaagcuguuuugacuuguguaaucuguuuugcaucuguuaagauaauggaaaagaguuaucaauaaacuaaacagacuccagcuaucaacacuuugauuggugugaccuguuuauaucagcagucagugaaaaauuuacaucauugcuuccauucuuuaaaguuaccauaucaggcugcagagauggcucaguggguaagagcucuugcugauauuccaaagaacuugaauucagcuccuaccacccauauuuggaggcucacaacugccugcuaacucuaaguuccggggaucugacaaccucuuuuggccucuucagacaccucaaaaguaugacauauacauagacagguacauguugugguaaaucuccucccagccuucugcuccaccuucccuuuugccugccucaaucaucagcucuccuuuauuuuacaaauuaaggugggaagcagguuuaaaggaaaucaccugagugcugacucauuccuuguuuauagccacucacaggagaacagaauuaacaucaaauauaauuagccccagggcuauccauaacacauacacauaaauaaaaaaaaaaaaaacaaacgaaucucuaaaaacuuuuuaaaugucagaaaauauaaaggcauuucuagaucaggucacaauuuaaaggcuguuacucauggguugccaggcuguuucugaauguauauguaggaagcauguuaguaaggacauagacacacuugcacauuuccuguaguuuaaaaaccaucacaaaaugaugaaucagguaugaggcugucucagaagucaguggcucaauuuggcccauggacuguaguuugccuucccucguguaaacucauucaaugcacagauuuauacacugcuuuuuauccaucuuaggaaagcuugacuuuccgcaaaugaucucuguacuuuggguauguuuaauuaauagugauuuuacuaaucaggauucucuagagaaagaacuugauaguuagggacuuugauguggggauucaucacaugauuguggaguucaggaccucuuaccaacugcaguaugcaaacugguagcccaacaauaccgguaauauaguucagcuugaaaccaacugccugaugaccaggguaguagaugguacaucuuuuauucugaguccaguggcucaaggaccugggcagggaaugaguagguaacugacagcacaugcaagcccagaaucugacauucugauguuucaagacaagagaguugagugccucagcucaagcagagcuuggauuagccugucuucguuuuauguuucuacuccucuugaggaggugggcuaaguccagacacacugaugagagaggguugucuuuguucaucuguaucuugaaaugcucaucuccuccaggaacaccuugucagacacacuuggaaguaacauuuuaccagcuuucuggucaugacucaguuauguugacacauagaauuagcuguccugugccuuucuaaaugagauuuuugugacuggugggcuccugagucaauaggacugugagacagaagcacagagugagggauguugugcuuugggcuuucucaagucuaacauucuagaauguuccuuuccaugaugauuuaagauaaaauuuaagagccagguuccaaggauccucuauacgugccuauagcuuuaacuguauuagagugaccuauuccacuaaacuuuuucucguagaguuuuuuuaguuggcauauauuauucauaaugguauggguuuuauuauaacaugucuauuauacgugaacaugcauuucaaccguguucuccuccauuaaucucuuccaucuuccaaagcagccggucuuucuaccacucuacaugcaugaguguguauguguguguguguguguguguuuacaggacccugcgugggaacuuguuuauaccaaaugaugggaaagucuuucuuguucugcuuugcuacugcuaugguaaacaccaugaccaaaagcaccuuggggcagaaaggguuuauuucauuuuauacuucaaguucacaugaagggaagucagugcaggaacuccaaacaggaaccuggaggcaggaacugaagcagaagcaagggaagaaggcuguuuauuggcuugcucagccugcuuuuugacaauaaccaaucaccugcucaagggugguaccacucccagugcucugggcccuuccucaucaaucacuaaccuagaauauaugcacagacaugaucauaggcgaacgugaaggaggcauucuucucaauugaauuucccucuuuccagaugaccacuacuugugucaaguugacaaacagcuaaccagcucacuccucuaucagcuguuaucuguguauacauucucuugacaggaugcugaugggucugaucuugcacagaucuaagcauuuaaccacagcuucugugcguucuagaaugcagcuucugugucauguccagaaguugacaugcacauuuuucuuuaaaaaaaauuuuaaugauuuuuuuaaaaauuuauuuuauaugagaauauuguagcuaucuugagacacaccagaagagggcaucagaccccauuacagaugguugugagccaccaugugguugcugggaauuaaacucaggaccucugaaagagcagucagugcucuuaaccacugagccaucucuccagcccagcaugcacacuuuuuuuccuccuucugcucuuacacucuuucugauucuuuuuucugcaguggucuucaagucuuggagauaguguuagagcugggccacuuaugucuugucauucaaaguuauuucuucucuguucuuugacaaguugcgaguuucugcagucucugcugaccacugcagaaaagcugcucuugcuaaagcagacagcaguaugauucugugagcaucaacagggcuauuuuagaaggcaguuugacaggcacaucaugucuauguagcaaaauaacagcaugagcuuccucacugggggcuacgacugcaccccaagcuguaugcuauuggccagguuuacaguaccagaugugaauccccucccaaggagcagcaccaaguccaauaagaaagcaguuaguuacccccauaacaggcuugccacuguagcacaagugggagcaucuccccuggcuggaguccauagcuaugugcguauugaugauaauucuucccagaagccugcucagccccuuccugcccagggaaggcuagccagcagagaggacgcuuccagcacaguuccagcuugcuuucucaauguccugugacuaaaacguguggcaucguuaggcucuuaaccacuuguucuugugggaaagcaacagcaggagcaauagucuagauucguuugagagcuucuggagccucccgaucaacaacccguggaaagcugcaccuccgucuuaccccugauuuguuucccuugaguucauagauacauagauauacacacauauucccccccccucuugguuauucuagaaacuguucgcugucacuaaaacaauggaccuuaaaaauagaauauuucaucaagacagcagaaaguggggcuuuuaguaggucaaaauuacuuuuuuuuuuuucauuuuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaaguucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagacuuuuugcuauccucgguuuuuuguuauuccagaugaauuugcaaauugcuccuucuaguucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugauuguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuuuguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacaguguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccucugguccggaagguggccggcuguccccggcccacacagggugcugccucagcgccucugugcuucugccuguuccagaagcugucagguucucuggcacacccucucaccuguucagacuaauuuccuaaguucggcgggucucggaccaagauggcgaccgcugcugcuguggcuuaggccgccuccccagcugggcgggcaccuguccuccgguccggacgguggcuggcuguccccggcccacaaagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcuguggcuuaggccgccuccccagcugggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguccggcgggucucggaccaagauggcgaccgcugcugcuguggcuuaggccgccuccccagccgggcgggcaccuguccuccgguccggacgguggcuggcuguccccggcccacaaagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggccgccuccccagccgggcgggcaccuguccuccgguccggacgguggcuggcuguccccggcccacaaagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggcugccuccccagcugggugggcaccuguccuccgguccggaagguggccggcuguccccggcccacaccucaaaauuacuuuuuauguguuuuucugagcauuucaggcagagauaauugcuuggggacugggagaagucauuuauacagugucaaugaugagcugaucgagagagcuaugugugagagagcuauguauguuaacuggaaacuuugacaauggaggacuuuucgugaucuuguauucccuuuuugagaguucuccaguuuugcgcguguaagugaacaccugugugggaagagauuuuaaucucacucuggacucaugauuuccuuacugugaauuuuccucaaggaaaauugccauguauuaagaggcaagugaaguuuucauagguauggagucugcuaaugcaucagguagguggaacuuacucagugaaucuuuccuucuuaacaauugcauauuucaaccgggcgugguggcgcacaccuuuaaucucaguacuugggaggcagaggcaggcggauuucugaguuugaggccagccuggucuacaaagugaguuccaggauagccagggcuauacagacaaacccugucucaaaaaaacaaacaaaaaaacaaaaaaaccaaaaaaaaaacccaaaaacuaaaaaacaaacaaacaaacaaacaaacaaaaaaacccaaaaaaccaauugcauauuccuggaguacauagucuuacugaagaauauucucuuauuaaugcucuuuaaaaugauaaucugacuugaugauguucuuuucuucuucccagaaaauaccaauauacuacaucuucuuucaaagggaaguuuaaaacugaaguucaaaaggcagaagaagcaguaaagagggguauguugguuucuauggucaaaucauuaugguucauccacuuagcaaauguuaaucaaacacuuauucucaggaagauacugcucuaggcauuguggguauuguggacacugucacugucaggcaaaugcagcuccagucucuggaacuuaaaaugcauuauuucucucugguuuaauugugauauaauuuaguaacuuuuucacauuuacccucccccacaacuucacccuccuccaccguguguguguguguguguguguguguguguguguguguguuuuggucaaugaacaaccugcaggagucaguucuuuccucuugugauguagguucugggacuccaaacucaggucaucuagcuuggcggcauguacaugccugcuaguaugauaagccaugucacagaccuauaguuuagcuucguaagugugaucucugugcuagacagaguaacuauugcugugauaaagcacagaaagcaacuuggggaguaaagaguuuaccuuauucacuuucuauauaacaguucaucauugaaggcagugaggcaggaacucaagcggggcagaaaccuggaggcagaagcugaugcggaauccuuagaggggugguacuacuaauuggcuuguuccuuauggcuuacucagccugcuuucuuauagaacccaggaugaacagcccagggugauacuagcccucucacaccaaccacaaguuuauaaaauuuauaaaaugcccuccaggcuuuccuguaacccaauuuucuggaggcauuuucucaauugagcuuucucccucuuggauaacuguagcuugugcuaaguugacauaaagcuagccagaaaaauccccaacauauuaagaaugagugggugugucaugauguuaugguagcucauguuaaugauaaacauugccucuauuugaacuuggaagguuagucagcaagcuuucuggaucugcgugucucuaccccauagugcauguauacacacauguagccuugcccugcauuuuauguuggugacuggaauucaaacucagcuccucaugugggcacucuuacccacagcaacaacuuccaccugccucagacagaagagguaaaacgagugaucucugagugugaggcacugaggguguucagcuguagucuccaugccauucucaguggucauggcuacaaggauagaaagcaugugcuuagaaauggcuuggaagagucucuccgugacauacauaacuguuguguuuuugcuccuagcugaacuccuguuuaaagaggugcaagccaaaguaaaccagccggacagaauugcuuugucuucuacccagguaugagauacaaaacaucaucuucaaugaaaagccaugcccuuacuucccucccgcccccgugcacaguugucucugaucauguaguuuccaaacuccgaaauccagacaagcucaaaagcuaugggugguuuaagcacagguaaacagaagugugagugcagagagaggacaggaagcccagcgagaaagggaaaggcugagguggagcaaagaugagcagcaucuaggacuuauuuggagcagggugaaagagcuuuacagccgauuaaaaaaaaauaaaauagaagcacuaccaaaaaaaaaaaagagagagagagaaaauaaugaaaagauggcagaaaaauaucuagccuaugacgcauccucaaaaaaauaucuauucaaauuauagcucuccauggauccagauaaauggggaaagcaagaagaaggcuaauaagcaauccuucuuccuagcacuaggaaucauagaccauaauuaugaauauuaaucacaacacuuccagcuuacaaagcucuuuucuugugaguugguucgcacaguucauaaacaaucccuguaauccuuguaauaugcccacgaguaaggcacguuuauaaaggacuauaauuauuaauuauagcauacugcagcuaaccgaaaaagaauauagcugcaagauaugcacuguuagucugcucuuaccaaaaccauggcauaacacuuccaccgcggugauucauuaagcacugcaucaacuugcuugugugccaagagcugaacaggaaggaggagaggaauuccuucucuauuaccucugcuacagguuaaauacgugagucuuggcagugauuuggccuuaacucucagagccagggaccgggauccaggccacaggucacacggaagggacagagucagagaggguguguguuaaugccccaagcaaaguaagaucauggcuuuuccaagauucuuauauugcugcugucauuuuaaagaauaaaguaaaucuaucuuauuuuuaauuaucagugcccccugccuucuguauauaagagcugagagaaauaaucucguggcucagggucuaguuccucuucucugugccuuugccccaugcugagugcucuaucacgaagggcgagcucucuuuggccagcuugcuuuguaucucggaaguauccugguuacuuuaaugcagagaagaccgcaaaguggaaggaccugaacuuagaccuuucccaugcuuucaggaagcuuaaugugaauuccuuuugugcucuaccccuccccuuuuaacuuaaaagacaguauaagugcuguucugucagggaugcagccaagagugccaccaucaagagaugcucucaguaaaauaugguaggugaagcucuuugaaugucuuuuuuauuagcauaugcuguguacacuaaugaaucucaguagaauauuugcauacaugcauaggauacauuugaucacauuagcuccauuaccaucccccucugagucccuaugaaggucuucucuuuccaggugcucccuauaaaaaucuguuauuaucuaugagaacaguaauaauggauacuuccccuugagcauaguucgagggaaugggaacauacuacagauggggaggggauaaaucaauguaucagauuaaaaucaagucaggcuggaggcuggcuuuagagcauucugaaaagaaaaagcccgaggaaccuauaaauggaacauuuggguagugucaguccagcauuugauauggaggggacauaagagagggauacuaacaaaaguuauugcugaaauauaucucagugacugcagaguucaugcauugaauaagucacucaaguuuucauguaguuuguguuaaaaaaaccuucugcuucauagggaguaaaaugaaggcagagaggguaucuuagaaugugaaacaaaagaguaugguagacuuggacuuaggguguauucuagaaacacugggaugaagccuauugcugugugccuguugaguuccugccauucgaacugcaucagacacgaugagcugucucugcuaccccagaaccuucggauaauaggguaucagcucaacugacauccauucaauguccuuaugguuccucucaaucaaauauccuucuccaggaugcauuacagaaagcucugcaagacguggacacaaagcauaaaagucuucgccagaaacagagguaaggcugcggcuuucuguuggugaggaaccccaugcugggucaaguucuuauuucuaagugggcagauguuaugguaguuauuauuaugaacauuucucuuuauuagcaugugauauauuaugauaguaaaucuuaaugugaugaggcuuccccaacuaaggcacacauuguaaaacaugggugacguuuuuaucgauguguacauuugugucuguauaauguugaagacaagccagaaacccucccagaauuugucaguuuggacuuuaugaagaugucuauaugaagaggcccgagcaggagagcauaugacagcuucacuaucccucugccauuuguccuuuacuuuagagcuuaaaauuucaaauuaagaauuaacauuugaagggaugugucacuuauauguauuaaaauaaaaauggcaaagcuaucuuacaaaacaaauauuuauguuuguaaguuugacuuacucaccaucccagaugcugaguaaguuaaauaaauaaauaaauaaauaaauaaauaaauaaauuacuguugcacagaccaagucaggcuuugaaaagugacaucuuugagaaacuccauuucaagaaacagugguuagcucugaagauaguuuugaugauacauuuauaccuuuaaacauaagcuuaaaauguuaauuaugcagauaccaaaaguaaauuuaaaauauuauuaacauauuuccuaaaauuuaaauuucauggaaauuucuauugaaaaccgagauuuuuuuucuagucuuuagaaaggaaaacuuuguugauaacucauuuccagcuguagggaaauguauuaaaauuaaccugaaguggcaaugauggcaguugcccugaauggauuuauaggagagugcuaauuucucaauuaaaauuaaaaguuagccuacgaaguaaugaauggcaucgucauguucaugaaaauucugugguuuuccauuuuguuuuagagagucucacuauguagcaauagcugggcuagaauucacucuguggacuaggcucacaguuucuacuagccucugcuucuugagugacaggacuaaagaugugugugcacugccaugccuaugcuuguaaaucuacagaccaccaucuauaguauaucccauacuauagaguggggaugucauaucuuuugaugcucuguuuugggaauccaugcacuguccauauucuaguuuauugcagaauuauaaucucaugguuaaguacagauuuuugagaaaggcuuugaucgauauauuaccuuagguauauaugcauuuaguauuauauaauaugcaugucaguaacucauccucuacaauccggggaaagauccuacuuguggccauuuugggaugagaaaggaagauuuuuauaccuguuaccauuacaaauuaauuccuaaaaaucaucucucucagucuucaccauauccauguuuagagagacauuuuccccauguugcaggugggacacuguucaaguagcuugugauugccagguuacugugaacaugagccaaguuuguguuucacauccuggugcuuucuauagcuccauaagcuuccuuguacccuggagaucuguucccccacccccccaccccccuccccugccucucuaucucuuguuuucucucucucucucccuuccccuuuccccuccccuucccucccucccuuccccccucuuuuuauuaaguuuuuagcacuuaauaguaaagaaaaggaaaaacaaaacaaagcacuuuaucuagagggaaacaacaaugacaaaaacaaagcaaaacaaagacuguagugcuugcccagccugucuauguuccgggugaauuggcuuuauuagcuuuuauuuauaguuuuugaauuuuggcaaauguuggagaaaaagcuacagagaacauuuucgucacagcuuaaucuucaucaguuauuuagaaauuugacaacauaucccaagugggagauagaugcagugucagaaauguuucuuuuaagagccacauuaucauuuuuuuuucaauaauacuauugugaugacuauucuugccugucaacuugauuauaaauggaauuaacuaaaacacaagcaacuggguacaucuauaaguuaaauaauuaguuaaauaauuuaaugugggaagacccacuuuuaauccaggucuuuugagguggggaaauccaccuugaaucuggacuacaccuucugcuggcagccuauauagaggacacagaagcuggaagguuggucucuuuuccuguuugcccucacucucauuggcaaguccauuccuucacuggcauuagaacccacugcuuugggauucugauggauacugaagaccagcugagaucuccagccuuguggacugaacuacuacuggauucuuaccagaaaugcuucuagaucaacagaaguauaaggaugaguuuuuuagcaaucuagaauaagcuuuucaauuuguuaauaccuacaguuaccgaagccucuccugggaguguggagacuccugaaaacccauggcgugaacuaguuuacaaagcgaaggagacaaaugccucugguuacuccgauccaccaauugugagaggcaauggguuuugugacucccuauauaaaacuuugacaauuugugggaaaacaaggaaaaucaugauccuggucauuugcuccuaggaucucuggauaaauuggcaaaggaaaagaaugaguucugugauaaaaucaagcaaccucucacauuuccgugugguauaggaugacagugaacucagugguaaaauugacaaccuccagaugugcauuagcagucugauguuuucuaaacgugcucugggagggaaucuucucuccauuaacuacagaauuuacauuauggaaaaucaaugagaagccuucauuagauuguuggcugaauuacagcgaaaauucaaaccccagccugagacgauuaauugauaaagaauggaaucuucuaacuugggauagugauguaugagaggacucuauugagccugagaacuccaaacccucaguuuuucaagcauuuauuucaucuaaggaaguagucucuccacuuucagcaggagguguaccccacgccucugaaauauugcguuuuauaccuuugacaaaggaaauuuguucuucauugucuuuuaaacugucagucacuuucuuuaaaggaaacgucaggcgagacaauacugauguucuucagggcccaccaauaguuaucucuagaucuauaaccagaauuaacucuauccaggcuccuggagaggagauagaaagugcauaggccauggggagguacgcaauccuacugaagagcuuagugaguuuacuacuucauucaagcagaaguaugggagauaugugugggaauggacuuuaaguguguaggauaaugguggaaggaacaugaaauuuaaucaguauaauuuauugaaaugggccuagugacuggagauucuagguuuaauguagaagcuguacaguaaaaaagaaaaggugucaacaauuugaauggucgcugaagcauuugucaaaagauagcccacugaaaaggaguuggagaugucuucuaucucuuggcuuaguauugauaaagggauuuaagguucagagaaauugcagugcgggaguggguauacuguguacaauacuccacgaugggaagagucagaagcuaggcucuucacuaauccuauaagaugcaaaauggcaagaggggcaccagcgagcaugaagagauuuguuguugcccuuuuuuuuucuuguacuagaacuuggauuggagaugcuacugcucaguuggauggauuaaaagaagugggcuucauuggguccugaaguagcggagaucagguggcagcacugagucaaagacacggugaucauaguuauaaugggcagcauaggcaaagcaauguccauaaugauuugacccaugauguucagcauaggcaaugugauuuuuaugauggcaugacuucuaucuucuauggaccuuugauucuggguaaucaaucaugguguuuccaggcaugguauugauaagaagccuauugcauuuuuuguuucaucuauauaagcagaaaaauccucacaugaaagaaaggcuaaauuggauuaugagaaaagagaaucuuggcccaugaaccaauuuccagacuugagcccauuugaagacccaguacccuuucguuccccugaagaaccaucuuccuaaaauaccuaagaguuguacuguuagccuuuuucuaguccuuccccagagggacgaauggccuuuuacaaggagaggagaacacggggaaaggaaacaaucagacuuuucugggucuauuggaugcugguucugaauuaauacagacucuguuggaucucaagaaacacuguggcccuccaguuaaauuaagggcuuacagagagaggucaggucacuguggagccugacucacagugugcccagggaguuuuggaguucauccugugauuauuuucccagucacagaauguguaauugggauugauaaauucuaacguuuucaggaccuguagagugagggcuauuauaguuggaaaggcuaaaggaaaccuuuagaguugucucugccaaguaaaauuguugaauugaaaacuguaucacgucccuggaugaauaacagaaauuagugccacuacuaaguacuuaaaagaugcaggguuagugguucccaccacaucuuccuuuagcucuccuaucuggucaguagagaagacaaauggauuauggagagugacaaaggacuguugaacacccaaucaaaucgugacuccaauugcagcugcuguaccagaugugguguucuuacuugagcaaauuaacauaucuccugguacauaguauauggcuauugauccagaaaaugcccuuuucagauaccuguccggaaggaguaccagaaguaguuuuucuuucaguugacaaguccagcaguacaccuuuaccucaagguaaaauucaagaggccuucuaccucagugagauucucaggagucuaguguggaggacauguagaaauauuccuuaugagguaaaagauaaguuauuucacucccgccaccaagaaagaagaacauuuugugggucuauuuggauuguggaggcagcagacuccucauuuggaauguuacucuggcccauauaccaagugacuuggaaaucuacuagcuuugaguguagccuagaacaagagaaguaucuucaacaaguccaggauguuguucaggcugcccuaccacuugggacaugauucagcacaccuauugguucuugagauauaagugguagauagggaugguguuuggugccuuugugaagaggagaccuuugggauuuuggagugaagcuuugauaccaucuacagacacuauucucccuuugagagagagcucuuugccuacuauugggccugaaaguuugauaauuguccacaaaguuaacacauaaccugaacugcccauaaugagcugaguauuaucugacccacuaagccauaaaguaggacauucugaguagcaauccauuaucaaaugcaaaugguauauaugugauguguccagagcaggucccugaaggcccaaauagguuacaagaagaaguugucuaaaugccuaugguucuacugcaguuauagugccaucuccuccuaggcaugcaccuauagcauuauacagugugcccugugaucaggugacugagggagagaagaccagggacucuuuuacuguugguucugcacauuaugcacgcaccacccagaaguggacagggcagcauuauagcccguuucugggacaacacugaaaggcaauggugaugggaaaucuucccagugggcagaucuuaggguaguacacacggucauacauuuuguuugaaaggaucaauggccaggugugcaguuguugauggauucaugucaacggauuggcuggauggaccaggauuugaacacagcaugguuggaaaauuggugagaauuauaucuggggaagaaguaugucaacagaucucuccaaaugagugaaggaugugaagauauuuguguuucauguaaaugcucaucaaaaggugaugccagcagaggaagaguuuaguaaucaaguagauacaauaaccuauuuggugagcaguaaggcuauuucccuagccauugcuauauuuaaccaauggguccaugaaaauguagccauaguagcagagauggaagcuaugcaugggcuugacaaccuggacuuccacuugcacaaggcugaccuggcuauagcuguaguugacagccagaucugccaacaacagagacaaacacuggugcccuuaaguaaacaggcuaagaaaagaauaagaguuaagagggauacuugauccagauuaccaaguggauauuggauuuuuucuccacaauggagguaauaaagauuaugucuggaauucaggaggucuuuuaggguguauuuugauguuuccauauccuguaauuaaagucaauaggaaacuacaauaaccucaucaaggucggauuacaaaggauauaggauauauucccacuaggaaugaagguauggaucacuccuccaggaaaagaaccaagacuugaugagguacuugcugaggguggaggaaauacagaauggguaacagaggaagguaguuaugaaaugucagcuaaagccacaugacugcuuacagaaaugaguauuacaaucaacauggguguuucugucauauuuuguuaagaauuuguacagauauuuguguuuucuuuccucaauuucuuuaucauguaauuuaacaccaauuaaggggauaucaaugguuaucauauauaaguugagggauuaaaagaaugucucucaagagauauugccaccuauucuaaaaguuuauagugccuuuguggcuaugcgugggauagguauaucauguuagacauaauuaugacacaguuaaauauauaauucauuuaugauaguaggugggauagaaauauuaugauagguguaacuaugacauauuuauuguuuucauuuggaaauuaaacaugacauaaagagauaugauuguguguugagaugacaaagagugaacuugugaugguuauuuuugcuugucuacuugauuauaucuggaaugaccuaaaauccaagaagauggcuacaccugugagagacuuuuucuuaauuaaauaauuugaagacuuuuaaucuggaucuuuugggggugggaagauuugccuuuaaucugagccauacugucugcuggcagccuauauaaagaacaugggagaaggaaucuugcuuucuuugccuguucucucucucucucucucucucucucucucucucucaaaacaacuacuggauuuuugggccuuuugcugguagauaccuauuguuggauuagcuggacacagccuguaagucacucuaaccauucuauagguucucuuacuccagagaacucugaccacugugacugucauaccugugucaaacgaguaaacacagagauguuucugguccuuuuagauuuaagugaacagauuuguguuugcaugaauaccuguguaugaccuguaauuuacauauacagaauacuuggcuauauguagacaucagcuauacccaccagguuuuacaaagcaucugguauauuacagguuauucuuuugauguuuaucuuuugaauauauuaaaggauuuauaaauuuuaauuuuuccuuaauugagcaguuuuaaauaaccuuucuaaauacaauucuagggcccuaaggaaagcaagaacucucucucuguucuuuggagugaacacagaagaccaacaccaagcuggaauguucauuuacaguaauaaccgauugaucaaaauguacgagaagguugguccccagcugaaaaugaagucauuguaaguaguucauuucuccauuuaaaggcaguauagggaggccacaguccauuucugucuguggagcuagauguaugauugacuauaacaccaguagguguccuguucuucacucacucuuccucucacuauacaggaauugauaugcguaauuuauaauaugaugaagcugugugcugucuccaugagaaaaucacauuguaggaaaaaauauuguuucuaauauaugaccuuaugucuuucuauuccuuaugacaucucuucauguuucuaauuuuaccaauuaaaaaaguacuacaaauuaaagaaauguuaacagagaaaagaaaagccaaacucuaaucuuguaaggaaccauguuauggauuccguaccucuugucuugucaguuaucuaagugugugugugugugugcgugugcguguguguguguguuuccagucuguuuagaaucuagauuccauuuucuggugcuaaaguuccauaaauugcuuugacaguuauguggaaucuugcaaaggcaucagaggaauagagugaugguccaaauauuaaaaagguuaaucucacaaccaaaaagucaaagggauagagucagacaagauguccaagagugguagaaggacucagggggggucuuuggucuucuugccgccuuuugcucaggggagucgcucuucauucauuguucaggcaaaagcagguguguugcuaucucaugugcuaagcucuauggacacgaaggucaagggcacucaccuuuugcugaggaucauuagugcacuuuaauacugugcacggacagugaaaacaauauuucuuuauuaucaguuuuaagcuuaacauauacaguggccaguuucaucauggcaucuucaugcauaugcaucacuauaguuuguuuucauucauccccaucuccccgugcucuuccccauguuccugucaccauguuccugucaccauguuccugucccuucuagugaaugcccuuucuccucccccagccccccccccccccccccggccuagugagucugcuuuucugcuuucaauuucaugcuuuucuuaagaucucuucccuuccuucucgugauccuuuuucuaguucucuguccuuauaaauacauucauaaugcacgcucccauauauauauaaauauaaauuuaaaacauuagagaaagugggcucuguuuguuuuucugagccugacugacuucucuucugguuguaugaaauuuucuuccaaucucauguuuuuauuuuuccuuauggcugaauaaaauuucauuucauauguggaccacauuuucuuuguccauccaucuacugauggauggcuaggcugaauccguuuccuggcauauugacuacaguaguaguaaacuuggauguauaagcaucucugggauagguuaacauagaugcuggagaaugaagagagcugggucaugcgguacuucugcuuccaguuuugugccuuugugacugcauggcuuugcauuucugccagcagugaagaggggcucuucuuuguccucaucuucaccagcauuuguuguccuuccucuucuugauugccauucuuacuagggcgagacaaaauuucaaagcaguuuuuuuccgguuucccugagagcuaaagauauugaacagcuucucaaauacauuuugguaauuugacuuucuucuuuugagaaugaucuuuuaguucauucauucgguauuuaauuuuuacacuuauuuguccuggauauuaauuucuugucugaugcauaccuggcaaauguuucucccacuguguaagcuaucauucuauacucuggugauuauuaacucuguugugcaggggcuuuuuaauuucauaaucccauuugucaauucuugggguuauuucccacacuacuagaaucccaaucagaaaaugcaugccugugcuuauauuuuugagauguuuuucucuguguuucccccuagcacuugcaaaguuucaguucuuacauuguggccuuugauccauguuuaauuaauuuuguggucagagugggagauagggauccucacucuucuaaguaugaaaauucaguuuucugagcaccagucuucucugcaacguauguuuuuagcagcuuugccauaagauagaugauuaugguuguguaugcuuguuucuggguccuccauucuugguucacagaucuguuuuucugucagcuccaugcucuguguuuaaguguaguccauaauacccaguguugugauucucuuccacugauuuuucugcuaaggguuguuuuuugguggggaggggggauaucuuuacuuugugcuuccauaugaauuuuaagauuuuuuuuugguuuggugagaaauguuauuagaauuuugaugguauuccuuugaaccuguauauuugguaauauauucuuuucacaauauuaauuaucuuaauccaugaacaugggagaucuuuucauguuucuuucuucauugccucaaagauguagaagucuuuuauuuccugacuuagguuuauuuuaguuggauuuuucugauacugugauggaauuuucccauccucuuauuauuugguauuuuuaaaagcuauuauguuauuuucauguguaaacaauaugugucaauacagguaucaaaagauaaaaaaaaacaugauuauugcuacugauuuguuuauacaagaaacuuuguuucuugguacacuucuggaaggauuuauggggccuaaguguuuucuggugaaaucuuuaagccaucuucagcacagaaguauguuaucugcaaguagggcuaguugaguuuuucuuucuuauguguagagugauuuucuuuuccuuuccuuucuuuucuuuucuuuucuuuucuuuucuuuucucuucucuucucuucucuucucuucucuucucuucucuucucuucucuucuuuuccuuccuuccuuccuuccuuccuuccuuccuuccuuccuuucuuucuuucuuucuuucuuucuuucuuucuuuuuuguuuuuuuuuuguuuuuuuuuuuuuuuuuuuuccagacaggguuucucuguguagcacuggcuguccuggaacucacucuguagaccaggcuggccucaaacucagaaacccgccugccuuaguuggcuuucauugcuugaaaucuuagcgcaguuagcuuagcauuugcuaacaaguuuccuguccuuagaucuucccacaauuggccuucgaaugcuguucaggcauggaugcuaaagcccuuccuuugauuaccuaauuaaaacugagcccuauugucacacccaucugucacuuuucacauaauuuagugcucaauuuauuucccuaaaaccacuuaucaccucguaacaugaucccuguacauuuaucuauuugcuaaugucaugguugucauucuucagugagugagaccuagggaccuugucuuuuuugcuuucgucuaagucccuaguuccugggacagguccaggugcuaacuuugaauggcugugugaauaaauggauggauaaaugaauaaaugaacguugugugagaagggcaguaagaaaacaggaaagucacaucaggcuuucuguuucagacauaaauuuagacucacagaacauguuaccaagaaggacaugguagaagagaaaaguugugaaauaugaagccaucgggggccucaaguugagaaagagugauauauccuauggcaaaaguaaugaggaaccaaccuccuguauucugggacauggggggcuuucccccaaauccuguaaugcuaaaauugagaauaucccagguggauaaaauugagaauaucccagguggauauacccugugccucuuaucacccucuggaccuguuauguucccuuacucgagcucugugaaugccuaagagccucuguaauggugagauguguagucugacaaugaaaugggaacaaagaaaguaguucuuuuuguccaguaucaagcuuaaaggugcacauugggucauugcaugaagauacuggaguuaugguugguuuugcuaaaauuuauuccuuuuuaccaaccugggauccccacaaaaguaccagguuuggaaagaguauuguuaacaggccaguaacauucugagguaacaucguagaacagaaccaagcucaccagaaauccagugcauguuugccuuuucuuuuucuuuagccugauuuuuacaaaguucauacauguguuuacucccucagacuuggugcagguauaauuggaauugugaacauaccuuuggagaccauggaaccaucccauaauaaacaagaauuccucaauguccaagaauacaaucaucuacuaaaagucaugggacaguacuugauccaguacuguaaggacauugggaucagugaguauucuguggucauaguaagaguuaaggggcucaaacuugggauugauuuaaggugaaaagauuguauugauucaaguaaccaguagcccaaagcugugaagaaaggcuucugcuuugaaaacuuaagaggaagacugggaauuuggcguaguuauagaacccuuguuuaacuguggauucuguccucagugguacaaaaacaaaucaauaaaaagggaaaagaaguuaguucauauugauguuccuucuauggggcuccagaccccuucagcucccuggguacuuucucuagcuccuucauuggguaccuugugcuccguccaauggaugacugugagcauccacuucuguauuugccaggcacugucagagccucacaagagacagcuauaucaggcuccugucagcaggcucuuguuggcaucugccuagugucuggguuuggugguuguuuauggaauggauccccaagugaggcagccucugaauggucguuccgucaggcucugcuccaaacuuugucucuauaacuccuuccauggguauuuuguuccccuucuaaaaaggauucugagcuucuggguuccacuuaucagugaaugcauaucauauguguucuuuugugauuugguuaccucacucaagaugauauccuccagauccauccauuugccuaagaauuucauaaauucauuguuuuuaauugcugaguaguacuccauuguguaccacauuuucuguguccauuccucugcugaggaacaucuggguucuaaccaguacccccagagcuccuuggaacuauacuaccaaucaaauaaaacauaugguggaacuuguggcucuagcuauaaauguagcagaggauggccuaguuggucaucaaugggaggagaggcccuugguccugugacgguucuaugccccaguauaggggaauaucaggaccaagaaugggaguggguguguuggggagcagggcaggggggaggggauaggggauuuucagaggggaaacuaggcaaggagauaacauuugaaauguaaguaaagaaaauaucuaacaaaaaacaaacaaacaaaaaaacacauuuauguguggaccgggcuggucagaaauccgacugccucugccucccgagugcugggauuaaaggcgugugccaccacacccgacuacacaaauacuuuuuauguguuauguguacagacaccacaaucauagcaacucuaauaaagaacuacauuuaauuaggaaaaaaaaagugaaaagggagccaauuucagaaucuuccccagaauaucacguaaaaaaucaaagcaucaguugggcauuguggugcacaucuuuaguucuagcacuugguggguagaggcaaguggauucucuuugaaaucuaguacagccuagucuacauagggaauugcuagccacgcaggacuacauaguaagucucucucucucucuccccgucucucucucuuucucugucucucuccuuucucucugucugucuccuuucugucucucacacacacauaugcacacacaaaaacagaucagauauuucaagaggaaagcaauuggaaagcagugugcugugguagcugaucauggcagagggaggaaaagggaggcagagagaggcagaagaauguuuccaagagauugaggaagccccucagagagucuccugagacuccacagucuuccuagagcacauaauccuacaugcuccuaagaaucucuugcuaucacauaccaugaaauaauucauaucaacucaugugacaguagauaggucaaaugguaugcuguaggucaaaaacuuacagaggauacuaacacugguaacauuucaauuaaaacuaaauguuucuaaacuuaaaagauaaacaauaguuaucugaaaaauuugaccugugucaccucacuuuccagacauacuuaaacaaugacuugcuguucuauguauuacacaaauacuucccccccccccccccccgagacaggguuucucuguauagcacugguuguccuggaacucacuuuguagaccaggcuggccucgaacucagaaauccgaugccucugccuccugagugcugggauuaaaggacugugcuaccacacccggcuacacaaauacuuuuuaacauaggcagccauaacacuucauuuauauaaaggaaauguguuagcuacuaugaaucuguucagugacuggcuugaaguaugcauaauacaaguguaucaaauauaguuuucuauugccaggacaacuuaagauguuauuauugcucugcuugaaguaguaacuuuagagugguuuuuuuuuuuuuuucuuauguacucauuguaauuccaccugaaaauuccucaccagcuacacagagggaaggauguuuaaauucacaggacaacaaagcagacagguacccuaccaagggugugcuugauauuguggucuguguugugaucuaugagcagcagcauccauacuguauacaucucccccucagagacauauguaaaguuauacaaggcacaggaauuaccacaaugauugacaggaucuacuuuaagcuguagaacauauagaaggauauaaauaucauaaacagugagagagaagccaagcauuugcuccuugguuuucaagugcuuucauuguacagacuggaaacagugagcauuacagagaggaugugacgagaacaaacaccucaugugcagaccuuaaccucccggccuuguaguaaggaaugaaguccccagaaagagguauaauacuuaggguauucuaguguguguguguguguguguguguguguguguguguaguuuacucaaccccuuuuccugguguguggguaccauuucuucuagucagauguuacuuagcaugucuaugucaauucuauuauuuacugucccuauucuaucuguaccacaugccccacuuuccuucaaaauccucucaagugauauaauauggcucaaaauaaauacuuuaucuguuucuauuaauauuacuaacauuguguuuuaaaucuuauaacucucuauggauuaauuuugggaugaagaaugcuuuuuaacaacauuccuuccuggaaggaagacaaugggaguagguagcaaacauggaccaugguccauucacuauaaauuagaauucagucauuaagaggaaccaaggagcagccugggacaggauccuucugguuucccuagugcccagagcuguuccuuugcugcagcucuccauacccaaauaccacugagagagagcaggucucccaggaccuguggccaagagggaccgacccagauccaccaggacacaagaaccaaggaacagccagggacaggauccuuccgguuucugucugcacccccugagcugacccugugccacaucucuucauacuuaaauuccucccagagagaacuguucuccaagaacuauugacacauaggcuugcaggagggacaagccacugucagagacagcaaggucagcuaacaccagagauaaccagauguugagaggcaagggcaagagcauaagcaacagaaaccaaggcuacuuggcaucaucagaacccaguucuuccacccugugagcccuggauaccccaacacaccagaaaagcaaaacucugauuuaaaaucagaucucaugauggugauagaggacuuuaagaaggacauaaauaaaucccuuaaagaaauacaggagaauucagucauugagguguggccuuauaguuucagugaccuucaccagaauagcaaaaauuauguaaugcuugacuaauacucuuaaaaccaguagaacaggccacaggguuuuaaugaaaagcauuugagagguuuuuuuuuucccuuauaaauaaaagaugcaaucuuuguauuugauguuaaucugaucuguuucuauggaaaacugggccguuguaaaacauugaaucagcagagagagaaaugcagaaggaaugacuuugugucauuucccaaaucugcaguucucuuuugacacaguggauccuaaggaaaucagaaguaguuuucuccagggcugaccuuaccucuccuuuggcuacuauuuccuaaauucuucuguauccuaaugaugcuauugcuauucaucagcuuugaagaguagggagggaagaagauagaaaucauggaguaaaauaucaaaugacauuugagguugaaugaaaucuauuauguagauagauaacauuuguguuauuaaauguggauuggaauugaacugauagcuaaagcacaaucuaugacuuaauggacauaaucuuucucaacaaaauucaccauguucuuaguuaacaacaacccccccccaaaaaaaaauaucacucagccuagucacauucaucuccuuaacuucacuguugcuuagcccugaagcauggcuuccagaguugcaaagauguuaccuucuucaagcuuccugugacucucaguaccacaguauuuuaaaauauccucauaccucuucagcuuucucaugguugcucauucaaccagcuauuguagggcugaguguucuagagcuggccagucaaaccugaucuaccuuguguagcaacuuuuaauccuguugccauggucugaauguuaugucaaccccacauuaauaacuugaaacccugacuccccaaaaggaugguguaggaggagggcacuccuggaagugguugggguucugacagcugaggacucaugauugugauuccuauuaaaaaaaagagagcaaguaagaggagagaggguugggguguuccaucccuggaccaggaugugaguccacaccugcauaucugccaguacauuuuucuuggacuugcagccuucagcacugugaggaacacauuugcauugcuuauaaaucacccagucuauguggcccaaaucaaccaaaggcccagggcuaaccugcugugacaaacaauuagaaacagaaugguugccuaauggagaagaauaagagggaagcugcagccagugucuggcaagcuuuaggcuuugggcuaauguuggagauuggcucuaaugcuuucucuuaauucagccugcaaaaagcaggaaucugcaugucuaaaugcugaaggacucuguccccaauuaguuuuugauugaucaauaaauagccaauggcuggauagaaugaaagagguggaacuucuagguuccagaaggaagaacaggguaggaggagaaagggcugccaggagaagggguuagaaggaccacacugggaaggaacaggagggaguaacagccaaaauguagguacaagaaggaaaguggcccccagaaggccugcccagaagcaucuugggcaacaaagagagggggccacccagaaggagccagggaaacaaagauaaaauauggauuuuagagguauuaagccagggauaccagaggggcauauuucauagcugcugggaguuuuagaagugccccaccauugagcuagucaagacguaucaagauuaagcuggcaugugugucuuucaucgugaauccagagggcucuggcaggugacuggaagugcccucacuucaccgcuacaggcuaaggaaugauacaucucugaggaagugauuauuucugaaggaggaaaaagaauggacaaacuugacucuucccacaugggccaugggauauaggguuaaagucuucucaguuguuggcccuuaagaucuuuaaagguuagucauaucucucuucugccuuuucagccuugacuuauagcuccaaauucauuguuauucuucauguggacagaauuuaugauuucuaccauucuggcauuuauacuuugagguaucaccuggaggaaaguguucuagaggaagcauagacagccuugacuucagugagaucaucuuucuuuggaguaauugcacuguuuucaguguagcguggugauacguuaacucucuuuuaaacauuuauuuauuuaugcacuugguagcccaauaucaacccuuccucuccccacaguacccccucauggaaauccuucccccauuccaacuuucccuucucuugaaggggguuagguguacccucucccauugaagccagacaaagcaguucuguuagggaugcuagauccacaggcaggcaggcaggcaggcaggcaggcaggcaggcaggcaggcaggcaggcaggcaggcaacaggcucagggacagccuuugauucagcuggugggggacccgcgugaagaccaagcuguccaucuccuguauaugugcaaggggccugggucuagcccauguucacucuuuggcuggugauucaaucucugggagacuccaacaguucagguuaguugacucuguuggucuuccucuagaguaagucccuguccauuucaaguucuucaguccaucucccaacucuuucacaggauuccucaacuucauguaauguuugggugugagucucuguaucucuuuccauuggcuggguggagcuucucagaggacaguuauguuagguuccuaucugcagucauaaaagauuaacauuaauacugucagcaauugguucuugcccauggaaugggucucaauuugagacagucaaugguuguccauucuuucagucucugcucuaucuuugucccugccuuguaggcaugauauauuuuggguugaagguuuuguggguggguagcuauccuuauuccuccacugggaaucuugccccuagaaguggcuacuccaggauccaaaucccccacugcuaggaauauagcauagacccucugggacgucuccucaucccagagauugcccccucaccccugccgaucucccaucucucuccccuguucuacuuacauaugaucuccucaccaccauccucccccucccaucuuucacccauuuccuucuauccauugacauccaauaucuauuuuguuuccccuucugagaaggauguuuccccuucugagagggaucuccuuguuauuggguuguuugggucuguugauuauagcaugauucuccuguauuuuauggcuaauauuuacuuauaagugaguacauaacauguauguccuuuugggucauggucaucucacuuauuugccugcaaaauucauauccuccauuuuaaugaccgagccguauuccauuguguagauauaccacauuuucuguauccauucuucagcugagagacaucaagguuguuuucuguuucuggcuauuacaaauaaagcucuauggaauaguugagcaaguguccuugugggaugguggaacaucuuuuggguauaugcccaggaguggaauaguugggucuuaagguagaacuaugccaaaucuucuuaaacaaaaaaaaagaaaaaaggaaaaagaaaaagaaagagagaaagaaagaaaagaaaagaaaagaaaagaaaagaaaagaaaagaaaagaaaagaaagaaaagaagagaaaagcugccaaauugauuuacagggugguuguacaauuugcauguccaccagcaaugcaggaguguuucccuugcuccacaaccuugccagucacgugcuguccuuugaguuuuugaucuuagcaauucagauggauauaagguggaaucucagaaucauuuagauuugcauauuccugauggcuaagguuauucaacauuucuuuaggugcuuguuggccauuugcuauucccauguuaagaauucuguuuaguucuguaccccaguauuucauuuguuauuuggauuguuuguguuaacuucuugaguucuuuauauauuuuggguaugagcccuuugucaauuuaggguuagugaagaucuuuucccaaucuguagguugucauuuauucuagugacauccuuuauguuacagaugcuuuucaguuucaugagcucccauuuauuaauucuugaccuuaaugccugagccauugguguucugcucaggaauuugucuccuacaggauuucuacuacgauuucaaggcuauuccccacuuucucuucuauuugauuuaguguaucucauuuuauguugaggucuuugauccauuuggacuugaguuuugugcagugugauaaguaugaucuguuugcauucuucuacauacagguauccaguuaguacaguaccauuuguugauuguacucucccuacucaauuguauaguuuuugcuccuuugccaaaaaugaagcguccauagauauguggguuucuuucuggguccuugaaaucaauuccauugaucugccuuucuuuuuauauaucaguaccaugcagugcuuguuacuauuucucuguaauauagcuugaagucagggauaguaauaccuccagaauuucuuguauucuucaggaucauuuuagcuauccuggguuuuuuguuuuucuauaugaaguucagaauuauuccuuuaaaguuuauuaaaaaaaacuguguuggaauuuugaugaggauuucaucgacuguauggguugcuuuugauaagauggccauguuuacuauguuaauucuacugauccauguguaaaggcaauuuuuccaccuucugauaucuuccucaauuucuuucuucagaaacuugaaguucuuguuauacagguucuuucacuugcuugguuagaguuacauuaugguauuugauguuauucguggauauugugaaggguccuguuguccuaacuucuuucucagccuguucauggcugggguagaguagggcuacugauuucuuugagauaauuuuguaucuagccacuuuccugaagguguuuuucagcuguagguguucucugguggaauuuuuggggucacuuauguauauacuaugguaucaucugcaaauagugauacuuugacuucuuccuuucugauuuguaucccuuugaccuguuuuuuuuuuuuuuaauuguucuagcuagaacuucaaaugcuauagugaagagauauagggaaaauggacagccuugucccugauuuuaguggaaauguuuaaguuucucuccauuuaauuuaauguuggcuauuggauuucuguauauugccuuuauugugucuagguauguaccuuguauccaugcugucuacaagacuuuuaucaugaagagguguuggauuuugucaaaugccuuuuugacaucuagugagaagaccaugaguuuuuuuccaguuuguuuauaaggugauuauguugauggauuuucauauauugaaccaccccugcaucccuggaauuaagcuuacuugaucaugguggaugaugucuuugauguguuccuggauuuggucuguagguauuuuauugaguguauuuguugaggcuugcuuugugaucaguuuuaugcucaauuuaggaaaauguucugugaagugcugagaagaagguauauccuuuuguguuugggugaaauguuauauagauauauguuugguccauuuugaaucauaaccucuguuucauuuuucuguuuaguuucugucucaaugaccuguccauuggugagagggugguauugaggucucccacuauuaauguguggguuucuaugugugauuuaugcuuuaguaauguuucuuuuacaaacguggguacccuuacauuuggagcauagauguucagaauugugauguccucuugguggauuuuuccauugacgaguauucaguguccuuaauacugucucuuucaauuacuuuccauugaaaaaaaucuauuuuauuagauauuagaauggcuaauccagaucuuuucuugggucuguugccuuggaaaaccuuuuuucaguccuuuauacugacauaauggcuauuuuuguugcugagauggggguggugguguuuguauauagcugaaugauggauucuguuuaugcauccauuauguuaaccugugcuuuuuuuaaaaaauagggaacugaguuccuugguguugagagauauuagugaccaaugauuguuacuuccuauuauuuugauguugguguuuguugaguguguauguguguguauauuucucuucuauugguuuuaauguaugaaauaauuuuucuugaguuuucuuuaauauagauagccucauugaguuggaguuuuccuucuaguauccucuguagggcuggauuaguagaaaauuauuguuuaaauuugguuuugaaauggaauaucuuaguguguccaucuauaauaauugaauguucuucuauauauaguaaucugggcugacaucugcguucuuuuagggucugcaggacaucuucccaggcccugcucgcuuuuagauucucagaugagaaauucugauaggucugccuuuauauguuacuuggucuuuuccccuugccaccuuuaaaauucguuguuguauauauuuaguguuuugauuauuaugugguggagggauuuucuuuucuugugucauuuguuugguguucuguaagcuucuugucccuuuaucucuuucuuuuaguuuggcaaauuuucuucuaugauuuugcugaagauguuuucugggccuuugagcuaggaaucuucuucuucuauuccuauuauucuuaggcuuggucuuuucaugguaucccaaauugccuggauguuuugugucaugaacuuuuuagauuaugcauuuugacugguauauuaauuucuucuauuguauaauuuacaucugagauucucuuuuccaucuccuguauucuguuggugaugcuuaugucuguaguuccuuuuucuuucuuacaguuuccaucuccaggauugcuucaguuuguguuuucuuuauuacuucuauuucccuuuuuaggucuuggacaguuuuauucauauccuucaccugcuugaaauauuuuccuguauuuucuuaagggauuuauucauguccuuuuuaaaggccucuauuaucuuuauaagauuggauuaaagauccucuucuugugcuucaguuucauuagacuauccaaaguuuguuguagcaagauaggggggcucaaguggugccauauugcccugggucuuguugauuguauucuuaggcugcucuuuaggccucuggcuuucucugcuguuggcuggcuaauccuaugguagcaggacuucacaggaaagugggaggagcugugggcuagauaaugggggucaggguaccugacucugauggcugugucucagacagacuggacacuggcugcagagugggauggcggguggauccgacucugcaggcuguguuccaagaaaaccaacugggguggagggcaguuaugacuaggauggguguugggacaagguuccaauccaauuagucuuggagcccagaaguuuuccacagagaagcaagacacucuuuggccucacaagguuccucuggaccaaagagcaauccuagaacuagacaguggggcucaggggaccauuccugagccacucaccucugcaggcugucccuagguggaccaagagggauagcaggcagauccaacucuuaauaagcacauucuugacccucagugcauuuauugcuaacuaaaaauuucaacaaaaagcuuaaugugaguucaugugaagcugaauuugaguucaugagucuuaucuguacuuuuaucuuucugaaauaggcauuuuuagucccuugugcacaauuguacauuuauucccauuaaauuuuauuaccuuacuuggcccauucaucugcauugucaggguuuuaucauugcugacuuacagcuacauuauuaucuuacaugauuuguguaaaguuaauguccucuaugauuucauguaaauccuguuguauaaguaggagaaagacaaggacuauggcuuugacuaauggucuccaccaagguggaaguuucuggaucaaauugauucaauuacaaauuuccccaauuagauucuuaccuaaauaauaccaauuuccaaauuugugcuuaauuuugaaagugaaguuuaauauucuuagggugauaauauucuccuacuuggacauagcuuucuguauaacaagauuucauuuuacuguugauucacuuugguuucuaagcugucagaacuucauuauagaaaaguacacugccauacccuccuagggaguguggaguguggagaacccugaaacaaaaagguaaaaaugugagacaauuuuaagaucuaggccaagaaacaauucauauccuuugaaauuuauuuuauaaaguuaugagauuugucuauuuauuuugguuuuaaauauuacauuauaaauaucacaucuuaggcauuaccuuuaaaguuuuauuauacuguugugaauugaacuauucagauuguccuucugaaauucauacuuugaagcccuucucccaguaccuaggguaugacucuuuuugaagauaggggcuuuaaagaaauacuuaaguuaagauggaauuguuaccauggacucuaaucccauaaggucagaaucuuuguaagaauaaauucagacacauaaagagacuccaggaauggauacaguuaaagaagugacuauagaagaaugugccagaagguggccaucugcaagaaaggcggagacaccagggccaggggcacacaccagggccaggugcacacaaagacaaagcuaugugacaaugcaucgaggaaguggccuucuugcaaauaaggcaggguacccuagaagagaauaagaauauguuguuuauccagauaguccaugagucccagcugcuauggcaggccaaggaaaacaaggguuauuucaaaauuagaaucaagguaauuacauggaagcuccacaaaccucucauuuagcauugacaaugaucaacuggugggaaagugauuucagcuccuuuuucaucuauuucaccacuuggauugugaaaggaauaguucuguaaauucuauaaguauauucgugaacacuuuagcaugcauuuuuaaaagcaaguacccuuuaagaccacacuuccucaguaugguaaauugucuaauauacuauucauauuuauaaaauuauuuccuaucuuaauauaauccuuaggacucuucuccauuuuacauccuuuucuuccccuuuacccuugaugucuauuuuuagguggagcggcuuuuguugucuugugguuuaucagaguauagaauuggcucucuguguuucuguuugaugugcucuucuauacuggauuugcuuuuguguuuguaagguggcagucugugcacuccaaguucccauguagugguaaagacaguccucagucucaugcuaccaaaugaaauccuuaguaccaggaauggguuaaagcugcaagauauuugaucacauugugaacacugggaauauguuauuuacugaaaaacccuguuucuaguuguugucagcccuuaaacacacaccuuuaauccucugacuggaauacagacacgcccuuagggcauaccuuaaucucaaacauugaagguaauguuaguuuguagaagaagcaccguguuugaaagugaugucugagugacaaagugaccgaucagagaaagaguaggauaugcccaacucucaugggaaggaaagggaagcuauuucaggagcugugcagagagagaagaaagcaguuuuuccaggucaguuguacagaggcuaguugcagagaagaauaagcuagacacaggugaagacagaaugagccagagaauguggaggagucagaagauuagaacagauugccaucguauguggccaagcagagcaguugcggagacucaagagagagaagccagauugagucagucagcuugaagaggaguuugagacagaaccgcugagguugaaucagccagcuagagaugagaaagaauaagagaggggaagcuuauucagcagcaagucucagagacguugaaaauauucuaggccuagauaagauuuuuacagacucuagaagcuuccaggacuaggccuagguuaacagauugaagcgauaagccucagagaugaugguuacuucaggugaauaaaaguuacaauuacaaguuaugucuugucgaguuguuggccaaagaagucccauagacauccuaaagcauuacaggcuguauugucgaugcagacuucacaaccuaacaguaagacccuauugcugaugaugcccacuuacuuauaucgugggacauggagaaaaagagcugaugccccacuggaagcuucaccucuacugauuagcauucaugguguuggaaauugcccugcaugcuacuggaggagaaacauauccaucaauauauuuuuuuuuaauuuuuuuauuagauauuuucuucauuuacauuuccaaugcuaucccaaaaguccccuauacccucccccggcccugcuccccuacccacccacuccuacuucuuggcccuggcauuccccuguacuggggcauauaaaguuugcuagaccaaggggccuuucuucccaaugauggccaacuaggccaucuucugccacauaugcagcuagagacaugagcucuggggguacugauuaguucauuauccagcuacaaacucuguaaccuauaauagcaagcugccuucaaaauacacuuauaugacaauggcguacauguuaugguaguaaccaacuacuauuuaaacauuuggauuuaaggcccacuccaugagauggaaccaugccugauacuucuaaacuagaaccuaagacuaggucaugggcaucaggggaaaacuuaaaacuauuauuuugcuaaguaaaugauaaaauaaguccuaauuauauacaguuauacccauagaucagugucuugcccaacccucaccagagaagcaucuguuugcuguagaugaugguuaggauagaaacccacaaccagacaagguguagacagugagagaccuuggaacccucagcucuauauagaaugucuucaucaaaacccuccuauugugacucauggaucuaugcagaagaggaaauaaacagguuguaagaaacacaggucuugaaugagucccaggaaacagcaucuagacugaacaggagugauguacauguaaacuuucagaaacggugcuaacauucacaaaaccugaacauauucaaagcagacaaaauuccagcaaaaaggggcaagcuaaggucccacacuaguaggaaccuauuuguaguugacaccugcagggaaaggggaaaucaguuuucuccaauggaaacuggguauauuagucacacuccagggcaagcccugugcucaaaaguagguagcaacacaaaauagacuauguauuuaugugcuuuuuuguuugacuuuugcuguuuguuugcuuugagagagagagagagaaaggaaaaguacaugaaguuaggugggugacaaggaauaggggaucuuggaggacuugggcaaggggaaaaaugugagcaaaauauauugcauaccaauucuuuuaaagccaguaaaaaauaacuuccuguuagauacccauuaguugguaauuuuaccauuugacagagaagcaacauaacuuucuccugcuaagauuuguugggaaugaaaacacaggagagaguaguuggagauaauuaagauacuaagacaggggauauucugccuguuuggcuaacuggaauccauacucuguuuagaauucuuacaucacuucagcucccaaugaauaacagaacaguuccgaaguucaccagaaugguuucugcugcaaacaaaaccccccagccaccugaccaaacaaauaagcaacaaacucacauuuuuagcucuugaaagacuccgagaggagccccucgcucaggccucaggacaauagcggacacccaagaacucacgacagaccgagcuuguugcaaaccacaugaggcuuuauucggggaaagccagagcucuggggacgacucauaucccacacagggguagaggagucguccucgaggggaaagaguucccaguuuuuauaggcccucaggggggaaaggagaagggggaaauuaggggauuuccagaucuaaacaaugucuauucucaagaaauggguaugggagggguacaaggaaagagucuaaugaaggugcagcaaugggcacacaccuggucagaacauuggcagacacacacagguucaaggaguggucagagcauugugcaccucuauuuuucuaaaucagugaagcuaguucugcuaacacugacgucuaucuugccaauuucagggcuucuguguccuuuuacauucugccaggaucuuucacucucacccacugcacagcuuuuuaagugauuagaacuaucaucaucaacuagauuuauauuauggcaaaugaguuguuuuuacuuacuuuuuaaaauauuuauuucuucaaugaaauuuaucacaaauuugcuuugccuagaauuuaauauggucuuauuuuuaagucuaauuuuuuucacuguuaugccuggaucaagaccucaagacuguuaaccagucuguugauucauguucaccuuaaugaaggucgaguuuuuagcuaaggacuuuggaguucaaacaauuauagaucuuauguucacuauaaggacucuagacacagaaauuaugcuguuuaugcuuuuuagucauguuuaaugaguauauuucagcugccuuugcuacaaaacaaagcuaaaagaugaucaggggugccaggguaucuaugugagauaccaacucuucuuucauccauuucaugaacguauccuuuacacuguuuacauauggcaugcuacaucauacucgauaccagugagccauaccaugagccucaaguuuaaugccagccuagcuuauaugggagaccaguauguuauaguuaauuaaauucaagauguuaauuuuuuucuaauuguaugaggaaaccucuuaagagacuguaggaggccgggcagugguggcacacgccuuuaauccuagcacuugggaggcagagguaggcagauuucugaguucaaggccagcuuggucuacagagugaguuccaggacagccagggcuacacagagaaacccugucucgaaaaaagccgagagagagagagagagagagagagagagagagagagagagagagacucugaagaaaucaccauccagagacugccccaccuggagauccaucccuaaucaaccaccaaacccagacacuauugcagaugccaacaagagcuugcugacaggagccugauauagcugucuccugagaggcucugccggugccugacuaauacagaaguggaugcucacagucauccauuagauggagcauaggguccccaaugaaggagcuagagaaaguacccaaggagcugaagagguuugcagcccccuaggaggaacaacaauaugaaucaaccagaaaaccaccaaucaaagaaaacacccagagggacuagcucuagcugcauauagagcagaggauggccuaguuggucaucaaugggaggagaggcccuugguccugugaagguucuaugccucaguauaggggaaugccugggccaggaagagggaguggguagguuggggagcagggggaggagggagaggauaggggauuuucggaggggaaacuaggaagggggauaacauuugaaauguaaauaaagaaaauaucuaaccaaaaaaaauauuaaaucacucaucaggucuccugaacaucugaguaauguuaagagaguccugcuagaaaauuaaccuccuaacuagggacaagagagacaggugcaguucacaaggccaagacaacaagaugcuaagaugcuucagaucacuguggcuagugucaugaaaaaugcccucauaggcuacaguauuugaaaccuuggugcccaguugguaguccuguuugagacagguuaugaucacugcuagaggagguacaucaguagaagugaccuuugagagcuuagagccucaccuuacuuccaguucuuguucucuuugcuucguuggugugguugaggugugaugucucagcucuuugcuccuguugccauuauggauguucuggaaccauaagccaaaauacauucuuuuuucuauaagccacggugggucaucuuauuuuauuaaagcaacaaguaacuaauauaacuauuauauuuaggaguuuaauuuguuguuguuguuguugcugcugcugcugcugcuguuuuuaagcagggcuuauauagcucaggcugguuuuuuuguuuguuugguuugguuuuuuuguuuguuuguuugguugguuuugguuuuucgagacaggguuucucuguauagcucuggcuguccuggaacucacucuguagaccacgcuggccucaaauucaaaaaucuaccugccucugccuaccaagugcugggauuaaagacgugugccaccaccgcccagcaaggcuggucuuaaaagucagaauauucuugcuuuguguguaugagugcuaagauuuguagguuugugccaucaggcauagcuuagguauauauaguuuugauuuucauauuuuagagacagggaaaugaauguauccaaagaaaguggugacaaaugguaaguaaaauuagauccuccaaaagaaaggaaaaguaauuuauuccugaggagaggacagaucagaagaaaccuauuuuguccuccauuucuuuugaagguuugucauaaugaaguaucuuguucuuuccuuucuaugccccuuaaacagaauggcacagauuccaacuggggcuaagaugcccaggcaucugcaagaaaagcagucacugaguggcuggccuuacacacagcacaagcaguuugaaaguuaaauggaaaaucacucaaagguuuuacugaaaauaaggcugagaacuggauguccauauauaucaaauaggaccuugaucucucauccuguacacaaaucaacuuacuguacacaaaucaacuuaaaaugaaucaaagaccugaaauccagaccugaaacuaugaaacuacacgaggaaaacuugaagucauugguguagacacuaacuuuuugacacuggcuucaaagcauagugagccauauuauaugauuagaauuagaucuacuaacguaucuaugggaauaaaguacagggaugccuaugggaugaaagaaaacauucccaggacaaagaauuaauguucacuauauacaaaaaucucuaaaucuaccaagaacagcaaaaagagcuaagugauaaggaccacugguucucaaaaggaaaaauaaagugaccaauaaauauauuuaaaaguucaauauaauacuauuagucaugaggguagugcacuaaacacugcaauaaugucaucacacuuauuagaauggcuguuaucaaaacaauaaaguaaugaaugcuggugagguguggagaggaaaugaacugccauugaccaaggugauaaaaauuaguacgaccaguaggaagagcacugugaagagccuuuagaaacuaaaaauaauucuuccauuugaccuugcuaucucgugucuggguacuggccucaagaaaaugaaaccaacacacagagacacuuuugugauguccagugcaccauuuacaauagcuagggugagcaaccuaggugcccuucaguggauaagagcagacuuuacaacacaguaaauaagcacaucugaauauuauccagccauaaggaaaaaugaaaucuuguacauuucagaaaaguagcaaaacugagggacaguuuuaaguaauugaaucagauguagacaaguacauguucucucuccuaugugguggaucuggagacaugguuuacucagagcacagugauuauuagcuguugguaagggagggaguggguaaaggaaggcugguugugauugguguucuuuacugggucagcugaaggccugggugccauugugcguucuauuuagcugauguccaggaggcaacuguauuucucccauuuuaauguuuuaauuagcauguauuaacuauaucuaauaauggguuucauucugaugauuucaugcguuugcauacuauguuucaaucacacacaccuaguuauguuuccuuauuucccuuauuucucuucuuuuuauagacaaaaaucuaacugugugagcuugacuaaaguuacuggauuucaacauuuuuuuuucaauaaauaauugucgcagaauauuugaucacacugugaaccccaagguuguguuaucuacugaacaaaaccuguuucuagcuguguuguggcccagcccuuagcacauaccuuuaaucucuuuggcuggaaaacagauaugcuguuaacauccaccuuuaauccuaaacaaugaagguaaacuuucacuuguagaaggaagcacccauguuugaaacguaugucuaauugaguggcagacaaaguaaggaaucagagaaagauuuaacagaacaggaucugcccaacucucaugagaacagagaggaaagggaagcuacuugaggggcagugcagggaggaaagaaaaagaggcaguuuuaccaggacaguuagagagagcagggcagagggagaaaagagggggacaguuuuacuggaacaguuguacagagacagguuggagagagagagagagagagagagagagagagagagagagagagagagagaacaaguuagacacaggugaagauagagcaagccagagagugagaagaagccagagauuaaaacauauugccaaaguuaguaacaggcaaagaagagcaaguaaggagaagccaagagaagccaaauugaaucagucagcuuugagaggaguuuaagccagaacagcugaguugaaccagccagcaagagcucagaaagaacuagaaagaggugagcuuauuuagcaguaagucucagaggcugaaaacauucugagccuagguuagaugguacagaggcuaggagcuuccaagacuaggccuagguuagcaaacagaggcauuaaaccucugagaugacaacuuaucaggagaauaaaaaaauuuuuccaaauuauuucagguuuuaaaagacuccugaaaauuacagugauauaaccauuacaguuugguaaugcaaauaguuuugaauaaaauauucuauacauuccuaacuuagauuuauuauucagaguuuugaauaaaauauucuauacauuccuaacuuagauuuauuauucagaguuuuucucacagaucucuguuguagaaagagaguuuaauucgauguacaucaauccuagauuauccuguuaauggaaugaacagauugaguuuuuaaacacgucuccaguuauauauuuuguuauaauucugaguguuagcugugagcuuuuggccuuuuacucuucacagaaguaaauggaaguuuugaaucagcugaguuuagagaugcuaaaguaauaaaaauguuguagucaguugauuguggaucaucugcauggcuuacuucauugguggcuggaaacacuauaaauguauucugaaaaaugaauuacuuuuuaaguucugaaacuucaccuugggccucugaauuaccugcaaaagggaaaauguauuguuuuaauuaaauugcaccaacauuaguacuuguuagcaauccaugcguuuaacuaucugugauuguaugccccucugagaaggccaaaacuaaaacauugaagagucauuauuacugguuuuauuucuugccagacuggguuagacaagaacuuuuaugagugcagauucugagccugcuuccugaaucacaguuugaaaaugucagcacauuuguaccuuuuaaugucaaucaucaugaucacuauggaaugcauggauuccucuccuugcuaucuuucuggccuucuugcguaugagcacauuuucucaucuccagaauccagcccacagcagauuuguucuaauaacacgacugucacauaugcgaguuguuuauguugcuguggcuuuuguggaauggaaauaguugaguguccaucagcaguuagugagagcucuuucuaacccugcagacauccaguugauuucuuugccuugaucucauccuugaguuuguauaggccaggccaggccauggcacacagacaaaggucagggacaaauuucuggagcccauucucucuuuccacaaugugggccucagggaucagacucaaacuccuuuacugcugagcuaucacacuauccugauaccaucaguccccguauauuccugugucuuuaauuugguuuagucuuccagaugucugggcuagugaaauuuccauuuagccuuuaagcaauaguucuuuaguauuacguaauacuuuagaaaacagucaaggaagauggacuucaguuguauaauuaaauauucaauaaucugaacaaaucaagcagauaucuaaagaaaacauucagcucucuauguuggguacugcagcccaugauacugugcacagccagugucuuaagauuucaucaucuacuggagagcagaggcagaaggcgaaagauaggagguguuaaacggugauggguggugugaucucagagcagggaggagagcaucacccagacuggagcauguacucugugugauuaccaaccaccugcuguucccagucuuacaggguuugugcuggaaaucaccauggauauucauccugcaaguuagcugcacugaccgcauucacugucuucguuaauguuuuaugacagagacuucauuucagcuucguuuuaucucaaacagguuaacaaagugucuugucaggaauaccagcaggaagauugcugcagaaugcuaggcuccaugcuaaagccaugcugugagaguggugguuaugggaaggugacauuuaaggagauggcagaugcaguacaacggcaccauguaugacuguacaucucucauucccccuuuuacauuuuauacauuuuuacguguauaaaacacuucgcaucuuuaccuuuuuuaugcacaagcugauaucauuaaguacauaauucuacauggcugucacugccaucuguuucuguuuccagagcucuguugaucuucuaaaacugaaagucagcauucaugaaacaauaagucauuuccauccccuuaucuucugucuuucuguagguuugacucaguauucaacauaaaggcauuugucuuuuaugacuuuuuuauuuuaccuaguuauagccucaagguuuuucauuuauguuuaagcaugugccaggauagcuuuucuuuuuaugacugacggcuaauccauuuuauauguaggauguauuuugacuccuuaucugucuguccauagacacuugggcuucucccacaucugaucucuugugaaagauacugcuuuggacaauuguacaaauucuuucccuuagaaguucugaagucuguuguuaauuauauucaccaugguuugcaguagaucucuugaacauauuccccaugacugagauuuuauguaauuugaugaacaucuuccccagauuuccccccaagccuguuacaaccauuauuauacccuuuguucccaugaacucaauucuuagagaucuacuuaugagugagaccaugggacaucugccuuucuggacauuuuucuuuuuugucuuaaugcccuccgugugcauaggugcuguugccaauggcaggauuugcuuccuuugcaaugccaaauguguguauuuacuguguguuucaaaccauuccucuaacauuuagauggauuccaugucauaccuguuuugagaauaacgcuguaaugaaugugggaauggagaugauuauucuacguuuccuuugaguauacgcaugcucugaagugaguuuuuuuuuuuuuuuuuuuuuuuuuuuuuuacaguuuuuuuuuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugcuuaguucauaauguuguuccaccuauaggguugcagaucccuuuagcuccuuggcuacuuucucuagcuccuccauugggagcccuaugauccauccauuagcugacugugagcauccacuucuguguuugcuaggccccagcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaguaggggcauagaguccacacuucagucuucauucuucuugaguuucauguguuuagcaaauuauaucuuauaucuuggguauucuagguuuggggcuaauauccacuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuaaugggguuauuugauuuucugaaguccaccuucuugaguucuuuauauauguuggauauuaguccccuaucugauuuaggauagguguggggagcggguguggcggcagucccaaaggcgccagggacugcagcuaaguuauaugacuugcaccugacuuccucauauaagacacaaacaucuugagugcugcgcagguguaccaggauacuggugaauccaguuugauggagauaugccccugcugcccugauuagcugaagcugcgugccuggugagguggcguggccugcugugcguggaugggaacugagaguauaaaagagugagaggcccaggguucgggggagauauaaacaagggagauauaaaaacaagggagauauaaacaggggagauauaaaaacaagggagauauaaacaagggagagauauaaacaagggagauauaaacaagggaaauauagagaaagaagaaacaggacugaauaaacgugugcagaaggauccuguagcagcgucguucuuccuggccaguugagcgcgcgcaagaguuggugcugaaacccgggaaaagaaacaucuucaggcaagagcgaagacccccugcuacagggaggauucagaacugcaucacggggaaggagugguuaauaaaaguucccguaaaacagacuguugagaaggauccggcguggauucagaacucuucagcuggggaacgguacugaugaagagaaagaagaaagaugaagacugaauaaacugcuguuagaaggacugguggucgugucguucuugcuggucgagagcgggcgcgacaauugguggcccuuacggggaaccgacucccccaccgaguucagaacuuucagcagucagugguugccagcagcguaaguucacagugagugaaacuugcgaccccaggaguuugggaaggaccucggauaaaauagaggugagcauaaaguugccaggaaguaggcacaaaguaacccaggaguuugggaaggaccucggauaaaauagaggcaagcauaaaguugccaggaagcaggcacaagguaacgaaagguucccggcuuugggacaaguuaaggaacuaugauaaccucaguguagugaucaauagauccucgcuguguaguuaugcuuuuuucucccauugacccuuuguggguaggucugauaguuuuggucuuguuuguucugauauauggacucuguuacuguuugaaucaagaggcagucaagacaggucagaaaauccuuauagagcaacaagaaaauaugucggaagaggagaagggcuuaaaaagaaaaaggaaaaagaaaggagacacaguguuaucagguggacagaaaggacaaaauaaaagaguugaggcagaggaggaaggcgaauuagcuuuugcucccccucccuaugccuccucgucagccaucuaugggcagaccuucuguccggaggucuggaaagaggauagauucuccuugcugggauguccuauuuucacugaucaagcuaaauuugcaugggauagagauaugcugcuugaucaagguagauuugcacaacaacagacaggauauccagugcagguguuugagcaggugaaucagauugcuauaagggcguggaaaucauugccuaacagaggggaagcuagugaaaacuugacucucauauugacuccccagauggacacacaggugauugagguuauggucucaucaccacgagguauuguguccauccccccuggggaucgacaggaucagguguugacgugggugagagggucuguuuguguguuuccacaggaccagacggaaccucuuugggugccggagagauuggugagaugcagcaagaaugaggcuccugauccaguugccccuguggaugugguggaugaucccacaagcacaaaggauggagccgagaugagagauccuuucgguguuccagaagccgauaccagcucgacaugacauucaaauuuuuccacgcuuuuugaucccugaauuccccuuaaagauauagccccucuggccaucuaucccuugcuucagggaagaugagcggggaugagaacccugggauguaugcuuguuauaguguguguguguuuuguguuuggcacauguguuaggugcagagugugcggccugcacuuucgccaugguagcguaggcuuuugcugcaguggaggcgggacaaucuccucagauucgguuugccgcucuaaaagaaauuaugcugcguuaugccguggggugcgaggcuaagcacugcacagaggauagcuugcuguuggcauccuguggaaggcacgucugauugcaugaagguucaguguccuaguucccuucccccaggaaaaacgacacgggagcuggccaagaccucucugggugaugagccuaagggaugguuuuguguagggccccuaugcuugcacacuggggaucagaccucuaccuucacccaugaggcuugcuugcagcaauuaagaucuggccauagguuaauuaacauccuggccuuuugaugcaccugccgcaagcaaaacacaaucuccccaggaguggcuuggcaugauagagagguagucagugauaagacucccugggcaugucaccaaccuaagacagggaucaaaccaaugcuguuugucacccaaggacggguaaggggcauggcugcggggggcuaucuacagacauucucucugccaaaaaagaaaaaagggggaauuguggggagcggguguggcggcagucccaaaggcaccagggacugcagcuaaguuauaugacuugcaccugacuuccucauauaagacacaaacaucuugagugcugcgcagguguaccaggauacuggugaauccaguuugauggagauaugccccugcugcccugauuagcugaagcugcgugccuggugagguggcguggccugcugugcguggaugggaacugagaguauaaaagagugagaggcccaggguucgggggagauauaaacaagggagauauaaaaacaagggagauauaaaaacaggggagauauaaacaggggagauauaaaaacaagggagauauaaacaagggagagauauaaacaagggagauauaaacaagggaaauauagagaaagaagaaacaggacugaauaaacgugugcagaaggauccuguagcagcgucguucuuccuggccaguugagcgcgcgcaagagauagguaaagauccuuucccaaucuguugguagucuuuuugucuuauugacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucaauucgcauucuucuacacgauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucuggcauggugauucugccagaaguucuuuuauccuugagaagacuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggcgaucuuuccaucuucugagaucuuccuuaauuucuuucuucagagauuugaaguuuuuaucauacagaucuuucacuuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguggaauuuuuaggaucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguugggucuuucugugguuuagguaucagaguaauaguggcuucauaaaaugaguuggguagaguaccuucuacuucuauuuugugaaauaguuugugcagaacuggaauuagaucuucuuugaaggucugauagaacucugcacuaaacccgucugguccugggcuuuuuuuggcugggagacuauugauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguauuuuggauuucuucaggaucuguuguuaugucucccuuuucauuucugauuuuguuaauuaggauuuuguccuugugcccuuuagugagucuagcuaaggguuuaucuaucuuguugauuuucucaaagaaccaacuccucguuugguuaauucuuugaauaguucuuuuuguuuccacuugguugauuucaccccugaguuugauuauuuccugccuucuacuccucuugggugaauuugcuuccuuuuuuucuagggcuuuuagauguguugucaagcugcuaguaugugcugucucccguuucuucuuggaggcacucagagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauguggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugaucuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuagaauggcuacuccagcuuguuucuucaguccauuugcuuggaaaauuguuuuccagccuuucacucugauguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcuuccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauuuguggaaagauauugugugaauuuguuuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucucucuuuauuuagugcauuugauguucugauuauuaugugucgggaggaauuucuuuucugguccagucuauuuggaguucuguaggcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuagguuccagaucucuuuccuaggguuucuaucuccagcguugccucacuuuggguuuucuuuauugugucuacuuccccuuuuaguucuaguaugguuuuguucauuuccaucaccuguuuggauguguuuuccuguuuuucuuuaaugauuucuaccuguuuggcuguguuuuccugcuuuucuuuaagggccuguaacucuuuagcagugcucuccuguaauucuuuaagugacuuauaaaaguccuucuugauguccucuaucaucaucaugagaaauguuuugaaaucugggucuagauuuucgguuguguuggggugcccaggacuagguggggugggagugcaguguucugaugauggugaguggucuugauuucuguuaguaggauucuuacguuugccuuucgccaucugguaaucucugaagcuagcuguuuuaguugucacuguuaagagcuuguucuucaggugacucuguuagccucuauaagcagaccuggaggguagcacucuccuuaguuucagugggcagaguauucucugcaggcaagcucucuucuugcagggcagguacccagauaucugguguucgaaccagacuccuggcagaaguuguguuccacucacuagaggucuuaggaucucguguggaauccugugugggcccuugcggguguuggucgagacuccgcuggcaagguagcccggggcuugaguggagcggaagggguuugugccccagaucaagcccggguagccugcuucccuauguaccgaagucucagguuccgcgcgauuggauuggggcaggcgcuguguuccacucaccagaggucuuaggaucccguggggagucccgugugggcccuugcggguguugggcaagacucuuuuuuuuuuuuuuaaagauuuauuuauuauauguaaguacacuguagcugucuucagacacaccagaagagggcgucagaucuuguuacagaugguugugagccaccaugugguugcugggauuugaacuccacaccuucggaagagcagccgggugcucuuacccacugagccaucucaccagccccugaagugagguuuuaagauaguuuuauuuuuauuuuucgagccaccucuguuauguucuguauuggcuguacaaauguucaucccuaccaacagugugcaagauuuccuccuuucugcaccuucuccuaaauacuugccaucuuucacguaaaaauaaguucuagucucacuacauagccauggcuggacuggaacuuacuguguagacuaggcuggccuucaacucacugugaucucugaucucccucccucucucucccuuaacaccuuucugucuguauaacugccaucauuccacuuucuacuuauugaauggaugcuggaucuuucacagauggcuuccccuuuguuauuuuacugugguccaucccauugacugauuuugcacauugaauuuuugcacauugaauuaagaauaaacaaggcuuuauuguaauacacauacacacauaugcuguuggauuaguuugcucacauuuuaaugagaaucuuugcaucuaucaagaaaauuuugacuuauaauuuuauuuuuuuuguaggauuuuguuauggaauuaucaucaauguaaugccucccuuauagaaugaguuacaaaggaguauuuauuucuucuucuucuguguguguguguuuuuaaggaaaguuugagaaacuuuaauguuaguuuaucuuuuaauaagucugauguucaauguuuauuuucaguuugagagaauuuagaaucacaggggagcugugcuucugggcaugcgcaugagacauuacuaugguuacuuuaaccgauguggggagacaucuaugaauugugcaugagaacauucucuggucaugggaaccgagacaccccaggaggaagcagaauguugcaccaaagcaugcauucguggcacuagaauccucacccugcaugugauaugagcgacuguuucaagcccuugcuuccgugacuucuuugccaugaguaccuuagacugugaucuaaaacacgcccuuucucccuaacauugcuuacucaggguacuuuaucacagcaaugggaagagaaauggaaaagcaaguaucugccccagggugugcucuugauuacagauucaaguuccuuacucauaauaacucuguucagauuuucuguuucccuccuccugguuuuaucuugguaggauuuaccuuuuuuggaauuuggccacuauguguacauuucuaguucacugcuauagcauugcucacguuaguaucccuuuuucucccacuguagaauugguagucaugccucucccuugauucauuauuguaaugacuugaaucucuuagcucuuuuuucucaguccaucuagcagauguuugucagucacuugcuuuuuuucuuugagaaccaaauuguuauuuuauugauguuguuuuuuuuuuuuuuauuuacuucaucuuuuauuugaccuuuauuuacuccuuucugccaucuucagguuugguugacccauuuuucagcgaguuuuuuuuuuuuuuuuuuuuuguaaaguuagguuuuugauugagaucauuuuuuaugagcauuuguagcuguaauuuccacuauaacauugaaucuguugucucccacacauuuuaguguguuguggguuuuguuguugcuguguuuucauuuguugauagauauuuuccaauuucuuuaugaucucuucuuggauucauuggguaauucuuauuuugucaauuucauacaaguugcaguuauuugggaagaaggauuccacuugggcaucggccucuauuauacuggccuauuggcaagucugugaagcaguuucuugauugauacuugacgugagugacaggugucaggugacugugggacgugucaccccuagacaggugguucuggacugagcaaauugagcaagccuuggagagcaagccaguaagcagcauuccucagugguccuucagugucuaguaaugggguucugccuggguuccugcccugauuuccccucauugauagacuaugacacaggggugcagccuuccucucccaguugcacuuggccaguguuugcucauagcaccagaaacuaaccuaguguggugcuuaauaguacuuuauuuaaucuucacaaauauauggauuucccagguuuucuuccuauuucuuucacucuucuuuucuucccuuuuucuuuuauguuuucauauuuuuccauuuaaaaaaaaugaaaaacacucuauuuuauuuuauuuuugagaguauaauauaaugacaucauuuucccugcccguuucucuaacucucacuugcaccccucccagcacucuucuaauucaugggaaaucccaugcuuuggcccaggcuauuuugagacugcaggcucagagagcucucuuagaccucugagcucuaggaccaccagucacaccacccgucacccugccaucccugacuuggugugggguuggcuuguuuuauuuuuuuuuaagugauaacugauuuuaucuuauuaugguuagagaaaauacuauguauaccacacauguuuugauuucuuucuggguuuggaaagauucauuauguuaaggauucaggaaguuucuauagcuaaagugugaugucgugggccagggaagaggaguggagcgaacuaagaaucaaagauggaagauaaaaaaaaaaaaaacccuaagaauuccuacuagauauuuuuuuauucuugguaccgagggaaggcauuagaaagguugcaguuaaggaguuuguuaaagcaucaucaucgucaucaucaccaccaucaucaucaucaucaucagguacuggggaauggacccaggguacuguuucugcuagcagguguuuuacuagugaacuuuaucccuugcucuauuuauuuguaauuauuaaguuauugauauuauuuaauggauuaguugauugguuugguuuuuucuuuguuuuuuguuuuguuuuguuuuguuuuugagauaaaggcacacgcuuaaaucuaggaugccgaaacccaaugugugaucuaggcuguccuugaacaaauagcaauccuccugccucagcauacugagugcuagaauuuauaggugugaggccccacccccaccuuuacaccauauuauuuaaaccauauuccuggagugcauuugagaaaguugauuguagagauaaagaaaggcauaaaauacacugugauaucugauauucuuggcaguugagugaaccaagagugaguggaugucuggaguuagagagaauugcacagccuuuugcuguggcugccauaaaauauauaccauagguggcuaccacaagagaaaguuguuucccagcaguguuagaggcuggaaagccuauugacaagguguggugacaagguguggugagauggcguucaccccgggggcuucuucugguuucgauugcugccauuuaguuguaaguucaauguccucugcucugaacucacacagguagacaggacagacuugcugcugucaugucugucucuuccugucauuugcuuuuacugagauauuuuuuguauugaaguuucucuugccugguauuucuauuuaaauuuguugcauuagcacugccaaagggaucguggcaacugguucuuccugcuugcauacaacaauggugugaacguggcuacucuacuuaaagcucuuagacuuaauuuuaagauaugguuaauaacauauacuguuguaugcucuaacucauuuucuaccugcucuuuaaaaggcauggauuaauaaaugauacacaggcaagcuuuuaguuagaguaagaaaaaggaagaggaccccaagaagagaaaagaaugaaugaaacauuaaaaccagggauacaaaacacaaagcaucauuagaaacuauuaugaacaauaauauaucaacaaauuggaaaaccuagauaaaugaaaauuuuucuauauauuucuuucuuucuaaaacugaaucccauaaauagcauaaaacaccguguuaaggaugaaguauucagucucuuuuguaaagcuccuuuuauuugaauuuugccaguuagcuucccguuuuucuuuagcuuauuguuaggugcaucuguguguaauuguuuuaucuucuugcucuuuugaacuuuuuauuaauauuuaagauucuucauugucuccugugaccaguuuugguuugaaaucuauuuuguuuaauguuugcacggccaugguugcucuuugugguuguuuuguuugcaagaaauauuccuucuuauaauuuuauuuguaaccagucuccaucuuaguaucaaaggacauagcuuucuucuuugucucauuugcaacucauuugcaucuggacagcacauauagaaaucauauuuuuaauucacucuaacgugugucuuuugaauggcgacuacauucucuucuacacuaaaguagccgcugaaagggaggggcuuuggucauugugcugauuguuuccuggaugccuuacagcuuuuuauuuguucccuguuucuugguuuacuuucuuccauugugucugucugauuauuguaaugaagcacuuaaauuccuuccucguuuauuuuucuuguuucagacaaggucucaguaugcagcccaggcuggccucaggcuugggauguggucccgccuucagaguccugggauuauaggcagacaccccuuuuuucauuucccaucucuuuuucuguuacuuaaauucuuuagccauuuucuuuguaugugucauauuuacuacacaaaaauuauaacauucuaaugugaauauauagccucuuuacuucaguaauuauaguguguguguguaugugugucuauugugccuuuucuuuuuuaaaauucucguuuguuuauuuuauuuguguguuuauuuucuaaagagagaaggaaaguguuuggaguuagguggcuguggauguaggguggaccugagaggcaucaagagaggaaaacuaucaucagacuauauuguaugaaaacaaaucuauuuucaguaaauauuuauauauaaauauauauauccacaugugcacuaacauguaugcucacacaccugucuuugucuuuuaacagcuugauuauaaugaguauuguuuuauauuugaguuugcccuacuuagaaauucuuaugguucuugcauaugauaucguuauuaaugccuuuaaucaaauauggagacaauuugucauuacuuauuuaaacgacuuuagcuuuuauaaugaagucucucacugaaccuggagcucacugauggggcuagccugccagucagcgagcccagggauuuucuuguaucugccuuccuagggcuggucacaggcaugcacuucuguguucaccgcugaaaguggaugcgggggauuugaacucagacccucaagcuugcacagcagcacuuuaccagcaaagccauccucuaaccucccuuuuagaccugugacagcugguauguuggucaacauggugggguuacucuggcuucggaggcucgguucacuuucuuguggucauuuuccucucugcuccgcacacacauaauuuccauuuauugcaucuucaacuucacuggcucuccccuguuccugcuagaaucugcacuugaacacuucagggaaacauccuuuuuggcuaauggauggcucugcucaggaauucuuuucugcuucuuacuaguauucauguuucucugguacuucuguguuuacaucauuuucuuaggguuuuuuuuuuuuuuuccucuuuuagaauuuucucuaaagucuguuggcuuaguuuuccuuuuguuuuguaugccuuaggauauuguucuugaaaacuccguguuggaaucugagaguguugucacucuggagauugagucucugaccuuugccgccucuuguguuuuauuuuggguuuugcugucauaaagaggucucuuggcagagaaucagccugagauguaaacuuaagucuucucugguauauuuugaucuucugcuaccuucuggucacuuaaauuucuuuuguacagauugcugcuuuugucuagcuugccaaacauagcucccaaaagugagaucacagaaaaagcaaagauuuagaagaaaaagguaccaguuccuccgaucuccauggagaccugugaugucaguggcccugcuucauccucugcaccucaugaggaccaguuacaacagggaucccuggugcuggggaagcaguuauugguaaaccuuuuuugcuuagucugaguuaucaaaaugugcaccagcuuuuccagggacucuuucggucacaggguuaggguggauaggaugagugcggacuauuggcuaggagcugaacuggcuuuguaauccucugauaggcuccaaaguuccaaaauaguuacacucaagagauucggccagugauguuucugucuagaugguaaaacagguuugagagcauccuauucucucauucuuuguuucaauguaucucauauucaucuuuaucguauuccuguaagacaaguuacuauaaucauucacuuuucauuauuuuucucuugucuugagagagaaagaaagagagagagagagagaacaugcaauguugauuuuuuuucugggucacuugcaaugauugucuccaccuccauccaugaccaugcaugucauucuccucuugcuuaccgcacucaggaucauauuuccagcucaaccauaugccugcaaaauucaugaugucuuuguuuuuaauagcugaguagccuuccacuguguagcugaaccacauuuucuguauccauucuccuguuaaggacaucuaaguuguuuccaguuucuggcuauuaugaauaaaucugcuaugaacauaguugagcaaguaucccuaugauauagugagguaucuuugggguauaggcccaagaaugguauagcugcgucuugagagaaaguuauucccaguuuucugagaaaucaccaaauugauuuccagagugguuguacaaguuugcacucucacaagcaauagaggaguguuccaucacacuguaccuuugccaucauguguuaucacuauaguuuuuauuauuuuucuuacaucuauuuauuuuguuuaugucuggggauauauguagaggucagaggacagauaguaagguguguuucucucuuucugccuugugcaucaucagggaucaaacucauguugucagauuuggcaccaagcuccuuugucuacugaacuauauugccuacccaacauucacuugauggauaaggaaacuuagcaguuugcccaaaauuuugcaaauaauauguaucagagccagcauauauucugucauuaaaaucuauaggccaccccuuagauaggaacgacaaaauaguuaauaugaaaaucagaggagcaacucucaugauccacuucagauucaagagacugguucuucaggaucuagagaaguggaggaugagguggaccacgacuaaauaacagggcuaugggggcaagagcuuaguugguugguugcuuguuggaaaguacugaguucauagucgucaccuggcuuugaugaucuugauccaccucucaacaccauauaaaccuaacucguuuacuaagaaacggagacagugggaucaggaguaauuguaauugucuuggucaguauucuauugcugaagagacaucgugaccgaggcagcuuuuauaaaagaaagcauuuaauugggggcuugcuuacauuuucagagguguaguccauuaucaucauggugggaagcauggugacacacagggagacaugaugcuggagagguagcugacaauucuauauccacaucugcauggaguaggggaagagagacagagacaagggacagagagagagacagagacagagacagagagagagagagacagagagacagagacagagagagacugagacugagacugggacugacuugagauuuugaaaccucaaagcccagaggcauucuuccuccaaccuugccacaucuccucauccuucacaaauguugucauucacggauguccaagcauucaaaugcaugagccucuaagggccauuuucauucaaaccaccucagucauccucagcuagauggaaauaauaagcaaaaggcagauacugagucugaauggaaagcucaccaggcccaugccuaaggaggauuuguuugaaagaguaaguaaaauuuuagugaagcaucaagauagagauguaggggucugugaguucuuuuuaguugucuagcucauggagaaaaaucuguuucgaagacugaccuuuuggucugcuuguuuuaaaauuaaacaugugaagaacggccuuauuuccaguaucucuaggguuuauacuucagaugcacuuuuggaaaugugaacauuggugaugcuguucucuguggauguauuucaggaguuccauagccacauggccagguugccauauuaggugaaauaauaucgcuauauuuauauaugccauauuuauauaaauaauaugccaugguugccauauuaggugaaauaggaagacuugguucuuuucuuuuuauuaaagauccucuuaaaaauaguaccugcgugcacauggaaacauuaagaaguguucacagaagguaaaaguauccuccuuagcguucguucuucauuacccuuuucuucuucuucuucuucuuuuuuuuuuuuaauuagguauuuuccugguuuacaucuccaaugcuaucccaaaaguccccuauacccacccccccaauccccuacccacccacucccccuuuuuggcccugguguuccccuguacuggggcauauaaaguuugcaaguccaaagggccucucuuuccagugauggcuaacuaggccaucuuuugauacauaugcagcuagagacaagagcuccgggguacugguuaguucauauuguuguuccacauauaggguugcaguuuccuuuagcuccuuggguacuuucucuagcuccuccauugggggccgugugacccauccaauagcugacugugagcauccacuucuguguuugcuaggccccgccuuuucuucuuuaaagauaucuaucugcuguuaaagccucauuuggggcuugaagagauggaccaguggguuaaaagcacucuguggguuaaaaguccucuguagaagacugagguuuuauucccaagacccacauaggauuuuaugccaccgguaauucuggucccaggggauucagcaucuuuuuuuggccuuggugggcacuaggcacacacgguacacaugcuuaugggugagcaaagcgccaauaaacaggaaaaaauaaauuuucaaaauguuuaaaaauauuuuuuucauacuucuaguaaaguauuuccaaccuaguauuauaugaguacacauuuugccaguuacaaaaacaguauacucugguguugccuuauauauuuuaaaaauaaaagcuguguucuguagagccucauaagacacuacauuuauauguuccuguauccucuucaaggugcccaggguucuucccuguuugaaauuggaguuuaucaguuauccauaaccuucuuuguuauuucccaauguuuugcuauucuaauaauucuguaguguauucacagcugugcuauuucuagaucaguggauaagaacacagcuucuuaaagagauccuaacacucuucugagaugagugccauuuccaagcaaagaacauuauagaaguuaggguuaaagcggaacagagaacacagcccaggaagaaaccagaaccagcgaugauauauggucugcgugauaggaaugauaaauauuuguagcaauaauuuuaaaaauggccuauacacauuaauuagcauggcucuuccugggacuauuuaagaauaauacuuuaaaugucaccauguuuuauugcaacaauaaaaguguaacuuuuuauaacuguuguugucuuuaguuucauuguaaagauaguacucauuacugugugugaucugaaaaugcaagagcauauaaaucaauaaacauauuccaccuauaaauaccaaacagagauaacaauacaucaauuucuuauuuacauuuuggcuucuacacaguggaaauuauauuguauuuguacuuacauguaaacguuucuuuguuaaucaccuugacuguguuacuuacuuauuuugucuuuacacugucuuuuuuuuuuuuuccucuucagguaauagaaaccuaacacuguuuugggacgaauuuaaauaucagcauagcaaagacacagacagcucuuuggaaucucuccaauggcgaagaagacaagccauggguaucccauucauccuacaaugcggugagugcugcgugccaaucuaacaaauauucaugauuuccuaaagggucaagucauggggcuaaggagacaacacaggguaaaaauugcuguuugcuucuaaggaguuacugucuaggcaagaauuuuacauaaguacaauagaggggaaguuggguaugugaacguuugaggcaaaaaguuuuugagcauggggugaagaagagugagugugaaacuguaggcgagaugucaugacacaagcagcauaugagauaguugcuaugauuggguuuugagaagaaggauaaggcacagggaaagauggcugauaucagauaugcaccuuagaaauauuugugauaaaagcaccagaaacagccauuuuccugcuuuuaauauauaacacuuuccuacuuuuaauauguaauacugugucugaggcuaauaggacuucuguaaucuuaauaacaagauaaguggggggaugagucaaugaagaaagauacaaguauuuccuuggguaaaugccuuuaugugucuuaaauuccaaggcaacauuuuuugauuaacaaugggagguuguguugcgcuauaucuccaacccaaauaugcccccgcaaugaaaacacaacucaauuaauaugaauacaugcugugagccuagauugggcagaucuauagcuacacuaccaucuuccacaucucugagacccccuagaacuugugguuucuccaggccaugugcuucugcuccgcuuuucuucuucuuccuccuccucugcguccucuuccucuuccauuuucuccuucuucucucuucccaccuuccacuccaucuucccuuuuaucugccuaaucaucaguucuccuuuauuuuacaaauuaaggugggaagcagguuuacaggaaaucaagugcugacucauuccuuguucacaaccccucacaggagaauggaacuaacaucaaauauaauugggcuuauuaagguuucauuccugugaagagacaccaugaccaaggcaauacuauaaaggaugccauuuaauugguccuggcuuacaauuucagaguuuuaguccauuaucauugugucaggaagacauggugcuggaauugcugagaguucuacaucuugaucugacgacaaccaggaagauaaucccuuccacgggcagccaggaggaggguuauccauccacacugggcagagcuugagcauaagaccccacaguaacucacuuccuccaaugaggccacacuauguaacaggaccauaucuucuaauagggccacuugccauuggccaggcauauucaaacuaccacagaggcauugggaaauucucaguaguaggacagcaacaugaaaucaccaagcacuugauacgccuucaaccugcucuccaaagggcuuggaguuaaggacaauauacuuucuaucacccgaaguccaguagauaagacagacaaguaccagaagagcgccucccccacgcauuccagggggaauuguugagucagauguaacuuccaguaaggcaacuccaugaaggacgauuugaugcagggccaaaucauccuucuauugagaauuugccaauaccucugugguaguuugaguaugcuuagccaauagcaaguggcacuauuaggagguguggucuuguuacagugguauggccuuguuggaggaauugagucacuaugguggugggcuuugagguccugugcucaagcucugcccaguauggaaggauaaccauccuccugguugccuguggaagagagucucuuucugguucuucucagaucaagauacagagcucucggcucuuccagcaccauaucuuccugcaccgugccaugcuucuguuaugaugauaauggacuaaaacucugaauuaaugagggauggucagaccugugcugguagagccuuuuguaauagaagucccagggaagagauguaaaugcaugaacugauguguuccagugagaguuaguaaauggaauaagacauguucagaaaguaugaaugaggcccauggaugacaguaugugagagucugccaagugacaaugauaaugcccaauaguuacuacauauauuugaugccugcuaaguaaacgcugauuccaguggcuaaaggccauaugggaucccagcagucauuggauaucccugaggauuaaucaccuauuuagaaaauaaggcuggugcuuauaacccauaagcacuuaugucaugagguugugaacaugugaucuaauagguaugaacuuugcuaagugauugagaaaguguuuagugguguugguuuuuauugucauuaauacuacaaagccaucuuauccucagcuccucuuucuauaaauacuaguagaaauauuuuuuuuaacagauauuguucugacacagaaauuaagucauucucucaagacccacaggcuguaggagguaguucaagggcuuauuggcugugcaaacugcuuuugccucaggagugcaggaaauguuuaccuuugugucaagagggaauccaggauuaaauuuagguuuagccuaaagacagcugugugccuugggccuaaaggcaaggaggaauuguaaggggaagcacacaaggauaucagaacaggcuguggaguaagaucaagggaaagagcggggcagcggagggcagugcgugaaugacuuauagaucuugacuuucacuuuuucugucaguucuguggaucugaauggaaaguggaauggaugggagugggcuggacacuaugggagucaagagggagaggguggucuagcgagguuccuugcucacaaguaauagcaaccagucuggagggagcuggagcagucacgaugaugauugcacauuucuagaugagcuuugcauauagcuccuggaaggcagaaauagacagucaacaggcacggggugugugcucaaagggccacugcuucggguguggcugaacugacuuguuuguuuguuuguuuguuuguuuaaauagauucauuucuuuuguguuuuugucuuaauggucagaucuuugucucaaauggagaguccugccuuccucuuccaauuaccaggaaaaaggauuaccugaccuauggauuugugccaguaaucccaacaaccuggaaaacagguaaguguugaguaauucuccaaaaauucucuugucaauguaaaauuccuaagguaucccuuauaaaccuugaaagugucaguuauagagagauuuuuaccuuagaggcccauuucucuuuaaagccuuuguaaacuccuuggcuaucuaugagaauauuguugguuaguauauuuuucuauugauuuaaacugaucuggccgggcggugguggcgcacgccuuuaaucccagcacuugggaggcagaggcagguggauuucugaguucgaggccagccuggucuacagagugaguuccaggacagccagggcuacacagagaagcccugucucaaaacaaacaaacaaaaaacagaucugcuaucacaaagcacagggccucaugugugugggccuuccaccuagcaggaagccuuggccuccugagcugcaucucccauccaugcacacaagccaacaacuugcucuuacaggaguguuccugagaggguguguccagcagcucuaagcuguuagaauauaugauuuaaaaaaaaauuaagucauguauugauuccauuauuuuauaugcuagaggaaaaaguucagacuaaacaggaaaaagggcugauuaaauauugauggcugucgagcccuuuuagacuaauauccuuucucuagggaagggaguuaguauuccuuuuuaauagaggcaucuucgccccaccccagcacugcuuucucuguacaaucuccucuauguccuuagagcuaaagaguaaagggaucacuuuuacuaauguggacccgagaguaaucccucuucuucaaguauguuuauccagcucugaagacuaaccccccgggaagcugccuuucacagcuuucuuuacuuccauugucccgugacccugaacuagcaugcucucgcccucaucccuuagcaacuagggaugccucacaaagcauugcagaaucauccucaagaccacauuaacuuugucccuuuuacgcauccagauaauuccacuugcaaggagaggcaagacaaauuuaguuguguugacagaaaauugauggacucugaaacuauaaauaccagaaagugcuucuauuucuuguuccccgaagucccugaaccuuucaacacaauggcauaauacugaccaucuguaugucauccccacugaacagauuauaauaaaauaugcagaaaacagcagcaggaggcuuagcaagauguaagagcaucuaauugggagcagacgcuuccugcauagggaacucacagucuguuguguggauacgaugacuccugggggaagacugggaaucaguccugugaccucacucaguccucugauucagcgucgcagucuggaccuaccuucaugaaaaguggggauugaugucugccaggagaccuaugcacuguugaguuuagaugauagaaucauauaaaauaaacucauauaaacaaaccugauaugguuguguauuagggcauguucugugagaacaagaacugucaagagucuugagaguagacaagguauugccuagagucccagagccuacaguuggugguccaaaauggcuuccuaguagccaccaaaaucaaugcuaguggauggcguuugaaugaacaauggucuaugaaacagaacuugagacagaaacaccccuuuuguaaacacaaaagcuuacccuuccaucuucauaaaaguccugugaacucauuccaucccuaagaggagaaagcacagauacccagaaggcuuuagugaccugcuggcgauucucccuucaagcugaacuugaagcagagagucuguaauagaacauccuauggaacucaguuccacuuuacaugcauuuaaugauuaaaaccaucuuacccauuguaguauucagggccagcagccuggacaaacuaacauagagccaguuuuguugaggcuacugaagucuuguuuguuuucugguucaagcacagagggaaacuacauuuuuguuacaaucucugagaaauagcugucagcacgcucccauuauauucaugauaugcauucaucuguauugaaugcagggaucaccagcgggguaaaaaugaugccuguauuuggcugaagcaaagucuccucuguuucagaaaggaugcaaaauacauagagguuguacugcauauuaaaauuguccaaagaucuuugaagguagacaguugcgugugcuucauuuuaauaaaauacuuccuuucucuguucugaauaaaaacuuaacauggccaggagguucuuuucucaaaugaaguaguccuguguaaaugcugcuccguaagugucuucagguucaugugguugguggcuguauagacauccuugugcagucauccuugggcuuuguuuauguagcaccuuccuuggaaaauaacaauaauagccaacaccacaugaaggcagaaugaagugguuuuuucacagcagugcuugaauucagugguaguuccucacucuucucugcugguaggggucaagagaaauccaugcucaacgcacugaaaagcguugaagagcgggugguuuccuucugccuucuauuuccuucucuguuuccaguguggagagguccuccccauucccagucuccucucucucuaagcccaacacccuuauguuuucugauucccuccaccuccucuuuuagugacuggaugcaacuuuccccuccuuccacguaucaacaauagaaaacuucuuaggcuaggguuuuacugcugugaacagacaccaugaccaaggcaauaaaaaacaacauuuaauuggggguggcuuacagguucagagguucaguccauuaucaucaagguggagcauggcaguauccaggcaggcauggugcaggaggagcugagaguucuaugucuucauccaaaggcugcuagggugaggaucuuaugcccacacccacagugacacacccauuccaaccaggucacaccuauuccaacaaggccacaccaccagauggugccacucccugguccaaggauauacaaaccaucacaaggagacaucuaaggaauugacgucugcaucuccuauuccuacugcacacucaaugaggcuuggacucagagcuauacucaaagagaguucagccccuuuucugcaucaagucuugauaccaacacaaacuaaacaauuucacuuuuuuuucccaaaaagcaauuugucugauucagcuuccuauuucacagcuguagcauaaaaauaaauaaauaaguaaaaaauaaaauaaagcaaaauggcuucacacuuuccaaaauaaaggcuuacuuacuuuuuguaacuuugaagagauuuguucaugguuguaaaguacacaaggcugggagccaggaugaaugcaaaguacugggcgacugaggacgacaguucauuugggaaagauggaccagucagggucgcuuugagcuaucuagugagcuacgugcaagccucccuaaccccaaggcugucccugaacagcguaugacaggguagccauugcucucucagugauuccaaacuagagauccaugaaucucagaggcagaauuuuuuuuuguaguauuuuagaguggugaauagauuucaauaacaaauuuggggauggaguggggaaauguuugucaguagcaagaugauccaaaacaaauuauuucuaaagacuugauuuaugauaauguaggauaaguggaccaauaacaagauaauuuacauucccacauccugguaaauacaugugccccuacauuuucuauguagcuccuucccauaccaacugaacauuuaagauuauaauucugcuuuagagucaaauuguggguguauaauagaaacuauaacacuuuaacuagucagcaaaacaccuuuccacugccuccugacgcuaaucuguuacuucuugauugugaagcuguaaccagauagagcgccugccuucuaucccacugggcaccgugaacagaagaccaccaucaaaagaugagagagagaggcaacuucaagagucaguccagagauaucaggacaagcugguggaagcgcagccgcaggugagagucgcucaucuuuucaaauuaagcaauugcucuugagcuguugaguccuuacaugggaaucgaccaauaugguuuuucauguaaaauauacagcuucuuuuuuauuuccauuuuguccuuuuuuuuuaauucugcaucagagaauuugcuaaagggaagggaaggaggucuauuaaaauaucugcauagguacuaucuaagaccaucuaccugcacacagagcauguguguagggggacaaggcauuucuuucuacucugcaauugugugcuuguuuuggagucagguauucaagacagggaacuauguuugcaugacuacaaagguuaggcuacaucccucccuuaucugcuguacuaccaggcuccuucccuggaaauggacauuuuggguagagacuguuuuguagacagcucuggacuauucauauggaaugucaaauguacauuuuaauuguuaugagaacucaauaagaauaaacauuauuaugaaugaauggggaguuauagcaauuuuagugaaagaaauguuacaaacaggaaaauucugugaucuuugcuuuuauuagcauguaucaacuguccagguuaagggaacgccucaggacauuucuauaauacacaugauacacuucgauuauuuucaauccucucuuacucggucuuuuauauuucacuccucuccuuuccuuuccccuuccacaucuuuaguguauuuuuaucuucauucucacugugauuuguuugcuagagagcacccaugugcguucacgcaugggcagaggucauaggaccaucuugugugucagucggucuucaccuuccauauugugugacgcagugucucucuguuguucaaagaugcauuugccugugaaccucuggaggucuucaguucuugguucuuauaucagagaggagugucgggggaucauagaugugcaccacugcacauagucuaugugggcucugaggauucaauucaggugucugugcucaugucgaaugugcuuuacccacugagccauauccccagcccuuauucucugauccaagaguuuuaucccugcuuguggacucacucaaauuaagcauuuuaaaguuuauauaguuuguuuccucaaguaucauuugagcagaucagcaguaaauaggcagaaguauuggcuugucugccaauuccagaaaacaaaaaaaggaaagccucauuagaauagaaaaucuggugauaggguaagagucaauccaauauuacaucaguuuuggguuuuauaacguaaugcaaaccuguccucuuaccuuuccacuuugcuagggaucugcugugcaagucggauaccaccugagguggucacaggacuagcucuccccuuuuagccuagugccuuguucagucuuggaacgacacuaaagauuacuugggaaaugcguccccuaagcauuuccuacugcuaaaacacaccccgccucucuaguuagcucauaaagccccuagucugcagugugcucaaagaaaccagagaugaaggcgggagagccugugauuaucuuaacuaacagccaaauagauaaauacagaaguuucuaucuggaaauaucuccauuuuaaaagucguuucuuaauuggaaaucacuccuugaagcuuugggaagacauucaacacauugggauugaccgucucugaauauguuguuuuccuuccuuaaaggucacuguugaccauuggauauugauagugucauucacaaagccuugauuagcuuauuguuuguuuaaaguuggacuauguuagccauuauugaguggagaucuuaauggcagcuuaugaagucaacagaugggagccauccauucugccuucucucucucucucucucucucucucucucucucucucucucucaguagaauuuuuuuucccucacacaaauuuaagucuagauuauagauucagcucauuccaauucuaacagcaauuuagaaccacuucuguagaaaucuuguucaaaggauauaagaauccucacugucuuacuguccugaaaggaaaguuuccacaaaaaucuacaugggcaaacauuccuagaaucuuaacauauuuucaaguauucaauacuuaucagugacccgacccugggcagcugguuaauucaguggucauugacuuuuaaaugcuugcuuuugggcacaccccagacuagaccauguauuaaguucaaagcuacuggaauaguagacugcaaaguuccuggaggcagggaaacacuucagcuuugccuaccaugacucaguauuaccuaucucugugccugguagguacagggcacgcaacagaccauuauugaaauaguaaauauaucacauccucagauuaaaaaaacagucuccuucugaccaaaccuaaugaugauuuacaaauuuccaaccacaauagaacguuaguucaguaauuucugaucacagcugaaaugguguggaaauccuuucuaaagaaacugggaagggugauucaguguaaguacauuaacuguaaguacauguuacagggaaaguagccuggaacuucuuucuugaauucuugaagucuaguuagaguaaauugaaggaaucagagagaacauucaagacaagaacagcauaaauaagaacuuggcaaagagcacugcucuugaccuucaugggguacuuagauuuuaaaaaagcuaacccagucuuuguaugguauaguuaucuuuccaaaauagccaaguucuuuauaaaauaugguaauuacugaauaggagaauauggaaagaaccucucaauuuuuuuuuuuuuaugaaaagaguccaugagaauaauguggguguucaauaacucuuguuuggagauaccuacccaaugccagaagcgagccuaaaagccacgcagcagaugguaugaaguugucuucuugguacccuuagaaugucuuucacauaaggacuuuugacagaugugggcauggggaggucagagaagcagcauugguuccacucaguaucaaaauaaacugcauucuuguccuggcugugugcugcuggcaaaucaggacuggcuaauuuacuaccaugauucagcacguuucucggcuggcauucauuugucugucuucuugaagccaggcugucauaaagucuaaaccguguaauuacgcguguccccguccuugcucuucucucuagccucucacugguagugaucacuaacccaccaugcagaccugggcagugaauggagccaugucuuacucuacacaucuauguuccagcaucaacggcagcuggcggucugaucugggaagugaagagggucacuagguaucuuaguuaauucucuguugcugugauaaaaugugauaaaauuacccaaagcaauuuaaggaagacagguguauuuuggcucacaguucaaagacagaggccaucauagcaggggagucaaggcuccccacagugcauugaucucugcuuuguguccaguuguggcuuucuaugaacaucucugcuggcuguaaagagagguuucuuugcugaggguugguaacuauacuuaccuguggguucgggauaagauuuagaauguaguaagggaguaugcuggucuagagaacuaucaggaguagauucucuccugagguuuaugacaucacuagccaugcuaagcugacaagguuucuaguccuggggcaugauuuccuuccuguugagugggccuuaaguaccacuaggcagacauucguuuacaccaacaugggcacgcuacuuauggcaaacauaggguuaucuugccaugguggucauugucaaguucacagggguggcaucaggguaggacuacucauugcuucccucccuuggcaacuggucaaguaccuucuuguagaaaaccagagcucaggaagcaaucuuuuauguuagauccagcucacaucauccaagccaggggcucacuuuauguaaacaaucugucacugcaggguugucucguaggugauuccugagccugucagguugacacucaacacuagauccaaacuuccaggaucguucugcaucucaaauucuguggcucucggugcucuagcacccacaaccaggacaguagaauguaacccuucucuuccucucaaaacccagcagcuuugguuuuuuuuuuuaccccuacccuguacacagccuaccuguguguagcaugccagucucuuaccccuaggaacacccacaugagaguaccccagagucaaucagaaaacuguugugguagaagcggcagccuaauggcuggcaugccuuguccccuaguguggaagguauaacucauccuggagcugcauccccacaugguuauauauacuuccuacgccauucuagcuacguauauucauuauaaccaagggagagagccaagugauuaauugagucacacaucuuuaaauggugacauuuggauuuuucugucucauuuuugcaccaguuuggcucacagggaaaagaacagcacagaaaaggccacccaaacauuuguagagcagcagaguggugugugacaaaucauauuugguaaaagaaacccccuucguuuaguaagcuaagaggaaaggccaccucaagaucugucacccauggugguacguuuuuugagaauaaagaaacuguguaauugauacucagugucagccagcgaaagcccugguuauaaauuguguggcuggagcaauccuuugcaaucuuuccucugaacauaggaaugaggaauuuguacccaacuccaguguaggcuuccuucucccaguguuaccugcuuucuacacugagugacaugcgccaccugcuggccgagagaagcguuuccauguccacgcgucgcuugagugcuuugcugccgcugacaaauuaacuggauaauugcuuuucuauuuucuaauauacugaggcaguacuuuuaauaccauugaccuaugaaaucaaauucuaugcaguuuagaaguuucuaagcuuccaguuccucucccuuaguuuuaacucacagcuuaaauuacuagauuccauuguauaucaaggaugacucugggcauagaauuuucuuucacugacauuugauucaggcauugugguaucacauuaaaauucccuuaaugcccucagucauuaaaagaugaaucauaguuucgugccugaaacugaccuacuacugugugcuuaucuuuuacuuaaauauuauaauuacucuuuauuuuauggggguggugguguugccugcauguaugucuacacauguguguucagugcucaucgaagucagaagaagacaucagauucucuggagcuggaagguugugagcugccauaggggugcuccgaauuugcauguuugugcaguguguauuauguugcuuaugucuccucuaggcuuuguggcuaauaguaauuuguuagcccacagucaaggcugucuguaaucggagacuacuuucuuccuaacaugcguguauugugcuuggccugacucuucucugcacucuuccacgggcuccucuuaccugugcugcccugagaaccuuucuuucugcugugcuccucuaugguggccucugccccuucugaucucaaacuaauaccaaacccgaugggaaauuuuuauccauccaggccuguaaaagcaucccuuuuucuucugguucucuuguccuuggcauguguuucuuccagcacauuucccccuuccccuugccauuacagacacuuacauagucaauaggcuacacaguuuuagaaagugaaaaaaaaaucauuuauucauauccacaauccuagcaacaccuagggcuggaucuuuugagugauagguauuuagcaaacaaugugaaggacagaaugaaucauuugauauugcauuuaguaagacuggguguucuuauacaggugagacuuggaacuucuacaucauauauuaccagagaccaauuuuuuucuuaacacuuggucaaaguagaaugaauuauacugaaguaaaaguccacauuuggauuccauuugucuuguuuauagucuuucuaccaaaugaacaguccugguggaauucaaugccucuugaaaggaaaaagcagcaauagcuuucuauaguuuugcagcgcugauauggauacacacaaaaaaauugaacuuaaauaaucuugcaguucccguguuggccauugucgcuguaaauguugagcaaaggcagcuugcaggauuuuuaacugugguuuuaaaguuaaaaugaccuaucugaagagaacuuuguaauggagaauaugaacacauuuucccaucuagaauuuagucuauuuaaugugccauuauuguguaggaugcugguuucaaaucugugucaccacggugacagacgccuuagaaaguguauugauuuaucacaagaacuuuccaacccccuuccaccaacaucuauguucugaaauuuauagcaccuaaagaccucuugucuuauaagaggcuauuauucucauuguggccgaaauauuuuacuuucuuacucuggcuacagagaucucauuucuccaugguguugcauuacucuuccaagauggaaaauacauaauguguucacccuugucggcccagcguuccugcauaauaaugagagguuagaagaacugcuugugacgaacucauccagaagccugaugaaggcagggacggugggcugccucugucucgaugcuccccucacuaccaugccuggcucagugugcacaauagagugacaucagagggugguccucucgccucaacuugaacugucuggucaaaccgucaucuuuagaagaugacauuaaaccuucggucaaaacaacaguuuguguuugcuaaaccaucucagauaggaucauuagccagagagaaggcaucagccugguguaauggcaugugauucacagaacccaguauaugcccaacuucuggauucauaaauuauucaacuuuuuuuccaggagguuggaacuaaggagcauugccuauugucaucugcuacugggcuucucagaaaugaccaaauacugauauugaaggccaagaugauuguaaauccagaggggacuaugucucucuuuaggaggacagaaauagccuuguguggccugaauaauucaacaggggacaauacccauuuagaaucuaauguaaagguaccuguuugaucucugcccuacacaccuccucaagcaccugaacuguguguaccaccaguucucaguuagugcacuggcuaacuaaggcccaucagaggcuccccagcauccuggaugcgcuuuggagccugguccuugacucagcugaggaaggugcagguauucagcuuccuuccaaggcuccuccuugcuccugucuaagggacacccuggccacuaagccuccaggucuggacacaacaugccuuuguucuucccugggagugggagaccuguuucucaucuuguuugacuuucauaucucuucuuauucgaaaccugaauucacauuuugaauuuaguucaaggauguggacuuuauuacuguugugacuuugaacuuaucuguaguacuacuggcuuguuaguccuuguugaacuucuuugacuccugcauuuuuuaucaucuauuaucuaucucaauucuauaggcucaggucaaauucagacugaauccccaccccaccccccauucuguuuccacccuagacuuuaccagcaggugcauuuaacacuuuagccugucuucccugaccaggcccagccuccuccacccuguauggagaagggcugcugauaccccagggccugacacugcaaggauggagccaccucacauacacagaagaaacugaggaaucuagagcuaaaugguugauuucuguuuaaggauucugucaguuuggggcagcuuuagaaggcuaggugaucacuugggcuuuuuuaaguggcuuuuuuaaucauuaaaggguuucuacauagaauauucuuugauguucgccuucucccaacuccucccagaucuucccaucucccuaccuacccaacuucauguuuguucuuucucuaaaaagaaaaaaaaaaaaaccauagaacuaaaaacaaagaagcaaacaccaaaacaaaugaaaaccacaaggcaaacaaacaaacaaaaaguccaccaaaggagacagacuaaacccaaacagagcaacagcaacaaagcucguggaaucuguuuuguguuggcuaacuacuccuggguuauggucaugguaccugccccugaguccacggaugauguaccuagugacacuccacuggcaaaugacucuuaaugacauacucuuauaugucuugcuuauuccucaucagggaagcugcuccuggcaggagacggugauuaacacagagauuccccccucuggucgaugugcagagagggagagacuucgaagcauucagcccuaagugggaugccuucaucaagcccuuccucucagggcucagugguguagaagaggaagcagaaagauuguaagaaccagaaguggugacugacuccacggcaguagugucauccagacccaacugggcugaugcacacaugugcuccaggagacucugacagcacaagaccugcuuagcagcuuuuuaaguaggaaaagaauguagcaagugguggcggaaauuugcuuuguagaacuuaggagacaaagauguuagaaauagagaaacggggcaggguagggagagagagagacugauuaauuuuugcuauagaaaugucccuucaaauucaaacacacucgccagacacuggguuucgagagguaaauucuuuaaauguucauuaguaaucagucacaaacugcacucagaggugcauuacuuccucuuagaucuuaagugaaguaaaguuagaacauugcuguggaacaugaaagcauuuuucuguacugucccacacaucaucaacacauacacaaaacagggaagugggaggagaaggagagcagacagacagacagacagacuguucuguuuucugaggcauugagucugaggugacuagggggucaucuguaugagaaaacaucacgucuguggaaauguagauuccuggauggauccccagguucacaaaacaaaauuuucugccauuggagccuuggaauuccaggcuguguccaacacaaauguucaccccuuucucccugucuuggggguuccuguguguucugcucccacagauaacccacccgaggcagcuuuugcugauuccaugugguuuugcaagacucugaacuucuaagagcaaugcagucaccuugcuggcagagguuaggagcgccauuuaaaaauaaauaccuguauuuuuaagauuucuaucauaaucauucuuuuucuaaaucugaaaaagaugaugggaauaaaaagauucgugauuaggaaauaguuauucauuagauagcggagagagaacuggaaguagauuagcugcgcugacagaguucacgauuauaaaagugcaaucaaagaugggaaaauguguucuucaaauuaaaaaugaauauaggugauuuuaaaagauacugaaaaauaauagggcaaccugcaaacugaugcugacagccuacgucaguuaauggaaaaugcuacuucuaauuacaaccggagggcaaacuucacuuaguacacuuagcaugugcagaaguuuuuaguguacccgcuauuuguccgcagaggaugcuuuagaaagaaagcugauguacccuacucugucuuaauuccuuagcauauuccuccucuuuuguucuuuugccuuggcuuugucccuuuaauucuguugcauuggguuuuacgauagaaguucugaguagggcucagguacguugaggagaaggggucaguggaauguaaagacagcaacuaaauguauauaaaacugaugaaggugggcuuguaacugcaugaucacacagggcugugguaaaucuguggcugagcaguucguccauguuucugaacuguuguaagauagccagugaaacugaaacauccuaucacacaagagagaucuggcgucuggcugauggacaaguccaggagacagaagguagaaggugaggacuagggagaggccuuaggucagaggagcuguuuucccaagacaugguaauaguaguucagggccuucacauacacuaauaaccuuaaucuugucuccucuaaaaaggaaucagggcuaucugaugacagugaagggcaggcaccguauaugggugcccagaagaacagacuugugugacaaggaaccggaguuaauuagagaccaaugacagaacagcugaccaugcaaugagaaucacgcaugcccuucugguauagaaucagaagucuuagaggacugaaauuucugaguuuuugaacuauucugcuccuguuuucaauugagagaauaaaaccucacuuggauaggagaaauuaagaaguuuggagaagcgugguucuaaggagaagcguaagugaccugaggacccagggcuaagaaccaucaggagaggcccagcccagggcacaggcuuuuucucaguagaauugaggaaggaaggauagucaaaaggagcaugagagaggggggagggaugaaggggaaagagguuuuaauugauagccacagcaucagagauacuccugauacaauaaaagcuauaauuguaaggaagaguaaggaauuucacaauggguauuuuuuaaggaaugaaaauacucgugaaaaaaagcucaaguuaagccaucccuggaauuagaaaguaacccaugccacaagagggaacucaccccggacacuuucuagagggcuaggacccaagaagccagauaaucuagagaccuaaaauagaaccaaaaugacuggcaaaaauaagucaacacaauaauuccuaauuauucugcuauacucauaaaucagugacuagcccgcaugccaucagggaggguuaauuuagcaaacagugaaauagauacagaaacccacagcuaaacauuaggcagaucuuguggaauccugcagaagacagggaggaaggaauguaggagccagagggguaaaggauaccacacaaaaucccacaggaucugccguucaaccaacaaccugcaugagacugaccugggcccccugugcacacauuucagcucuguagcuugauugauuuguggucuuccagcaggggcuaucucugacucuuuugccugcuuugaggaucuuuucccucauacuggguugccucuuccagccuuaauacaagggagguaccuagucuuacugcaacuugauaugccauguuugguugauauccauggagguuggcccuuuucugaagagacagaggaguggauagggggggugcaggggggaaaaaagggggaaggacuuagaggagaggagggaggggaagcugcagucaggauguaaaaaugaaugaaugaauaaaugaauaaauaaaaaggaguagaaauaaucagaaaggaagugaauggaacucgggugagugggaggaaggcaacuacagauuuuauaggcuguaucaagcaccuuuacggaaacucaggaaauaauaaccaucuauuaacuguauucaaagcugcugagugcauagcuaagggagaaaguauucacuacaguggcuccuccuccucuuccuccuccucuuccucuucuuccucuuccuccucuucuuucuccuccuccuccuucuccucuuguauucucuugucuacccccacucuauuccuugaagccaguacaguaucuucuauuggcuucuugauagcuucaaaauguucuguuugaucauaauuauuaaugcauuuuuauucaaaaugcgaccggaaacucuucugugcuuuucugucucuuguccuuuuguagaaacaauucugaaguuaaaaugaagaguagaauuuaugaggcuuauaaaauacccauuuacagcugggugugguggcgcaugccuuuaaucccagcacucgggaggcagaggcaggcggauuucugaguuugaggccaaccuggacuacaaagugaguuccaggacagccaggauuacacagagaaacccugucuugaaaaccaaaaaaaaaaaaaaaaaaaaaaaaaaauacccaguuacucacaauuauugcuuagugaugugguuaguaauccaguucugauuagauuacaauaaaacuguauagcaagcaauaauugucuuuaaguuauuauuaaaacauugcaaauucaaaucgugcaauugggucauauauuauagccaggcuaggcucagucugcuuuguccuaucaggaaucagucucauuauagaugauugccagcacuuaacuggaaaugaauguauaugacaccauugaaaguguuugcaaggugugauaguauccagcauggaguauagaaucugucaagcuaugaauucagaagagaaucugacagugguucaacuguggauaagauaggcaguacacucuaggaccgucuguuuauccuauaaucagcaccccuauacugagcaucuauaauaccccaagaauuaugcucugugccucacauuagaaacauagaaacaaguuugaaguucugucuacugucaugcaucauugacaugcaacuguauggcugugugauacaaccauauagauagguagaauccugggggacuuuggguguaaguguagcuguaaauacacaucauuuccacucuuuucuggaaguccuuugagaacaaggcacucaaaggacaaagaugugaacugcauuaagcuaggacacaucuaccaaagauacuucaggguugcuugggggagucaagaugaaacaggagcuucaaaagaaaaaggagaaagcgguugaagagacccaggcaagaacagaucagaaggaucagcacgugggcaccgacagagaagggcacuuguagagauggaaaagguacauuguuuacaacggaaggagggcuucugagacccugcuggacaaaggccaguucauggaaauagaauacacaggaugcucguaaaagagcuuaagaagccaugauugacagagcagcaguuuguguagauaugagaaaaguggcuuucccugugaagaacuugcuggaaucuuaccuuccauucuacuuuuccuguagagacacucuggccaaaagcaaucuugguaaauguaacucacaaaaauguuuuuuguuuguuuuguuuguuuuuguuuuuuguuuuuuuguuuuuuuuucgagacaggguuucucuguguagcccuggcuguccuggaacucacccuguagaccaggcuggccucgaacucagaaauccgccugccucugccucccgagugcugggauuaaaggcgugcaccaccauaccccgcccaacauuguauuuuuaaagaaugaaccagagaagcuuuuuuuuuuuucuguagcuuuaaaacaaaacauauuaagaaguaaaaacccauuuucuuaaauguucuaugagcuaaaaacauagaugguucagcaugguucuuccuuaggcaacuggaugcagccguugggauggaugcuuuuggaaccaaggcuugaaggaugaacgggguuuagcagaaagauaacgcuggacagcaccauccaggcuaaauccauggguuaucuagugguucagcaguaugaaaggggcccguguaaacagggaggagcauugagugcacaaagggaagacugugguagagggaugagaaguggucaggaucagaaguagacauuaggaagcagcucauaaggcuauggguagagugaguuugcacuuguacaaccugaauugaaaguucaugcgccaggcaccugaggcucagccacgguaucacccuucaggguagcguuucuucaucccuacugcauaucagaaccgcuugcaggacacuaaaagaugggcugccagacuuuacccugaaccguuuaaucagaauuccauguguaaggaugugauaccauguccagaggcuuuucugaagauucugauaacauguacgcaaauuugacuguaauguauucuucucaauucgauuuauuuuuuaauuuaauuuuguuuagcauguguguguguauauauguaugaggaccaugccaugcuaugguugucagaggacagcuuuguggaauaagcuguauccuaccguauauauguaugacgaccaugccaugcuaugguugucagaggacagcuuuguggaauaagcuguauccuaccguauauauguaugaggaccaugccaugcuauggcugucagaggacagcuuuguggaauaagcuguauccuaccguauauauguaugaggaccaugccaugcuauggcugucagaggacagcuuuguggaauaagcuguauccuaccauauauauguaugacgaccaugccaugcuauggcugucagaggacagcuuuguggaauaagcuguauccuaccguauauauguaugacgaccaugccaugcuauggcugucagaggacagcuuuguggaauaagcuguauccuaccguauauauguaugaggaccaugccaugcuauggcugucagaggacagcuuuguggaauaagcuguauccuaccguauauauguaugaggaccaugccaugcuauggcugucagaggacagcuuuguggaauaagcuguauccuaccguauauauguaugacgaccaugccaugcuauggcugucagaggacagcuuuguggaauaagcuguauccuaccguauauauguaugaggaccaugccaugcuauggcugucagaggacagcuuuguggaauaagcuguauccuaccguauauauguaugaggaccaugccaugcuauggcugucagaggacagcuuuguggaauaagcuguauccuaccguauauauguaugacgaccaugccaugcuauggcugucagaggacagcucuguggaauaagcuguauccuaccguauauauguaugaggaccaugccaugcuauggcugucagaggacagcucuguggaauaagcuguauccuaccguauauauguaugacgaccaugccaugcuauggcugucagaggacagcuuuguggaauaagcuguauccuaccguauauauguaugaggaccaugccaugcuauggcugucagaggacagcuuuguggaauaagcuguauccuaccguauauauguaugacgaccaugccaugcuauggcugucagaggacagcucuguggaauaagcuguauccuaccguauauauguaugaggaccaugccaugcuauggcugucagaggacagcucuguggaauaagcuguauccuaccguauauauguaugaggaccaugccaugcuauggcugucagaggacagcuuuguggaauaagcuguauccuaccguauauauguaugaggaccaugccaugcuauggcugucagaggacagcuuuguggaauaagccguauccuaccguauauauguaugacgaccaugccaugcuauggcugucagaggacagcucuguggaauaagccguauccuaccguauccuacccuuacacauguugugguaacugauucaagucgccaggcuuucuugguaagcgccuuuaugcacuaagcuauuucaccagcauuuucaucuuauuuuuuauuacauuuguuuauuacuuauuuaguuauuuggaggaagagugcuuuaguguguaugauugguucuuucaacucaggucacaggucuuggugacaaacaccuacacccacugaaccaccucaccucuuugauggugacuuuggccuaaugcacuuugaauuuacagaagauucaaguggggacauucacaucgguuggucacugaaaggcaugggaaauggagagggucugugagccaggaacauccugaggcucuagcguaggugucuuugcugaggauccaccaagcaagagaaagugcuguaaaaauaaccuguucgaauuuggaaggguggccaugaagguaccugcagguguaacaugucacuaagaacuuugugacucccaggacagugcgcuucaggccagccaggccuacauagugggacccugucuuagaacaaaacagcagcaguaauagaaauaguagcuaaaaguaucaaccaaagcaugagcaucgaaggagcacccuuuucagagggaguaccagguccuccucucucuacccucucucuacccugccuggagauacaggaagcuucugggugcuagauauaagacauucaccaguuuacugaagcucagcccagugcucccagaaaggaagaauaaugccucaggcagaaugccccaggcagaggacagaggguuucaagacaggagagggaggggauuaugggauggagaagcuggauccagucggggcuugauuaaguugcucauaagacauugaaucugcagugcuuacuaaaacaaucagaugaugcacuaccuccaccacuauaagaacaucccugcagcagaacugaaggauuauggguaaggauugugaucuuggcacuucuuuaggaaaauaaaaacacugaguuucuguaauauggcaacuuaaagguauuuuggguuaauaaauuugcuuuuauauuuucuucccauagaagucucaacuuauaguaacaagcaagauccccgaguucaaguccuccugccuuuccucagcacucaaggugagcaauucaaguaagauucaggaucuagggagaugguuuagcuguuaggagugcuggcuucucugacagaggauccagguucaauucccagugacucacaaccaucuucagucucaggagaucugacacugucuucugacuucugguaugcaugugguauguaacaugcaggcaagauauacauacacauaaaauaauuuaaaucucaaaaauuuuaaauaaauacauagacuaauguccagccauuucuguuacauuucucacuuaagcaucaugggucuccagauuuuccuauggaugguuaguucacagagugaagcaauaauauauuuuagcuaacauagauuuauuagcagaaauuuuaaaaauaaaacauaaauaauauuuagauuacuuauuaucucacugguuggauaugaugagaauucuuuuuuaaauuuuuauuuauuauucucucauaccauacuuuccaacuagagauucuguuccuuucacuccuccaaguucaccuccaccuccccucucccccauauccaucccugcaccaccagaacagaccaggccucccaggguuaucaaccaaacagggcacaucaauacugggugaggcaacccaguaggagaaaaagggucccaagagcaggcaaaagagucagagauaaccaccacuaccacugucaggaaucuccucaaaacaccaagccaacaaccauaacauauauauacagaggaccuaauguagacccaugcaggcuccaugguagccucuucagucuaugucagcccccaugaggccugcuuaguugaugcuaugcuaugggauaugauccccugguauucuugacccccuggcucccacaauuccuccucucugucuuugcugaguucuccaaagcuucaguggaggcacccuauggagaccugcaaccugggcucucucuccaucuaauguuuggauaugggucucugcaucugcucccaucagcugcccaaggcaaccucucugauaacgacuguacuaggcacugaucuaugaguauagcagaaaacaguuaggaacuuuuuuuuccuuuuuucuuuuuuucuuuuuuuuuggugaguuguauuugguucuaucuuaggucucuagacuauccagccucugguuccuggucauccuugagcuuccucucaugugggccucauauuagaucagucacugauuggccacucccaccaccauugccccaguccaucuuacaggcaggacagauuguagguuaaagguuuuguggaugaucuggugucccaguccuaucaugggaaaccuugccugauuacaaaagauggcugauucagacucuguauccuccauacuagaacuaauauuuuaaaaauauguuuccaguaguuucuaugagaaaguuacugaugauuuaguuuauagaaauuuauuuacuuauaaauauucuauauacaugacucuucuauauguaugugugugcacauguauggguguucaugugugugccacaaucuuugcauggguguaugcaugccuguagagaccagaagauagcuguagauguuaucucucagacaucacccaccuuggaaguuuuuguuugguugguuuuguuuuguauuguuuuuuggugaaacugucccucaccuggccuugugagguaaggcagacuuaucaggaagaugaaagaauccacuagucuccuccucccuaauacugggauuauaagugugugucacuguacccagcuuuugaaaguggguucguguccucaagcucuuucuugauuuuuaauuuugcuaaaugucauauaauauuauauuuaucaguuuuacaaggaucccuccuuguaacucauaccugcaauaucaguaccaggggggcagaggcaagaggacugccauaaguucuagaauagccgagucucccagcuugcagccugccgggugguacauagugaaguuuugccuccucuucacauacacacuauaauaacauaaaaucaagugcagaggacauuugaaucauuugagcaucuuuaaaaaggaauaguugugaggccucagagcugcucagcuauauuagacacaagaauguauaggaaaccugacaguuucaaauugccccuauuuuguuuauguguaugugcauauguuuuuguguguguccauguguaugugcaugucaacaauuaacaucaugugucuucuccaacgaugugagauagagccucucuauaaacuuggagcuuaccaccuugccuaacuaucucuggucagcaagcuuaagcagccauaaguccucaccucccagagguuacaaauacgcagcacugcaucuggcuuuuuaugugggugcuggagauccaaacucaagucuuucugcuugccuucuccccaaccuuuaacagcucauaggucuuugggguuuuuuguuuuuuguuuuuugagacaggguuucucuguguagcccuggcuguccuagaacucacuuuguagaacaggcuggccucgaacucagaaauccaccugccucugccucccaagugcugggauuaaaggcaugcgccaccaugcccggcuuucauaggucuuaauagacaaagauguacauaucuuaugucucgaaauuucuccauguuugcuugaaauacugaagcauuugcuucaagcgugucccuuuaguuuggguugcugcugcuugcauuuuuuguauucuauacaggcacuaaaaacuccugaacccaguaauaaguuggaaugcacaugagcucauaaccuugcuccuuccuuucauagaaauuuaccuaacucacuacauagcugaauuucagaaucaggcacaagagcaguauguucucuuuguauuaaaguugguucuccuggauagcaacucaucaccagcaggaaacuugggaaugcuagaaaagcaccaacauucuaccccaaagucccuuaguucuguuuggcuucuagcauagagaggagacucuagcuaagggcuagaaaacaguagccagcaggggcgggauucaggaugugagaugugggauuagccugaaaaugcaaacuggccucaccucacaugcacuuccucuggcaggaagugaaguugcauuguguguucucaaagucaggucucugcauucagcccacgucugcagcuccugcugaauccaccgcgugaacuauuuacuacugaaggaugcagucaaaccuuuuuauuuuugaacuuuuuauuaguagugagaaacacgccugauaaucccgagccucacaauggguagaagugcagagaaaacaugucuagggcaugcuuggcccuuuaugcucaaccucagucuacaucaugcucugccccacaaggcucagaggacaucacggaggaggcuucuaagagucagagaucagggcgaucuucuaugaaucagugucuucugagcguggcagggccguugcacccauaagcacaggagcuguugcuacgugcaucuauaguuugcccaagaccaaggcagucuacauucuaccaugggugagggaggaacacacaaaucccagaccugaguggaggcgcuauuugcagaggaugacuuuuauagaaaggagaguuauuuuucuucagaggcauggccuugcuccaguggaugaugccacaccugugugaauauaggcagcaugaguuggaccuaguggauuuaagaaaaaaaaaaaaaaaacaggacgugaaauugaaaaggggguggaugucucuuagcugcaugaccaaggcaacuuggaaaagaaagcauuuaauguagaguuuuacaguuccagaggauucuuauucauugcgggaaguggggagcauuguaacaggcagggaggcauggcaggagaacuaaaaccauagcagagaacuuauaucugagggagggaggaagggagggagggagggagggagggagggagggagggagggagggagggaggagaaaaauaugcauaggauauaagaaagcauacuaacugggaaugguaugagcuuuuaaaaccugaaauagggccgggcgugguggcucacaccuuuaaucccagcaauuggaggcagaggcaggcgaauuucugaguucgaggccagccuggucuacagagugaguuccaggacagcuggggcuacacagaaaaacccgucucaaaaaaccaaaaaaccagaaauauaugaaucuauggguaccacucacauuugaacauaaauuggggagaucugggagaaacuggugggcaagacuaggggguaaauauaauuaaacuacauuacauacauaaaaauauaauggagugucaugagagaagauaguaauucaucauaaaugaugcaacuacaacucauaaaauuaugucuuacuguuuuuaauuaaggaaaaauccaaacuugggagaauccagccuucaggggcagaccugacucagggcagucccucaucuguuaagcuuucguucaugcaaagaagccaaaagaggagcacagaggauacucacucggacguggaguucaucugcaugacgaagauuccgaagaagucugugaagaagaccgugaaguaccugcagccuggucacgcuccagcucuauuggaaaaccucaaacucgaggacacagcccaggcaugucucccccccccccauucuuuucucuuauucacaaaauauauaauaauucccuuguucuggaaauagcaugugguaaagguuuugcuucauuuucacauuuuuagcucacucuaauuaugggauguacauugcaaccuguguuugcuggauaaggucccaauuucuauuuuuucccuuugguuuucuacuuuggaagaaaaguuagauugcuaauaucagcacaauuuggagaacucagccaagugacagugccccaaagaaugccuggaugggaaaagagcucacauuuguauuuaacagaagagaaugacuggagaaacuucuaacuuauagcagccaugguguggugcuuugaaaaugcuuggcccaugggaaguggcacuauuaaggagguguggccucauugggauaagcguggccuuguuagaggaagcuugucacuguguaggcaggcuuugagggcuccuagggucaaacucugccuagugaggaagagacucugggugcuugcagaagauuguugcuuuguggcugccuuuguaugaagauguagaacucuccacuccuccagcacuuuaagcuggucccaauuaaauguccauuaucagaguugccuuggucaugguguaucuucacaacaaugaagcccuaacuaagacaaaugauuaaauguccauuaucagaguugccuuagugucuuaguuaggguuuuacugcugugaacagacaccaugaccaaggcaagucuuaauaaaacaacauuuaauuggggcuggcuuuacagguucagagguucagcccauuaucaucaaggagggagcauggcaggcaggcauggcguaggaggagcugagaguucuaugucuucauccaaaggcugcuaguggaagacugacuuccaggcaacuagggugaggaucuuauacccacacccacagugacauacccauuccaacaaggucacaccuauuccaacaaggccacaccuucaaauggugccacuccaugguccaaggauauacaaaccaucacacuuggucaugguguaucuucacaacaaugaagcucuaacuaagacaaaugauuuguuacccuauagucaaaguuagggaggaauuggcaucaaauauaaauacacuacuaaagaguugagauuguuuauuuuuguuuuuaauuauuauuauuauuugauaacuugugcacuuauuuaauauauuugggacauuuucacacuuguuacccccuuugucugcuuucuauuaugccuguggaauuccuucuucuuucccaagucuuaagacuaauaaauaugucacccuagaauuucuagguaugcaaauauguguuucuuuuaaagaaucacagcacacacacacguuccuacaguguucucaucauuuccuucuuguugucaggaguguguguacugauucaguuacuaacagcgcugaggauaaggaugugaugccuguaguuguaacguucaucuuguaccauguuuauugcucgugcucagaggcacuuucccuggcuggcuggcuggcuggcugucuuucuuucuuucuuucuuucuuucuuucuuucuuucuuucuuucuuucuuucuuucuuucuuucuuucuuucuuucucucucucucucucucucucucucucucucucucucucucucucucucucccuuccuuccuuccuuccuuccuuccuuccuuccuuccuuccuuccuuucucucucucucucuuucuuucuuucuuucuuucuuucuuucuuuuuuguuaagauuuauuuauuuauuauacauaaguacacuguagcugucuucagacaccccagaagagggugucagaucucauuucgggugguugugagccaccauuugguugcuggcauuugaacucaggaccuucugaagagcagacagugcucuuaaccacugagcuaucucuccagcccacuggcauccuuucuuuucuuuuuuuuuuuuuuaaagauuuauuuauuuauuauauguaaguacacuguagcuguccucagauacuccagaagagaguaucagauuucguuauggaugguuaugagccaccaugugguugcugggauuugaacucgggauaaaauguguagcccaggcuggccucgaacucgugauccuccugccucugccuccuucagcaaauccuacccgcgugcgccaccacuaccgguggcauccuuucuuaagguuggcucucucuaagccucuuuguuuuuuauguuaucuuccuggcucaucagucugacuuugauuguuucuccuaauaacauucuggugguuggaauaugcuccccaggggguggcacuauuggggagguuuggccuuguuggaguagguauagccuuauuggaagaagugugucacuguugggguggggguggguuuugagacccuccuucuagucaagugggaaccagucuacuccugguuuccuuugaugaagauguagaacucucagcuccuucaguguugugccugucuggaagcugccaugcuucccaccuugaugauaauggacucacccucugagccuguaagccagccccggugaaauguauacauauauguguguacauagacauauguguguguauauauauauauauauauauauaugauauauucauacauauacauauaaacauguacauguauguaaagcuaacaugaaauacacuaauuuaucuacugcuuuauauacacaguucuguacuuuucauagcaugcguguguguguguguguauguguguccauccaucuauucuguauaaucuuauuguagaccuuucagcauaugcacacauauggcuccucccucauuaaguuuacuauagaacagcuuaauacuuucacaggcagauguaaacugugacuguggcagaugcuuaaguuguuuuuccuuuauuguuuuuagagaguuuuacucuguuccccaggcuucucuuccuuuucagccugcagaggaguaggaaauagauuuggaugcugcucugccuagcauguuguuugugcauuuuucaguuuauuuuuauuuccauuuauguguauauauauuugucugguacauguauguggguagauacccacagagaugagaagaggcugucaaaugcccugcaacuaaugugaugggcaauugugaaccacuccauacaggugcuaggaaccaaacuuugguccuugauaugaccugucaaagcuccuaacugcucaaccuucucugcagccucuguuauagcagcuguuuguaacacaagaguaaaaacacuuaaaaugaggaauuuaacuaaaaauagaacagagaugucuuucagggaugugugucccugcauuuuuaaagauugcauucaguuaaauugauaacaagagaugagacagaacauuuggcacgaugaauacaaaauauuuuaagaggacaaacaaugguaacauggagggaugccaaacagagauuaugauuuguacaggaaucauaaccaugguauguucuggaagccaugaagagggaguugcauuauccuaaaggcagugaggcuacacuaucgguuuuacauggaagaguuguauggccagacuuuccuucagaaaggguuggucuggcauagagaaacauuuaguacagaguugguuauagaagucuuggguuugccaggcguuguggagcaugccuuuaaucccaucacucgggaggcagaggcagguggauuucugaguucgaggccagccuggucuacaaagugaguuccaggacagccagggcuauacagagaaacccugucuugaaaaaaaaaaaguguugaguuguguagucucuuuagccacauaaaaaugauccaugaggcugggacaauuccuuauucaagauauaaaaccccuuaggcccauagacagaugcaggguucaucucccuuguagaagaugcacuguuuuuguuuguuuguuuguuuauauacacauguaacaugucacaaaucaucuggguaacuccacagcucagucugaccucuucuaggaagaugugggauccuuuuaccaaacaaaagaaugcacaguuagacagucccccugcauuggcuacuagaggcaugcgcugccaugcaggcaggaugcccagcacugagggucuugcacucucucuucguuaugcaauuaaagcaguguucuaucugaugcuuaccuacacuguguaccaauaucaauaccaagaugcaaaggguaccucucuggggcugauagcugaugcauggauucugcucagugauugugcuuaacaggagucacugugaaacaggcaguucagagggugcuccagaggagaacucacuggagugugaucuagaaugauggugguggagguggucacauuuuggucacauauuagggguacugaaugagcagagagauaucgcaagagugccaacugaguuuugaacuucugaacauggcuguauagugaugauauucaccaaaauuggggguucaagagaacaacuggccuguggagaggaacaugaauuugacuuacaaugucaaacuuaacgaaaagugucuggauucacauaagacccuggauuuagaguugaggucuacacaggacauaugaccuuaugaaauacuaacccaucugagugugagugaggguaaagggucaugugaagagaaggcaaacaguugaggcuaggaagguaaacugcacagacugggaaggacuugcuaguccugugaggagagaaacuagggaugaggcuuaucauuaaagcccagggggaauaaggagauucaaaaggaccugagcaagagggcugaauucuauagaucuuaaaaaucauucuuuaaguugcccaaacuuaguagcaagcaguagauaugauauaaggaagacuuuuugugccgcugcuguugguggagagaagaggccagaagccagauugggacugauuuagagauggaggcagaauguaugucagcucuuggaaacuaaguuauuugguuuggggagauauuauauucuuggaaaacaaaaagugaaguagauaaaucagaagaucacuuaauuuuuauaaauauuuaaaacuaaaguaauuguuuuuaauauauauauauuacacaaaauauauacauauauaauugugauguguucuuaguugaucuuuauauguauuuauuggcuugugacccuccugucucagccugcugaguacugagauuauaggugugugcuaucauacccagccaaccaugcaguuaauagcgucuccgugacauagugaaaguggcuucaaguuuaccauugcuugguucuaccgcuugcuuaacuguugacacuguuuuagguuucuucacgggaaauaaaaaagcagcagagugagagccucgugcaggcaggcaaggcauccacugacguggcuagcagcagagauccaacugugaccaugguaagaacaacaucaucuuaacacucuuucacauccauaaaaauuaaagagucuacuaaauuuugguagguaaaacauagcuugaagaugaaggagcauaccccaaagacacuguuaucugcaugaaccagagagaugauaaguauucauucuuucuuucuuucuuucuuucuuucuuucuuucuuucuuucuuucuuucuuuuuuuuuuuuuagagcugaggacugaacccagggccuugcacuugcuaggcaagcacucuaccacugagcuaaauccccaaccucuuguuauuuugucuuuuuuuuuuuuuuuugagagauaauaaguaaacucugaccuaugacucccuuuuuucacgcugagagaacuuugacauauauguaaaugugugaaaaaaauguacauauaauuugaagaacguaucagaaccccaugucccaauccaaaucauaugcaauuuuaaauauggacucuugucagaaacguaauucuucuuuugauguucuggucuuuauuauuuauuuauugccugucugucugucuaacccuuguggugcuagggaccacuaaguuauaacaucagucccugaaguauaauuuugaauugacuuaaauucuccaaaagcccuuuggagaaaucaauucaggaaacacgggaacauuuuacacucaauccacuagauaaugcaucuucauucugaugguugguaucaaacagcuauguaucuuggcaacugugaaaucacuuugaguuuacgaagccaagaguggcaaugcuuugguguucaggauugauucaaggccuggcuaugucguugacuggucagucauugacugauucaaagacuggccacgucuuccuuugugaaguccuguuaaaaccauuguccauauguuauauagcauucuucucuguuuaugaauuguuugaauuguacuuggcccaaugggggacauauuucuucugauuuuacuucccuucaggggaacauaacugauacaaggcacauaauaggacuauuuaaaugaauuuauaauccuagcuagcuuguauaaaagacacacaauccagguauuuuguuuauaaaccuuaaguuuaguuugggcagguugggagcuauucuaacauauucuucagcuauaaagucucuuguuacuuacuguuucuucuggccaugugcucacgguccaucgccuuucauggcaaucuccuccaccuucgucuuccuucuuuucuucccuuccugccuuugcaaaccccucacuugauccucaagucccaucuuucucccuccacugcccaaucacaggcucuagcuuuuaauugaccaguugaauugggaagcaagguucacauagcaucaccugguguacaugaggaucuccccaugggggcaaccauaucuugagaacgcauauuuagcauuagaauacaagcagcauuagaaccacccacuacaggacuauaaagaaguuuuauuuagagaauuuaaauauggaaaauuucaaacagagcaccaucaagucccaugugcucauuucccaccccuuagcuaggacuuuguggcuaauuugcucccuucuacauuugaguccagucuugcuacuuccagacaucacacgaagccauugcuagcauuuuaagaagccaucagaagagaaagagagagagagaaagagagagagaaagaaagagaagaaagagaagaaaggaaggaaggaaggaaggaaggaaggaaggaaggaaggaaggaagcaaggaagcaaggaagaaaggaagggagggaaaugagaaagaaaguugaaaaggaauaauuuauguaugggagcagaaaaauaaaaaccuuaauaucaaugauaaggaaccaaaaucuagcaaguaaacaugaaagcaucuucaaaguuagaaaagaggucagaauguaaccagaagcugagaaggaagggagagccgcugcagcguuuuaaccacaagaccucugugauguacaguuugacacagcugcaccugagacuguuagcgcugccacuuauuuugcagaugcaucagcuucuucaugggcuucucaugaagcuguuacaucgucaucuuuucuaaaccaugcacaagauuuuaguaagugcuuauuuggaaacuaccuaugugccuuuguaugguguauuucguaaguucugaugaauuuuuguggguguggugggugauuucuuugugacucugugaucuuaucaggguauucauuuucaaauucauagaacaaauuaauuugcauaagugcacauuacugagaugcauauuaauuucuguuuggcugaaguuggaauaauucaacuaggacauaauuacuugugaacgcuuaucuguauuuucuuuuuaaaaaaaaaaaauugaagcuucuuaagccccaugauccuucguucccaguuaucuuuuaauuacugugugcaugccucugacugugugugugugugugugugugugugugugugugugugugugugcgugcgugcauguggugcaguggauggguguguuugugcacucacaugugcacacguguguuuauguguguuucauuuggaugcucugcuuguugaauaggagggaggacagcagucaguguuaacaguggaacaagaggcuguuacuuaaggaagaaaaauaaacacaacacaaaacacucucccuucacuuaccaugcuacuguuuauuauguuagugugcuuaauugauuguagagccuggagccuuauucccaaguauaagagacugagauguauggugugugcagcccaccauagaaagcccuuaccucaugccuggcugugcucuacuguacugguuucauguugucuagggaacaauuucauucugauuagcauauuuuuccccgacuguguuaauaaugucuacccacuugccuuuagacaagauucauuuucacaguagggcauuuaauuuuccucccuucugacuuuggguaccucacuggcucuugaauugacaguuucucuagcucaaaugaaaugaugauagcaccaauugcccuguacauuguaauucaaccucaccauuucuuaggguucagucacgugaucaucuguccucccaggugaccucacuguuagggcucaguguucuaacaguuuccucucuuacccuaacaucuuccauuuucucuccuugaagucuguuucuuuuuuuuuuuuaauugaaaauaucuuuucuuacacucuacauucugauuauaguuuucccuuucccaucuccucucaguuucuuccuaccuccccuuucaucuagagccacacccuuucugucucuaguuagaaaaaaagggcaacuaagaauaaaaauaaaauaaaaauaugauaaaaucaaauuggaauaagacuaaacaaacuaagagaggaaauagcugggggggggggcuggaggggggaacaugagaacacauacagagcagagacacacacauuuguaugcucaggaauuccuuaaaaacacaaaaagccaugauauguacacaaagaaucuguaggauuaaaaaccaaacaaccaaacaaaaaacaggcagguggugguggcgcacgccuuugauaccagcacuugggaggcagaggcagguggauuucugaguucgaggccagccuggucuacaaagugaguuccaggacagccagggcuacacagagaaacccugucucaaaaaaccaaaaaaccaaaaagcaaaaacaaaaacacaaacacaaaaaguauagacacaacaucacaacauuaugagacaaggaaaucccagaggugcuguugaauuucuuuauauuguccaucugcucuugggcaugggcccugcccuguccaguauuuuuaauguccuccuuucccgugcgcugugucacugguaacacuccccugcuuuacuccccaggucuugggcucaucugcuucgccugcaguugcuucaggcuguguagacuguugucacugccacagcauuuuaaauuuaugcuuggccuuucagccaguguaggccauucguuuucugcauccaugcaaugaacguuaguuaguccacacaaugcucuugguugaaccuugcacaucuuucgaagaugcagaaguuuccaacugggaauuagugagcuugaaacacucuguagacauugggaaaaaaaaacaaaacugcccugcagauaaugaagaguuuuccaaaagacaucauaauccacuuucaaaugugcaaguuagccuuccaguccugguggcauuggacucuucauaccaauuucagcaaacuucuuuuguuauucuccacaguucuauuagccuggggaucauccuugccagcaauuuagggaagcuagugugauccaaauuuaucaucucuguuccuguaaaccugaauuguucucacauuuugguguguguguguguguguguguguguguguguguguguguguguguguguguguuggggagcaaggaauaugggguugucugaguguuuuacugaaaucagucucuuucuguguggccaggaugaaaucugggggaaguucuuacccugaaucacuucaucuaaccuugauagucugaggaguaggauuuucauccucacaucacaggcgaggagaaucaaaggucucccaaggccacacugcuggaggugcuuacucugaaccucagugguccaaccaugacuccuccuccuccauuaaggggcuauugugaccuccugcucucuguguaguaacugaucuguuaucagagcagccucuuccucuuggaucaucugagacaaaccaaccuucuguauacaaacaugaggauuccaagaauacccaugcaguguauugauuggcauuaagaauuuggggcuaccaauguaggagcuagagaaaguacccaaggagcugaaggggucuguaucccuuuagguggaacaacaauaugaacuaaccgguucccccagagcucaugucucuagcugcauagguagcagaagauggccaagcuggccaucacugggaagagaggccccuuggucuugcaaacuuuauaugccccaguacaggggaacagcagggccaagaaaugggaguggguaggggagagcgggguauaggggacuuucgggauagccuuugaaauguaaaugaagaaaauaucuaauaaaaaauuaaaaaaaaaagaaauuggggcuuaaaaacuuucaaaguuguauagaugaguaucuacaggccaauuuacaggccagaaucuugaauugauauuuaagagccaaaccaccuaaaaacugguauguguacacacauacacacgcacacacacacacacacacacaaacacacauguccugccauugguagcaacaugcauagagcuaaguuauauggaacauaccaggcuucaaacacaaaccauauaucuccccacuuguuucuggaagcugaaaaaggugaucguguagauguuaguaggaaggguagccagauagaaaaggggcagauaguggcuacuaaaacacguuuccaacaggagaaaugguuauagguuguauaauucagaacagaacuccaguccacaauuauucaugcuauucuugaaaauaacugcagaaggcuucagagguuaccaacccagaacauuuuaggauauggaaaugcuaauuaccaugaagugccacuccucauuccuuacauguauugaacuuugguauucuuccauagguaaggacaauaauuauaucccuguuaaaauuuuuuaaugaccaauccauggggcuagagagauggcucaguggucaagaggacuuguuguuccugcagaagaugcuaauucaaucccagcacugaaguccauuaugagcaccccacaacuccagcuccaggagauccagcuccagggcccacacacacagcauuuguauacacauaaauaaaacuagaucuaaaaaaaaaaaaagaagaaaaagaaggaaaaacaaaaacaaaaaaaaccucaguccagaauugaguccucuuuuuugguuuuucaagacagguuucucugugcaguccuggcuguccuggaacucacucuguagaccaggcuggccucaaacucaaaaauacaccugccucugccucccaagugcagggauuacaggcaugcgccaccacugcccagcuaauauaaauuuucuuuagucugucuuucucuguauccacccuguagcuagccugaacacacacuuuccuuuuuuuuuuuuuuuuuuuuuuuuuuucucaguacucaucucuucuucuagucagccugguauccuguaugagucaucuuauagacgacuguaagagcauuucuggacagucucucuucucagcucuuagggaggagagugucuuuuuuucuuuuuuaaacaucacugugcuuauauaccuuccacuaacuuuucccauggcuucguguucucuuaccuuuaccuuuaaaaaauccauuauuuucuuauuuccucacauccauugaugauauucugaccuguuuucugucucaagcauuuccaaacuuauguguaaaguucugauuugcccuacauaaucccaguugggaaagaaguagaagcuauuuuauuguaugcaacuaugcugacuuuugucaguaguaccaaagucuggauaaacauuacuauauguucccuguuacugcucauaguguuacaucccugucaaggaccugucuaaauuuaaguaaaaacuucugugcauugcugugugauaaacuggcaauucgacccagauuccagucaaaaauuugcaacuuauuuuccacacccaagagcugggacuugaccugguaguaucagucacccaugucccgccacaacacucaaaaguaaggcagucugagugacuauuacuucauugugcauaaaagcagcagcauaagaaaggggagcaaugggaagagaauagcaagcagccuaucaaagaguugugaguucuuucaagucaugccacagccuaaccucccuagaggcucucugcuuaaagccagugguguaaucagguugucaucccaacagaugguugcaaaagcaaaugauuaguuugaagaaagcucaaucaauuuaaaaaaaaaaaaaaaccuucauguuugugaaaccgagugagaauaauuuccugagccucaaaugagaggacagaagaacaaauuuugaaauaugcaugugcgugccuucauucaccuuucugggcuacacauuccagauuuacgaagaaauuuagaaauuuuauaauucuaauauucuaaugguuauucuuuucuuguaucugucuucaucuccaguaaucuucgguugcuagaguaaauauaugaagcaaagauaguuugcuaaaaacaugugcaaauaucuauauguggaugguuuagauuuaaaagaaugagauacuauacaaccuuuaaaaaaguauugcccuauaucagaagucuucacagccaaagugaauugugcugagauuauguuuuuauauuuauuuguuuauuaucagugugcuuauuuauuauaugugcacaugccuucuauauucgugcaccuuauguauucaggggaagaggaagucagaaggagcgucagaugcccuggaacuacagucauagaugguguuaagcuggcaagugacugauguaaacugaauuccagccuucugaaagggcaacaaagacccuuguugccaagcucucucuuccauccucccauguggccuuuugaucaggcuggcuuuaacuugcugucuucugaagauacuucucccucuggugaucaggucuugaggaaagacuggcauauggauuuaucaucugaguucaaagcaucacgcucugcccuccuuuuugauaaauacuugauauucugaccuguuuucugucucaagcauuuccaaacuuaagaguucugucaacagaauucugucuucaaaagcuugauggccagguuauucucggaaaaauauuuuuaagaguccauggagucuuagauguuugggggcgauguacacgccaguguucagaacagaguucaacacaguuuggggcccaggaaagaucuguggauaaaggaacaagaguagauagagucaucaaccugugucagagucaaacuaagccucaaagacaccuggguugcucuuccuuucagucauucucccagacgggccacuugcugcugccugaaagcaccagggauaucugaaugccugggaccagugacagagcuucccuguaaauaucaagggacacucacucggugagcugcugaguugucaacuagacuccauuuauggugguuaaaauccaucccacaggacaacccggaacaacugcagcuaaauuucggguaucaguguuaaauggcgacuaacccaaaaccauauaaagaaaaaagaauaguaaagaggccacuucugcuguauucacccugcuccuuguucuggguccuaagacauuuccauaagaaacuacauuguugucgcuguaacauacacagaauucacccagugugaaccaagaaaguaccaggguuguuucuaauacuaccaaaacacuccuggggaaugcugucauacaauauaguccggagaugcccaggggcuuugaggaaaauuaucuauacccagccugucuugagucauccaucagccgaccagcagacugcucagacagacagccacaagaugaaugugugagacaugcgaaggcgcaucucaugggugacuuagacugaaucuauauaguagggaccugugagugaacuaccaacaaccaugacucaaaucauggcggccaauguacgaagcuuucuuguggcagagauugugagggucaauaaaaagauaaagcucauaacuuuagcccaaaaggaaagggaaaaguaaccgguaccugcugcgguaaaucuccaucccaaauaagccccgacaaugaaaacacaacacgguuaauaugauuacaugcagugcgccuagacugggcagaucuaccgcuacauuaccgucuuccacagcuuaugagaccccuuagaacuugcaguuucuccaggucaugugcuucugcuccacuuuucuuccucuuccuccucuguguccuuucccucuuccauuuucuccuucuucucugucuccaccuucccuuuuaucugcccaaucaucagcucucuuuuauuuuacaaauuaaggugggaagcagguuuacaggaaaccaccugaguguugauucauuccuuguucacagccacucacaggagaauuaauaucaaauauaauuagccucaagucuauccacaacagguacccauacucguaucccaugagccccuuuucauauuaugaaaagaugacaggcuguagcuuagggaagcuucaguuuccaauucaaaccuacaugcugcuugccaguuuuaucaaauuuugaccugcugugguuuacauuuuguaaacaaaguagcaauaucaccuacugccaugguugcuacagggaugcaugggauaauugguugugaugaaauuaaaauaauucuguguaaaaugaaaugcaucucuuaaauuaucucuuugauaauuggaaggagccagauucauucuuuauuguguaacccagaagaaggaagcagagaaagcaaaauuuuccagggagaauaugggauggagcaagggcagguugugaccccagaaauugugaguccuggaccugaaaaccagaaaggcuaaacagggaaaaugucagucauggaagaauuagguguuaauggcccagcaaacuucugcugcaacucucuauaccuaugaaguagguguuuaauggcaauuuaaaguugauuuauaguuuugcuacauggaaauguuuccuuuauuuguuaauacaguucucaguauuuuuuuuuuuuuugguagacuuagauuuguuuugugggaauucaacugaauugugaauucugauuugaagugucauggcaggaauugaaagcauaugaauaauaauaacaguaauaaagaaucaaggcugcuguguguucuaguguucuccaagccauaguugcuuggcuacuaaugacaguagcauuaguauauauucauagucacuguugagaagaaggaagaacgacugugugcuagagagaugaaaaagacucuuuaaggagcaagaccuauauuugucuuuuaaaauagauacacauuuuaagaaaggaaaaaagugaggagggagacauugcaaguggaacccccuacauccucccuuauucccucuccugauaaauagauagauagauagauagauagaaagauagauaaauaaauagauagacagagaugugaauauacacacacaaagagacagacagacagacagacagacagacaguugccaagcaggacuuucugucauucuucuaggguauuccuggcagaaccuuagguuauaacaggaauguguauuacaaaaggugaucuaugacauguuagcucagauucacauugagaaggguuugggaagucauaacacucuaugcuugaaguaguaagcaggcagagccugcaggaagcuuucacuguguuuuuguuaacgguggaguuuucucuuuuucuuuuuucccccaauccuuaucagacaaugaaaaugacugaaucagagggagaagguguuaaagcaauuaaaccaaacaaauaaaaacacaaguaggaucuuacugccuggaaauaagaaaaggaagaagaugagagacagauugugcauugugguaaagaguaugaaagacuuaaugauaaaaucagcguucagucaaauguacgcuauaaaggauaagggaccagaugaacaguggaaucugcuugguguccaguaauaacacugaggauuugaggugucagcaagauauuugccuuuaaaugcaaguucgguuguguaggugagggggcccaguaaaggagcugccagcacaacugcuccaugauccgguuauggauuuaacuguagauaugagagggaacagccagagaggcaucugcaagagccugggguagagagaggaagaagcagacuggccauggccaggacuaagaaugugggagagaacgaugaagguggugguaagagaguaagagagggacagagugacugagccaguggugggcucagaggagggugaggagcuguggcaauugaggggccaggaggcuagcuugugcacuuugacauuuccaacaagcacuucugaguagggacuggagggacuuugauaugcagccaaggccaaggauaaaugucaguagaaagccaaaugccccuccuuacagaagaaaaggagacuccuuuuggccagagggaacccguucuacaaguuuugaggaaugcugguuuuuauuuaaccaccagaacuccuauggucuagcuugagcugauuuggggcucuguggacugcuuuuggagucuggggagaaaguuuccuuugggccugaccaguuggcaguaucuagagcaagcguggaagguggagggugggggcugaugaaggcacugugugcauaagaugugguagcuugcccuucugugguuucaguuguacagugagagguggaggagaauaaaacaauuauuugcuaagggaucauugagacagagaagccuacaggaaagaagaaagaauuccgagagaggggguuuuuguguuccuucccgaagagacacugugucuagccuuuaaacccugcauuuugcacaaagccagucugguugagucagacuuucugaguugaguugcuguuuuguugccuccacagugaccacucuggccagcaucaucucuucuagagcaacuacagaagccucauuaagaaucuuaauauucgucgggcagugguggcgcacgccuuuaaucccagcacuugggaggcagaggcagguggaucuuugaguuugagaccagccuggucuacagagugaguuccaggacagccagggcuacacagagaaacccugucucgaaaacaaaacaaaaccaaacaaaacaaaacaccaaccaaacaaaaaaucuuaauauucuucuuggccuccaccagucuuaaaaccaugaaugucucacuugaagucuaaguugucuuaagcgcuucuccuacccugacuuuucuaauaauuccucauucucagacaaaacucaauguccuugcuguggcuccaguacuccagaugaacugagccgggcugugacaagcauaacagauauauguguguagggagucuguagacgagacaauaaggcuccuuuuggcacacagaaaucccauuuuuacaggucccugaguaauucugcaucuuuggaguuuuuaaaaaaauauuauuauuauuagauauuuucuucauuuacauuucguaugcuaucuagccccuuucuaguuuccucucugaaaauccccuaucaccuuuccacaucugcuccccaacaugucuccucauuccuuuccuugccuuccaacacucuaguaaguacuaauugaacaaaaauagaaaaauggaacaugauaucagguaccgaaaguucuguaaaagcaaaacaaaacaaaacaaaacaaaacaaaacaggcaagaagaaaagaguguaaacccaagcuuuccuuugugguuucuaauuccuggacuucauuuugcacagacccuaccacuauuaucaaagagcacacaugucuauucaagauuuuguaugcuguuaacuauugaccuagauauuggggaucuggcagagggaacguugugauggcagcacucacuccuuguucuaagcuaagcaugggcuuugacaugcauaacagauguguguguguguguguguguguguguauagggagucuuuagacgaggcaauaagggaguggcuccuuuuggcagacagaaaacccauuuuuacaggucccugagaaauugugcaggggagcuucugccagcauuccuaguccagcuggagcugagccaagaccgucauuuugggguuuuucacugcuuugggggaacugggguuccaguugcaccugauauguaggggcaggaucugaugggacauaagauggcuaagugaauacguugcaugguaggugguucuacaugcucaggaggaaccgaggcaaggggaagggcuaggcacaucuuuguugguuguguauauuuggaugguaauuuuagguaagguguucaaguagcucagagacggcagcagugaauggaggcaagaaaaaaaggauggauccaggaguaaaaccaagucaccagacagagagagccaaagaccccugagauccaagggcggcugacauauuaacggagguggggaguguggggggugugugaggagguggcugcaaagcagaaacagaagaaaaggggcagagaacauagaccagcuaggucggcuaugcaaggucuuauguuccucuugcucaucuguuagguuuucuuugcagaauugguugucaccugauauugaguauguauuguuuugcuuauuaaagaucuuucgcauacauuagaaaauaggcugcaaaccgcaggacuuugaacuucacaccacauuagggcuugauugcacuacaaacucaccuuuaauggaaaacugaacgugugaaggggaggggccuguaacaacacacuaucuaugaagaggaaaaaaacagccuguugaauugacagaaggcuauuuacuuaucugauagcuuucuuaaguccuugacaauaaugugcacccagcgggggcaaaggcaccaaggaagagaaggaaagaaaccuaaugaugccauccaguucccaaguuuccuggcaacauuuaaaucagguguugcacagcugguuacccgugcugcucuccaacauaguccgggcuuauaggucuucugacagagagacuuuacaaagugagcaggugauccuguaacuggcucgccugcccagcaggaauaaacacauucugaagagacucuuuucuucccccucuagaccaucagaaaggaugaacuccgggaaauuugaacuucccuaggaaucuccugcuaagaggggaaaugguuaaagccuagaagaaaucuccugagagaacucucugcucuuggagaaagauuuaaaauucuucagagaaccuugaaggaaagacucagggcugacccagcaggaggcaggguacuguaccuugcuggaguguuuaguuaguucaugcuuccuguuuuaaagccuacccuuagucaggaacccagagaugggcuuggggugugaccagaucucuuuguuccccuucauaauguggcuggcuaaaggaguaaaucuccuuuuuauccuuuguuuuguuuuacuuuuuacuuuuaauuuggccuuuuguucuuuuuuuuuuuuuuuuauucucccuuucucccagccuccucuguucuuguucauuuuuuguuuuuuguuuuuuguuuuuuuuuuuuugaggcaagcucucacuauguagccuuagaccaggcuggccuugagugcuuucagaaucucuucccugugccguaaguggaaugcugguuuuaaaggcaugccccagcacccuuagccuaauuuggccuuuuuuagguggcuuacugaaaaggacaggugcucuaaccuaggaagaaaaauacauuuuugggugucaacugucuacagcaagugaaccccaaguggagaggaaagauggccauucuggcugcugccugagucuuuauucuccagggacacuuuccucuuuuuuucuuuucuuuuuucuuuucuuuuuuuuuuuucucuguauagcccuggcuguccuggaccucacucuguagaccaggcuggccucgaacucagaaaucugccugccucugccuccugagugcugggauuaaaggcgugcgccaccacacccggcugagaguuuuuuuaaaaggcagauuugauggacaaaauaggcgggauuacagggucagaacauaaccauaaguuagucauaaugacauccugaaacaaaaacaugacugcaaaguggccagaauaaagucguuauaacaaccuucugaagcaguggggguagggucgcaagaugauuuugaaacaagaacauggcugccauuuccuggaacacacagugcagaacuguuuguaguuaagguucuaagugggauauagcccaaucuuugaaaaacagagguuuaaucauaaacagaaaugaaucuaguuugucuguacuaugagauggcuuuccagccuaagauggaggcaggcuaguucaucaaugaaaucaugacuggccauuuuugcaauuggaggcuccucagggaaagcacauuucaugauaaauauugacaugugucgguguugagauguucuaauuuuaguuaguugcagagacacaauacauuauguuguauguaaugucuuacaguucaguaucuuaauaucuaaauauguuacaggagguucucgguuucuuuugaggugcuuagucuuaacgugggaauuuggaaauaggacucagaaagaaacuugagggccacuuaguuugagagaaagcaaaacaauuagccuuggaaguagaguuuguagaaugcuccggggaggaacagaagucuucagaguauggacgaaaaugcccaaugucagcacagccauccuugggauuuuagauccacggaaaaaacagaauaagggagauguuaggguuuuguugcagcugccgcuacuuguuuuugugcuguuuuccuuggggcucaagagaauaguccaagcuuaccaguaaagauugcagauagcugcauuaugggaaggacagcuacugaguacuaaggacuuagaaguugccuccccaggccugagcaauaaaauucagauucuauucauguggaaaggagaaguaguuuucccuuaacaagccuccacccuucuucuuuucauuugcuauuuuggaucuugagaaggggcuguuguaauuuucccuucuguauguggguuuugucauggaaauucuacuuucuugggguccagccuuucuauaguauuauauuauagccaaugaaggggacauacuugucucuuuacaauguauuuauuccagccaggcaggcuggccacaaaauuaugcuucuccuuuaggcccuaccaugcuuguugcagacaaaauugaaguugagacauuuuaaaaaucaugccaggauugaacuguaauaucauuugccauuugggagguguuaucugucuuaugguuuaaguaaaaaucucagcagauauucccaaacugcagagugcaagccauaguccagcuacugaagaagauaaggaaacgucauugaagacagauuucuugugucacccugaacaaauucagacccucuaaacagaacugcauugugagagaagacgaaacagauguuuuccugaaacagaugacuagaaccuuaguuagagaaaaguaauguaggcagugaguuaauuaauuuuuucccuacacuuuaaauguaaguacuaaggaaaauaagccagacaugguggcguaaaccuuuaguacugucacucaagaggcagacgcaaguggaugucugaauucaaggauagccuguucuauacagagcaaguuccaccgugaaacauugucucaagaaaccaaaaccaaacaaacaaaggaauaaauaaaacaggugucugagguuguauggcuuucuaguggagacagccucaacaacagaauaggaauaacagaauaggaaaacaauaacuuuaugagucuguguuaacaagaacaggaugaaguccucugugguccaugcugccucagagggccaugucuguguugugcuguaguugggggaccuguuggugucuguggccuguguuaccaccaaaggccacuguccacguugccaucugaagccauguugauguuugugggucuugcugccacuggauccaaauugguguccauggcccuguuuaccccaagucuguguugaugucacugccacuggggucaugaugguguccaugaaguaugcugcagcagggagccauguugaugucugugguuuguacugccaccagagauccugcugaggucuguggugugugaugaugcuggagaccauguggaagucgugauccaugcuucuacugggcuguaaaggguaauggagcaaauuuugccaugguaucgaugacugcagacucacaguugagagagggauguagaaggcuucuaugacaaccccuauccccguucuacaacccaccccccaaaaguaacagccuaggaaggaaacuguuaaagacaacucuuaaaaauugugauaaggacauugaagugugucuuuccacaguugagggcuuuuggcagggaugcauguggggaaggacucaggguuuuuguuuuuuguuuguuuguuuguuucuuuuguuuucuucuucuucuucuucuucuucuucuucuucuucuucuucuucuucuucuucuucuucuucuucuucuucuucuucuucuucuuccccuucuccuccucccccuucuuccucuucccccuucuuccucuuccccuucuccuccuccuccuccuucuuucuccuccuccuccuccuccuccuccuccuccuucuuucuccuccuccuccuccuccuccuccuccuccuccuucuucuucuucuucuucuucuucuucuucuucuucuucgagguaauaagaguuuggguggaccugggaggacucaaaaguaaguaagcuuugggugcaugguguaaaauucccaaauaaucaauaaaaauauuaugcuggaaaaaaaggagcacucacaagaaguguucuuugcugggaauagugccaguuuucuucagauuagaugcuuccucuggacaagggcuugucuuaucauaagccaagucaccaaggaaaaucgauacacaugaacagacucaucacacauuaaagugcugauauucaaagacaugcaaaguuuuccugagauugucuuacagucacuccuaacugcuauggaaauuuugcuacuuauaaccugcucaaagcuauuuaguccaaauauagagaagcuuaguaucauguagcuuuucuuuauacagcagagaaaacuauuaauuuuaugaggugucagaaauauaggaaggcauacauuugaaagucacucucaagauuuucacaaaaugaacuucagaaauaugcauuuucauuucuuuuccuggaaaauucagauaguugcaauguaaacaugaacauauucuaacugcaccacaguagcugaaaaacgacuguuuccccugccugggaggcucuacuuucuguuugaauggaaaagccaagggcaaugaugggcagcuauaguuauucaguugcuaggcuacaggugugccuauuaaccugccuugagacagugcugguuuccaaagugugcaggaauccacuguuguuuccugguagagggggaaaggcaguuugacuucucuucuggccauguuugguuagagguguguauggcugaggaaggcuaaggaaacucucagaaugaagaaucuuaaggaaacaagcugccucugcagguguccauggggugggggugggguccccaaaacaaaagacagggcagaaccuuggcuucuuucuauuuucucaaucuuuuacgucauuaauuuuuuaaaaaaaauauuuauuguuuuauguuuauaugaguacacuguugcugucuucagauacuccagaagagggcauuagauccaauuaccgaugguugugagccaccauguguuugcugggaauugaacucaugaccuuuggaagagcagccagugcucuuaaccgcuagcccaagucauuaauuuuuuaacugcuuauuuuucuaccuugauaaaauuuacaacauauuuaaaggcaucauacugaguuucuuuuuuuuccuugaaggucacauucaaauucaucuccccuuuccccaugccccucccccuucccugugcuccucccacuucucugugccccuuccccuucugcaugccccuccucucaucuauggagcugucuucuggaaauguaaauuuguuuccauugagcccuguccaugggacuccggagaauucccagugugauguuagguaggugagguuuacaauuuaauuuaaggaauguuauuccucacccugacuuuacaaacauccuucauagagaucugccugcaucugaagcuggagcacuagaauuaaaggugagccccacagcagccagcaaccuccauuucuugcaccgaugcugagcuccuacuuugucuuagcugugugaugaaccucacccaaacuacacauuuauugccagugaaucgaauacuugacucacuugcugcagccucuguuacagccacauguaagaucaauuucagaaauaaauaggucauuuuaaaagucuauagagauacuaggaaugaguguagagucucaaagauggucauucuggaggggcucaccaccauagccgucuccagugacuguucacugccucaaaaaccugaccauaguuuggugcugauuuacuuaugaucugccgccugugauguggaugcugcguuuucaaggcuuggcuccgcucugucauauguccuaugugcuugcacaauuuuaaauguagaacuuguuuuucagguuugggaucaaagcagcaccaaggucucacugaaacaagaagaagaggaggaaguuccccucauaaagccagguaaaacaaugcagaggacucuagaguugcuguuguucucagucuuugacugccgggacagcaauuuggacuugaauaagcuuggguuuuuuguuguuguuguuguuguuuugguuuuucgagacaggguuucucuguauagcccuggcuguccuggaacucacucuguagaccaggcuggccucgaacucagaaaucugccugccucugccucccgagugcugggauuaaagacgugcaccacgacggcuggcuuuccuuuuuuuuucucuuuuuuucuugauuuauaagcuuguuuuagaagagcaggucucaaccuaugggucuagaccccuuuggggucacauaucagacccuuacauuaugauuuauaacaguagcaaaauuacaguuaggaagcaacaacaaaauaauuuuaugguugggcucaccacaugaggaccuguauuauguggucacaguagaggaaggcugagauccaccauucuagaaggagaaaggauagaaagagaacagugcagagacaugccuccugucuaggaacagugucuugcacacugccccacugccuucaacucccacaggcuugggccaggccacauugaauucacuuuggaaaauaguuuuuuguugagauucagaccuggaacaaaaggcugaggggcauauuuuacauaccaaaguguaccuggccuccagguucuccugacaucccucagucccuaacuguuucaagauauggcuggcagacugcccugggcccugaacuuuccagcagucacugggcauccccucccuuagaagccaacguuuugccugaguuacuccccuuccucucucucucucucucucucugucucucucucucucugucucucugcugucucucugucucucucccuccucucucucuccccccaccccgugagugugugugugugugugcgugugugcucgcgcgugugugucucuaugugucucugucucucucuuccuucucugcuccugugcuuucucuuucucuugccccuccucugucucccucccauggcaacuccacugauccccuucuauguggucagugucagaaagcugcuuccccauaaaccugcccuuucuauacucuacucuggcucaacucaugccaccauggagaauaucuuaacaauuuucacaauccguuuuaaaauuauaauguuugccccagguuucagucuucuacucuccuuccugcuuuuaugauuucuccaagacuccccaagaauaucucagcaaaucuauucaugauuuauuucauguucauacgauuuaaagcauuucagaugagauuugaacuuacagcagaaagugcucaucuaacaacguucaagccagcaaaagucuccauggacaguugucccugggaaaccuucauccuucguaguagccauucuucaucaguccaguauuugugucucauccuaaggcugccauugugcauucucucuuuaccacucugucccuggcuccaggcaacacacgcagugcauuuacuguuagugccucugguuguuuuguuuguuuuuguuuugggacaaggucucacuguguaggccuggcuggccuugaaugagcugugagaacugacuagucucagauuacagagcucuguuugccucugccuccugagugcuggaauuuaaggugugcacucccaugcccagcaauuguccuuacaguaaacuuaaguuccaaagucuuucuuagucuucuuacuuggugacccucagccaacauacuugacuuugucauuccuagcacucccccccccucuuuuucuccuuuccucuuccaucuacaccaucauuuugcaaucacuucccuggcaauguguuuuuccuggcauccucuguuuccuugguaacgucuuccuggcauccuuuguugcuucuauaaccuucgcagcuauuuacuuacaacuucaccuuugaacucaucagcgaggcccuaagaaaucacagucuuuccuuuucaucuuaauuagaaugaguuuuaauucuacaacaaggacauuuuuuugguaauggucucuuaauuuuaaauccaacaucuuaauuuuagugccaguuuuucagagguuuccaaccacuacuuugccaucaagugugguuccaauuggugauacaaaaauuguuaauauaauuuugaucuuaaaauuuauauuuaacuucaaguacucauuugaaguuuggccagaaugaauuuugaaaaauuuccaauguuugucauuguggacuaguugacuguuguuuuugaauacaagucagcaggcgaagcucguggugccaagcaugcgcuuggagagccuguacauccauuaguuccuuuuguguuugccuuaagggagguuggccgguccucaucauucuaacccuuucccuguugcucuccuguuguacauggccuucaguagcaauaaaauacagcagugguuaauucugucaaucaaaaguaccaggaaugucauaacaaggaguugcugggcuggagagaugacucagugguuaagagcacacugacugcucuucugaagguccugaguucaaaucccagcaacuacaugguggcucacaaccaucuguaaugagaucugacucccucuacuaaugagauacucccucuacuggaguaucugaagacauaaauaaauaaauaaauaaauaaauaaaucuuuaaaaaauauaacaaggaaugacugagcaggauagaagcaacucacucagcuacuucaugagccacaaugcaauuccacacagaaauuguagacuaaauggccaacuucucuuaaacuauaauucugagauuuccugagugaucagaucuucuagaaauagcagacuucuuccugcucuaaaguucaacucucuaguggagacucagcgcucaucuagacucaucagaacucugaaccugaaucccaaggugagaguggcauaggagaggaaaaacaggugggucaucuuaggagaagguagagugagaggugauuugagcagacuauaucggcuuuccacacauuuguaacaagcaucauaaaacauuacagacaagagguugcagaaguucuuuagaucauaauuacaccaauauauacuucauuaaaauuauuacaaauucccuuaagaauguguuauaaauugcccugaaauuggcauaauuuacaaauggauguuuaacacauauucaaacucuacacagguaguuagugagcuggcauuuucuuucuuucuuuuuuuuuugguguaauuuauaguaugcucaugagccugauauuuugucuguguucuuuugaagacaaacaagagcugugugaugauacuccaguagugaaaggaaauucuucagcgcuucacuggaaaagguguguauacucuaauuauacagauuccaaacgaguguaauuacgcugcuggaagguaauuaucaauguggaaguagaauaagacagaaaauaauagcaacaaaggcaauuaagaaugacgcccaaucuuacagcacagccgaaagcauaggcauucuccuuuuccguaaaucuuuucauuucuuuugugaggauguuggaauagcaaaagggagcaagcaagcuucacuuccuguucacaauagcuaaccaucuacaaauuacuguauagucaccaaagaaaugagagucgcugggcggugguggcgcacgccuuuaaucccagcacuugggaggcagaggcaggcagauuucugaguuugaggccagccuggucuucagagugaguuccaggacagucagggcuacacaaagaaacucucaaaaaaucaaaacaaacaaacaaacaagacuguaguagcccugucacuuggaaagugacauuuaaauuucuccauggcauacaucguccuuacuguauuccuccuuuuagucucacaccugucuauacauagauaguuggaugcgcucugccagcuugugucccaucagccccacuuccauuuuaguugggucucaggucaauguucccuuccuuggggccuccuagcuguccuaggcagauauggauauccacagagucucugcagaagugccuacguacaugucaaguccuuccacuuccaaaguuguuugcuaaacacuuuaccaguugcauucuaucuugcuuggcuguuuccugccuuuuccaugagaaauaaaccuaacuccguaagaacacaaucugccuuuuuaucccugugucucuaaguaaccagacagaugccuguccauagugggcacuugauguuuauuuggauauccaccagugcuguggccaggccuugucauggaaagacuguaauauagaaguauuuguuaaaauaugaguuaaaaauuaggauagagccagauacuagaauguauguauguucgggguguguguguguguguguguguguguguguguguguguguguguguguguauuaugugaauguauggcuuuuaguucuugagguucauuuuaacacuguugaaccagccuggguguuagucguaccugccuuuaauuccagcacuugggaggcacaggcaagcagaucucuugaacuggaggacaaucugguuuacagacacaguuucaggacagccagcgcuacacaaaccauguuucaaaaaaaaaaaaaaaaagaagaaaaaaaaaagaaaagauagacagaaaauaagcaaccaaugaaacaaaaagcccuguugacuuaguauaaaaugaauguuagaccuauaaucauauaaaacaaccuucauggaagaaauugaucaaauucagaagggaugguagcuaugauaaagaugauuauaauaacagugguuauuagauacugcuuguugagcacuuaauccucagaacugaaguaguuauacauuucauuuaauccucaguauccuaaugugagcuacgccccauuauuaguuguuuuguuagugcuuaggaugcuaggcaggcgcuguaccacugagaaaugucuccugcccugugacauuugacagaagaaaugcuguccugggaucuggccuaaacuauuuuacccuuacugucaacaccagagacaauuucuggcaacuuuaaaaugcuuuuagaaaaaucuuaaaaugucaauauauagaagauuauaauuaaugaucauuuggauauuuuguauauacucuuuaacagaugacuaagcaauaguuuauauaauauucuucaucguaaaacagaugggugaagcaagacaguaugcuuaacgcuaaagaacaguuagcaguagaggcaccuucuucauuauuuaaauuaucaccccguucuuaaaggccuucccaguauaaucagacaaaacucuuugaagcagagguuuauaggugucagggugaaaggauuuaaaaaaaaaagaucuuuauugcuacuugaaaauaaaagugccugucuacccucucuacccaucugaccuguguccaccuccaccugcuuugcuccagcaccuuuggugucauucucuguuguguuccaaccaugcccaaagcauuguucuugucucgugcuuuacucucaugcacccucacaugacugacacucuaggaucauuaauucuuccuccagaacauucuuccuuuauaucuuuacuaggaauuucucuuuuuaccuuuggcccuuguauguuugguuauugugcaucuuugcaaguauaaaauagaaccuacgucucuuccugcagagaagaggugagugguauauaacucuauuguugacuaggugugauaggauauaccuaaaaucccagcacuugggaagugggcaagaagaccaggaguucaagacuaucggcuauauacguagugaguucaaggucaaucaagucuagauaagauacugucucaagcaauccuaaauaauuagugaauuaucacaaacuguguuuaaucaaugcuauccccaaaccuugaagcaauguauaagacuaaguuauuauugcuauaagacuuuuguauaauccaauacgugggaucucugaguauuacauugaugccuguccuuuucuuucauuguguauuaacaauucaugggaauguuucugaaauggguggaaucuaacaugguuauucuugacaucugaaaucccagcuugcccggggugcaaauggaagauuuaaguccacguucuggacacaaaaucaacucugugaguggugacugucagcugccggcuucaccaaugccuucucaaagcaugucuguggaagaaacagcaagaaaacugcugucuaacuuaagguaaaaauaauuccuaguuuucccacaugcuguauugaaucuuuaaaauaagcagugauaaacaguguuuuguuuuauguuggcuucccgcugauagaggauguuuuugaauacauucaguggaaugauuuuaugaccuauuuccuuaaccauauuuaguuagauacaccacaaguuaauagucccuugaaagauaacuuguggucacuagcugcccacugugaugugacccagcaguaugguggauauacacacauaggcuacucuuuccuugaauguaauaaagaagauuuuuauugaauauuauggguuuuuuuuucuacucacaaagauacgcaugacauucucauggccuuugaaaaggauuuuuuguggguuuagauauggaacuuacagaagagaacugaguuucacucuuugguggguugaauuuggacauuuguagacaugguuacucaaggaauuuagaugucauaaucucagcucucaaaggagaagcugggaaggagagaugauucuggguuuucagaaugggacagauacaggagauggcuuuacugucaaaaccaugaauguauuguccacaaguguuuucucagaaagcugucauagggagggcuggguaggagcaagaguccaauucacuuaguggacaccauuaauuuuucuggguucaaggacuugcugaguuaggugagggggcuuugagccaagaagaacaacaaaaccuaagaucccuggagggacauucccauauaaggccuugauuuucuaagcaacuuaaugaauccccuuauaggugggaguucucaaagaauagacgguagaaggaaaggaagaaagaaaagccagccauggccgcugcuaacacccaggugcugaccugucuguguaaggacuggagagccacuguagacauagacucuauuaugcaucuguacagagcccuguggcagcauuagggccgaagggcuacauuuacuuggauguagagccuguccuucaagagucaugucuaacagcaguccugcuccaggagauuaagggcacuugauuuuauguaaggagacaagguugauggaccaguaaaccacuagcacuauguuccucauuagcuaugcuaagcacccauugagccugaguuggcaacccuacagucaucuagaaaggagacagaaagagggcacacccaacuguguaaagauguuauaagauuguaaaggccacuagucaaguggcuuuggauggauggauagggcagauggauaaaugagugucauauuguuaagccuaccagugaaugucugaagaaugaguucuccuuugacagcauuuuuucagaggaucauuuauuucuuacccuuugcuuuguaguuaagugacuguagauuuagccugguuuguuuacugauauuaaagucagggcauaucaacugguuacucagacuugauagugugcagucaauuacauucacauauauaaauauaauaauagauauauugauguaugugugugcaccuauaugugucugaauaaauaugugaagaucauuuaaaaauguguggauaugacuacauagaaagugacuugggacauugcugaaaguaaaccagaguuucuugauaauaauaguuauuauuuugugccuuuacaauauuuuagauauccauccaagaauuauuuugaauuaaaaccacgaauagguggauaucuuccugggcacuccccacugaggcuaggaaagaucugccugaguguguuguaacagagguugaaugcuuuccuacuuaacuuuuuuuuuuucuggugacauaaacacucuuuucagauucaccaucuuucuuaauuuucacuuggcuagucuuuuuucuucaugucaaugcaacacugguacuauuaauuuuaacgaguuccaugugaucaaaaggagguaaugcgauugacuguauuaagacguuaaacugugucugccucuauuguuagccaccaauggcauauuaaaccuucccagaaaccaucucccuagugagcacguagacucagcagugcccagaaucaucauacugagcguugauucuuaggguguuuuuuuuggcauguuugcaggcacaacuccuuuagggguccccagugaauuauagacuggcugugucugguuaaagaaaccugaaauuggauaggcuucgagaguuagauaugauaaacucucgaacaaaggaaaacaucguuaaagaauaagauaggugaaagggacccauggcaguaacggaaggaaguuuuaagaacuguuaaauaguuauaaucagaaccuacaggggugaacuuuugauacucuuuggcuuuuuuuugugccugacccugggcagggguuaauuaauccugcagaaaaaugaggucgagggucugugugugugugugugugugugugugugugugugugugugugugugugugucugcauuguuguaucacuuaucuuucugucuagucagucuguggaacagaauucccaaaggaggagcuauuuagccacaacuugcuuuagaaaggcacaaaaggcuaaacauaguaagugaaucagaaagaaagaaaaaaaaaaacccacacaacuuucagaugugcuggccguacauuucuagauucucuguucuccuagaaaugaaauauguaucaugaauauaauuaaucccagagaaauaugauauauucuggcaaaauaaaagaucuucagaccaggggacaccauggucugggaaaacuaagauccauaugugauuucuuuuuuguucuucuuugagacauggucucauuaugccccucaagauggucuuaaagucaaucuuccugacucaguuucccaaguguuaggauuaaagguugugcuucugccugggucuaucugugaauuucaagacuagcccugcagauucuaaugaaggguauugcuuuggguaauuaaacaccuuuguucugggggguggggggcagcgaauagagccaguagugguuuuucuccaggaagcuuucaacacugaauucccuauagaaaaggauauucacacaggugcagagguuuccuagaaugguaguugcagauuucuagguauuaccaaucuuugacucuuuuuaaauaugucucuucuguuucugccucugucucucuaucuccccccgcaccccucccccaagcagggauauaucugugauuaugcaugcuuuuguguguguuugcauguuugugauauguaugugguauguguguguguguguguguguguguguguguguguguguacagaucccucugaagcacugggauuaaggugccuucuaugcucacccagcaguuaguuauauggaugcaggggauccaaacaccagcucccuucuguuuuacccaauaagccaucuacccagccccccucugucucucucucucugucucuccuuuucuauucuguugcuugucuuuccuuccuaucuucuuuuucuccuuugguuuuccuuucauuuuauuguuuuaaugaacuuuuaacuuuaaaauaaagaacaaaauaaaauguaugguuuaaagagauaauaaaaauagaagugugccuuuauaauggaaauaucuugaaaaacugaagaacaaaaccacaaucaagguauuaguguugacacagucaagaagcagagcaucuccaucucucagaggcuuccuccuauugcccuuuuaugaccacgcccaaguuccaaccccagucucuguuuccugaagauguuaauguugaaaacaaaauaauuaauaggaacuagcaucuaucucugccagaaguuaaacacacaagagacaaacucuguucuuaauggcgggugcugccucucuugucuggguacacuaugauuuuguugugauugucuucuuagggaaauucuucuauacuuuguucccgaguuucagcuaucaucagaauuugagugcacaucuguggaagaacucauaacaaauccugagguaagcugucuauuuaggaacugggugacagaacaggugaacacagaggaggacguagaaaggcuuucagugacuggagauagaaauuccauaucagguaugugagaagucacugucaugacaggcaaagcaagguagagaagaucucggagacugagacaguuagccaugacuaucauggaggacagcaugguagcaggaaagcaaguguggcguuagagcaguaacugagagcucacauuccgauccacaagcacaaggcgcagagagcuaacugggaauggcaugagauuuuggaaaccucagaguccacccccagggacacaucuccaccaacauggacgugccucuuaauccuuccgaacaguuccaccaacugaggacccaagcauucaaaccugagcccauagaggccauucuuguucagaucaccacaacucucuccuaccaaauagaguuucucauuucauccuccguuauugagaugcugagcuaaggauugugcagcucagcccucugagguguucaggguacuacccuuucuaaaccucaugggaaugaugaagacaaagcagucaccaaagcuccucauggugacagugccauggaagaugggagggacaacuuuggccagcuaccucagaugcagagggugacucucacaccggccuugguucaaaucucaggggaaagugcuaacaggguuuaguacccuccagguggagguguugguaagugaggagugcauguagcaggccagugcagggaagagacacuccagguaggacucugagaggcccuucucggccaccauggucaacauggacuguaagauuggcaggugcacaaggaaaggcucucagugaaaagaacacagguuacuaauaggauagaagugccaugugcccaggauuucauuucuucaccuucucucaucucagccucucauuggcuucuacugcauugcuuagcugaaguccuuccuguaggggucaccagugagcucugggccaagugugguaguuguuuucuuaccugacuuccagagauauucaacccagguuucugcuuucuccccagagugcuuucuucucauagcauccaugaccucauggcucacuuccuuguuuucucuaccucuaccccaucaucauuacaguaauuauuuccugucugaauucuggaugcuaccaugucugaggccuuauuccuggaccauggugcuuucucugcuaaaagccauuucugggugacaucaacuaaucucuuaacuaauccugcucaagauaccugugacuccuagucuauugcuacccaaauauaugccuucuucacgcugcauuuuggauaguugucaucugauuuuccuucaccuugauuuguacuaucugcaggcugcuaaacuaggcugaguuuauuauuuaacauaggcuaccuugcuucuuuaaagaaaauaauaaauucagguaggucaguucaguuaaauaacuuaauucggcuuaaaagaugccuaguagcaguguugguggauucuaagcuuggaugauuuuucauacuagaaacaucaguguucuaacaguauuccagacagaucacucuguaaaauuaauguccuuuucuguuauugcuuaugaaaacagcuggagcgaugcccagagaauauaaacgaaaagcuaaaaacguguuucaaccagguaagcuuucuuuccaugaagccauuuauauccugaaaucuaaacaacccuaugcuccaaagaaggaauaauauguguuuugaaauguuagguuuggaagaaaaucaaguuuuucuguccuuaucaagacuuaauguguagcccaucagaugucacgaagcaacaucuuuuugaauuugaagaugcaaauguucccacaaccagugcuuauguagcacugaaauggauguuaguuuaaaccagaaaugggaauuuucaaaguuuaagaaauaucuccaaaucuuugaaagacuagaauaaaacagaaauuguugaggagucacagaaaauuaacaagcucccagguaguuuuagcuuugggaaaaaaaaaauccaugauuuguuuacauaacaaucaaccaaccuccuagugugucuccucaucagcaugcugcacacacacgcacacgcacacacacacacacacauacacguacacagcucugcuggugcuuuuucagagacuguucucaauugagucuaugaaaaccacagguaaucagagggaaacuuaccaacauaagcagcgggucacggugcuguagggugaggcuuuaacuaagguaucaucgguugauuaaaguugcuuuaccagcuuucauaugggauuuucagacauacuuaacuaugguugauucucuccaugcucucucugcuccaccucacuucccugcacauauauccugcauauacacccagcacauauacccucacacaaaccuugcaauauaccuugcacauauacccugcauauauauacucuguacacaaacacugcaauauacccucacacaaacccugcacauauacacugcauauauaaccuuuuaccccaguauucuccacugcuuucccccugucuucucugcuuccuuuagcccacucucuguuuuuguucuuucucacaaccccuuucuaguuucucaucuuuacccauauuugcucccacccggauacacagaauaggagagagaacauauuguuugucuuucugagccuaagucaccucaauguagugguuacuaguucccacccacuauccuguaaaugccauaacuucauuuucuuucuagccguauaaauucuguaguguauaagcauauacuuucauuaaccaaccgcucaucuguuaauggauuccauuucucuaguaugguuaaccauaaugcuguucaauucaauggacucacacccucuccacugcaacacaaagccaggcugguagcacggaacucuuccucagagcagauagaauucuugaauaauuacacuaccucacgcugucaacuaagacgugccugagggcaaagucagccuuacguaucuguaucacuaauaaugaaguucaaugccuugacuuaggaaguuguuaguagaaucuuuaggaaacagagcuaugggcaggugaggguuugcacauuggguuuuauagaggagcaacucacgaaaacagcauggccagcagauguuguagauggugcggaggaacuuugcacacauuaguggaugugagugagggccgugaagugugugugugugugugugugugugugugugugugugugcgugugugugugugcgcgcgcgugugugugcgcgcgccugucuuacaguucccugccacccagccagcacuccaacccagaaaucuuaagauagaaacauuuaaauguuuaucaaaguggggauugcccuguaucuguuuucucagaauucccccugguccucucaaaauguugauacgaguaaguaauaccauucuuacauggaagaggagcccgugggagcagcaugccaucuuggaaaauagcccagacccuaaauccuugaggggcucuaggaggccuuucaauauucuuuacaucaggauuuaaaaggaaauaauauuaaccaaaaaaaaaaaagguccugagagcagaauuccuuacucugcagccucugugcucugaauaguacagacuugaguuacagcaaugcgccaucacugagaugcuccacgugacuggccaucugccagugccugugguacugcuccuugagaugacgguauaccacugaggaggaaaacaaacucacacuucacaagguuucuucuugauuccaaaacuaaggucauuacacuccccucucugugccucuccaugccuucugugcuaaguacuuccacaagcuuuuccuuccuuccuucuuccucucuaucagauaguacguccaagcaucauggucgauucuuagccgcuguguacagaguuggaaugugaaauugcuuugugauauuauggggaaauaguaaugucguuaaaaauguacuugugggcuggagagauggcucagcgguuaagagcacugacugcucuccagaagguccugaguucaaaucccagcaaccacaugguggcucacaaccauccaaaaugagcucugacgcccucuucuggcgugucugaagacagcuacaguguacuuacauauaauaaauaaauaaaucuuuuuuaaaaaauguacuuguguucuuuaaaaaccuucgcagauccagaauaucuacauggcucaguaugagaaaagacucaagaggaaaaugcaguccauugucuaugaggcaaacagaaggggcuuacucaaccaaguguuucugggacagugugaacugaaaaggaagaggacugaggagaaacucagugaccuucgugcaaagcuggccuugcugcugcagaaacuucagcuggugagugacaggcugaggggcagcaacaagcucuggggaaagagccugggacuggauuucccuccuaccggugugcuuugcuaacucaccuuggggaaaccgccuaacccaggccuugaugccaggaaugauacuaaaaucuuucuggcucagaucugggcuugagggauagugugauagacuguuggggacagacaggcagaggacagaaugacagggcucugaagaaaguucaggcccuaauaccacuacaaagaggcaaauggugaccgcuaugaagagaggaaucaggcacauguggccuaguuggagucuuauguuucugagaaagaacagcggugugucacugcaggcuucuucagcccagcaggaaagggguuugggguggggacaggauguguggcuuccaaucuacuuucuuugguaaaaacucauggcucuaagcaagaagucuagggaccuggaaguguguuagguaguuacaagcaguacucuuaguagagugcuugcccaugccugugaggggagggguugcuguagacacagagaccgagcagucuggucugucuaaccauacacuguuacaauaaauuaacuuucaaggcauacauuagaauuuuucugcaccucuuucuccaaggaaacacuagaaucuuggcuuguaccaugaguugaugaaaauaccuggacaaaaggagcuuaugagagaaaagaguguguuuugguuuacaguucaaggauguggucuaucaugaaagucagagcucaggagcuugaagcuggccacauugcaccugcagucaaggauagaaagcaaugaauauauucuacuacuuaggcccuuuauccucuuacauuguccagacccacagugcacacaguuggagcgucugucuaccucauuuaacacagucaagauaaccuuccauaggcaugcccagagcccuauuaacuaaguaauucuagauccaaucaaucagucucucaauaacauguguccaauagauaauaauuuccaacuuuuucaggaagugaaauauuuuaaugcaauuuuauuuuauauaaaaauaaaaauaaaauuuucuuaaucucagagggaggaguuaaagcaaaacaaaagccagggaaacaucauaaaucuaaauuauugucacuuuugcuugaaugcuuccaugaugaauuaaguaauggguacugguccaucuucuuuuauugguauacuuucacuguacauagugaugaguuuuauaaauacauuuucuuucuaguauauuguugggaacaaaauaaaaaagggguaaccuggggcccuggggaauaacggaaaggaaaagaugcccacaccccgccagaguuucccuauucucuggucagucaggugugggagggcuacuaucuacccuaucuacucaucccuaggugggcauuccucuauccgacucuucaggggguagucaagaggcagcccugccuggggacccccccccccccagcuacuuugcuaaagcuaccaggguugugggagagagggaagaggaaagaaguucccaacacugaccagaguacgcaguggaacuugaaggagcagaacagagacucuaugguuuuagagcuuuauuauagaaaugcaggggaaagagagaagguagaaaggaggaagagagagagagagaaaagaagaaagagaaaggaaagaggagagagaagugacauaagagagaggugagaggacaaaggaauaagcgagcgaggugggggcugagcaccccuuucuaaggucuucacuguugcuagguaacuggggaggaguuuagccugaaggucagaagcuugggccauuguuuacuugacuacugaccaugcuucucuuguggggacugugggagaugguaccuuaggcaggggcuggaguuccaggagcaugagggaaccccuaccaugucauguaggugaauuaugaccaucgggguucagaccucagcucgacuggagaccagccugcaauuucccacaguauaucaugccccuuucccaugucccucuagaccuauaaagaguggcccaguuucuagauagcacauaggaaucuugguuauaucaaaaacuuaaauauaguagccaaagcuguaaaggcuuucuguggauucuagaaauauauggagaaaucagagucaaaacugaguuuaaggagccugugguauuuuagauuuaagucaugagcuaagucuuccugagcgucgcacacugugagaaggcagggaccgaccuuauggaaaacuuggagaauugggguggcuuuauccuugaaggggcuggaaaagagacaggcaaaucugccauauaucacgacagaguugaauccagccugccuggguuucugucuguaaggguucaugauucgaugaagaaugauacccugacucaaauaguauguaaaugcaagaguguuuuauucagcagaaauccagcauguuggggucucccauuaccaagacagagacacccaagugagcuugcuggccuaaaaugugauuuaaagcacauuagggaauuccagggcaggugaccucuguguuaaucuguugcauucaucucuacggauauuccauugugugugugugugugugugugugugugugugugugugaggguguuggggguagggaagcugggaacguacuguggagggaaccauuacugaggaaguagcugaggaagucuggaaacugcuucaggccagguggcugggacacuccauuaccuggucaugacguuggagccugggcuuuuuuuuuuuuuuuuuuuuuuuuucuauuaguaauugacuugccugggcuugccuggacuugcgaaguguuuaggccucgucuccuuaacugccaauuugaagucugucauggaaucagcuuagccuucucaugucuuaaguugugaacaugcugaagugcgugaguucauuuucucuaauauccucaucuucagcuucaccaagaauucuuucucuaucgaguaaaaacgagacacacaaaaaguacuucacacaagcucagguggcaguccccacuccuccauucacccaggaagagcuauggagagggugggggacuugagccaugaggaccuucgccuccggugguagggggcuucucccccacuauccagcccaaucuccuguuccccaagcccagauggaaagggguuuuagcugccagacggagaaaucccucuucauuuuggugauccgguaagugauuaagaggcuacauuauuaaagagcaaaaagauaauuuaugcuaaaugauuucacacauaguaauuguauuugggcuuugucagcacuaccacuucagccaauucuugaaagaggaaaacucugacuuccacugaagaagaaaacaguauucaaauccuuaaccacuuguaaacguaaaauaagaugaaaugagagaaaacauuugcaaagguaagaguauuaaucagacgggguguaggguugcugcuucaugaaucaccacggugacugcaggaggcuuccagagugacaggaauaacagcugagccucuccuccuggagugacuguggcuucucucuuccagggugguccagcaggagacccgcagcagauugaugcuuacuuagaagauuugcuuaaagaagaucggcucccgaccgcuuuacaugaaaagucuccagagucagcguaagcaaaagauacagaacccugagaggguaucucagaagucagaaaagauguuuuuucuuaaaaccacuaauaaagaaaacuggaaaauccuuuuagaaaacauuuccuuuugauugcuauuguaaaauuuagccugauucuuauuuuuuuuuuucuguuaucguuugcuauacauccauucccuuauuucuuaauucuuccaauucuauaggaagcaauuucuagaguuuucuacuuucccucugaggucuagagaaaaagaaacugccacuuaagcuuaaauuuugcuugauuuggaccuugauauguuuuuuuauacuaauuu

SEQ ID NO: 8264 - RNA, 2099 nt, Mus musculus
cucugccucccaagugcugggauuaaaggcaugcaccaccacaccuggcuacguuuaaguuuuuuaaucguguggugacugccuauuggauucauguacacauaugaaucaauaucuugggagauauguuauugggagauauuuuaauuucauuuauguauaguuguugcugucaaauaugagaaacagaacuucucgguuaaaggagcucaugacgcuuaaucuuuguuaucauuuugacuaaguuugaaacacagcucugaauauggccgaguggaugcugccagaaaggaagacccaccuugaauguguuccaccguccuagaguaggguccuagguugacuaaaucagaaaagaggaagccagcugaacaaaagcaguccugugucucugcuuccugcuugcagaggcagcgugaccuaaguuccuccaguuaggccuucuccaacaucuugaacugugucccucaaaacuguggagccaaaucaaaccucuuauucacuaaguuaguuucgucaaaccaacuuauugucagggcaaugacaagcuaacagguaucaucuaacagcacucagaaaaaucuauuaauauacaucccucauccucauacaacauaugaacccucguaucaucacaguuuugccugcauuaucaaccuguugaucaaauaaaaaguuguaucuccuuguacauuuaaggcccgucugcugaguuacuaguuggacaacuucuuauguucuauugacacucaaaauuuaaaauuugacuucuguagguuuuucuauuuggugaaaggucuauuuaugauuuaugugaacaauuuucgcauaaaagaaauuaucuuuuuucucauaguauaugugaaaauauuccauuuuuucaguuuuaaauauuuuauugugucuuaaggcauccauaugagauuccaauuuuuucucuaguauccauuuguuaaugccuuuuguagcuauauuuagagagaacauuauggugcuaaaguuauuuuuaacaacaauuuuuaauauuuucuuauaccuauaauaacuaugaauauauuuuuauuuguuugauucauauagaauuuauuuuguuauaagauauuaauuggaaauccuuuguguauguauuucuacacaguuacuuccugguuccauauuauauacuaaucaaucauuuccccacugaacuaaaauuuuaccuuuauuauauauuaaauuuuuuccuguauaaaucuuuuaaacagaugugaaaggaggaagacuauuugggacaaagagggucagcaggacuaggaugggagggauaagauauuuguacacaguuauaaccaugguauacauguaugaagcuauaaaacauuuaaagcauuacaaaugagucuuacauugagccuacuucuagauuuuuauuuuuauuuuuucucaugucagacucacagugcuauggcaaacuaauuaaugguuuuccuuuacauaguuuuguguaugguuuugucuauucagaccucauguugacuuaaaauaagcuuuuucaguuaccacccacucuaaauuuuauuuguauuuucuugaguuuguagugauaguguagaaaaauauacaguuuuugaaauuaagucuuucuacagacaaaaaucaagauuggucuuucuauguguuccagccgugguaacuauaguguuauugaauauucccuuucaaguauuuugugcauuucuacuuacauuuugcaguuaacucuguuagcuaauuauaaaugauguuuuuccaugcucauaugacuggaaaauguuugaaacagaaagaguccuuguugcuagauauugauacuguaucuaauauaauaaggcucagaaaagaaauaguuaaauuuguucugcaucagugucaucauuaugcaaauuuuaauaugcauaauguauaaauaauaagacauguauaauuuauaugaagagacacacuuuuaguauuucagauccuuguaguuuuaaucuaugcaaaguuuucugggaccugaaaaugaauuuccuuccucuaucaacaucagugcacauuuuuccuuuaauuuuaagauuggugauuaauaaaagugaagaaua

SEQ ID NO: 8265 - RNA, 1900 nt, Mus musculus
auacagacacgugcaaauuugucuuuauuuuuuucaagaagcagggcuaauggacaauaugaauucaucaaugggauaugagccagguuuccaaguugggauugugcuuuuguuauagucuucauuucaaagcuagguucucagcuuccucauucuuaggccaguuggcagcaacgggcgguggcccaguccauuguugagcacugacaguggcaaguauuuccaucccggauaucccaagauccacagccauagccacaagcacaaccagugacagucauuccugcauggucaugugagacacagaugucagagcccuuggacuguaagcaauggggagucucaaccugucauuucuuaggaagcauaugaguagaucuagguuuugcaggacauuugcagcuauucaaauuucacaguucuccucaagcaaacuaauugcaaguuacuuaaacugaaggacuugaaaggaggaguuucacagucuuugaauuaauagcaaacucaucccuguuuuggccccuccccugcccaugauauaaggaaauagauuaggaaagaaaugaaggcuauauccauggccaggcagaugaagaacaggaagggcugucaugugguggcaugaaggaagaagugacagaaagggcaaaacccaaaaguccuuuaguagcauccuuggggaacugaaaaucaggaacaggugucuacacaccuggaacuauagcucagguccgugguaguacaaaccugaguuaggagaaggugguaucccuccuugagcacuuacucaccagaaggacaggaggccagucugccugaagccgugauacuaguacaggagaaagucuuuguuacaguggagggacagucaucugagggagagagaaagaaaagugacauugcccaugauuuuucucacaacucccuuguauucccucuuguaucuuaagguugucacuguuuccauaaauaguccacuuaccagcuuuuaagauccagcuucuucauuugugaagagaaagucauaguuguacuuaccucauaaaguugccugugaaaauugcaugaacuaacugaaugcuuuauguucauaaauuacagucccuauccugaucaagaacauggagcucuuauugaagaggucuaaaggguaggguggugguuggagagauggcucagcaguuaagaacacugacuacucucccagaagagcugaguucaauucccagcaaccacacggugguucacaacuaucuguaaugggauccaauuaaaaagagugacaguguacucccauacaugaaauaaauaaauauuuuuaaaaaauaaaagaaaggaauaaaggggggguagugugcugaagaagcccuggucaggaaggcagggauggagaggacuaagagcuuagaccaggguacaggggauuuuaggauuuauguacagucagcaucagcaaaagcucaaacuaugauuuuuuccuacucaucucauaccucgauuggcaagaaguuccuugaccuuuuucuccacaauagauucuaagguccccucaguauucacugggaccaucagcuggagaagggagaugcagaugagaagggaacaaguuguagucuucaucuuguugaaagucagcauccuagggcuggagagaaagagcagaaaagaugagaucacugagcuaugggauggcuguaagggaaaggacauauucuggagagagcagggagagugcaacagaaguaacuguacuauaacuguucuagauguuuagagaagaagagagaugacugacuuaccagaaucucaggaaagguuccaggaccuggccagaugagaugcuuuaauacaccgugggauuacugaccuguguacccuuacuauauacaagcacacccca

SEQ ID NO: 8266 - RNA, 3194 nt, Mus musculus
aacauugauaucuaaauuaucuucuuagaauuuuuuuaaacaaaugaaaccaacgcauuccuuuuagagaacugauuccuaaacugggaaggaaaguauauauguaccaaaaaugucuggcucugccauaaaguacucaaaguauguuggggaaauauccaaugaacagccagauacagagacaaguugagcaucauaauaaugaacuguauaaccacaggcccauauagauacgacuccuuacaauaggaugucugaugugugacaacguggaugcugcacuuagaaaaacaccagcugcagguaccaugcuagcuaauuggagggagaaucaucagugaaugccgaaacgacuagggggaagcucgaugagaaauggggugacugcaugguuucauuguagaaaaaguaacccacaaagagagaaaacugucaauauacacuggaaaauccgguacauaccacuuacauuaaguugaucaaaguuaacaucaccagucuuggacaacuaccguuuaccaccugaagagggcacacaguuguuggucauacuggagaugcauagccugaauauaauaacaaaaugacagccacgucccaguugagaggcuuguacaaacagccugugugcuucaaaagugacuagaugagguacaaggaccaaggaauugucccugacuauaggggagagcagaagcaugacaccugaacacagcacugcucuagauuggacccuggaucaguaaggagauguagacuggugcuacaaaguacauuuuagcacaaaaggaaaagguuggguaaggucuauacuuuagaaaauugcaucuuaauuucuuaaguugguuuugagccgugguaauugaaaagaauuuauguaaaauaguacacauaaugauuuagccauaaaagggcaucaugccagcaguguaaaugguucaggagacgacuauguguguauuggggggagggggagcuagaguuguauauagaaagaugaaagugauaagucaugacauaauaguucaauccugauuaccuugauuggauucuggcccacauacaacauguuccauuacuauguacaacuagcauguuaauuuaaaaaccuaacaggcaguaugguuuuuggaugcuauuucucaagucucuaccaagcaggugccuaagauuaugcuaaauuuaaaagaaucaccaugacauaauauuguuaacuagucauuaaaagcuuucacuaaaaaaaaaaacaauagaaauuaugauaaauuguuaccauauugagaaucugggaaacagauauguagaaaucuguugaacuguugcagcucuccuguaagucuaaaguaauaguucauacaggugacaugcaacugggcagccucucccccgaauauaccauucauuuauuagaacaauaugaucuuccguugagaugcuguaguucaccgauaaaacaaaguuauaauuguauucacugaucaaauugaacaaauucucaaucaauccaaacaagguuucuccaccucccccuuucccuuucccuuaaauuugcaagcagugcuuagguuuuuacuuuugugguuuguuuuuuaagaguaucagaaccucuguuggaaggguucacagagaacaugcccaugcaaauagguaugagaacccuaugucaucuggugcuaugccccaucccuucacggguuucaagagagccugugugagaacacgagacgccuguggauuuggcucagagcucccagcauggaugaugagcaggcacucugugcucccugaacacaacacaguaugaagauguaggcuuccagaugauccacuggccauccuaaaauugggccagacgcuguucuuaaaauuuguguacaaguaagaaaggucuugagaggacuaagaguguagcucaguggcagaaugcaagguuaucaugcagaaggcaaucuguugagguccuagcuacaacccccguuaauauguuuuauauauuuaaaacaauguuacaauagaauuuuagaagguggaauugugugacccuguuugugaaauuacagugauuauagcuucauuuuuuuccaacuuaaugugucuaacaacuacaaaccuuaaacugcuuauucuuaaauuagaaauuuacucuguuaaauaaauaagaaugauuugaauucacauuuuuauaggcuguuuuauagaauuuaaaaugcaagagggagagcaauggccaccucauauuaacagaucuaaguaaugccucgagcauuagaauccuguaauuguguaauuuuaauucaggcacaaaauucuaaucugauuuaugguuccacucuuagcaccuuguuucaacccagaguguccccuuuauuaucuguccgugcccuacguaguacacuaacacuuucaaacuggccaucaaacugccuccgucagccaucaucugcccaaacuguugcucugggcucuuggauggcuucaagguccugugcauagucucugggcucuuggauggcuucaagguccuaugcauaaacccuuuuguauaacucggaaguuacuucauggcugcuacucuccugcccugcaaaauauucucugugcuaacagcugggaaacucuccauugccugggcaucaaaaucaaguggacagcuuaauaaaaauaccuaugugccccacccccaccccuauccagaacuaagcuacuuacaauuggcaggggcagggaagggauggcugguuugcaugagaauggccucauuaggcuccugcuuuugacugcuugguccuguggguagagauguuugagaaggaguagaagugugaucuuguugcaugugguuugucacugguggugagcuuugagguuuuaaaggccuauaccgcuccaguuggcucucccgccgccaucuccuguugguucuaagcuccuagcuacuguuccagugccaugccugccugcugcugcccugcuuccugccaugauggucuacucacccucuggaacuguaagacccaguaaacucuucuguaacuugccuugguuaugguaucucuucacagaaauagaaaaguaacuaagacagagggagaaaaucgguuuucuucaaagacaugacccuugagaaacauaggucuaccauguuccagauagccacacaccaaaaaguuugggcuucaggcucaauggauuga

SEQ ID NO: 8267 - RNA, 1687 nt, Mus musculus
cagugggaaagauacacacacacacacacacacacacacacauaaacacacacacacauacacacacacacacacacacauacacacacacacacacaaacacacacacacacacacacacagaguuaaaaugcuuauaacaguaaguuuuaugauagacaaacaaacuuuagugagaaaaaucauucuaacuuugagaaaacaaaggauauucauaagaguagaacugaaagacgauaggaauccaauaucaaggaaaauagccaggcagauagcaagagaugaaauuaugaaguugugaguggacaucauggggucacagggcuggguguugacagaacacugaaaaaaaaaaagauaaaacagagagacuuguaagaaaaguaacccggcagaaaagguuuacauagaaaauugacacaagauauuaaauuaugauaaaaugauaaaguuacauauggcagaacauuguugaacagauauguagaauugaggcuucuagaaguuuucaaauggaagaagcuaagaagugccaggauauagaaccuggaugagggaagaugcaagauuagaaacaguggugaguucucugcacugugcuaaauauauuauuguuaugcuucagaauucaaauguccuuuggaaagcuguguguuaaaugccuggcccucaaauuaacaagagggcuccauggaguaagagugcuugcugccaagccugauaacccgaggacagucccuaggaccugaauggucaaaggaaagagccaacuccucagaccucuaaacaguggcacaaguugacccccaacacaaacacauacacacuagagguggaggagagaagaaaggggggguagguggagacaaagacagauauauaggaaagcuuggucugaaccugacaccucagugggagguguuagagcucuggaaggugagaccuggcuagagaugaaaguguguuggugguaagccucugaaguuagcccugacaccucucucucucucucucucucucucucucucucucucucucucucucucucucucucucugugugugugugugugugugugugugugugugugugcgugugcgugugugugugugugugugugugugugugugucuguuuauguguaugccugugucucugugagugugucuuucugugugucucucugucugccucuugugcccccucuauucucucucccucucucccucucuuccucucuuccucucuuucaauggcacagugaggcuuuaucuaggaucccuucuuccucauuaucauacccagucauauccaagacucagacaagagaacaaccacagaucucuaaaacaaaguacaauuuuuuuuuuuugguauaaguuguuuuucucagguacuucuuaaaaaauauaaucaugaaaagcugacugacacaucuauggugucacguuuuauuguguaacuaaagggguguuauuuccauucacacauaugaaaaugagauccagaguagcuaaaacaaaggauguaagcccaucaugucuuguauaugauauaggaggacacaaauaacucaaauugcuuaugaugucaaaauauuucucaaguuacaauuaccuuugauugaguguauacuguuuuauaaggaccuuuauauguauaucaaaccaucacaacagucuuaaca

SEQ ID NO: 8268 - RNA, 176826 nt, Mus musculus
aguuggcuuagacucccgcucggggcgcucacgcccaccugcgcaccccucauugguuagcuccccggcgccuugcugcuacuuuuucaguuccuuuccucguuccacuuuuguuccaggcuagccuagguccauuucccaacgaguucuucuccaagugggacgcaguggagugggccuuccucuggggccauuguguaccguggaggacguggacugggggguagcgcgggaggagcgucucgucccgcccauuggcuccgcccgcugucuggcagaaagcagccucucaggauugguucgaagacucaaggcuccgccuuagcuccgccccacgccuuggucuccggggauggcucaggggugggguggccagugaguggucuccuccuccggcgggcgcugcggcggccucccgaguguggcgcgggacugccgggcgggcguggagcuuuuugcacgguaauugccgcguccccgcgucucgguguuccuagaucucgguggcuccuuccccggagcgcucuccuagggcgauuccacagaguccccacccgagccaccccagccagggcagcguguguguguggagugggacccgcgaucacgcguggcucgggacggccgcggugacccgaguagaggaaggaaugggucaucccgggguuggacgucucuugcuggcucgggggcccugcagcugggcgcgggccaucagggagaggggacagcccuagcuuccagcugcugucgccgcugcgggccugagccaaguggggauuuaaacagcagucccuggcuggcccggggcccgggagggagcggacucuggcugaucgccgccggugggaggugcgugcuacuggcgcuagaucgggcaggcugugggauugggaagccaggacggggucuagggcuacuuuaucuuugcugaguuccucgucucuuucccagaccccugaguggcgggcuagaggcccgagccuggaaaggguacagacguucugaaacaaagcuuuggaccacuugauaccggguaggcagaagagggaccaccggagaagugaacuccgcggugcgugcccgcccuugccggguucucaccgcuuuuuaagaagggguugcuuguugguuuguuuauuuggcucuagggaaaaacuacucaccucacugcuuuaaagaacuauuuguguguccgcagcugcuggcuuuugcgggggggggggguguugggggaauggagaggggacgcgcgcgcgcggggcgcgcgggggggguauccaaguccuccgccuuuguugacaagagacgugucccuuuugcguguguggaguacuuugcauuuauguaauaacuuggcgaaaucaaacagcgugaaggaggcuacugaagugaggcucccaacgugaauuuuaggaguugcagcucuaguauuucgaaucuggauuacagcagaaggggggggggggacgacauuguguucuuaccuguuaaaaguuguuuuguugaugauguugagcuguagcuucauagaacacgggcagaggaugcaucuuuaacuuuuaguauuguaagagcaaaucuugugucauggcuccuaacuuggaggaugcccuuacucaggguuacuaaaaaguugaaucugggacccugggcuuugucacagagacagcggagaauaucauuaauggguacaagugagccuguucaguucagguuccuguuggggaaauacuuucauauccagcuaacuuuuccucucuugaaauucuaucuugcaaaaaggacuaagauuccagauggcaaauucuaugaauggcagaaauccugguggucgaggaggaaacccccgcaaaggucgcauuuuggggauuauugaugcuauucaggaugcagucggacccccaaagcaagcugcagcugaccgcaggacuguggagaagacuuggaaacucauggacaaaguggugaguucagucaguguguguacacggcccucagcacccugaaugcgauuucuucggguuuuauuuauauguauggcuaauaaucacuauuauggugaugagcuuuguauuuagguugggccauuuuucuucaacucuguguuugcaaaaguugaauucagaggaaagacuuuuauuuuuuuauuacucuuucuaacuuauuaucuugcuuuucaaguuccagagccccuggguauuacuccaauaugcaguuuauaccauuggcuacuuuugcuggguguauaguaugguuuggaaguuugcuuagucuuauguggaguugccuugcuacuagauaauauaaggcuaacaagugaacaauaggcucugcuggagcacacuuaggacaagcacaugggugauguugaaaccuuuacuggggaaagaaccagaacuccagggaggauucaguauugaagaguuugauuuuuaucccuguaaacucaucuuuauuaagaaaauauauacauauauacauauauauguauacauauauauguauguauauauauauauauauauauauauagucuuuacuguucaggacaucgguacaguuucuuucaucuaugauuccauuuugaaacagggaaccuuuuugguugugcguuguuuauugugaaaggaaaauguaugcuggaggcuguguggggcugagagugucagaaacuucugugguuuuuuuuuuuuuuuuuuuuuuuuuguugcuuuuagaugagcucuaguuucacaggaagaaaccaaacuggauggcaguucucaguccaguuauaagggcagugugcauaccucccagggcccugcuggaaaagcuagcugucugaggaggcuugggacacagauguguugguguccuucucggcacacauucauaacuuuaugauguugagaagaaguugggcuaugcuuugcugaguuugagacauugacaaagaugcuccuuuugaaugaugaacaaaggcguguugacaucauuuggugucauuuaccuuggcuuugguuugcuaccaaagacaaaauuggcuacaaagaagccacugagaagaaguaacaauucugggaggugacacuaugggcuuuauuuucauguauucuuauggagauuguagguaagauaacuaaaccauggcccugccauuggauggccacugauaucaaacgcagcgccagagcauuuuuuuuaaccagguaaauagccuuaguauggggcuucagugugaccuauuuaagcuucugccaauguuuucacauuguuauguugaagugcuccagacggaaugacgucaugaugucagaacauugcaacuugcugcuugggcucagguuuuggauuuagcuuuggacacuucggacugaagaauugugcagcuggaaaaacugcaugcaucuggcaagcacaugagcugucuuuugcuuuucuacugagucuucuucugaaggucacccuuacugccugagucauuaauuggugguaggagaagaaauucaagguuuguuccaguuuaucuguugcauaaguaggcaacagaugggugccauuucaaaagggaguugguccaucagcaucguuucuugagauguuuaguauuuguauauuugcgauugagcucuagagcauaaaaaagauuuauaugguggcguggugagcaacaguuacugucaaguggucagugaaauaguaaaaaugaagugguaugcauaauuuugcugcauaacugguuguuaaccaguacauuaaucgcuucuaauuauuucaccaugaauuacaguaaaugccugguuauuugacaguuaaacaccuggcauuguccauuaacccuucuguggguuuuaacuuggcuucuacagcugaguuugacccacaaggaacuguuuuaccccaagucucuacuuagugggaugugggugccaguguuggcaaagggacaacaauauggcuuucccuagucaucuucauuauuugucauagaugacaaugugcauaccucuguggcuuuguggaggaaacucccaucauuugucaauagaguuuggucuacuuauuucuacucuucacacgcacuaagaguaaggcacuggaaaugacuauuaccaauuggcagcauauuauuugaaguugggauguagaugucuuccccagcauggguucaucuccuucuguuugacagugaugaaggaaguggaucauaauagcaacacuaucuggugauucuucaggaaauuuauuacuaguacagaaauaugaccaucugcuguaugaccuagagaagcagcagugugaguuuacuuugugaauacagaacagaagguuucacgucugauagguuguuaaagaaaagucaggcuuaagagugaaguugcaccguuuucuuuauggaaccucuuucccuggggaggucuucaaagcauugcuuucacguaauuacuaagcaccauaacucauuuuaaagggggcagagaaucagucuugggcagcacaggauauaucuuagaaguguauaauuuuaucauuccuugaccucuagaacuuaagaaacucaacugaaaagucaguugcaacuaaguguucuguuuucccagggcagccacucuuuccaaggucacccagcauaggagaaaacaguuguuccuuguguucuuuguaaguuguguaacguuuuuguaaucgguagugcagaguucacaguagugcaugcccugagaaaauaacaaauggugggaucccaaaagcauaccccuuagauaguuuucuggucuuaguucuucugaugagucuaagagacugacucuaaagccauaacgucaguggauggcucauugauaacacugacagaacuauucuagaauaauacacauuuagguuuaaauacauacaaaaucguuuguagauuuuguuccuaaguugcuacaggcauguuuccaucaacccuuaaacacuuauugaggguuuguugugugucacugagugacuauuacugggggugagugggcagacuagguaagccauaaccuauuuuuggccuguaaaccaggaggacaggauuagagcuggacaagaguuguaauugccauggggugugaaaagggcugggguaaaaaccuaaaaaaaaagguaccuuggugucaggauagaggaugcuugcuucccucuggauuucagucugguuucugcugccccagccuuuuaggaacaacauuauucugcuccuguuagaaaugcugaagcgaggggaaggaaaugguugcucaucggugugguuggagucaucauuuauuaaugugagguuccugagugugguuugcacagagucugagccaggugauggaaaacagaagaaagcauuuuccuccuaauagaugcuaaaugcacagaguguacauggaugcucgggaaauuaggaaauaauuacuugaugauaaagagccaagcaagcugaguaccugcuccuugucuugcuccacuugccguuuauuugaaguugaguuggugcaccaguguuagaugcucuuagaaagagaugcugucacucggcguuugcuugccuuucaccuauuguauaccgcuuagccuuaaaguaacuuugugcguaaucucaccagaauuaaauuuaaugucugucaaagaugcaugaguuauguacuuauacauauuuuuaaaauaauaguaccguaauaauacuuuuugcaaggugaguucuucaguacaucugagaaagagucuacaagauuuaaaauauaguucccugaccagcuccugacagcggagcagcugugcuacccaccacggggcuacauccccaggguauuucugacuuuuuaaaaauuuagcucuauuuccuuuuucuuugcaaacaagaucucuaaauugcccaagaacucucucuuguagccuagcuuguaggcuuugaacuuaugacccucgucagacuccauaguagacuccaugauauacaguccuauaucaucagacaugaaaguuuuggaugcuaauucugucugucagcuuuccagagcauuaauaaagggaacaccauugauuugccuuaugcauggauuuccuuuucuuucuucaaguccuucauuagacggauccugggccccauuaaaccuugauugaguuuaauaacacacuagcuguuggggcaauuuugcuuaucacugaauuacauuuugaauuugugcugacaccauuggcuugauucuaaaguuugcgacuagugacaccuggaaaagcuuuauuugccauaguaaaaguuugaaaguagaucugugaagaguuaacuuggccuaucccuguaauagaaagcaggcauauaauggaaaccuuaauugugacugauuuguuaacucuuaaaaauauuuuagccgggcgugguggugcacgccuuuaauccuagcacuugggaggcaaaggcagguggauuucugaguucaaggccagccuggucuacagagugaguuccaggacagccagggcuacacagagaaacccugucuugagaaacaaaacagacaaacaaacaaaaacaaaaaagaacauuuagauuuuccuuucuuuuaaaaguuucuuauaugcugucaauuucuuuaucuuccccucccccacacccccaaauucuagcccuggacagacaucguuuauaaauaauaucauacaguauauuaaauaagcacuauaacaugaugcaaauacuguuccuaguagguggaggugacuguugcuugcuggaggugagaagcuggugaaaggugcugucuguguucuaaaagauuguuugaacucgaggggcuggaaaacaucuuucaccgaaggaaugaagagaggcuguugugugagaguaaaguagaagaggaugguagaaguuucaauauuaccaaagaauuuggauccaguuaguuugguaaacauauaaaguuuucugaggggggggggagagagagagagagagagagagagagagagagagagagagagagagagagagagagagagaucaaggccagucuuucaugugcuacucugcagagucugaagguuggcgcaaugcaaggaagacuagggaugggaucaggaggagucacagcaaugugguuaagaauuuauaaagaccugguccuggucuagagacuugacaguggguuggguuuagcaagugugucacagauguggaagguuauggggggaaaaucugcaguccccgagcaucuugaggguucccgaaagaaagagaagacgaagugaaaguggcuugagguuuucaagcuagucaacugugaaggcaguggagcccuuaaggagauggggcccaggaagggaaaggccaaacuugaugguuggcaugucugucuguuguguguugaguaugaccuaugagagagaaauugauuuugaagucagaaaauuggguauacaguuccgagagaauuugaaaccaggaucauauguuugucaguuguguuucuaggccgagcaucucaagcuguagcacugcgaaggaguuaggaugcagaucuagacucagagacaaaggcagaacacccgucauggggagcaggagggauauuucuuuagaguugguaaagagaugggaauuaggacauagaauagcaauggaaaggugaagaaagagcaguuguguauuaaucucuacaucuaaacauagagaagaggauuccuucaacuucuuacaaagcuacauuuaagaagagaaacuaaacaggguaaaacuuaggaagucauuggauuuccuaaucagaggcuauuguugacuuuggcacauugauuucacuugugaugaggccaggguaggaugugcguggagauuauuuagugguucuacaacuguaacaacagacacagagcaagcugugguagcuugaggguuuauugaggguugaacuuauuaauuuuaucgugugucucugugucuguccaucuaugcaugaacaaggcuuccauuguaccagcagaaggaauacaugaagguguagauuacagugaggauggagaaagcucuauggaagcaacuaggaguggcuaagugaggcagacagguauaguuuccacauaggcaggagggaaaugagacacacguaggggcguuuuaagugaauauauacaucucuuuuggguugguaagaaguaguguaagaugguauuuguaguguuuaagccuuaucuuuaaaguuguacauuauagaccagucuuccaacaguggagugggugaguuauaugaauugaaguggccuucuggcuccucccuuuacauuaagcaucaucuuacgcacaugcugugaugacaaugguugcugugccaucuucuuugcuccuauuuauggcuuguuuuuuuuuuuaaacuauuuguuggaugccaguuuuuuuuuuuaaaucaaugaaagaaacuuuagauauuggaccaacauguacagcuuagcauuucacauuugaguaguuguuaaacugaaucaaacuugcacacaucagcaguuaaguuaguacuaguucaaagauaaaauuucccuccgucuuuaguucuuuucuugagagucucuuagguuugaagaaacuagaagauggccauguaaacugacuaaaauaggggccugccuugggucuuaccccauauagaacacccagacucuuuauaguggccugccuuuggucucaccccuguauagaacaccccagacucuuuacagauuucauguagcauaaaaaguuuucaccaacaggaagagcccuuaaacuaucuugauguugagugggcuaccuagugccuuuaugaccuuguguuuuuauaaaaucuccaugggcuuuucuuugcugugauggaauauaauguaugaagggagaagaacaagaaggaaaugagggauggauuuucacugcauguugugcugagaacugcacuucuuauuucucuuuaaaagucuguaaaucagugagacuucuagaaggaagcagccaguuuggauuguacuuaaugugugucccuuguauuaggacagugcugcacacuguugcaggguguucucuuucuuacaggaaguaaaucacaaggguguuuauuauuuacauuuugcacuaccaaacucuucuccaaauuuuguauucaguuuuggagagauuuauucaauaauuuuaugguuaucuuuucucucucucucucucucucuauauauauauauauauauuuuuuuuuuuccugcaaugucuuaacucuuuuccuuguagccuucucuccaucaaacacaugcuguacuucuuuuuauacaaagugagaaagauagaccagugaaaaaaaccagauauguucuccaguagaacagaauacacaauguguauuuuaaguauaagcaguuguuucguaagugguccuuuaaauauuaacucccuaaagguaaugucauuguaaaacguaacagaauuaaacuucucaagauuccacuauaaccagucuuaagcucuuggccaguuuuauaugcuaacuuuauuuugcuuagcuaauguucuguaaaaacugcuguauuauuuuguacucacuauguaauaguaugucuucuuuuauguauacuuuauucuuuuccuaggaagcuguugaguucagguagaaagaacauacagacauugagaugcuuuuuagacccguggcuuugguguagccgaguaagaagccucugagguuuccagaagaagggcucucacacucuugucuuuagaaucagggacccuauuggcgugcuccucccuggggaggacuacuucuccugcucccagcuuuagucacuuguaugcaguucuuuguguagaauugaggccucugcuuuggcgugaacauugguguccucccugcucaacucauuuuuggcuggucauguuagugagacucuacagggacagcuucucguguuacuaggagacacaagugcccaaccaagucccggguucucugacucucacaguguuucugcccuugauugugcauuguuuccuaaguccuagguaugggaauguuuuagggauguaaccacuaggacuuguccagugacaaaugcucagccaacccugaaaacauacauccauguacaauguauggacuugacagguuauauauaugaauauguauguacaugcagauacauaugugcguauaacaacaacugaugaaaauagaaguuaggaguuugaagaagagagggaggguuauaugggaggguuuggagggaguaaagagaagagagaaauguaauaaaaucugagagaggggggguucuugggucuuagcucaguggugguagaauauuaggguccuaucuccagcacacacauauaaacauaaaauacguacuuggcuuggagacuaagugacucaauaugcuuccaguauccaugaguguuccuugggaugaaguacguuuuggaaugaaaguuauuuacaguauagucacaguugcuuaccauugacauguuuuugguuuguaaaacuucuuuuguacauuuaggaacugauuuccacuuuauuuucgaggugugcuaggugaucugaaacucuuuauuuaccuuuuggcuggacauuuuccuuaagacacagcuaaaaaucuuuuuuucuucuuuuuauuuuuauaauuuuuauuauaaaguuuuuaaauuuaaugaaaauuuuuuuuacuuauuuacuucagaaaucuuuaaauguaacauuccaaaguaauuaauggcuugaaaaaaucuuauagcaauauuaaauucuguuuuuauguuugugccuuggcuuugauaauguugaaaaaugucuaauuauauggucacauacaucuguuuuuauuaaaauacauaaaguauauauauauauaaaacaauaauguuauguauuugaaucaacauaaacuauaugaacauagaguaugcauugacaucuuugaauauaacuaaauccuagugucuguucuguaguguagucucugaucccuaaguuagucaucuggguacugagaaguuaguccuaaacagggugcauuuccguguuuuaaugcuagcaugccacaacaagaaaaguucuuuuagugauucuaaagguuuguaaagacuucagucucaaaauccuugggccagaugaugggauauucagcuuaauuccaaaccugaauuucuuuuuugauuaaaaagaaaagagucaucauguuaaccaauucuuuuaguuaucagugccagccuuaaaaugcccuucauugaauaacauagugagguuuauuucuuugugaaagcuccuuuguuuucccaccagcuuucauuguagggugcagcucagauaguucuagaacuuacucuugugguaagcuucauuuuuccccuuaauacacugguuuuagaagggcuauuuuucuuucucuggcuuugccguuccgugcacauagcaagcacucaauaaauauuuauugaauggaauugaauuugaccugcuuagaagucauaguccugggguaggauuauucauuuucggcaggagcggcuauaaaucacagaguuuagcaguaauccaucugaugaagugcacacccgaaggcacagagugguagcucagcucccucaauccugccuccucccguggaaaguuugagcacgggguagcuuucagaguccuggugcgcuaagguacacuacuccuuccaaccuccuucgggucuucugaacugugugcugacagccuuccugugugcccauccucuagcacaacugcaugaucccguuccuuuacccuggugucucacaagccuuuguauuaugauuuagcugcaauauuuaggcgugcguuucuugaugcucuugggaaugugacuuagccacggccuuucucccccagagcuuugcaagguccuuugucacacuucuagguucugugauccuuucuuacgcccccagacuuucccaccauacugcugcaugaggacaggucugugagugacuccuuugucuuccuucugccugagacaaugccuguuauguacacguucuucccuugaacuaacaaaugggccaugaaguucauguaaauucgcaaauggaauaaaauaaaaauggaaaugaguuuagaagggaaucauuaauuauaugccuaauucuaauuaaauuguaauauagccagaagaggaacccgagauucagaagaugcaggcucuuguguuggauuaauguuuuuuuaacugucccuuaaucuuuguaguucuuagcuuuuuuaauccggaaaugaauggauuggaugagaucuuuucuaagaucccuucaagcaagaauuacauugcuccuaaguuaauuauauagaacgaggucuccuuugccagacuccuugaggcagggagcguguuguacucauccguaauuuccuggcacguagcucaguaccugguggaugggaguuauucagagaguuuuuguccuuuaaucaagcaauguguuuccaugugaaauuauaauuggaaaaaaaaagcaagugacuaaaaugucauauaaggaauagugaauuagauaugauauguaugacacugaaaaguaucuaccaaagaacaauuacuugucaugucuaacacguuugugauguuuuucauuaaguaguuaacaaauuaaccaauggaacaaaugaaugugaggcugcccuuuuuacaaguuaauaauugaucagucugugacguuuuacaaggacauguugcuaaaauucagcgguguccaccgugagagguugguggaguucuugaaauucaccugugcucugguugcucuuggcuuuaagaauugaaauacuggagcggguaagaugacucagugauaaaagacacuuguagccaagccugugaccuaaauuuuaucccuuaacccacauggugggaagagagaagcgacuuaaucaagguuuccucugacuuccacucagaugccaacacacacacacacacacacacacacacauacauacacacacacacacacacacacacacacacacacacacacacacacacacagauccucuuugucauauaucucagcucuguaagcccuuuuacucuacaaagacuugguauuacuuaauaagggagauuccaucugaccuuugccaaaaaaaaaaaacccaaaaaaaacaaaaaaaaaucucuugaggauuaagguaguauucuuauauuuaaauuaaacccuuaccccucauuuguuaauuauauaccuauagaacucaauuaugaaaauuaagcaaauuauauagucaaaccauuuauaaaaagugugugugugugugugcgugugcgcacgugugcccgugugugugguguuucuuucauuuaaggcuaggcucacaauuuaaaagacaagugugugugugcauguuuauacacugauuuuuuucagucaacuaaaccuguuuauuaccugcuuauuuauuaguugaguaucgugugcuaagauccuggccuuaggaacuguguacacagugggagaaaauagggaaaauaggggcaugcaacaggucauugugagaauugauuucguucauggucaaugccuggccugacaauuuaggccagagugguuugcuuguuuguuuguuuguuuuuauaaaaaauauaccuaugcaaaugugauagucugagggcuguuuauuucauugcugacaaauuuacuuugcguuccugcuuucuaaagugauuauaguuuaccuauuuugaguuugugauaauacuuuuauggggucuagaggcagguguugaaaccugaaacuauugucauuuggagggucccuacuaaaguacuauauaagucugauuaugaaagagaauuuucuuuaguguuaagcaaacaacaaaccccagcaaauuaagcuuuugaaaagcucccaagacugcacauguugauaaacaugucugcacugcuaucugacaagcugccucuugcuugcauacuccucuguugccuacaugcgcuuccugcccuggcuuccuugauccuauuuagauagcauauugaaauagaccuucucacgcccgaagcaggacagucagugcuuaugauauuugcguguuuguguguaccugaagccuuguguguguguguguguguguguguguguauauauauauauauacauauauauauauguauauauauauauauauacacauauauauauauauauacauguacauauuauauguuucaguaaaaguuguguaucuguaagauuuauugcaauaugauguaccucuguagagaaagagggaguaaacaugucugccuuguuuuguaguaagaguggcuauagucuuuuucccuagagacuucaauuugcaaggugacacugugaacugugguucucugugcuuuguguuuggcaucuagacuugugcauccccuuugaccucuaucccccacuuucccuucuccucccugcccuugagagccaucauucgauuuuguuucuacguguuuuacgucuucacuuuuagagucuguauauaaauaagaucacauagcaucucucucucucucucucccucccucccucccuccuuccuucccucccucccucucccucucucucucccucucucgcuuauuucagacugccgaccauaauuucucuauuuauggaacugacugcaugcuuugcauauaaauucucuaaacccauacugaaugucucucuaacuuggccuccuguuagccagguuccagaaauguccuuuggccacuccguugccacccaaaaggagguucauugugaugggaaggaagaugcaggaucauuuauuuauaguguuuaaaauuguaugcucugagaucuuuuauaaaaaccaaacaugcacaaaaccuagaggaaaacacaucagaaggacccaggggccuuacgcugugcugacaugauagaagcuccugccgguggacauugcgccugucaugagugcuggacuccuaccuuaugaaugcaccaugcaguucccaaagcucuuuuuaaaaugauugaauugguggguucccaaaacccuagucacaaggaugaaaugaacugguuuuuauuaauggcuaaguuaccuuuaccuuaacguguaaaggugaaugccguguaguuuuaaauuaccacuucuuucuucucuucuucuucuucuucuucuucuucuucuucuucuucuucuucuucuucuucuucuucuucuucuucuucuucuucuuccuccuccuccuccuccuccuccuccuccuccuccuccuccuccuccuccuccuccuccuccuccuccuccuccuccuccuccuccuccuuauuuucuucuucuucuuucuuauuuuuuccuggaggaaaguauuuucaguucugcaggcagcccuuccucuuuaaugcgcacugaaugcauggcaccugguggaguggcugaacggugcauguuucauaggucacguguuucuaggccuauuagacacuaggaagagagacaggcuucuuuagacuugacaccuguuuaacugcuuaguaacucaguugugaagguucagaaauagugcauucaaauauuaaagucugugaaaaagcuuuagccaugaacuuaauacagaaaaguagcgucuuaaaauuagauauucauugauugcuugcuuucauauaaaaccauauugguguuaccaggccauuaguaacuacuacacuguguucuauuagacuguacacucuaggacacuauggaaaagguaaucaaaaugauuagaggugaaaaugaggauggaauauagcaaaguuugccuggaauaagaaaacgggauuuggguguuguaagagaaaaguauuuauagauacuuucuaagcagauucaauaauucagaucacagauuguauuauggaaaggaaagaggacauagcucuguucauuuauaacuuuccuaugacagaaaauaguauaguauccauaaaguaauuuuuucuuuguuuuuagguaagacugugccaaaaucccaagcuucaguugaaaaacagcccaccguauauacuugauauuuuaccugauacguaucagcacuugagacuuauauugaguaaauaugaugacaaccagaagcuggcucaacugagcgagaaugaguacuuuaaaaucuacaucgauagucucaugaagaagucgaagcgagcgauccggcucuuuaaagaaggcaaggaaaggauguacgaagagcagucgcaggacaggugagcacgugggauuuguacuguuccuugugucacguucuucccauuguuuugugucucaagguuaacagaagugcccuucauguguucuggggacuaugcaguuuccuugccuguuuccuuuuccuauuauuuaaguuuggcaaaaguugagguagaaugucgaaccugagccaauggucuugcuauucucuggacuccuuuuuagagcacuucauguuucacagaaagacugcccacgguaguuccugcugcuuccugccaagcaagccgucuuccccagcuuacaucuuuuauauggauuuucauaaagacaugagaauaagcaggucuucucccuagauaagccacugacagaacaaagaaacaaagauuccauccugguccagcuugguaaaacagccugauuugggguuacauagcgagguugggugacugugcucaugagaagugucacugcagaguaccacccuagcauggaugauggcucugaaguuguguucuuagaaucauaucuucaacuacccuuccucuuccuauaugacuccucaccucucgucaaauaccaagagccuugggucucagaggcaauggcagcuggacuaucagaugcuccauuuccguggagguagcuaucacaguaugcuuuugucuauuuucuugucaucuguguggggucaacguauccuguagaugaucguagcaguaucaguuccgggauggauaugucaugcucagcauugagaauggagcuucacugcugggccaucuuugcuuuaguguggcauacacuaccauuagcauaggguucacuguuuuuauuguucugugguuuacaaacauacacuugucccaugucuacccauacccuguaaaaacucccuguguuaggcuggguaaguggcucaguuguuaaaggcuauauauagcacacuauuaaaaugacaagaaauguucuaccuucaaccuacacagugugcaguaaguaacuguucagacugguuucuugcuggucuuuuuauagcuugacagccuccuuucuuauuucauggaugaugacauuguauguuuguacuacaguuuguuucuauacucacucuuguguugaaggguaccuugauggcuucaaacguuuggcaacuguguuggagcugguaggaacauucaagucaucuggggaaauccuuggcgcauggucauuagaucuuacgacuugccugugugaauucuauccugacauagugacuguguuguuuuccauucccaccaguaaugagugagauuucuugaugcuuauuugcuucagcaucuggugugagagaugcaguacauuagauucccuucgaaucucuuagugaaguagccgggaguagaugcucuuucagcauacauauuuugaccauuaagugagaaacuggccaggaaagacugauaugaaauuaaguuuuaguccuuacuuuauagucaggaaauguucucguucucugucuccauucuugucuuucucucucugucucugcucuaccccuuucacccacccuacaaguucucguguagcccaggauggccucaacuuccuuuuuaaaauuuucuuuuugaaauguuuauuugacauggguggcuguuuugccugcccaucugugugaggcuaucagaucuucuggaaugugugcugggaauuggaucugggucaucuggaagagcagccagugcucuuaacuguagagccaucucucuagccuggccucagacuuucuagauccucguggcuugccuugaacucuugaugcuccugagucuccccgcugaugcuacuggaauaucacucugacucuauguggcucccaguccuugugagcucuaagggcaugaauucaagcaccacacagugcaguguagaagagacuggguuuacuacagagaaaaguagggcacucuccagggaugaguguggucgguagcugaagugaucacuaugccaaccuccauucuuagauaggcuuuaucuaguucucaaccguuucuagagcagaugccuuuucugaggggggauuuccccuucagaugauugauaggcccacuuaagggucuaggcaaucccgcgccccuucuuuacaagaacauucccuaacuagauagaagucaguaaggucuggguggcuguuuagaaugcuggguuuccacuugaauccagagauaggaucacauuccuucgaccaguuaaguccuccaacugcaguuccuguuugucaagauugugagauaggggucucuccucacuaaccuucagaccugccaguguauacauauuuacuuaaaccaggauguugagcuucugaagcaggaugcucuaucuagguaagggugcguugauggcuggcgucuggcucuuuaggguuuggauugaaauagcugucuccagcuugauaauggaacugauagcuuucaccuuuucugagcuccuuucaauuuagcuagaauauuaaccaaucaaagaaguauuuccagcuggaaagcuaguaugaauuaagauacguaaugucuuagcguuagcugaauuaauuuaccacucaguauuuaaguuaggaaaaucucuaagagacauauaaucuuucauaucagaacacauaaccuccuugguuugagaugguuuaggguuguguaauggaaaauuuaguuaucuaguuacauaggcucugaaauuguuuguaagagcuggccaaauaaauauacagagcgugcaaaaccaucacauucacgcaccgcaaaggccucugccagagguaaaaugacauaaauguugaucucaaaugcuuuccagcucauucucaguccuaguguacccguggaguacagcgguucugugacucugcguccuccacuuaacguucuuggaagacaguuuauauuucuugagggcagugaacguccuggcugccuuucaauuguaaagcucaaagccuccccagggcuucagacucagugagaguuugaauggccacaugauucuagcagcaagguagauggagagagaccauggcguggggugagguuguucuucgggcuuuacgugauggaccaaguuguugaaauccagauggugauguaaacuuuuucaaauaguauuuguaccacuuacaaaaacaccaaaccaaaacaaaaccaaaacccaaaaaacuaaauugcuuuuacaaacaucacuguaauuccuauuuagauauagccucgaaguucuugguauuccugcuaagcacuuuaugauaucaggaugccagcaaaguguguaacucucaggucaagcacuuggagcagaaggcguguuuuagcuggauguaagauucaggugauaaacucacaucugacuuuuacguguuccaaagaaaccugaagcauguuccaauucagcagacauuuuauaauuaucacuacagcaacugucuugcauuuacaccugugucaaaaaaaaaagaaaucacaggacacauauaaaauuuuguuaaggguguagaguuccacagacagugguaggucacauaagacuggccauaaauugcaucugugccccugguuuaaguauccagguaaauuuaaguauuccgaagucuuaaacaucaacuguaagaggaaauacaguaguuuguauucugggauagcauauucccuuauugaauuuuacuaucgucuguggucucuguuuuuuuguuuuuuuauggucuauagccaaccuuugaaaguacacauucuucugugcuaaauaauuuucuagugaugauuuauagugaaccauuggcauaugacacagacuucugaucugugucucucuggcagucauccacuugugcacauucccuguggagcguccuugggagucacaaaacugacgugagguacauucucgcccguggagcccuguggcauuuugcuuuguagaaccuuacgggaaauucuaagacuguccgugaggaaguucagcuacugaauauacuguucaggaaaauggccacugaugugucaggcgcacagguuauugggaaucuuagacauccuuuggacuguccucucugauuccgaaccgacucacuggucacaguaauguuguucaguugacacugaggaacagcaguagaaauagucauuuugaauuaaaaagagcucacaccagcacugcuucaagugagccucuauuggauaaaguuguguuggaugagugccugugucgagaugaucaaugucuauguaucugcugugucaaucagugauggacuucuuucuggcuuuauuuuaaaauuaaauguagauacauaaauuaaaaagcaaacauugggucaucaguucuggaauguggagcugucuuaguugacugaauuguucauuucaugcuaaugugauguaagcauguaaaacauguacaacaaaccaauguagaauaagcagacagcuuucaguguauuucuuuguuaguacuauggaaggagugagguagggcuuuuagcuagguaaagugccagugcugcccaaagagacaucuaaggcaccaggaaacuuuguugcacugagaauggcaggguaaugguuucugacucaggaaaggcccaugggguugggggacugcacuugauugguccagccacgcuccuuugucucucuucucacauguuagggaagcaauugaaccucaccuggcuugaguugaugugucuucaguuggguguuuaaccuguucugaacauguguuuuugggaagagauauguagugaagugugaccuaagaguuccugucagugugcuugggggguguagcaguaacuuguagagaggucuacuuggggcaugggaaaaggagacuggcuccaguugguuuggggaaugcaagagacauaaggguuaguccuggggaccacggcuauaucccuuucuucugugaguuuacugguacuuucuucagucguuuguuuucauagugaauuuaucuuccaccaguaaagugagcaucagugagcugcugccuaaagccuggugucggacagccauguagggauaguccaggaucaugguuucaggaguuaugccugcaagccgggucuauaaucccuucccucccaggagcuucacuccugaaacaagaccuaaaguuaauuuacaggagguagacuaacugcauuaggaaagcugucuguggagaaaauaaaggcuuuaaaagugcacacagagacaacauagauguugucuuacuaauaucauuuuuggguucucuuucaguuuuuuuguacaccaguguagaagaagacaaauccauucccagagaaaauggagcaagugcucguauaggaggggcaguauucuguucuuucgcauaguaaugcucgcacuuauuaagguuuaaugggaggguauuuccgcauagagaagcuaauccuuugagaggccagccuauauuugaacugcagaaacaucaggcagauuuucccauugucuacugacuaagcugagcuaaggaaaaccuguuaucugcuauguuaaugagcuguccuuccccuggaggaccuguuaccacugcgucuccugcuaaccccagucugggcuagccagaauauuuuccaguugauuuuuuuagagacauaguuaagcaaaaaaaaaaaaaaaaaaagacuuggaauaaaaaugacaacagaaaaaacaaagcaaccccuucaucccccgcccccaacaauaauuacaacaauaaagaguaucuguaacaaacaaugcuacaaaaaaaaagagccuccuuccuuuacguacacuaugccuucacuguuuaaguaaugugguguguauuacgguguuuaaauuuaggucaggcgugguguccacaccuauaauuguagcacugcguugacuugaggcgaggaaguaaauuuacugguaucuaaugcugccuguucuauacauaucuauuuauuaaauaaauaucuauuauuuaacaguacaugaaagggaauaguuuuauuuauuuaaauagacuauauuuucuacuuucuaauaguggaaaauuauagccuuuuuaaauucacaaggaacagagauauaaauuacaagcaaaaaaaagugguuucuaaguaaaauagacgacaauuguuuugagcagcaguguuuuaauauagucacugacuauuuaaauuuuguauacuucucuguauucuagguauuuugucuuuuuaaauacuaaacgagauaauuaaaacauuacuauuucuauguagaaauaugucugcccacuaggauauggaauuuuauuuuuuaagaaacuuaauuccuaggguugauucacuguaaaugagugaaguaaaauuuuuauuuguucccaauaagaauauuuucaugcaucugagaaauuaugaauagccuguaacccuuggaaaugaaagggauaauuucuuuaaugcaucauuaacauagaggucacaagaaaguuauuuggacaaauguuuucagaguuaaacaaagaaagacuguuagggugggcaagcaccuggagacccuugacaaagacuuuauggcccaguagguuuggcuaacugcaccucuguugcuuuguuugcuagauacaaaguaguuuuuuguuuuuguuuuuuuguuuuuuuguuuuuuuuaguugauaguugacuuguagcaaguucuucauuggugucccuuuuucaaaauuuaaaagaaaucaaaauuauucauauguaauuuggaacuauuccgcuuaaaacacuuuagugaaauauuugccuguaacccagguaucuguuacuuaguuguuucauuugauuucaacuccacccuacuguccuuuagccuuuaacuccugguuccauguauauaguauuuuuauuuuauuuuagucuuuaguaucuuucaaguaaagaugacauuuuauguccauaccuuaucuggauuuuaaaauuggggcauugcuccuggugauuccagcuuguuaaugguuaucaauuccggagauaaccauuaugcgacaaagcuguaaacaaaugcacaagacuccaguggacuuggcuuacgguugaguaccuuuuauguuuuucagguuuaaggcagcuuauugaaauugauguuuuccugccuguaaauaucuggugaugcucagauuugauaauuacaauccagaagcacuuaagaaagaaagguuguuuuuaguuucguaauaacaacacucccgcaaagaagauugaugaaugaugucuuucaaguggcagauuuguuauuuaguuagagaaagcuccucugccaguuccucacaaagcuaauuuagagucuguuuauaaagcaggcaagccucugcaguguuaaugcuauagcccugaagugcuugcaugucuacccugagaagacucuagcuuuucagugguuuaacaaggaaguagauuuuccaggaauccaaagggauuagcauuuagcacuaauugggggaggguguagauagaacagagcucaaggcuagcugcuguauaguaaaacaucccucaguuuucugaauccauuuucaaucuauucggucccucugagcaucacuguuggggcuugaguucuugucugucuagauacaaguacaucagucuauacaugugcucguuucgacaagguacacugaggagguccuuaccaaaagaauucuucauuagggacuacaguaaaagcauucuucauuagggauuauaguaaaagcauucuucauuagggacuacaguaauacaaacagcagcucacacaguugggugaauggaaugauggcucagagguuuuacugaacaguguuguucaaaaucaaucccuguuuuccucugucuuccucuccaauggagugcuaacugaucgugguaguacugcaacacguacacaggcugccacaagugugccaugcauucauuucuuggaacuguuauaacaaagagcaaccaccuggauggcucaugcaagagaacuuguuucucucccaguucuggagguugaaauugaaagcaaaacaucaugccaggucuugcucuggguaccucuccaggagggcgugcugccaugucucuugcagauuauguuagguuuggucuuccuuggcauguggaggcagaacuucagaaugagucuacaccaacacaugaugucuccuccugcugccccccaccccccacuaucccuuaccuuauucuuccucuguccaaccaaaccuuuuucucgggucgucagucauuugcuguuugaaaugggucuuacugacccauccuaaguuggcuacuucugcagagacacuauuuccaagcaaagucagggucaccaguaagggugagccuagaauuucauuuaucucuuuagaagauacaguucaacuccuaaaagugauagauauggaaguguaaauucguacuacacaggagaagacaguuggaacucauuagagugucauccaagugugagaaacuuugcuggauaggauacgccaagcaaaauuacuugaaacucuuuguggaaaggcuuguaagcccagacuaguuuugccauuuuuagaaucaggaacguguuagaauuaaucugcacugauugauuuugauuagcaugcauauguugaaaauuaugaugaaaucaacauugaucaacguuucacacauggggcagauacauuuuuguuuuaauuuuuaaaagccauucucuacuuugaaaaguuuuagaacuauaaacauauuuaauuacaauuuauaauauuaacaguuguacuuacucuugauuaagaauccccguuuguuuuuuauugcaugauaaaugcuggcaggcuaauuuaaauaagcaggacuuacaucauuaaaucuguacacaaaguucuuugcuuugcagauaaaacgaaguaggaagcguuugucauguggcuggcagacaguuacagguccacuuccugccuuuaacauuacaacucaaagcagugcgcuguguacaauuuuaagucuaguuauagggaauugguugagagaccucaaaugagaguaaaugacucuaaaaguagcuugagucaagguugcccugacuguagagccauguaguaacuauguuggaccuuguuucugggaaacagucagcuuugccuuugcuguaggaaggaaacguguaaauuaauuggcaggacuaugguccacgaaauccuauuuacaaaaacugugcugggguugaguucugccuguggguuguccuuggccagcugcugguauagaguacugagcaaggugcugagcacaaagcuauuaaaagugucaacagagacaaguauaugugucaccucguugugaaaauauguggugaauaaugacacccuaaugacaguuuuucuauguaauuagaaguccaugcuuucuggcucuguaauuuccauccuuggagauugagcuuugucuuucuguuccccuccugggcggagauuuuuugauuuagcugcauucccucccccucccccugaggcuacagaagagagggggaaggaggaagaggacaacauaggagcgguccaauuaucuuuccuuuccuuuccuuuccuuuccuuuccuuuccuuuccuuuccuuuccuuuccuuuccuuuccuuuccuuuccuuuccuuuucuuuccuuuccuuuccuuuccuuucuuuuccuuuucuaaucuugugucuaaaaaaccaaagcauguccuagauuucucccacucaagguuuuggucuacugaaaauguauauuucaaccuccauuguagaggaagacagaggagcacagggacugagggaaugugcuguuagcugggaaagucuguuacaacagauaagcagguauguacaugugcuagcuagaagguuauuuucuggcgugguuuagccuuaaggcuucauucuuuaaaaauauaucuccaaggacuaccaacuuuuauguucauccgcuucauuuucauguacaagcagaaggcaagagaaucuuuggucacaaaauaggacugacuguuaguuucucaacucacagucuaucagcugugcugagucuuugcuccaguuccuacaggacagagcaggaccuaagguguaucuugcaggaucucuaaucuucaaggacagagucugugauagugaugaccuuugcccugaaaggagacuuuaaauagccucucugcugacaguaaaugcucccucugcuccaaggcagacauaguuacaucuuaggguuuuugcuguauaagugcuccugggaggacagacuccugcuuaaggcgguaagcaaccauuggaggauucucagggaaccucagaaugcguugucagugacuucucaggaaccaugacugugugaaguuucggguucugagugcuacguaaaacauuuuacuagcauuauuauaaaauauaauauuuauauuguggcacgauuugaaguuguuaguaagaucaaaauuuuggauuuugacacuauaacguauaaugaacucuguaugggugaaaucucacaugagcuuuggaaaucucucucaaauaaugugauaucaagauggacaauggaaacuuguauuugggguuaauuuaagaucaauccuaaggccucgugugucucaggcaggcacaucacugaacuacacuuggucaggugcaacuuuuuauuaugcaccuuuucagcauuuguuggcucucuagguggaaaaugcagacaaaugauuaaaugaauguaggaagaucgguucauuucauauuuuguuaucuagucuuuauagaagagaaagcaguuuuauuuuuuuaaauauuuuuauuagguauuuuccucauuuacauuuccaaugcuaucccaaaaguuccccauacccuccccccccacuccccuacccacccacucccacuuuuuggcccuggcguuccccuguacuggggcaucuaaaguuugcaaguccaaugggccucucuuuccaguguuggccgacuaggccaucuuuugauacauaugcagcuagccgguagugguggugcaugccgguaggauuugcugaaggaggcagaggcaggaggaucacgaguucgaggccagccugugcuacaguuuuauauucuuuuaaucauuauauaauaugaaccuguguuucaacccaaauaacugacuugcuggauaaggaagaucaauguucgguguauuagaagugaagugauauugcucaucuucguuaucagucccuguacagcagagaucugcuucaggcuaccuagaucccuuuucccgcuggagggucaguguuggcuggaggucucaggacaggagcuguguguaugugcguccucaugggauggcacuugguuucucugagucuauaacugcaggcaugagccagguugaugucacaugccuuuuccagccuuucuuaccgaaggacucauuggaacuaugugcucacuuaaggaccaugaaaauugcucuuuucucaucuucaugaaauuacuguuaauaaugcccaucagcuggcuguucagagcagugugcucuguguaccaagacugucucuagccauucucacagucccaaauaggcuucuugaaaacuauuuuuccccaccuguuuuguagaccccugaguuuggggggaauguugcuggacaccuaaacuuuuuuauuuucauuuuuuauuuaaucucuguaagcaagguaucauuuuaguuuaaggaaauagaagauuuaccugaguaacuuagccccucauuccuuuggucaccuuaauccucuuacgauuuaaaugguauguggaacuuccagaauuuuaucaccugagaucugaaugucuauagauaguuacaagaaaugugugcuguuucugaccucuggcaugacuuuagagcucccugccagugaaaucaaccucauaaaacuuccagggagcauugacuugaauagaauccugaaugcuuucagggcucucugcaguuuacugugcccuugugcugcucacuagaggaagaggggucccacccagucaugucaacuaacacuugacaagaagccugcuccccugcaagcccucugagaauguucccuggcagagaugaauucagacccccuuccccuccuccuccacaccagccacaugguucucuucuuaugccuuucuuuuauucucccucuuccuuucuuucuucuccccucugaaguuucucuuuccugcuucugggugaagcgccuacccucccucaugcucaccuccagggcuucaguguucucugaccaaucugagcagacugucuuguguuccuuugacacauguagcccuuaucaaggacugucaugugacggucagcccugugucaucacauauugcugucaugcuaaguaccuacugcugucauauuaaguggugauaagugguggcauuacaaauauugagaaaaguuuaauucaguuuuuuuuucuccccuuccgaucaaagagaacaucgauggauuaaaggaaaaugagaaagcccuugagagugagcaagguuccaaggaaggaauagccuucaauuaauuuaaaggcaaaagucacuucuguguauuuccacauaguauucaaaacaguguucagacuuggcagauacauauaauaguugcuauuucucccaauuuccauauuauuauuugaaaaucuugauuuaaucuagauaaagagcuucuauugcuuggaaagagguaaaagguaaaauuucacauuggaaacuagcaaaaagucuaaagucggucauuuagaacuuguggauaaacaaugccaccuuccugagauuuggcagccggggccaguuccggggccaguuauuuuaaaagaaaggcacguggguaaauagauuaauaucacugcuguuuauugcagaguagucacaauucagggcgcugucuuaacugugugucuaucuuuagugaaguaacguuuguggaaaaguuagaggugguuacacacagcgccucugccugcuccugcaugccccgugcgcaugcgcagugagcauucacagcucucccacucaguggcuggcucucugaaccccugcgagcuguuuucacuuccuuuaaauucuuauauuaacauuuccuuaaagacuuuuuguuucuguucugugcugcgcucaugacccuaaauauaccagcuuacaacaacuggggaauccuccaaaugugcgcuuucgacaugaauaacgugguuuuguuuggucugcauuauugacaaagguccuugaucauaacucgugguucgccuugacagaacaugguuggucuucccugcuccagaucccccuuagaguagcaggcaucguguucuggaaacuauccugcauugcuguugauagaauuucuugauguguaggauaugaugugagaauuccguuagauguucgggaaaguucucuuguaccuucuuagugucucuuuccccuuuauuccuuuuaaaaggcauucuuggaggcuuggcucuggcauucuugcuaacuaugccuacccccuccuuuucuucuguauaagcaaaguggcuuugaggaacaucugagacguuuucaauguguaaacagccuuuuaaagaaauagcugcuguguucucccaucacaagcugacuuguaacacuugaaagacaaacagaggccuguguguucucuguuauuguugcacccccucacauagcugucugcguuugucagcaguuuguuuugacucauaaugccagggaggggguggcuugguguguuuuugucaguuaugcaguguaggaugucaguuaucucaaaguuaccauuauguuuggcugcugucccucuauguaaagaaagccucagcauugguuccuguuucucaggccaguguuggguuuugaaacuugcccuuaaaauaaaugccaaacuguuuuucucaucuuguaacccuggaggucagaggcuggcucucuuguuucauuauugucucggugacguguuugugguauuuccccagacugguuugagaaccuaccugaacugcccuuuucaaguucccguugcucuucuagaguuggggaucuuguguauuccaacaagguuggaaacacucccaaaucaacauuucauuuugaaagcgguacuuucagacccagaugacucuccuacauuaauucguauggggacaucaacgguuguuguacuugacagaggcagggacccugggcuugacagggacgccauucuucaagagaaagugucccagguagccucuccuaacauucuucccauuuccuuagaacacugacgcucccccaguuuuaggcaaacugucaucuuucccagccaagaccaccaaccuuaggaaguagcaggagcuuuggaggugaaacacaaaggcaaaugcuauugaucuuaggccaccaagauucucauuggauuugagucaguacagaugucugcuggcuccgaugacugcccgccauguaaagugucuggcugccaccucugcuguguguauggcuucauccuaacagcaagugcauacgcguuuacugcagccugucucuuaugggggauuaaaauagccagaaggccugaauaccuagcauuuuuaucuaguauuucagcgauggcgaguucauggggugaggggugagacuguguuugcugucccgccucucaagccaugaccuuuaacgagggguuauuuuagaaaguucccaauucacugcgggucacuggagcuugggcagaaguggggaugcacggcauuuucauagaucacccagcggcuucucuaccugagcuggaacucauggauuguaaagauuucaagcauuugcccugagucucugugugccuccgaguauuauccauuugccaaaggcuaagcuguguucaccacaccccucucuugucauuccuuagugugguguggauccaguucacgcucgcugcuccaguccugacagcuaacugugaggccucuucugaauagucagugccuaggauuuaagcuuuauuuuguguuugugggagcauccuagcugauaguuuagacguugaacuccgucuuacaccuuugauguccuacuuuguugagggguguucaagucagaagguuucacagauaagaucuuggaacccagcugggggucaggaaagacugcuugugaggaaauacuuuggaucuaauguuaacacuccugucggggcauggauuggacucagguagagaaguguaccacaggagacauuuaaggacguagagaagcacuccuaaguuggagucacgugagaacauguuuuguuggguucugaguguucgauggcuaagcacuguagggaaugggagacuggguguacuguagggaaugggagacugggugcacuguagggaaugggagacugggugcacuguagggaaugggagacugggugcacuguagggaaugggagacugggugcacuguagggaaugggagaccgggugcacuguagggaaugggagaccgggugcacuguagggaaugggagaccgggugcacuguagggaaugggagaccaggugcacuguagggaaugguagacugggugcacuguagggaaugggagacugggugcacuguagggaaugggagacugggugcacuguagggaaugggagacugggugcacuguagggaaugguagacugggugcacuguagggaaugggagacugggugcacuguagggaaugguagacugggugcacuguagggaaugggagacugggugcacuguagggaaugguagacugggugcacuguagggaaugggagacugggugcacuguagggaaugggagacugggugcacuguagggaaugggagaccggggcuuuggaucaggcuuuccuugucccuuccuccagccuugaucauggucuuguaaguggcagacguuugccucccgccugccuguaccuugagcugcccuuuaucuguucuaguuagcaugagguugggugauacuggcuugcauguuuguauuucacauguuucaccuuauuugaugcacucgugugaaucaacuuuggauaaaguuugacuggcaaaucuugugaagguacuuuaucgugccaugaauuaacuuuuuauuacagcauggagaauaucuuugggaaaaaaaauacuuuaauaagagaaaagguugcuucugccugucccagaagcuguuagaauugggaacaaaacacccauggccuuacagagacaaaguuuggagcugagacaaaaggauggaccaucuagagacugccauacccagggguccaucccauaaucagccuccaaacacagacaccauugcauacgccagcaagauuuugcugaaaggacccagauauggcugucucuugugaggcuaugcuggggccuggcaaacacagaaguggaugcucacagucagcuauuggauggaacacagggcccccaauggaggagcuagagaaaguacccaaggagcaaaaggggucugcaacccuauagguggaacaacaauaugaacuaacuaguaccccggagcucuugacucuagcugcauauguaucagaagauggucuagucggccaucauugggaagagaggccccuuggucuugcaaacuuuauaugccucucaguacaggggaaugccagggccaagaggugggaguggguggguaggggagugggugggagggcaugggggacuuuugggauggcauuugaaauauaaaugaagaaaauaccuaauuaaaaaaaaaagaaaagguugauuuagcucuugguuuuggaaagucauggacauugucuuugaagucacacaguucuagugaggagcuugugaauggcaauaggggaggcagacauuagucugaauuccaguccugaguagcaacagagagaauggccaucaccaguuguguucuucuugggaaaguccuucaugacaacuuaauggccacccuguaagcuaccucaugcucuaguggccuauaguucauccacugugagccaccucucaagcuuucagguuuuuucagccccucccacuacugagcucucaucagacagacccuuaguggacucucaggccacagggaaagcacaccgugugguuucagcgcuguguugguugggguagacacguggccucacauuauagcugcaggugacuuuagcugucaguaccacagggguuuaugucuuauuuggauguccuacugucucuuugucccugaaaauacaaagucagagacuguaccuuuuuauagacuuuaccggcaaacauaucagagucuguuucucucauuucuucauuggagaaacaccuccgggacgggugggggaauguuuuuaaacuaguuuucaucucuuuugugaugcuuuguaaggcggaaauuguaacaguauuaccaacacuuccugugacaaaaagaaaacaguacaggccuugguagugcugaguuaauggaaaguauuaucuccaggggagaauaguuuccgccaggaaggauugcuuccucuaggagacggaguccaaggaucagagcauguggccugcaaacagacagccuuauuagguaauuguagaggacugucugggaggugguccaccgugguucauggggucguuaacguugcugccauagccagugcugaguucuuaggguuucagcaguaggacugcguggccgagaagggcgauggagauugucaaucacugcacauauucucuucucuccaugcgcuuucuuuuuaauauccaaugaauucgauuucccuggaucaaagucccagugaaaagaaaagcaagugaauauucucaguaguuggacuuccugaguguauagguaauccaaguaaguccauguacacugagauagcccuuuaaaucaaaauggucacaauguuauugggcugcuuugaacuggcguuguagcaauaguaaaugauuuuauuuccuuauuaauuuuaauagcuagaguuuccuuuagaguaaggguaaucagaaaauuugaugauguuuggaaaauuugaauacugucucaggcuauuauaaacucagauacucuagacuaaacgaugugacauuuuaaagcagguguuaauuagcuuugagaagguuucccuuuugaaaucauggccaugccaccaauaguuagaagacugguuaaguccccagcagauagcaaucauuacaguuggaaggagagacggacaggguggaaccuugugcuaccacguguucugcagaaugagguaagggccgaggacuaacgcuggccuuccuucuugugacaaaaaugugggaaagaccauuucaccuaaacuuccucuaauaauguguaauuugucagaagugacaaaaccacauuggaaaagcagcccacauuuccaaaguccauauuuugggaguuguauaaaaucagccuucuuaaauaugaguuuuugaaucacauuagagacuaucuuagugucucuucugcaguuuggacuccaggaauggaagguaaauuugaugguuacuaaguuguucuucuuuuuuuguuugauuaguuuuguuuuguuuuuugauuguuuguuuuguaauauucaggaggacaguuacuuaagaauuguagucacuggcauacaguagcauuucagauccagacauaugacagagcagugcccaggaggcuucuguuccugagcggcugaacuguuuucucacccucuugaacaccuucugccugcugcaauaggggacaccuguuucguuccuagaaaauuuggugugaaacacuccuuugaccuuucuggaugcuuggcuaaggcaucuugugacugacgagccuuucuuuuaaaagguaguuuguguucagaacugaaagucaacuuaaacaagcauuucagucaguuacccccaaaugaagauguggcauguuugucucaggaucgagagugacauuaaaccuguuagugucuauuuuuuucuauucaauuccaugcuaaaaaauaugggacucacauauuauuuuuguuguuuguuucuaaaacuucuaccuuucacaugacuugauguuuaaauauuuccuguacguaaaaaugagugagcuuacuuccuggcucauucauucaauaaauuccacguuauuuuuuacugaugagcauuacauggcacuuucuacugccaacuauaauaaagguugguaguugcuuccaaggucuuuuuucugccuaccccuguucuguaggaaguauuuuauacauccuaaguaaagggaauauuucacagguucagauggaccuaguguggccuguguccauguucccccuccauucucucuuucugucucugucucugucucucucccgcucccccgcccgugugugugugugugugugugugugugugucugugugucugugugucugugugugucuguguguagaucagaggcuaguuuggguuguuuuauuuuuuucccaggaaggcucucuaauuugugucuugagaccaacauugucaauggaauguggauccagguagacuaggugacccgugagugccagagauccuccuguuucuuucuccucuaacuacaagcacacacauucacuuugugcuuuuuaccuggguucugagguccuuaggcuugucuggcaaguacuuuauggacugaacugucuuccuaucccuuaaccucaagaccucaaagagcugaaagggaggugaggguacuggcguucuuuuucccauuuccugaucccugcuggcucaaauaugaagacgauuaacuaguaucccggauuccuucaggauggcacgaggaguauaggcacuuaauuauccuguggacucuagagggaaaagacaucagugucagacauucuguauuuugucacgcacugcgaaaucuaugugcucaaaucucucuucauguugacggugugugcuauuucuauuacauucuuugauguucagguuucagauuguauaauaauauaugaaggcauugucacaugaaauauuaagcuuuaguaacuauaccugacuuaaaccauaagcaagcauugaguucaugaauuuucagcauuauauguugugauuuuuauuagacaguuuuaucuaauguuaaaccauuugaagacuauuuucagucuugaucgauuuaauggcccaacugagauuaagcaggguggugucuacccacaaucaagaucuccuaucuuuucauucucuaucuuccuguugcucugccuuucuuucuguuccucuaugaaccuuuccuuuccccauguacauuguauuggggagugguaagcgcugguaugcucuaagaggcuacuucacucaucggacuuaaucgaggccaggugccuggcaauccuccugaacacacacacacacacacacacacacacacacacacacacacacacgcugaucaaauugagucagcugcuuggggagcuugcgggcuuacauuauaauggauggaaaaaugcccugugcuuugcaaccuuuuaaacuaaguaauaacauuuacgagaaauugugaauguuaugggaaccacuuuccaugugggagaugacuacuaagaaaaaaaguuuccuaaugaugaaugagaguuuuucaaaagcacgguuugguuugucaucuucaguucaaaaggcaacuuacaucaucacacuggggaaagagauguaguagcuaaaugucaggguagguccccaaauuauuugguuguguuuugugacaucgagagacagugcccuugguagaaucauuguaaagcacacuugaaguucuauguggaaaaaguugaaagaaggaccagaacauucuauuggugcccuuuccaagcuguguauuugugguugugccaaauucugcuacgucuuggaugcagagcuguaagugccuacagauaccagacaucucauaucuuagcuuggcagugaacauauguagucugccugauagugguccagccauauuuuguaauuuauuucauauaugaaagggaaaguaaaaggaacguuuccuuuccuguggauaugggguaaccugaauaucaaagcucaucuccucugagcuuggauugguuuaggagucacugcauuugcguguccacucuugcuuuccuguucauuuucagacaucuuuagugucguacaucugugaugugauauuagcaggaauauguuuucacuacagauuuucuuuuuuucugcucugucauuguuauuaucauucuaugcagucugcaguuuaccugggagggaccaauggucagaaacuguuagcacugcucgacucagcccuccaugcauccauuguguuaccuggaaucucuaacucuaguuugacauuccucaggcacacucccagucaugguacauccauauuuauuuauuuauuuuguccaugaaacccacuuuagaugucuugaguguuuuuuuuuuucuucccuaugccacucaaugcguugucucuuaggucucccagguuucccucaucuuuucccuguuuggauccauuaaucacaggccaugccagucuuccuagaaauguucuaacuguauaauuugggcagucuccuaacucuugagucuccgagugucccuacuucagaguggggcauuauaguaaucaccauagugaacaugggaggauucggaaggauacugaugcgugaguugggagaguucugaaauaagugacaguugcucuugucaucaguaugacaauuacuugaaaaaauagaaauaagacuaguggagaaaguuggugaugaacuaacgaaagcuuaaaaguauggauuugauauuacagaagauguguggaaccagcagagguuccuaagcccugaagugauaucacuuaaaagaccuugaaguugugauuuaaaugguuucuauagugaugggaaagaucaaucacuaauguaagaagagcuguauuuuguaucgagauguagugcuguuuccaggucacugugucuuauuucguguuuuaucucccuccuaacugacauucuguuucaagcuucauuauugcauaguuuuauuacuucuuaauaaguggcuugaagaaaucauuuuauguauguagugacuguuaguguguucacuucauggucaaggagaugaagcaaaauuaaagucgagucauuuuaacuuuccagaguguuuguguuuguuguuuacuucauugaaaccagguugguaagaauuuacauuuuguuaaguggauuuuaacuuucaggaaucuuuaugcccuaacucucucaaagacaggauucagguuuaagugaaacggaauggaaagacuagggccucucugcugcugcagugcacgauuuauaucucgauaaaaugaagggugugaggucaccucuuauggugacaucauccuuuuuauaucaguguuuuccuggcuuaacaccaggaaguguaaaucaagagcagaucaaaauguccacuaaugucaagucaccaagcgcuuuggacuuuucacgcucugucaggagaaaggggcuugacucuaaaauccgaagcaagcuuuuagauggccacaagcuucuagcuuguucacuugccucacccccagguuguuagccuuuuuguguauaugugcauauuuguggguguaugugcauggccauaugaaggucagaggacagcuugugggaauuacuucucucucuccaccaugcauucugggcacucaacuccggucgccaggcuagcuagcccuuacuccaagaguuuucucuguuuacgcaucauacuugagcuccugcauagauauuggaggagcaggccagccaaaagggaauuggcauguaccaaacugcucuaauuggaguuaguggugagguccaggacggagggcacuccugagcacuagggaggugcuggguuuggcucugcuggucuaacacuuccauaaggagugggaaccucugggucuugcuguaagguggaaggugaaguuacccugucaguaucuagacugaaggggaaagcugaaggauagcccugccuuuacugugcugucugggucacugugugcgagcuguccauuucuuccacauuucacccagagucacacaguuggcaucucgauccgauuuuaagaacccuuuaggagaaaacacaugucacuuggcgucgacuccaugcugggcaccagggaaagucacacacagacacacagacacacacacacagacacacacagacacacacagacacacacaccacaccacacacacacacacacacacacaaacacacuaagacugagagaugagggcagaauucacaaaaugcccaacacuacagauuuccagagccaaggauauguucaugguauuuaauccucuuaggacacaaaucugugugacauuugagcaagguuuuagguacauauuugugaacuugcucggauggcagacuaccauuuucucaugcauaagcaaaagagguacuugguauuugaauuggcaucucugguaugacuccacggauaucauacccuccaaggucuuuccuacagaaaauugccuuucagagugaagguuaagcacccagcccuucucgcucuuugaauauugaucugagagccuguguagggcuacaggcuccaaggccauuguaagucuggagcuguugggggggggggugguugcgaugcugaggcccagaagaaacacaccccugggcuucaggcugagacuauuuucaucaccagcuucucaggaggacagaaagcagauugacagaagcuauggccacaaguauaacauaguaauggcgcuggugaggggcauggggauuccacagucagaaggaugcaauagcaagggagguggcggguagggaacacuguaauguaggucccaaagaguagaagauugaaggagccugguccuuuuuuuuuuguauucaggcacgagaauuucuguccuagaguucagaggacccagacacaugggagcuccagcauaagaggucaguugcagcugaaaacaaagagguuagcuguaacccaaucagagaaaagcccaccuguuccaucacagcugcauggccccauccuacuagcaguaggaagagucuacaaggcuacugucuagcagucucaaaauaaguugauugauuugaaaguaaauuuaguuaaucagauaaugugaaauuucccaagugucccuuaaacugagcccccuuuccucaaauuucucuccuacuguuauagaaauaguuuguguguagugaacugugguagccacaaaugggaauucagagcuacaaagaaacaaaggccugucacugcaucuggcuaccucaccagaagucgcuuaagcggucugagaggcuucuguggccugagagguagagauggcauuaggccaggggacugacuauuuuaguggccuuccuauucuggguggcuuuugucagugacaccagucauagccagaaacagcuguuucuguggaguccagacugccaucuauuuuuaguagaagcugggagaaugucagaggugauguuugaguuucuccgcccuuuugugauggucuaagauuaggcuguuuagaccuucugcccucugucauuucacuuauugaauucaagcacagccuuuuaauuucagcacacguaagcucuggggccauugaaccgguucuauaaacaaggacuuuucugagccacagauaggaauacaagaaguacacagauagcgugucagccagcaguugguuugagaggagcaagacuugggaggcgucucugcacuccccugaaggagcaggucugcugcuuugauuuaagaagcccggauguuacagagaacagcaaaugcugagagcuuggugaaagcagcuguucaguucucuagacauugcuacucuguaagcuuucacuauguuguauguugauuaaacaacagguauaucucagcgaaaaugcaagauagacaagcaaaacacaauagaauauuugggaacaaaggauaacuguugacuaggaagacauuuucauuggaggccauauuuucccauuguaucaaaaggguccuuguuuuaccuggacucuauucuaaguaaguuuguuuccuuuggcccugagugugcuucaguggguaucagccucccagcuuguaacugauugugaacauuguuuuccuuuccguuuucuaauuccaagggaagauaaccaaguuacacuccuuccaaauagcucugcuuggguacaggaucuugaccagcuagauugggcaagauuuagucaaggcuguuaggaugcugccuguccugagaagggaaucgucgucauagaacaguuacgccugcugaggcacacccuuccuugcaugcaucuuuccuugagcaccuuuccaguggcuacccauuuagagauacuuaaacacccuguguacaucuuguguacaaagacuauauguuuguagacuaauacaaaaaguagaaaacauaauuauagaagaaguauauacuagaguuuauaugugugaaaaauggaaauugagcaaaugauggcuucauauaaugaggcuuccuuuuguuauuauaaugggcuuuauguguuguucugggacuaucaugagguuguuaagcaaaacauaaauaaagcaaaauccgggagaguguauuugcuggaguaaugcugagaugcccacauguaagucugcucauguuugaacuccaaaaaggaggaggaaggcacaguuaggaucuuggaagugcgcuaaucuuguucuuaaauuggcucccucuucuuugguguucccuaagccuacaaagauacuugaaaugauagaaaaguauuuaagaaugaaaggaagaaauugagaaugaaucuugauuuguuguuguuuacacuucaguauuuggagucagccauggucacugucuggacaaccacagugcucucucuagaguguucuuggaguauagcacagcugcaguaugggggcuaacacuucugaacugugaugaccuuugcugcacaaguucccaaggaucugcacucugagugugaauuuuuaacagccauuuaaagacgugugugugugugugugugugugugugugugugugugugugagagagagagagagagauggggaaaguacuaacugguuaagucauuuucucugauccaugacuuuuaggaaggugaaugaauaagcuuugaauuguuuauuugacauugaaaaauuauauggaucccuaagucuggugaagcaucaacaaaaaaaaguauaugcucauauauacauauacauauacauauacauauacauauacauauacauauacauauacauauauauauauacaccccacacacauacccucacaauauauauguguguguauauaugugaauauauaguauauauacauaauauguguguauauaugcauauauaguauauguguauauauacauacauacacacacauaaaugacuugggaauguuaguggaauccuuugaaguauuuuugugugaauauauuuuagguuuuuacauaaaaacuagaccaagaauuaaauaaguuuucuucaucuucuguaacuaggaaaauagaaacauaacauuuuucauuuuuuggcauuuucauauaaaugauuauggaaguauuggguguuaugguaucuugugauaacucauaaccaucacuucgugucucagcuuuaagaacuuuguuaaaauauucuuuaucaauauaucuauaaauauucauucaaaagguuaacauuuugggagcuagggagauggcuuauuggguaaaugugaaugcuguggaagcaaaggaaccuaacuuuagaucucuacauagaagccaguauugagggguggggacagaaagacacagggauuccccagggcuugguaacugcuuacacaaacugaaaugguggagaaugauagacaucagcugacauccuccucuggucucugcauguguuauacagagggaugcacacccacagacacauuuacacauauacuacacgcacaaaucacacacaacaaacaucaaacacacucaugcauaucacaaacagcagacaaaucacacacaauacauauuacacacaucaugugcacacacaacacacauaucacacauauaucacacacagcauaucacauacacagugucucacacaauacaaauauacauauccuaugcacauuucacacugcacacauauuacaugucuuaaucacauucacacauaucacauaugcauauaucacacaucacaaauaucacacauaucacucaugccacaaauacuacacauaucaaccacaacacauuauacaugucacacacaacagacauaucacauaucccacacacauaucacaaauacagaguucaaguuuuaauuuuauaaaauuaaaauuccaguuucuuuucuaggacaaaucaaaauggagcugcaaguaucauaaauagacaauaaaaguauaaagucuuuugcaacacguguauuuucaucacauuucuguccagucucauguacuaugagaacucucccuguauugguuuuucuuggguuuuaugcuguaaaaaauuuuguucuauacuccuagauuuuucauuucuaguuugcguguacuugaacuucacagauauuaacuauagauggguuuaaaauaaauggccauuguuguuuucauuuuuaaugagugguuuucuuuagucgccacaggauggaguaggggauaccaggggacagacacaggacuuagugacaccaccugcagccauggcaguucuguucuuuuauguuacauguuuuuccuguguucaaaugaaacauugcuccugcuacuuuacucuauaugcagacaaaacauucaugagcaugaaauaaauaaauaagucauaaagacuuaauagaacuucacucuaaagauaaagauuuaaucuagaaauauaguccuauuacuauacaauaggaaagaguaugaauguggcuguguggcuguugaguacgcuaucuagugacacugaaagaaagcucuacuuugauagauuuuuuuuaugugugucauucagugaaaaauuugguuuauaguagauuucuguagaugagaguuggaaguuucuaggauuauugagucaaauaaacacacaccacacacauacacacauacacacaacacacacacacacacacacacacacacaacugaauuguuccugaaugucuuacuccuuacuuucaccccacacuggauacuaaagaaucgguuaauuugauuuuuuuuauuugaggagcuuccugcccucuauuaaaguaaucacaauuuggcuguauucaguugguucacaaaacuaaaucuagccaagugauccccaacguguuagacaaccagaagccugggaguguuaguguaaaugcugauccagugcauggaucucugcuguguaggcuaagcuguuaugaaaucaagugagagauaacgagaguuaucacaaccuuuugguuuugccaguggucuuguuuauugacuuagucauuuucuccuaucagaaaagaaaacaaaaacaagcaguugacuagcacaggagaacaguugaaucucuaaauuacaauucugcacucuacauuucuaugcauacuuuauagccggcuaaagauucugaaaucauuggaugaguuuaaguagcugaauacuuuggucacucaacaccucuuaccuaaauucacuuuucuccucuaguacauucuaugguacucaccuggacaaaaauacuucuguugaaacaucaggaguguuugcuuccauaauaaauaggcuagacauauuuacugauuacagucauuaaauuugauguuugcauuaaacaaaacaaagggaaccaacuuucuuggggaugucgauuuagcuauuuugccaggucaucaucaucuggauucuaguauguacauuuguuuuuuauugugucauguuuuuucucauuaucuucaaugaucauagaaacauuaaggcacauaaaagcuuugggugggaaauuuuaauuuuuuuuccaaacauacuuagacuugagguuaccuugauuuugugcaauuguucugccuuaacauccaacugaguuuuuuuaugauaguaauagcaaugaaauaguaaugacuaauuaucccagcagccaucaacucaaucaaaauguuugguugaauuucacuugaaggcagacuuuugaguaguuuccaguaccacccgucaccuuucccaucuuaguaauucugagcccacaggacugucgaacgauuugcaggagggugucuggcugugucuguguucuccacugaacagaaugaugccugauguaaaggaggagagagcagauugccagaaguggugcgggcgccaagugguaauggcucuacaggcguccagcagggauagcugcuauucuucgcccagugcuucuggguuagcccacccaugauguccuagugcugauuccacaugcacugcagcuuagcaccugagaggugaaucuuuuuccacaaaauuacacauucucuacucuugcuccuuaaauuauaaaugcacuauugcuuuuggcccugcggggcauaauuuucuaaaucuugaaaaauuaauuucugucuggcuacacugaggaauaauugacaguuaaaacgaauuugcaauuuuaauuugaacuaguuuuauaguaaggagaaauaugacuauuuacaaggaaaagaaaagguggcuuuuaaugauuuuucucaaaauaccuaugcuuacaaauucuguuguaagggugcugcagccugacucagauauugcucucucgggcuagguuauaacuuagauuauucaguaaaauuuaucuguguagugaguuuucuuuuaccccgagucuggaauuaucacucuuuaaaguucuuuccucuaugaaacaaggcuagacugagauucaccucccgagacucauguuggagguugccuuugauuuaauuuauuuuacuuucuuauguuuuguuuguguuugugacuaugaagugagauauuuucuagacuuuuuuuuuaaaugaauuuguuccaguuuucccuuuuggggaaaauggacuugccgcuguuuccuuguuuauuuaguugccagauuucaccugucugaaaauguuguugcaggauuuuagcuuuaacuguuauuggaauauuauuaucuuugauuuaauauauaagcuuuuauccuucacaucauccuugaaaaugcauuuuaucaucucagguuuuaaauagauccgagauguaaaaggcgaugacuuuuauguauauuuuguagagaaaggaauugacaaacuggccauuuagguggugauuaaguuggaguaagaaauuagggcucugauauuaagauuuugaguauauuugacauugucaucagggaacggcucuaucuuacauaacauucauauuggaaugggaagagcaaagaagugucugccauuugcucuguacgugucuugucucaguuucccuguguucuuacuccuuguagggcucugugacacucuccuguccucgcaagcagagucuugcugcucugcauuuccuccuauauugaaaacuaugaaguaugucucucagccagcucuguuuguacuggcucagaaaacugaguuuuaucaacuuggaucugucucaaaauugcaaggaaaggccuacuuuuggaguugcucagcggggcuccucugcaauucaggaaaaagccuaauuaagguuuccugaaacugccuuuuaaucacugggauuaccaugaaaaggaacguuucuaaucacauacauaucugcuaaugcuuuucuugugguaucugauuacuuugauaauaaaaaguagcaauaaaguggagaguuaauggguuuuaaacaugugguuucugaaccauauaaguuguggaauagguacgcuuagugaguccaauagaguuuuaaacauagacugugaagauguaucacauacaguugaugaauagucaaccucacccaacgguuccugggaaguggaggcucuuguauguaacagaaaguagaaagaaauuaaaaucguguugugaccuggacauuggugagucuccucuguggcuucaggugauccuuagcuccugauuggcucuuguuuucugaagguaguccagcuggugaguuacagaacgccucuucaaaugugaauccuggguaccgagagugaaaauuagccacuuuaaauaaaucuauuccacacaggaauaaucuccuguauuuuaaugauaaaauuccacuguuuauuuucacaagggagaaaauaagguugcaggccagggaagcuccuaguaguauucgaacaugcuguagugacuguuaagaaauucaguugaugucgaugaccaagagaacacauucucuaguagcuacugcuuugaguuggcuccagcgcagggcaauucauuagcagcuguugucaguccauagcagaacucuuuaaccuacuuggcagccucccuacaugagcaaugagcuucuuugcagaguuugacuuuuggacuugaugggauauuagcuuacaguucuccaagucaaguacacaguacuaaagguguuccuucuguuuguguccaaaugcgcaaaugucagacuugagccuggcugcuuugcgacuuuacuuuguucuugauacugagcgcggacugcugguuucuuagagucuccucucauuuaucuuaagagucucuucacuucaggcaucaaaaacacauguggguucaguccacauggcuguuuuguuacuuaccauugaauuguguguuugggaccuucgaccgucugaacccuuaucuguuugauaaagaaauuacccaaccaggauuuggaaagaaaaccaggaaaaaaauaaauaaaaaagacagggugguaguuugcuggcccagccugggaugugucugcauuccuaaaucccugccuuuaaguuuauggcuauaacaaauauaaacagcagugaacaagcacgaagagcuuuuauuacacacacaggaguuaaagaugaaucucagaugguggugaggauuacauuagucauucauacacacaaggucucucuauauaacccagccuggcuuggaacuuuccggcaauccugcugccucucccaccugagcauugggugcuaagauuacaggcuguguugucauggccuuuggcuucccugguauucguaagcaaguggcuacauguauacacgcuuuaccggguugagaaaagucucccagugcuuucggaugaguagugaguacuccgguguggcagcuaguucucaugcugaccuugcuuccagggaagucagccgacuguugacacgguuuuuaguagucauauuccaucugugucacugaguugggcuacauuaguuaucucccaaugugccauucaaauguugugucuucuguuuacaauuuauuaaaauauaggggaguauaagggaaugaaaguguuuaaagacaucuuuggggugugcuuguuuucuguucucaucuucccacuucuauguauguguguguguauguguguguguguguauuucuaaauacccuucuguguguugccccucugccagugcugcccaucauugaacguggcauguagcuaucauguaguaauaaguccuagauuagucagugugggcgugacccuguccuagugcugguucuuucugcauuuucacuucagcaaguggcauagaauggugcauggagcacucaugacaacgggaaugggaacuaugaucacugucuuuauccuuauggauuuuggguaaauggauacucggaaaaugugucuuucaaaugaagaccacaacaugaguacacauguugguucuuagaggaacaugucauuaauugcuaaauuuuaguaaugauguaagauuuggaggaagaccauuaaauauuuuaacuugaucauauuuuguuaaauccuuaaguauacuuuuuuuuuuuaaaaagaaagacaaaacaaaaccaaccaaacaaacaaacaagcaaaaaucccaaccuuuuaccuggaaaagauguaguagcucuagcuggccuuuuauuuuuauuuauguguaugagaguguguuugucugugaaugugugugugugugugugugugugugugugugugugugugugugugugcaggagccuguggagucagaagagcgugccugauaccuuggaguugguauuacaggguugcacguuacaugugagcuaccugacauggguguugguaaccuaaccaaacuggguccucuauaagagcaauauauccuguuaucugcucagccuuguuguccacaccccaugcugaccuugaacucaaaucauuccugcuucagucucccacaagcuggagcuguaggaaggugacuucacuucaugucugcuggcagauuaucuuaauuacacacacacacacacacacacacacacacacacacacacacacacacacacacagacacccuuaugugcaagauauuuucccaaugaauuuuuuagaaggucuucaugaaggaggcugauaacacuuacguuuaaaaaccuaaucucgaccaaauagcuagaggaccaaaaauggccuucagggagauucuauaagcagcuuccuucugggugucauguguccuaaguauacagagaaggugugcacuugucggccgcacagugcuaguguaacaguaaguaccgacugaggugcguggagauccuccucccaggccucuucucccugcuugugccuguguggcaguggagggacacuuugcugaggugguugcucugagggcgguagcucaucucccccgagcucucuaccagguagguggccguggguguuccagccugcugcagaggaucagguuuguacaaaaccacaacagaaagauccuauucuuuuaagauuuaaaaaaaaaucuuuaaauauaugaauaauaacacauugaagugaaaauuaaauaccucuccuuuuaguuuuuaaacacacagcaaauugcaauuacuaaugaauagaccuguauacuuuuuuuuuucaaauucuucuagauuacaaaaguagguuuggcuaaaagaaaaaugagaaaauacugaaaguagugucaucugugaugaaacguuucucucuugaccguaugugguuuuguauacaaaaccuguaaagcauuacugauagugcuuguucaacacuaacaaggaauaucuuuuguagcucagccucauuuggauugcuuuauacugggaaaagagagagagaaaaaaaucaauuuuguuuucaaaacauuccaagauauuggucagcauuuugcaugagcuccaaguuaucuuacaucccuuuucugcaguuuucuccuauuaauuuucaguucagaauuaaccaaacugcuuuagugaggguuguggcaacucucauaucugaguggcuuuucagccagauguuuggaacagcuuagauaggggccaagccccggucuagcucugugaccuuuaaaaagaauauccgcuuccugacacuagauaaggaucucccacucaccgccucuuccucuuuagagagcucuuacagaaucaguucauuaaacuaugugaagugacaaauuaugcuuuugguuuaaagugguggucagugaauauuugagaauagaaguaccuuuccguggagaauuugguuucguugugcucagguuccucugcaugcugacugugucuuuuguuugcuugcuuguuuguuugcuauuaguaguguuugcuaguucaccuuucuaccacucagccguaacucccugccuuaguuaagcucgguagguucuuuccuaagacucuguguugaccagugcaggcauagaaguccuuucuuuaguucaacgcaugcuacaguaaacugaaaagaaaaaacaaacaaaacaaacaaacaaaaaaccuccccaaacuucugagguuugagacccagaacaaguuuuauuugguuugcucuuaauuuaccaaccauuuaacucuuuaucuucucaagugccugcuguguacagacaacucuggggauguuguaauuccugucacuuguugccuaucuuaaagaauccccuuuuguucucauuucccccucccuuucuuauaccuuuuccccuuacgagcauucaccagugacaauucuuugaauauaacguaaggaacuggaaugguagaauucuggacaaaacugugggaucucccaggcccagaaggauuaguuccaacaucugagacugggacuuugcugggagaugaguggucucucaacaguaccaugaauuuggcauugugaagcuauaaugcuguaaacacagggcuucuaauaugucuuagauggggggaauaccuuagcaguggguugggucagaugucuucaagugagaugucagggaaaguaugguuauagcuuucaguuugugagaaugaauguucagaaacacagacuuuuaaaaauuaggccaucgcuugccucaggugaugaaugaaguucucugaccugugcuuuagaaagauaguccugaaagaauuuugaaaacuguauuauaguuaauagaauguagccagagggaugacuauagauggcuauaugacugcgguuuacauaaaugaccauggacucugaaucaccaguuauguaacaguacagaggcaaaagacagcaagugaagaggaggaacagcaaggacgaggagcagguacagugagaaugaggugcaggugcacugaagaagagggacaggugcagugaggauggggagcaggugcagugaggaugaggggcaggugcagugaggauggggggcaggugcagugaggauggggggcaggugcagugaggaugaggggcaggugcagugaggauggggggcaggugcagugaggauggggggcaggugcagugaggaugaagaacagaugcagugaagaugaagaacaggugcagugaggaugaggaacaggugcugugaagaugaggaacaggugcaguaaggauagcauguucagugauaaugaggggcaggugcagugaggaugaggagcacauacauugaggcugagcagcauaugcagcgaggcugagcagcauaugcagugaggcugagcagcauaugcagugaggcugaguaacagguacagugaggaugaagaacaggugcagugaggaugaggaacagguacagugaggaugaggaacaggugcacugaggaugaggaacaggugcagugaggaugaguaacaggugcagugaggaugagaaacagguacagugaggaugaagaacaggugcagugaggaugaggaacagguacagugaggaugaggaacaggugcagugaggaugaggaacaggugcagugaggaugaggaacagguacagugaggaugaggaacaggugcagugaggaugaggaacaggugcagugaggaugaggaacaggugcagugaggaugaggaacaggugcagugaggaugaguaacagguacagugaggaugaggaacaggugcagugaggaugaggaacaggugcagugaggaugaggaacaggugcagugaggaugaggaacaggugcagugaggauggggggcaggugcagugaggaugaggaacaggugcagugaggaugaggaacaggugcagugaggaugaggaacaggugcagugaggaugaggaacagguacagugaggaugaggaacaggugcagugaggaugaggaacaggugcagugaggaugaggaacaggugcagugaggaugaggaacagguacagugaggaugaggaacaggugcagugaggaugaggaacaggugcagugaggaugaggaacaggugcagugaggaugaggaacagguguagugaggaugaggaacagugcagugaggaugaggaacaugugcagugaggaugaggaauagguguaguaaggagagcaugugcagugaagaugaggagcagguucagugaggagagcuugugcagugaggaugagguacauaucuuuuugagaugauugaugugagagcacacuagacaugggauggccacucacuguaacaaaagccguaaaggagucuaucugauggauucaaaagccaucaacaggugauuaaagaugagagaggaaaauggaaagaaagcaggagauaguuggagcuggaaguaggaccucaagagacaacccugucuaguggauccauauugugaacagaaaacauuuuaagucaucuagcagugauuuuagaaacauuuuauuaaauaauuuauuuugcauaaaaugucuaaauuaucuuauuauauuaagagaauaauucuguucucuguguguguguguguguguguguguguguguguaguagagcacacugcauggcacaggcauggaggucagacaacaacuuguaggccuugguuuucuccuuccacugugauuguguaauguguagguccuguggcuagaacucggguuuucacguuuguuggcaggugccucuaucaauugagucauccugcccacccagaauaaugaauucuuaaugaaauaguuuauauguuuuuaauucauacugucuuaaaauaugcuauguauuuguccuaaccacauuugaagugcagcgucucacaugugucucaugguaauuguuuccacaguuuauacuuaagccauuuucaaaagucaucuacuaucuauguaaagugcugcagcuggguaguuuaaauaugcagucagagugccaucugagugcugccaguuucaugggauuaaguuguagcuuaaagaaagcauacaggccuuuggaucaaaagaagaaacacacugguagcauuagccaacaugugcuccuguaauagcaugccuuacuauuuuuauuaacuuuuucaugcuuuaaacaugauuaaacugcaguacauuuuagaggaaaugcaaauuuaaaagaaugacauugacagauuuguaacuccuucaagguguguaacaaucacaaauccauguuuuuuccagugacucuuagucauaguaaucaaccuccauauuauuuuaaguuuccccuaauguuauauccuaccucauugacugaaauuagaaugacagaacagauaaauacagcuaucacuucacggaacugcagggaucaggaguaaaaguggaccacagcucucuugugucccacacugcaagaugggucugcuuccagguggguuucuggcuaagcaccaagggucugaaggagguaguccacuccaggaaaaucaacgcuggcugucccucuggugugcuuggcacuuuuuagaggagauacacuugauaggagagagcagcacggggaugggggagaaauggagccacacagaguaccauaggaagaagaaucaguaagggcuugagaaagauccccaggccucauaaauccacagccucuuugcuuaagcagcaagccuaaagaacuaaauagagguuccauaauuauucugaagauuguguauuuuaaaucucguggguaauuaucacagcuaaaaauuacacauuacaauaaucacaacuagcaaauuaccuggaauugcuugcucaguggauaucuuucagcacccgaaauuuguacauaaaaugacuauucaugagagcuauuuauaauggagugcuuguuagcacuggcugguguaaagacuuuacugauuucucuaauugaauuuccaucaacaccgcagguuucaguguuaccugucuaagucaaggaguuaucuuauccuuaaauaaagcugugaaaguguacuggugaaaugaaguaguauaucaaaauauauauguguaucugucuguauaggggcuggauuggauuucuuguuaaguguucuuucaaauuugacuuuacccauuaaugaaugauguauguccagggugccggugcucagugucuuggcugcuuccauguggcugcauccugacauaccauuaaugcuguaccuaaagggccaguugcacaucuuccgauucccucccacacacagagacaugugaaugauuuuugugaguagacaccuuuagauuugaacuuggccugugcucugaguccccuggacucccugggagacuccauugaauucagcauuuaggucuggucuuuccuuuggcccuuggcgcucugacuuaggugucagucggcagcccagggggagaggccacuguucaaccucucuucaggcagauacuuaaaaagucuccuagagauguaugggauuucucuacuagaaagauacggcaugaguaauuuugcuaaggucaaagaugaauuuuugaaauuaaaaagccaagggugggcuguuccagcuggguaugacaggaugugggaagauacccuugugcccgaagcagcaucacuguucaaagugccgagagccugggugugaaccuugcagccaugcaugcggguuggggcaggguggggccggggcacuggagguagggccggggcacuggagguagggacaagcagaggaagcucccaucauguaugacgcccacuuaaguggggauucaagugucucuugaguauuucaaacuuacaucaccuuagaggcauguuaugagacucucaaauuauuaagguaguucagcuauuuuuugaugacuuugcauuguugacuucuugccaaaaaucauauuuucacacacaugcucagagcacucuccuuuucucccuccagcaucccuuggaucuuugagaaccuuuucuaugcucaggcuccaggcgauugugacuagagguggaguccuggccuuggcaccauuucugaggcaugugguugaucaagcacuauauauauaaaaucugugcccacuucugagagcuuuuaaccagcguaacucugcugcugugugaaacagguuagcguagaaugugcucuugagaaaagugaugauggcagguuagcugaggaguccuaaaggugggcagugggaagggcaagcaugcugugggacuccuugcuggucccuguaccauacagaaagcagcacauuucaaaggcauguggugauguugcagaacaauucagaguucuucagaaaaugaaaaugguagacuuucaaaccugucuucauguuaaugcuuacuuaaaaggcccagugacuaauuugacuaacuccuuguuaaaagauuucucauuuuaacuuuggauacaauuauacuuuaauagcugcucacauuuaaaauaguuuuuaaugcauugaaauauuaaauaugugauaugcuuuucucauuaaaauuucugucuuuuuaucacuucuguaagugugguauuuaacacagcgauuaacuguggcuuuaaugccccguaccuauguuuuggcagcaauuaaaguuauagaccauuuaucuguucauaauaauugcugcuuccuuuuaagccauuuuaccaagugccguaaagguuauuuuuauuaauaagccaauauuucugccucaaagaaagggcuaauccuuucugaaguuugucauuuaacuagccuaagucaugaaugcuuugaaaagugguucucuguguauauggacaaaaguuugucaguuaauuauuuaagaaauguguucaacaggucauguccaggauuuugacuuuuuaaaaucaaauuaauuucuaugaauaaauauuucaccuacuuguguguauguucaucaccugugugccugguacugauguaggucaaaggagggugucagguucccuugaaaugaauugacagguaauugggaccagccauguggggcuggaaaccaaacccgugcccucugaagaacaguaaaguacucuucaccacugaccgagccaacauucccacucgugauuguauuuuuaauuugcugauguaguauuuuuuccuucucucucagucuucaaaauuauuauguaaacuuaaugggucaaaaauaauuguuuggggcacaaaaaaucauuuugaauaauuuuucuugaaucauuuaaguguuguugcauuuauuuccuauuugauuuguguaguaguucacuaacuuuugcuuuaucuuucuuuuuaguuuuauuuguuuuauuuuucuagacuuuuaaaauauauuucuagggguacuuuuuaaaaaagugugugcuguuuugauaaaaacauucuaagauaaauaauuuucuuucugcugaccugguuagucuugccagugagucccacaggaggacacagagaggaagaggaguguuuaaagucacaccacagcuuaggugcccucugaggcucaggcaaacgggggcuagguugggucaucuucacaguaagcauugguuucccagccccuugggugguuuguuugugcugcccaccuugaggucccgcugggugggugcuggagacccuccuggguugucugcaaccuuggcuccaugaugaaauucccugggaaguuuaaccgaccuugaucccugaacucuuccccaggaggcuuugcuuuaguggugcagggcuuugcugcugucugaagaucuguaaaaugguuuggugagucuaacacgaaagcaggauucaagacuguugccaccacuuuuuaaaauuuuuaaccaaauagggaaucugaagcucaaaaggaguuagugacauguccgccuccagacugacacaauacagacuguaaucuuuacauugcuuaaguguuuguuaguuuguuuuuuaaugaggacaucuaaguuuuuugaaaauaaaaguaugugcucugguguuucuaaggaacucucaaaaaugccucacuguuuggcuuaguccaggaaaaugacaaguauuauuuuuuuaucuguuuuaacacaggaaaugaaacaugggcauucauaguaaaaccuauagucuucaccuuagauaugaaauucaggaaauuaaggagguagauuuagaagagucauguguucuaugaccugcccacaucgucugaaagaauaucaaacaaaggaugaaggcaacugagacucuguuaggccaggucgacauguuaguaauuccaaaggagaacuguaauguucacguugugacaugagucauuugggggacaaaguuccauauuccugcggucaggguuacugcuuucagcacauaugacauaucaguaacauaauugcaagguagaaacuagacuggcauuuuaauaauggaguuuucagaguuaugaaaggggaaauacugagaaaauaguguagacaaacuacauagcccauauauuuagaaagagguguauuggggguauuaagugagaagaaaggugcauggugcuuuuuauuuauuucugucuauauuucauuacucauuaaacacacagauacccaacaacccuugcuacaguuuugccagguaccucucagacugccuguguaucugccugucuaucucuauuugucugucugucugucuaccuaucuaucuaucuaucauguuuaaucagaguuguugucuuucccagacuccaauuuaccaucccauggacacaggcuacgaugaacaauuauuugcugaaugcaguuacuauaccuuggaccuagggcagugguuugcagagugugaaguauagaccagcagaauuaucagagaugaagacagcucuggggagcuugcuggaugaagauauucucagucccacccaaaaguucagacacaccuguacuaaggcgguauucugaagaccgccaugauuucugaugcucauuugcaugagaggaucaucacauuuuuuuucccccaugaaagccuaaaauaaagaacaagaugguaaaaagaacauacucauauaugccccaggagcaucuacagccaaucucuucucugaggcuaguuuguuaucguugugcgcugggucuaauugcuucaaagagcacuuuuguuguccugacuggcuugacuacggggauucuguggucugugaugcccagcuauggguggauggcauugaguggcuucacuccauauucacagccucagaaggaugucuggagcuucccuccaccugucuguucccucaguaaguuugguuuaggacauucacaugguugcaauggacuuugucacagcagagaaggagacucaucaacacagggacuuucacgaucucuguuucucucucguaauuguuacuugggcuguuuaaaggugccuugauuuaaagguggagcaguggucuuuaucucuauauaaaagaagcaaaaguaaaauuauaauuaauucauauaggcaagagaggagcuuguuacuacuuugugauuuauucaauauauauuugcugauggauuacaacuugggauccuuuaaugaacagaaauggcuuuaaggcaagguggguagccuuugagaaucauaggaagggcauggaggccucugugggaagaagucugacuuaccccaccguccacccacccaccccaccguccacccacccaccccacacauaaacacuggcaagugucuaggggcuguaacaucuagcuacugcucugcacuggggaucagaaguuugcauaaacucuugucacugaaaaggagcacuaaagcggagaaagggucaguucucaguguugaaagaggaagucguucccccacaccuaaccucagucuucaacaucugcuucugacuacagacagggggggaggacagacagaguuaacucucccuuuacucagcucuugucccaaacaguuugaucuguuuuuauugcgguucgggggucagauguucuuguuaauacuuggguagcuggagaggagaaaguuguaguaauucuuuauggcuuucugagaaguuacaaugccacauaccaacguuuuaaaucuguggauaggguaggauuuagucauuccuuuaugaaccccaaaggcaauaaaugauuauuaaauccagugugcuuuuguguuguuucagagauaaaucaaaacaagaacccugugaaaugguucauucauuuaccuagugcauauuuuauuuuguuuuaaaauugcagccuacuuaucucuguuuaaguaauaaaugcauaagggcagaauccagauugaugugguauccaugugauuuuuaaaaacugcaaguuuaggaaaacauuaaauaggaccuuauuucuuuauucaguauaacuaaacgugaaauaguguuuuuuuuuguuuguuuguuuuuguuuuuguuuuuuuuugaaaagcaggugcuuuguaauuugaggagauggugcuaaucuagcuggccucucugaaagauaaaagccuaccugaaaauuagaauaagcaguaguuggcaugggcuagcuguguuuguggcacuggaagggagcucagggauuaauggcagcugcucucauccugauacauauguucaaggaaaacgcccuucgcaucagcuucaugcauacaugagcgucaauuagggaugucuaugcaagagaaauguguacugauaaaaucagcuguugcccaugucugaaucacauuaaaaauugacauacauuacaaggucaaaucagguguacuuaugccuauauguuuuacauaugcauaucacccauuugucagcauuuucauggguuacugaauuuuuauugaauuggacuuuauaaauuagcuaauugaacuugucaaagggaagacgaugaauuaagaaaauauccuauaguauucagcuagucaccacaaaacuggaagaaaaacaacacaacaagccagcucucuuuucagcucuagguggcaagacugcugggaaaguggcugguagggaccuugggucccaggguauguuccugagaguucaugaaggcacauaaugucuccgcuuccuuacacaaugaaagagaaaaauggauccgucugucuccccucucugagaccuugcugagcauuguuuaugagaugcuuucuuugcugcagcaugucauugguugcaguuggcucaccuuugauacuaugcagaauucugccacauucgguuucucugugcuguugauagacauuggucuuggguaguguuaucaaugugcuugugugguuuuuguuuguuuguuuuuuguugguuuuauuuuuuuugaugaacgcacacauauuuaugauggauauccgucugucugucuaucuaucuaucuaucuaucuaucuaucuaucuaucuaucuaucuuucuuucuuucuuucuuucuaucuaucuaucuaucuaucuaucuaucuaucuaucuaucuaucuaucuaucuaucucugaguaagauugcugggcuguggaacauggaugcacauguaugcauucuuguucaauagaauauacacauauuuuaaauacaucgucauauguguacaugaugccugcuucuaacaauuugagcacuuaaaaaaugaguugugucuuuuuaauaggcuagcucacaagaaagcauuuuccuuuugccaggaaacaauagcagaguaagugugaccucagugcaccuggaggcucauccaguccgugcuagucuucagcuguuuagggacauuguguugaccagucacagaauuucugaguuuacagcuguacgucuauacuaugaaaauagaagcaaauuacuucugagguuacuucugucuacagcuuugaaacuaaaaguguccugacagaagauugcaaaagaauuuguaaauaucugcaaucucugaaggaauauaacuucccagcaaggauuuuuggauauuugagguauucaguuagcaagucugacuucugguaagaaguuaauuaauguggcacucuguuaaaauaaugauuguucuacuaacauugcuagaaguuuuacaucauauucaaaauugaucaaaaacaaaacccacaguaaauucaaauacuuuggcaacuuacaauuuaaucuccccacaaguguguguuuuguguuaaaugccuaaugaguuagaugugugcuuucuuacaagucucacucuucaguucugcacguguaccccauugugaccuuuucugacaucuaacaggucgguugccaaguugaaaagucaugagcugcuguuucauagggaaauagcaaccaguugcuagcagggcauacuuaauuugggugugguggagcugacuuugacauuuuucuuucagcucuuucucugaacuuguguuuguaccuaacuggauuccacgacuguggaaguacaccagagcucugcuggacacuugggaacccacccagggcuugccugugcccaggacuggcacugguggauagaacgggcaucggagagucuucugugaggcugaaucucuccucaguuaaggcacacauucuuccccugcagccucuagccuuguucuugcagcaugaaagcauucuguagugacaaagagauuauaggucccaugcucacguguuugauggagaaauaaacaggacuccugugucacuuucccuuauuuccauuguugagcauuugagaguccuguaaauaaaagcaucuggacccagugguuuauagaagacuucaccaguugcuuuauauuccuagcugugcuuccugcacggcugacuggcggaggcuuaguuaguuuuacccuugauuuauugcucuaagcuagcucuaccaagaaugucuuccugccuuucacauucucucuuuuagcuguaaaauggacuggcaccucccuuaggauuucuuagcagcugauuucaaauucugcuacucucuugucucuuuugacucuugugugucccccacuccaccauaggcuacacuaacgucuuucucuugauuauuguccuccggacaaaguacgguagcagagcuugauugacauuuucccaggacauuuguuggaagggguaagcagggacaggggaacuugccaaguucccuuuauuacuaagcuagaaggaauauaauagugggaacagucaagucuaggaaagaaaguaggugugcauuuacaggugacaguuuucauguaucauugccacaugucacuuguuuuccuucuuuggcaaggcuaagguuaggaacagccauacuggguggaucccuugcacuuaggcaucugaaaugguaauggaaagugauggagcugauugagaauuugcuccuuccucagaaagcuguaggugagccacaggaaccccagagcaggaaugcaugcccucugccagucggagagaagcuagacauuucccaguccuuucucugacaucccacaaugguauuuuaucagaagguucugaaguaucacccagcagagacuuacaggauuaaacugggguguggugauuuggggaucagccaucugaugcugguauuuacaaaaguaaaaaguacagacugucccaggacaaggccuucaaguccuguggugagucucucuggcgauugagcaagaggggugacaaaugaaaguucuguaagccuugcccuugaagucccaaguugaaacuaacacacuguagaacaaccguguuaccgcccacgggugaugugauugggcuucuagccugcuggccgugucaccaaggggcugauagcuguggagugaaggagggccaaaugaaaccucucacauaucuucagggucuuagaccugaggcuacuuuauaugcagucuuacaagaagaaugauagaaaaugaaagauuuaagugaaaauuguaaauucuuuugacuuccugucuaaccagugauuuuuccgaugucagacuuaucguauuaaauccgcgcccugacuuaguagcuuugagguggggccucagacucugcaugucuguagcucugaacugcuggggauauugcuggccugggcacccaguguugagcaguauugucagacauuuauugaagcaauauccacacugcaguguuuagcgucccuucuuucucccuugguguacaaugguuucuaaaugaugacauaugucauucucugugguaagcauuaguugucuuauuggaagaacacugaugaagcucgaccuuggugaggaaaauuuagaugcaacaagcacacuuccuguccuuucugguugcacacuagugcaggcgcaugccagcacuacacuuccauacaagacaaucaacagccgucuagaaauuggaguuuugugcuauagagugacacaagaacuguauauaggagacacaaaacucuuagugaaacacuacaauacucagcuacauucuguuuuuuaaagaacaaucuagaccauaacuuagagaguuaggcuggguguguacuugagagcuuagaagacauucccugccuggagccucuccaaggguacgugauaggcugcucuuguguguuugcacuugauuguguucagccgaguauucuauuuucagucaugaagaaaaggauuucuucaccacacuagauguuugucuguugacucauaacuggaacugagagaauuacugugguaucugaaaugaagacacaucuuuucagaaguauauugggaauggggugguggugguguuaucucaggcucuuuaagauggugauaacaccuugggcugaacgucuucaaggcagaacaccugcucugugugccucucucuguguguuacuguuuucaucugcuugcuuucuuggucuguuaacuguagaaugaguucuagcagagacacggagguuugcuuuguguucccccucaaaauccaucuacaaucuaaaacuuuagaaagcuucuucaacaaaguugguaggugugcauaaagauccaaggguuccuugucauuaaggucuuaguugugaaacaauggauggaaguaauuucugcaagucccuucuuagccccugaccaugcacgccucacugcuggaaucccagugacauuugcagaugaugcuccaagcuacuguugggugagaagauggacaggccuggguggagagaugacuuuauuucuguuguguggucuuccugcuuuaccagccuugucccuucaugccugucacuucugcuccaaaaccugcuguauccucagccucaucuacuccugcaagcuuuuucucuuugcugaacugucagcuuucaugugucauguucucccucucuucugccuuccuaacccugucagaaaggcuucagggcgcagcaggcucuccuugaccuccuguaguccagaagcacccuaacugcagcccagugagucggaguuguauguuuugcucucccaguaguuauuagacuguagaucagucagcagggagacugguagcuuucacccucuguggcagugguguagaguagaaacaggcuccagcaaguucucaacgaauaucuauugaaugaauaaagggauccagggugaguggccuuccauguucauagaucacaauuucuaagcaugguucaccagucugaauguacagagaacugacauuuuucuaagguaagauuuuagacaaggaagcauaagccuguguugagguggggagaauauuuauuauuuauuauuacuauuacauuuaauauuuccucauagucuagucucuguuccucucccguucugccacccuccaacaguuccucaucucauuccuccucgcccaucuccaagacgauguccccacacccccacauucccccacaccccaccaggucuccucauuuccuggguccccaaaucucucaagggcuaggcaugucuucccuuacugaggccagaccaggcaguucuccgcuguauaugugucaggggcauugggccagcuaguguaugcugccugguugguggcucaguaucugagagauacugauuaguugagacugcuggucuuccuaugggguaaacuuccuccucggagucuuccagccuuucucuaauucaaccacaggggucccagucuucagaccaucgauugggugcaaguauuuuccucucgcucaagucagcuacuuguugggccucucaaagggcugccaugcuuagcuuccaucuguaaucacaccacagcaucaguaauagugucaggccccggagcugaccccugggauagguccauacuuggacccgucacuggacuuccuucucuccagucuccucuccauuuuugucccuguaguucuccaagacagggacaacccuaggucagaguuccugacuuugggauggcaaccccaucccuccaauugaugcccuguucuuuuuacuggaggugaaccucacaaguucccucuucccauuguuggggaggugggagguggggagacccucuagaauguaccagagaccugggaggugagagacucucaaggcucaaagggagggagcugggauaugaaacuauuaacuagugcucuguuaaaucuguuaagcccuuaucucuguguaguacuuggagcuuucaccccucuccuuuaguauuaaaaucuauaagaaauaguuaaguauggcauaccuacccaagauacacacacacacacacacacacacacacacacacacauauguguguguguguaauauauaauugguauaugaucuuuucauauuucuaaguuuuaauugaaagauuaaaguuuuuuucucaauaugcugauuuucuuguuucuguuaaauuuuuuuuuuuuucauuaugauaugagaauuuuacugauguguuaaacuuauauuucuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccaacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacaauuugcaaauucaucuggaauaacaaaaaaccuaggauagcaaaaacucuucucaaggauaaaagaaccucugguggaaucaccaugccugaccuaaagcuuuacuacagggcaaaugugauaaaagcugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauauggguacaggggaaaaauuccugaacagaacagcaauggcuugcucuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaagaauaccgaauggcagagaagcaccugaaaaaaugcucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuguuaaauuuuaaaugacuaucuccagggcagaaguagugauuacuuuugcuacuuaagguuugaauuaaauccagcaagucuuaccauggcaagccaucuuccugaauagucaucucacuaaaauugucucccugggauagacaggaacgauggucuguuuagcagcauuguuagauguccuuuugaaauuguuguuguauaguuugggcacaguugagaucuaaaauaaguguucuuugaaaaguaugucguuaauguugguaagccagggauuauuaauagugcuugacuuuuagacugagaccccuuuuagacugagcgaauacaccuagacaagccaacaucuaggcugaugucuuaucuaggcuuacgucaaauaugguuauguuaauuuauugccaggagacacagauuuagauggcagcucaauuaauggacuguugaaaagucugggaacauuccaaucccugcuucccuuuuagucagugucaggagcugcucugccuuuccccgaguacuugagacuuguagacauaagucuguuguuugucaggguaagucaguggccuagcuuaaccauagguucacgggugcuuaggaaugcuuuggaagugaaaagguaaaaguuguugacauaaggaaaaccagccaaccaaccaaacagucauacauacaugcauacaugggccugugcuauuuguagcuuuagauauccauagggaaucuuggagcuguaccccucugcaauuagggaagaucuuuaggccuuguaaauugguaguacuguuugacauaagccgacuaugaguaacugaaauucacaacccugaaugcagacaaucugaagaauuaugcaugaugacagcaugguaaauuauccacuaugugaacuauuuagaauguaauguaagcuuauuuguaaguuauaugcaauauagaccugacuuuauucccaagaugucucacuauauacaaacaauuuuuuaaucccuccacccccacaauuacagaacuacaauacucuuugucagaagccucaugagcaagagaugcuauagaaacagugaaaaucuaagacuuauacuagguaugguuuucccaaugcagucauaguacacuguuuagcaaaccauuccaaacucgguggugugauuuaaccucaguuaugcaaguuacuguguguucuggauaguuaaucuucacguccugcuggcuggggcguugguucagcuggaagauccacugggaaguuaugcauaacaugcagugcugcucugcugcugggggccgauggaaacaucucuauacacacuugcuuaggcuuccucccaaugaagcccgggagcacgugcagagauauagguaaaacuuggcaucucauaagauccccucucacccaugucacuucugagccugaagggugcuaaagcagagcaggccagaaggugcuuuagauagaaaggggggaacgguuuacaccccgugaugagaagagugacagaaucaucuuuggccaucucuaaccucugcugaucuucuaaguuaaguccuguuacaaugugucuauaaagacuugaggaaaccauggcuuacggaggauaagacagugcccugcaccauacaguugcuaagugguuuaagcuuaaugcuagcuguggcuuugaugcccgcagagagguuuuaaugacuguggugagcugacagaaaacacuaccuggaucuuuccuuauauuccacagccaauagcugaggguaguuuuauugacuugaggaauuagcccauuucagucagacuggaugacauuuuuugagaagcuaucaugugcucccucugcugccucuccagaucugaauauuucauaauuguugggaaagguuagaggcaaaauucugacauuguccuguccugcccucauuauauauauuagucuauuuccuuaccaagagcagauauauccuuugaaacuggauguucccagugggcacccucuguucugcuacagccuacaguuuucaugugguuucaauauucucauguuuacuauucauuaacaugaaacacagauuuuuagauugacccuuuuuuccuguuguucagugguuuuuguuguuuugagagcagucauuacucauggauauucuuuuuguugaaaaaggauaaacaaaagaaaugucagagaugacaacauuuguggagaacaaaguaaaaaugaaggccucuagaugagcuaaugacagguuuuaugcuuacaauaacuugaguuuucuguauuugauuccugguuucagggcaucugucuuuaauccacacauguuggggagaggggagucuguaaauugaaaauauggcggcagcauucuccuugcacuuuagcacgguuuguaaaguucacucaccuuaggggcucuucagggcagacuucucuagguaccuccugaucacaagaaaauguuaacccucccacugccuguuacggagccuuugaacauguucuacaacugccuuacucacacguguuuuggaugagagauguuucacagaagacccaucucuagaaucuacagugaccagcacugugcuguccccauuauaugcugguauucuuuuaacuggcuguguccuuugagauaucgauuccacauauugagggaucggccauaccucucagggcaggagaaguuacaccuggaaggcccccaugguuagaaaccuguguccauuagguucauaacguuugcagcuuuucuuucguuguucagaggagcaucaacuccuaagaacugguggguuacuguagguguuuuccucgguuucuuugcccuuuuauuuuuccccuggaaaaggaauaacuggcagagauauccuugcggaguuccugugugauaaugccgcuugaaacuguuuucauaucuuccaucuuguaaauggaagaaaaguauggucagcagcguugucugcucucaaguagcuguaucuuuguuguuaagguaugccgaaaugcauugugauguccucauuugacaaacuucacaaaacucagaggccuuucaaaaguuccuaagagugucuuggcuaacuuuuuagagccuguuaugaaaguaggagauaaagcuaucaaagcgacuugagaacauauucuuucucgaccguuuuuagauacgggcuuaagugucucuccguuauacuuugugcuuuuuauuuuaagaguauggaugugagaacccuucuuuggugguaaggaucuaggaaaacauacguguaagguuugggaaaacuuuggagggaaauggugagugcagcccuucccagagauuccucugucaguguucuccugaguaguuuauggcgaguguagcagaaaagcuuuuucaugugaaagccaaagcugguguugccaguggggcucuacagaugguggagccugugcugggacuggaaaucuauuuauucuucuacaagcacauuuggcccuugccuuuaaaaaaaauaaaaaaaagagagagaucaauguaauggcguuugagugauguuuuuguuccuuguugaaaauaagaauauuuaaagauuauaaagaaguagaaaaaccaacuguagugaaucugcuucucagagaugacugcugucaauauuuuucuuguauccuacuauucacuguuuaugaauuaucuaucacagaugaggaaauauuaauauaguuuuuuauuaauuuggcuuuugucaucucguuuuucuuucuuccauucuuccauuuucucccaguguuaugauugacgcacauaccugguuaugccuaccaugaguaggccuggguguggaauggugaauuaguaccauuuuugguuaucacucauagggcagcugugguugauacuucagggauggcccaaaucucgugucuuuccauucgucuauguugcagaaucaguaguggggugagcuggcccuuccaacuucugcauguccuuugucuuucccuugcuccauuccaggggaacaauguggagaugagacagcaggcuaccgaagggaaaaacuucccgauuuccaaaugggaaggagguucugaggaauuguuagugugauaggguacuggaugcuuccccaggaaacaggacagauguguuuccgcugcugcuguccccgcagacugcaugggagaguggcagcucugguuucaauuagcuuggugacauucugcuuugccauucaugaagacagaagucacaaugagaaagcaugagacaaccuccgaacuuacagagcaguuuaacguuuuuaugauuuaguagagucuaagauugagcccuauauuauuuuaauuuugcuagaacaauuuuugguaauuuuacaaauaauguuuaucaagguuuggaagcauuauuuauaaaauuuauugguaugugucuguuugacuguguuucucucugugugugugaucacauauaacauuucuaucugguuuugggaacuguuuugagugguagcaaaucuuuccuuauaauuuuaaaauauuuuaugaucucuucauagucaaauguguguguaugauguauguauauauauaucaccaacaaaaacuuuugugguaaaaaguacacugcaauauguacaauaugcuuagaaugugccuucacuacccuucagggaagaccauuuaggggucagguaaaauggagccuucacagucaguugaucacaaggagaaaggccagggaaaacaugacucaagcauauuuugauauagaaccggugcagagaagucaacagaaagaggcacggggagacugugccugggggaaugcauagagacuugguggcuggcuugggacaaacucagcgagagaaauuaggaaaggcagcuggcccucgggucaguagauguucuagaaaauacuggaaaauuauacagcauauuuaguuaagugaaaacaaaagggaaaccaucaaaaccauuaaaacaaacaaacaaauaaauaaaacuaguaagcucaagaauuuuccaaguaaacagaaacuaagauuuuuuuucugaugugucugugauaagguuuuguuaugucaugaagcaaacuauguauuacuuuuuauguuuuuaaaauuaaacuggauuagaagcaauaaaacauggacaucauauaaauagcugcugcacugcaggguugacauuugccuuaugcuuuuaaugguagguuacuuugggucauaaguaacagggaggaucuaguuuauuaaaacuguuuacuuuauuuuuauuuguuugugugugugugucugugcgcgcgugcgcgcgaguguggacacacaugccauguguguagaggucaguggaugaucugcaguugauccuccucuucugccaugugggagcaggggaugaagcuuagguucucaggcuuggccucauccaucucugcccgcugagccuucgcuacuccacguucacuauucuauuucaacugcucuucuucugaagucaaguuugauuuguuuuuugauacauguuacccaggucaugcaccuauacuugaguuucuaguauuucuuuucuuuucuuuuuuuuuuuaaugugccagugaccgggcuauggcagcugccgagaagaaacagcccccaugcauaaaucaaaggauuucucuugcccauuguauccacuagaaagcuguaccuacacaacagccuccagcaaccacauugcuuuuccugcaauaauuaauagucugguguauauuuuaaagauuuauuacagcugaacucugucacagaugagguuuuuaucaaaagaugccuaauauuuaagaaaagaaggguuguuuauguuacugggguaagauuauaaagcuauuagacaaaauaaaggugggagucauaauauaaugcuuuaguagauuguaauggaaaaauuuccccauaaaaccauuuauaggaaucaacaaauauaccuugaucauccugcuuugguauuacugugaagguaauauggccagcauuaaagaaacauuuaggagcuuuauggaauauguaaguuaagauuuaauauaguccuucucuuuguggacagugcuggugcacuccuagaacauuucaaagccuaugagaacaacucuguucaaccccagagccaccacacccagccuaauucuucucccuccuugagcccguugaucacagacagcauuccgcaccucucugggaaccuucaauuccuuucucagaugauugcucucaugggguucugggucucucuuccuucauuucuccuguauuuucaucaucuuuggagauccccaaacccuuuuagguguaguuaacugccucuuugaguccucgguccuuaaaccaagccuggauaugauagacagucacagagaucuguagaguaaauaauugaauguguguucagcugcuugucaauuguuccugaguauggaguguguacuacagucuuccuaaagugugcacaauacuuuauggcuguugguuguguagaugaaaucuauauuacaaagggaagaaaagcagcccaccucaaugacuguaauuucuuuauugaucauaacuucuccuuaugacuccucuagaccuuuggcuccauaccucacuuacucauuagaacaucucaaggagcagucauuuuagguaacauuccaggaugaggaaacugauuucaaaaggcuuaguaacguaagacuucauagcagaguaaggauauggacccaguaauaacagacuacauagcuaaacucuaauguaggguauuuaaaugacuaccccacauauuugaaugugaaugucuuagaaacuauucuaaggauauuaguugugaacauagcguaauuucauauuugaguguuaaggaugugaugguaaauuguccauuuguaauucacccaucuguuuuucucaugggcugaaucuuuauuuuuaucggcuuugcccgaauggaagcuuguauauagcagaugcaagaagaagauauguagggauaaaagaaugcuuacuauggucucugcuuugggcuacaaauuugagcuuggcuuuuguucuagcagucuucuggguugaguuaauauuuaauuucuuuuuaaaauuuauaaucaacuuucauauuuaauuuguuaacauuuuaauuagcccacaaacgaaugaaauuuaucauagcauuuuucuacuuaucgcuauacuuucuuuuuauucccacucuccucuguaucuuccuccccccuuuuugcuggcuuucuuucucuccccaaguuaaccaucacucuacaguuuacugggaagcuagcugauacagguacauugcagagggccucugcuccagucucuuucuggcccuccuccugacuugucuguggcuugaaguaaauacugagucuucaguaguaaaucguugcugagcucuuccacuucuuucuucugauguuucacuuccauauuggacuuuuaaggggaaucuucuuuguuaguccccuuagagguauggcaggucucaguauuuggacagagucgcggaguaauaaucagucuuuaagacugucagccucuuccuaauaauagacugacuguuuucagaugggagaaaugaaaggcaagguuuccaccagccaagucuccucacuccccuaggaaucagagugccccaggucaacagcaauccagagcacucuaugucacaaauacaauagaaaugguucuuagcuggaugugaguuuccuuuuaagugccucugcuuauauaugucaugugguucuuugguuuuauguuagauuguuuacguaaagagcuagauacacaugcucuagcuuucaagugugagaaaugaauuauuaauaguuuuggauaaaauaccugcccugucuucuacccaaagcagaacauucucaugaaguuuggacuucacuaaauaaauaucuuuuaauauuuuugauuaauucaguauuucugccuuuuuauuuccuccuccauuugugacagcuguuucuucaauguaggaaaccagcaucgugcaaucucauuagauacauguuuugugcaccucucauauuuaguggaugccaccaaugaaaauuugagguuauuaauucgcuuuucaacauuuacucaugacgucauaguggccauaauuaaaguggaccagaacacggugaagugucaugaauuauuguaaugcuuuuuucaugcuaaaguuuuuuuguaccaaaguucacuaaaaguagucuuauauauuccuguaucaaacuauuuauucuuuguccuuuaugauguuggcuagaacaagcuaaacuacuuagauuuaucauaaucagugaagugccuucaguuuaagucauuuauucauucuuguacaaccacauuccacaaccuugcuugauugucaaagaaauugauucacaccauugacagaagauacaggguuauaaacugaagcuaaaacagaagagugucggggcaucaucggugauggccuugacauguggaugaauuauaguuauaagauuguugagucuugguuagcacaauuuuuuuuuuuuuuugguugugguuggaaggagacuuuuagugauacaaacuaguaauuaguaaucaugaaaguccuuguuaauuagucaucauuuccuaucauaugguggcaagucagacggcuuucagaagggcugucucacuguggaaugauuguaugauaggaacaaguaccccagcugcagacaacguguucugugaggcuuucugucuuccuuuguacuuaaacggugagaaauaaugcaauuuuguauuuugaagguugaguguuguuaaaagcagugugucuagaauacagaguuuguuagagaauuauauaaagcauguacuucauagaaaaguacagauaugucacagucuuuauugugacauuaaauuuauaagauaauagauacauaauucacuaucuuaacaugaacuauaaccuucauaagucagugucguuggcaaugauauuccaagaauucacauauaugugugguguguacuaggguguguguuuaaauauauuaugucagaauucuaaauucuggccuauaugaaaauuaaaauaacaugauaucaaugacuccaaauaguuuuaauaauaugaauugggguuucuuuaaaaaauacaugucaagugggaggugagagacucccuggacucauaggggaggaaccuuugaugaguugccagacaguggggagagggaacauguggagcccacuuccagugggaagacgggauauuugugggguugccaucccacagucacaccucucacccauaauuguuccugucugaaagaauuacagggauggaaauggagaggagccugaggaaaagaagauccagugacaggcccaaagugggauccagcucaaggggaggucccagggccugacacuauuacugaggcuauggaaugcugacaaaaagggaccuaucaugacugcccuccaagggacccaacaagcagcugaaagagucagaugcagauauuugcacccaaccaauggacagaagcugcugaccccuguuguugaguuaggcaagacugaaagaagcugaggagaagggcgauucuguaggaggaccagcagucuugguuaaucuagacaaccacuuucaaacacuggaucaccaaacagacagcauauaccagcaaauaugcggccccuaacacacauagaguagaggacuuccaggucuguguucauucagagaugaaccaccuaacccucaagagacuggaguccccagggaguuuagaggucaggugggguggagagugggggcauccacguggagauggggugggguggggaggaggucugggauguggagcagccagagaguggauagggaggggcggggaauggaauauggaguauaaaaaaugaauuauaaauaaaauaaaauuaaaaaauuacaggucaaauauauauauauuugucaggcugcuuugcauggccugaggucauccauuugaagguaaaagaacuguacacacaaagaaagagccacuggauauacauacauauauauguguauuagugacucuuagagccucuagauuauaaauuuaaaaacucuuguuauuucuguuuuaaaguugaaugucuacuaagucaguuguccgugggcaagcugaaucucuccaucuuucaucuccuggggcucagagagccgagauuacugguaaucacugacuuuaugcuucagacguauacgucgcaaggcaaaaugagaaacauuuggauaugcuuagagaacaaagacacaaggggauggaggcaagcaguuuagaaaauaaggaacaguuggcuaaucuuaauuauaaccauauucauuuuuuuuucuuucuuaugugucaauuggaaguuuguucgaaaacuaacccucuuaccugauaaugggacuuaauucauugcagguuuucugcggugacuuuauguuuugucuaagcauaaauccugaagcgcuucuacaguugagggaacccacacuuuguugcuuggauggagaacaguuugcuaucauuuuuaucuggaugggacagccaggucaaucuuaacgauucagcucaguggcagauucgugcuuggaucagguugugccgagcaucaacgcagauguauuucagagaaugaagauuuaucuguguacacugacaguaaagcugcagauugguaacuucugacuccuuagagaugaaauugcguugauuaaguauguuaggagacuacuggauauuuuccuuaaauugaaagauauucugacaacacauuuauccuugauugcuuucucuuuacuuuuacucuccuguuucuugaguaucuuggcucccccccccuucaucuuaucuuuuuuuguauuuuuuuauuagauauuuucuuuauuuacauuucaaaugcuaucccaaaaguccccucuacccuccccucacccugcuccccuacccucccacucccacuucuuggcccugucauuccccuguacugaggcauauaaaguuugcaagaccaaugggccucucuucccagugauggccgacuaggccaucuucugauacauaugcagcuagagacacgagcucuggggguacugguuaguucauauuguuguuccaccuauaggguugcagaccccuucagcuccuuggguacuuucucuagcuccuccauugggggcccuguguuccauccaauagaugaccgugagcauacacuucuguauuugcagcuacuuauuuuuaaacauguuuuaagaagacuaggaucuucgucuuuaaucacagauacauaguacaccaugucuucuaagcaucuuuucccuacugucauuaaguauagauacgggagaaaaaaaaugguuaaagcaacacgaauuuuaguggcaaagacauugcuaaaauagaaaguuuuauauauagcaaauuaaauugcucuauauuuccuguguauuuucuugaggcaguugcucuuacccuaguccccaacacacauaugcacacaaaauggcuuaagccucaaaacaguaaguguguguaugugguggugguggugguggggugaguuuggguuggugauugugaguuuaaaaaaagugguaaagucaauucaaaguuaaaacuuagauuccuuuuuuuuuuuuuuuagcauucuguguuuccuuugcuucgucauuaucuagcacuaguuuauucuacaacauaguuuaugcuguauacuucagaacuaguaagaacuauuacuggugacagugugacuugugccccgugaagcacacauccccagagcauccggauuagaauaugggugccugcuguuccuuccuaccuuaagcagcucucacccucuugucacuuuaucccucugagacuuuucguucaauuccuguuggcucuccuucccauauagcagucugccuaaugagggacacaaguuagaaugucccaggaaaguuuggaagugcuugcuugcaaaccccaucauuagggcauuuaguuuguagcuagaagaggucagugaacuugggaagaccucgucucacugauuggcucucucuucaugucaaguccaaacuaaauguuuuuucacccuauuucccaucacaucuucuuucccucugcugugcuucagugacccaaagugagaagcuuugcuucuaauacuuucugggcccuuucugcuccuccccagccucuucuuuccacuuugggacacucgugugccaugcaauuacaugacuuucucaacucuccucuuuugucaaaauuucccuugcuuuuccggauagaaguagcacugugucuuggcauuuaugucugauuaugcuucccauggguuucucuuucucauuaaacagugagcuuaaugaaugaaauucugugauuuuccuugcucauguuucuguuaaauaaucacacggauaaaggagaaaauaagagcuguuaagaauguaugugaacagugaacauuaauuuagauggaaucucagaguggcauuaacccguuuuuaggcucaugaaugucuacuaagacucaaguguauauaugcugaauuuuuuaaaaauauagauucccauuaaagauuccaugcauauauuuacuucccuuucucuuuucucuuguacuugacagacggaaucucacaaagcugucccuuaucuucagucacaugcuggcagaaaucaaggcgaucuuucccaauggccaguuccagggagauaacuuccggaucaccaaagcagaugcugcugaguucuggaggaaguuuuuuggagacaaguaaguagaaauugcuuucauagucugcauccaucuuuccagagucaccuaauugaguguauagagaacguacuugguaauuuuuauaagauuugaugggguuuuuguuuuguuuuguuuuguuuuguuuguugaaaaaggacauuuuuccuacuuaaguguuuuaccacugagcuaugccucaaaccuugaaauguauuuagaauaauggcuccugguauagccaacaaaacuauuuguuaauaauggaacauauaaauuauguuguuagaguacaugucagauuagacagaauuuauauucugagagaauuuauugagucauuuagcuccaagaagcagagacacauaaaauaauuucuguauguaauuucuuaucacuuaauacucaucuaggauauauauauauauauauauauauauauauauauauauauauauauacacacacacacauauauauaauugaaagguauagggaaauauuuacuuuaaugagcauaaauaagaccguggagauaauucagugguaagagcuugcugugcuaguagggacccagagcuugaucuccuaguauccacauaacuguuggugugcauggcggcucacuguaacaccagcacacugcagcucacaaauggcauuccugaaguaagcugucaagcuagacuaacugagguggugagcccagggugcuaugaaagaucuuccucacauaaggugaagggagagcaaguggguaagacacacucugucuaccucagccuuccucagguauacauccacacaugcauccauagguaccaaaggagcguguugagcuuagagaacuuaaaaacguaucaaagcaaaacugagguguaagaaguccccuagaucacucaguuaaaccuguguguauugucccaaaccccacucuguuuaaagaaaggcuaccugccagugucaucaggaagcugccaagcgaagacuagaagaagauguuucuuuuuucuuuuuuaauauuuuuacuagguauuuuccucauuuacauuuucaaugcuauccuaaaagucccccauaccuucccccaauccccuaaccacccacucccacuauuuggcccuggcguuccccuguacuggggcauauaaaguuugcaaguccaaugggccucucuuuccagugauggccgacuaggccaucuuuugauacauaugcagcuagagucaagagcucugggguacugguuaguucauaauguuguuccaccuauaggguuauagaucccuuuagcuccuuggguacuuucucuagcuccuccauugggggcccugugauccauccaauagcugacugugagcauccacuucuguguuugcuaggccccagcauagucucacaagagagagcucuuucuagguccuuucagcaaaaucuugcuagugugugcaauggugucagcguuuggaagcugauuaugggauggauucccagauauggcacgcucuagaugguccauccuuucgucacagcuccacacuuugucucuguaacuccuucuauggguguuuuguucccaauucuaagaaggggcaaauguuucuaaugagcacuucuuacucagauacagauggccaugagcaggguguguguuggggcaugauagucugaauccaucacaauuuauuuaacauuuggaaaacuuugugcaauguggcccaggugucaacaaaggaggcauaugcuucuucagugacgucauagguucccuuuacaaagagcgccuugggaugcucucuguagaguaugcugcccaguagggaggaagacugguggcuuccucauggagaaaaugggguuaaugccucugucugccacauaaauuguaaagucagacauguaaagugugggcugagcuuugagcugcucagugcucucagauuagugagugaagcaucgcuuuaaucugugucuuuuccuuucuaucaugaaaugcuugguuuauauagcuucuaccccaacuagaauauaaauagagcaauguuuuuaauuggcauacaauauuugggugccagaacuacauuuuggcuugcuguuugagaagcgguuugcuacguagcuuaggcuagccugaaauuuaagguuauucucaggcugccgcccacgugccaggaucacuguugccaggauccacuccuuguuuggcuugaaaugaauauuaaauccuauuuuucacuuccaauauuaaaauggacuuuuugaaaugaaagggaacaauaccauuuuauuccaguaguaugaacauucuggguucuagaaauccagcuauucauaacauuucuauauccaauuaaagugaaggauuaauaguuucauccucaucugguaaugggaacuacagaagcagagaguauacucaugaaauauguaugagucugcaaagcagagaggcagauuccggaagacugccagccuccuguauuaacacugagaacccagagcauccauggugacuuucaaaaucacguuucucucugaaaauguauagaacagguuguucacagaaauucauuuugaaaacugaaaacuacguuuuguuauaaagugcuuuguuagcagguucuuaagaaacgacagcuuugcucaauuguuuuuagaauuauauuuacuuuguuaaauaucacagcacagugaauuaugaauuuuugacacuuuggguuuucucugcuuagcuacagacaacaagggccuguuauuguauagaacuguuaugucaggaagucacuuaaccuacaggucaaguacucccccuaccuccucagcccucccaccgcuugcugagucuacagacugaggaaggcuguaaauugccuuuaacguuuuguuacuuuuaggaugaacauucaguuccaggcuacugccagaauguauacagaaauguauaacuagaguucuaaaaugagcaacaccuuugggagauguuuggagaagcgcucuucacuguugguuuuucugucgucccugugcuuuuugacuucgugaacagugcugacuagucuaccuucccacugguugaguucuuucucuuucuucugccccaaauucuucagacuuacuugauucucaucuuaaagaauuccuguugcuuauccccgauaaugaugauaagugaaaacgauuuuauuuaaucuaccggugacuuuaaacuucagaauaguauuguuuucaaaaacagacccauaggagguugucucuacaaacagucagauuaucauuuuauaaauuguuuuguuugcugcuuaaugacuguuauugugacuuacuucccugaagggauagucauuucuaacaaagcauuuagaaugaauuaaaauagaaaacaaaccauuguucauaagauguuaugauacucauaaauauaauuucaggucagcccuuaugaaagcagggaauagaaaaccagcuuucaaaccagagcccuguucucugccugcguagcagccauuagccccaucugcugagagccuugggaacacagaaugcccaugacaaggggaauagaagagccugccugugccagauuauuaggggacuccauuuacuauuucaaaaguucagucuuaucuuuacuuccuauuauucuauccaccaggagauaauagcaauauguaguaaaagagcauuauugaagaaaucugucaaaguaaguuguacaaaucuucaaauuuuguaauaauguuuauaauccagaaaagaaaguaccguuaauccagaaacauuuucagucuggcacauuuccuaacucacacaaguauauaauugccuaagaaacagggcaggaggguaaguaaggcaggggagaggagguggaagggaaucgagggauggguggaggaggacaagugggaggguugggaagagggaugaaggggcuaccaugcccacacucuagaaguucuuuuucuaagcaggaccaguaacaauuggaauugcagggaugguuuucaagcaaauuauuauucaaugaaagcugaugggcuauuuaauucucauggcugucuucuucuaauucauccauuaccaguuuuauucuuuuuuguugguuauuuuauuuauuuucauuucaaauguuauucccccuuccuguuuucuucuccacaacauccccuauugcauccuccuucccccugccucuaugaggguacuaccccacccacccacccacccacuccugccucauuccccuaauguggggcaucaagucuccacaggacgaagggccucccuuccuaaggacgcagauaaggcaaccuucugcugcauaugcagcuggagccaugggucccucugugugugcucuuugguuggugguuuauucccugggaccucucaggggucugguugguugaugcaaaucccuuuagcuucuuuaguccuuccccugacuccuccauuggggucccuguacucagucugaugauuggcugaggucaguuuuacucuucaaguugaaguuuagacacuccccggcuugcuguaacagccuuuauacuggagccucugucuucaaucacagcuucugagaucagugcaaccuguggaaagcagaagcuguccaucauucuagacuucuggcagaacugcuuucagggauauuggcucugagaucaugucaagccuuuggccuuaagaaagguugaucucucucucucucucucucucucucucucucucucucucucucucucucucucucucucucucucucucucucucucugcuucacccuccuccaaaaggccacacccaggucaucuauauuccaguguuuccccuugcucucuucugucuucacgcuucagucuguuaccuuuccuuccacuaccugggugucucaucauugugcccugccacuuuggagggucccugacagacugucugaagugcucauccacauucuuauugagccaaacacccagguucccauccauucuucuagcuuacaugguacugugauauguuccuguuucccagcugaggaauuuccaagagacaggacagucuauuugaagacagggacugucucauuuagcuuuguuuuugugggccuggcguaugucuuagaauguaugggcacuaguauuuauucacaaucugcaugcauaguuggauggacagugucuguucuugguucuguuuguaaugacuccaucauuguuucucugucuuuucuuuuuuuucuuuuuuucuuuucuuuuuuuuucuuuucuuuucuuucuuucuuucuuucuuuuuuuuuuuuuuuuuuuguugucucuuuucauucuauaguuuuuauacauuucuacaacuuugccccagaaguuuacuuucugguuacuucucagucacuuaccagcuuccacacaauuaacuaccugacucucuguacucuugcuaauauuucugagugcacauaguugaguaugauuuuacaugggcuuguccugcacuguuaauuuuuuuacaguuaugucaaauucugugauguuucuuuuuggaaugcuaguucuguuuucauugucuucuguaaaaugcuucuccacuuuguuuuauguauauguguaauuugccugaaguuauaucugugcuuuauauacauguauuaccugccggggccagaaaaaggcauuggauccccugugacuggagucacaaucgauugugugggguccuaggaaucaaaucuggguccucugcaagaguagccagugcucuuaaacauucagguuucuguccaaguccauuuccaauacaaucuuuacacuuuuuuccaagugguuuucgugcuaagguagccuauaggacuaugcacuauagagacacccuguuguucuugagcacacacgugaguauaugagaccacuuuccuacucuagguucucuuccuuggcugacacuccgguaacuucuguucgugggacucuuccagaggcauuagcacuuguagcuucucaucuuugcuccaauuagcccuaucccuuaaagauaguacuuuugcucagacuauggaacuauccucauagcagugagacuauggaaccugaagaggucaucuccuguagccaggcaauggcccuaguggagugauagagacaacaacccacccagaaaacuuucaauggaaaaaaucuauccugucuacaagaaaggcagggcuaaagauggagcagaaauugagggaaugaccuacacggguaggugcugauuauuccuaauugguucuugauugugucaauaaagaaggcuagagcuaauugcuuggugaaggguaaaggugggacuucugggucccagaaggaauagaagagaugcagggaaggaaguugcuuuuggcagcuauacauuagaaggagcagaaagccagucauguaaggccuuagugcacuuagggccugcagccucugcagcaggugggggccaaggaguugugugggagcuagcuguuagcugauaacauuggcaaaggauagucuuugcccagcaauuguguuaucugguaaguuuuauauuaaaaaaaaaagauacuguaaucucaggaauaaaauucucuugaaucucuucaaguucuuccaucucaggacccaacccuccccuaaauguuacaaucagguccacugauuuugaauaagcccuuccuggccuccugcauuuacuauuuuuaauauuuuauuuaaaaucguuuggauaauuaucaucuucucaguccgugucuaagcuuuaugaacugggguucacugcuuugugucugugcauuucagcagagugugugcugugugcuuucaugaacauuggauuucaucucagaaggauaggggaagaagaggugcagggccucuuaguccacacacaauagagauggagacacagcuccuaccugggaugggaggaaacuagacuggcccugaggcccugccgcacucgcccuucacugcagccucuccucacucugucacugggcacacuccuuggccugccaguggaucccuguccuuuugucuaaagugugugccugugagacggugauauaaucucuugucugguguugcuguggaaauucaacacgauaaaagcugccuauaaagagggaaauagugucuggcucauaaugggccaacuguauugugaaguaauuacguaguuugggucuuugaucuuacuccaaauaucaucuauguauuugcucauucuagaauuaauacaguuaaucuuugacuuugauggaacuuccacaccuggcaauggaaggcaaaccaaaaggaauuaaaaauaaaacuugaguugucccaagaucaugucuaucccuauauaaaagugaguuaaagguccaugauuuugcugaccccggggaaaauggccuuuuuagagcucaguuauugcuucugccuuugauuucccgagcaagugcuguagacucucuuugguuucuuguguucacuguucacuuuuaauaagaaacaaggaaaauuaugucuuuuccucuccauugaguaagauauauguucuaggcuguuaauuaguucuuuuucuccauuauggaaaagacaaucuaauucucucuaauuaauagagagagugcacaguugaaacugaguauacuuauagugaaacuggacagcagguucacuagaaaaaaauaacuaagaaaugaaauaagcucaaaaauaauuucuuuugaaccagcucccaauuuugucuguuuaagcaaauuauaguauuuuaucucaauaaaauaauguagcuuaaauagaaauugaaauuuuuugcuaguguuggacucauuaucuaaaaugcaaaaguacaaaauugugacauacuaauuauaagcauucuuuucagauugggaaugacagaaaauaaaaaggugauaaaugcuuaaaguucucauuugacguuaggaagugccuacugaaaaccggaauuguaugcuucauuacugacuuauuaccaaggacuuuuucagcacaggauauuacucaauucaucuuuauccuauauucauguuuauauaaauuaucuaucuccauuacuauacuaauguauguauucacaauaugcaaaacacacauaaagugauacauuauacuauaacauuuuaaaacuauauacagggggcuggagugauggcucagagguuaacagguguagcuguccuuccagagguccuaaguucaauuccuagcaacugcauggugguucauaaccacauauaaugaaaucuggugccuucuggcugcaggcauacaugcagacagacacugcauauaaaacaauaagucacacacacacaauguaagaauaauguugauauuugcuucacauccuggcaagcaugugugcauaccucuaguaucuaagacuaccaccuccacaugcacuucauuuaaauacagaaaaugguaagguccauauaacuucuuuguacaugcccacucaauauuuuguucaucuccacuccuuuaaccucucuuuguuucccaccucucuccugcuacccuuucuauccucaacucucaccucugcuuucauaaugcaccucacacacacucacucucauacacacagacacuuucauucucucucucucucucucucucucucucucucucucucucucucacucacacacacacacacacacacucacuuuaaaaaauaaaauauaaggcgagaaguagaaacaagguggaguaggggcuggugggagaagugugugauguggaccaugguaaaagcuacaguaaugggcccugcuccuuugugagacaaaggugagugcaaaggguugcaacugagcugccuucugucauuuaucuagcuuugccuucccuccuuccuugaccucuccuccccucccuuucuuucccauccucccuccuuaucucccuccaugugucuuccccucccucacucucagccccaucuucccucccuuucucugccuccacacuuccuccccuccccacucuuagucccaacuucccuuccucucucucucugccuccaaacauuccccucccccucucagucccagauucccucccugucucccugccuccuguaucccccuccaccuuucccucauuuuuguguaugcacugcucaaugagaaaacugcauaaaugacauccuggaggucauuaauguuuucugaaugaguucucaauauuaugauaaucacuaaaacucaaaauggugucucuaaacuguuuuugaaguauaguuuagaaaaauccuuguguaaccucuguuuaaaacaaaaacccaaaagagaaugagaaauuauguaauuaaauuuuacuuugaaaaaauuuaaauaacccaaaucacuccuuccuguaaaaccccaaaauccauaauuuucuuuuccauaauucuugccuacuaauuaguuuggaguuaauucaauaaagaacguguuuaagauugugcauccucauucucagaaauucuuguauguuuuuacuuuuugaaccauuaaucuuaacaaagcuugaaugcuaauauuuuuaaaggguuuucuauaauaguuuauaaucucauuguaauauuaaacauauuucaaaacauuuggaauaaauuacaacguacuuaaaaagagaccucauauaauauucuuccaagacaagcuguuucucuuugaagcagagauccagucuguugagcccugagaaccuuuguacuguucucccucuguccuggaugucucuucccuggcugcaggacuggagagagaaagucugggaagcuggagauuggaaggguagguugcacaggcggcauucuaccccacacccccagagaugauuagauugguguguuuauugcccauuggaaaagaucuggguucguuaagugccagguucuguaucacugacaaucacacagugcauguggagccacugggcaucuucauagagagaauacaggcucagggaacacagggaagacaugggugaugcucucaccacugucuugcugugaauaauacacaucuuuuuuugcuaacccaugaaacugaaaacuaauuuucuagaagcuuggaagcuguguauguaccccacacuccacaacacccuagaaucacuuucugcuggcaggcaaacuaauugacuuaauagcaaaguaauucuuuuuuuuuccccuacagucaacauauagaaauguguuacugacugcuaaauauucauuacugacugcugaauauucauuuuguauuuugaauguugauucucacugugaagaacaguaauggauuucccugcuuaguuccaguucugcucuuacucuucaguaauaauguaguguuucuacagaacauuaagcaugaccugugcguccagcuacuggagagagugaggcaggaggauuccaaaaugaaggugugacugggcuacacagacaguucauguccagucuucgguacuuagugagaccuucucugaaaauacagaguaaaaacaauguugaggacauagcucauggugugaauggcccuggguugauagagagggagggaagagggagggaguauugggggggagagcucagugauuucugacuguaguagaaggacauuuugcuagaccuaaauaugugcaguuucuccagucaggggcuuagaauauugcuggaugcuuauuuccuuugguuuuagacucagaugucuaagaggcuucacucacucuuaucugacuuaauugggcaauauuaagagauucaagaggaauuuuguuuuuauuacuggcagaguggguguguguugugugugugcacacgugcacuugcaugcauguguuuguaacaaugaggucuuauuuuugaaaggaagaucauuuucaaacaaacuucugugguaugauuucccauuuuucaugugcacauuauuucaauuuuaaguaaucugauuguagccuaucaaaggcagcuugcuuuaaacaucaacaguugcaucccaggcaccuuccagauguuaaugaacuuucugagaaaaggcaaugaagacuagcuguacuuuaggaagaugugaguaaauacucaacacuuuaagaccagagucugcucuucuaugguucaugacuaugacauggaaaaacgacaacaggaauuuuaauucaauuuuauaugugauguauuugcagcuucucugccuaguccuuucuaccaguaaaccauauuuccaaagugaaagaguaagcauaagcauugcaguggugacuggggauucccuuaguuaguuguuacucuccuguuuaauaaaaaacaguuaagaaacuggacuuggaagcauggugaccauuuucuuagagcuugagagaaaaccaguagggcaggcaagcuggaaaucucaguaugugccaggaggagauaacuguggacuaggaaggcaaagacccaugccuucacccucaggguccaagaagauugcggugcagauauggaggucagcaggcagucuauggcagaaugcaauggggcaagugcaucccagagagaauaaaagcuauccaucaggucauguugcgcucaccuuguccagcaagaaaaacgcaacacgguuggauucuucucaacagccuucuuuauuucaggaacaccucuaugcuaugggaaccccggaaacccagggaggacugcuuauauacaccccagcacugggaagagcuauguguccucccgggauuggucagucugcuggcacuuuaauuucuaugcgcccgcucgggagggguuggcgccagauucgggccagcgccugcgcaguggcguuguuuacagugaugguguacuggaggccggcgccaucuuuuaggcgcccaggcugccuacaaggucauagaaagauaucuuauggagagagaggaaagaacaagagugguuuaaaaugugagagcagaguuauguggacauaucacaguguuauugugaaaaucagugacagggagugagugaaaacauuuccuuaucuguuccugcaagcauaaaacucucaauguagaucucagacuggacaugagguaauuggucaauccauagagacacccugauaaugcuauagcaaacuggcacaggcuucuuugaauaggaaaaauguguaucacaaacgcuuucgguguuuguuuguuuguuugauuuuuguggaaguugagaagugguuagaucuaguucugaacaucucugggcaccaugguuguuuccugugaaauaugaguaguccuauagcaugugcaugaccccagugagccuccucugccccuccugcccugcugcaaaacaauuguuuuuuccuuagcgauggagcaguggaucaauggccgcccgauaacaaucuauuuucacauccuccaagaaaugcagucauuacaaaaaagauuggauuuaaguaauaacuauuuacaaaacugucaacagacucaggaauccgaguucuaauggucugcauccauaauaaaaacagaaaaucagauucuccagccuccugagaaccccaguccauugcugagugaagcuagccuucagcucggauguucugacacagaguaucugcuggguuagguaaauacguugaagaauucaacaaaaaauuuaaaauaagaauaagguaaauacauguaggacagauuuucucuucaaagcugagaugacauugcauaugaaugaacuacaaucaauuuuaucaacagccaccaccacagcaaaacuaacaaacaacaaaaguguugauuugcuuacuuuuuuauuaaucauuuuauuccuuuacauuacaaaugacaucccccuuccugguuaccacucuacaaaaaccccauccccucugccuuccccucccccucccuuuugccucucugagguugcucuuccacccucucacccacuccuaccucucaccccucuagcaucccccuacacuggggcaucaaacuuccacagaaccaagggccaccccuccuauugaugccagauaaggccauccucugcuucauaugcagcuggagucauggguaucuccauguguacucuuugguugguaguuuggucucugggaucucugggugguccagucaguuaauauuguucuuccuauggcauugcaguccccuuuagcuccuucuagcucuuccauuggaguccacucuuaguccaaugguaggcugugaguaccugcauuuguauuggucagacucuggcagagccucucagggaacaaccauaccaggcagguucccgucaacaagccaacaagcacuucuuggaaucagcaauaguguuggugucugcagaugggauggaucccaagguggggcauucucuggauagccuuuccuucagucuuuguuccauuuuuugucucuguuuuuccauuggacaagaacauuucuggguuaaaaauuuugaggugaguggguggccccaucccucaaauggaagccuauuuacugggggugguuucuacagguucuauuucauuuugggugguauuuuggcuaaagucauccccauuaggccccggagccucguguaucccugacaucuaggaguuucuaguggcuaccccccaguucuccaucugccccaucccaaaaucuuuuuugauauucaauagugauuuuaauguaauauuuuaagaauucaacauacaauuuaagcuuaauguucauggauagaagcauggauggcauuauguaaugaauuuucaagaugaggacauacagauaucaauacauucugaauaaaguaucagaauauuaguggccccuccucugagaacccacaccuacagccagacccaaguagucaccuccugcccacagaagucucacaucggaggguguugacgucauuaagaauuaaacagcaugugauguguuucuuuuuaaugauauugguucuucucuauguuaugcucaugaaagcucugcauuccugcuugcagcaguguuuaauucauuucucuugcuccuuuguguagauauucauucuacucuuuguggcauuugaaugacuaucagucgugaacggcuguauauaccuuuucaaaguauucaugcaaaguauucaaaggcccucaucuuuagcaggcuccccaaugguuccuggaguacuaguagucacuuccagcaggcagugguucaccuugcuccacaccccuuccgcacuuuucaaaucccucaucuuuuuacauauuucuugggagagugaauuucaucagauucacauuuccuuuuuucucaugagcagugaaguggagacuaugguuguauguugguucggcaucuuaguaauuguguuuacagucucuucucauacacauauccccccacacccaagcacuccucacuuacuguaugcuuugaauguuguggguccuguuuaaauuguaugccuaguccacaugugugcagauaccuuccuguaucucuucuaagaacaucuuguuucauucuuagguuuaagauguaccucaaguugcugguguguagaggucaagauucaguuccauccccuauuuguguuugucagaccaccagcauuuguggaaaacaucuuauugucaccacuucuuacaaauaguugaccuuauacagcaaggcacugugugugguuauauuugcuucugaaauggcaguuuucccaccucugcuuguccaugucuugucaccacaguguugguuaaugugaaggauguaugauugcuccuguucuucuaaagauuuuuuauuuaaucuugguuauugguguuucgccgugagguuuagaaucuguuucuacugcagcaaugccucuuggggguuuugacugagguuauauuaaaucuauagaucaauuuaaggagaagugacaagcuucugauaccgagccuggcagccuccugaaggguuuaucucuguaggacuuuucuauuucugacugcacaugugcugaccgaguguaucuucugguagcuccccacccgcucaccccauauguuuuauaucuucagguuacagugcgucauucagaaguuuauaguuuuaugaucuagguccaguuucuaaugauauuucuaguauuaugaagaugcuaaacauuggacccuuaauagcaguaauuaaacaaaaucuagcuuauuuaauaaugugcuaugaacaccuuuacauguugcacauuguucugugcaauuccaguuucuguaaugcagucuuccauucagucauuaagaauuuauuugauuuugguuuaggcuauuacauguagcagugcuaugaagagacagguaagagcucuuuacagaaucagauagguucuggaccagugcuagacucuaguggugcaugggcuaugaaucuucuuaccaguuuggccucuagaaaugcuguguaaauucucuucuuuccacaaguguuuacaagcuccuguuuccagacaccaucauuagaguucauagucacaccuuuauuguguguuuuuuccccacaaguguugcaccuaaaacccauagccaucggugaacuacaaguaucaugaaaaugcuuuuucuuccuuugguuuuucuauacugaugucauaacuccuugauucauuccuuucccuuaaaauugcaagacuuccauaugaaccugaugcaugcuuucucuuucacauaggugacagccuagaugacgaagccaucucuugauugcugacccacugacccccuuuauguuauguuuucuggcaucugauugguguccuuuucuuauuuaucaaaggauauuuguuuuugucuagaaggauugagauauggcaccuacuaacagaaugauagcauaguguuauuuaccaugguguuuucucuggacauuauaugaaacaacuuuaccuuuuuguaaauccuuaagauuucugaauuguaggugagcagugguaagcugugaaggaaucacagcucuucucuuuacugcgguuuuaaagagucugagaucauacuauugaagcaaucgucuggauacccacuggucugucuaaccugccuuguauauugaacauuguguuuggucaaguaagaugacccugcagacaagcuuaauccccaugaacaacauuauggaaggagaaaaucaacuaugacaauuuguccucagaugccuccccacucuccagaugcacacacuugugugcauaugcacagaaauuaaauauauguuauaaaaaugaaauacuuucugaguguacuuugaugguuuucugccugcagcuaaugugauuuauagugacaggaggcaaaugaaagaaaguaaauuuucugggauugugagauaccaaagcucaaguuggccacuuugugcuucucucugucucugcuucucuucucccucuuugccuuugaucacugccaagacaaacaaguucacagauaccugugaaacauuucgccaucaacauauucuccucuggcaucaucuuaugacaauugauaaucaacuuuguaaaguagacccaaggugcaagaguucgaaaacucuguauuuuuuucuuucuuuuaaagagaucuuugcauuuuucuucuguucuuuccucaugaagcuagucugcccccaggccuaccacccccuacacugggaaucugcugaguccacaaaaguggagggacgauacaguaaugauccgguguaauaaaccagccaaauaaugcucugguuucucagccuucuuuuccagcuuuaauuaaggcucuaaugaauauguacuuggggcuuaggguuuaucacaaaugaacuaugaucaaaucucauuacacagcuaguguggaaaugugucuuuuuauguuggaaauuauugcucugcaguuguauggcagaggaaaauuuuagaaguagcugaaauauauauuuucgucuggaaagucagagauauucaaaguagguuauaaucugcaugaauguuaaauauuggauaugaugauuuuaggguaacaucaagaugcuuauuacaaccauuuuguuuugacuuuauacuuuacacacacaaaagagugaacuuuuccacuuggccaguuucuuuacaguuuaugcuuuuuaaauaaaauaauauugugcuuuucuagaaaaaaguugugucuaugucauucugaaauuaguaguucuuugaucaccauuuucccuucugcaaguuaggacuuuaguuuucugugucugcuaaguauuggaaacuuuaauuugggaaaggaauauuuuccucuuaggcaacgcuuucauggucaugcaaugcagcugaccuaacuacauaucuacacgugucuauuaaucaauaacugccuaagauugcuaaauacuuuccuugugcuuuuaugacauuaccuuuuguaaaccuuaaucagagugugacguguguuucuccuaaauggccucugauguggugccucucuucaguucucugugguuuccuguuuuuuucauacauagauuaaagacuuuugagguauuaaguaucuuaacuuucuucuuuaauggugcuucacaccuaagcuuucgugcaggccugucuugcuauuuuguuuucaggcuacuuccuacaccacucuguaaucacuuggguuuguguugggcaguccaucagcacaguuuucuauuuuccccauuuggaucaucgagggauaucucuguaugucccucaaagccagaggugguguuaggccuuuccauaguuaagugccucuagugucauugccaggugauagguauggcccaucaguggcucugagagaccagcagaaucaacacucauuuaaaaacucauuuaaauugcucauucucuggccccuccccaggcccacagauuaauuuagguuccaaauucucugugacaauaagcccuuuaaaugacauagucugugcuaacaauuuacuacuguagauaaugauaguaauucagaauauucaaguuauaacuguaugugaucuuuagugagaaaauggggauugagagaggccaaggaaauuuucgcucauuucugcucaguuucuccagagacaaugguaaagaaaaacucaagauugaaacauguacuaucuuucucacacaugcauauagcucuuguguccuguuuugaagacugaaauauaaauguuuaaaguaugaauaguuucuuccuuccaucuauucaugaguaggaacuuggcaugaugaaaggaggaaagguugcuaagaaacaaaugauggguguuacagauuuucauauugggaaggaggguggucaagggcugggaauggcugaguucuaaaagggagagacagauguucccccaaaucuguucacuaguccucaaaaauucugaagcaugucagugcauggcuuauugaaacuguugcaguaugauauauaauaagauauauugauugguaggaagagaauaaaccaaauccuauaagaugguuacacuuaugaaagacacuuucuaguugcauucauaagaaacauaaaagaacauguguuuucaccccuacaaaaagcaucugggaggugggaggcgguugauaauugaugauuagucuaucuucagcaugcaaauaaagaguucaggguggcuaacacuuggacccuagugcccucuguuugauaugcauuuagauauccaugaccuggauauccaugaacuaggauuccuagcaaacacagaauaaucaagugaccauauuccguggagccugaaucaugaaccauauuuucaacuauuccaaugcaagccugcuacugcugauguuauggcuuccaugugcugccgugaggcucugccgucgauggcccugauucccugacuccugcuuuucccuugcacagaacuauuguaccauggaaagucuucagacagugccugcaugagguccaucagaucagcucuggccuggaagcaauggcucugaagucaaccauugauuuaacuugcaaugauuacaucucaguguuugaauuugauauuuuuaccaggcuauuucagguaagauauacccuuauuuuaucuaucuagccucuccuucccucccuucuuccacagcuccguauguguuucuuuucucucuuauauacacaguauacacaaagguauggacaacaaccucagucuugguagccagucauuuuauuaauguaagcacuuggucguuccucuacgcuuggacugaguccucugguacaagcuuguauaucggguuaugugauccugguagguugcuaccauucaugaaucaugggaggaauucaugaaucaugggaggaauuguuuuuaauucccuguucuuucauguuguuagccuuuuagcccaauggcugcuagauugaaaacuuuauaggugggugucugccagagguauaucccaacaucucuuuggcugugacauucuuuggaucagaagauaaacaguaaacaggccacuguucuaucuacauaguauauuaugguccuauagcacuuugcaacuugcuuuucccuuucaaccaguuguaacuaauauuuuuccauaccauuagauauucuucaucaguauauuuuaaaauuccuuuaugauauuauaucacaacuuuauguuaauauuaauuuauaaaaucuauucaguuuguuuuuuuuuuuugcuuuuuccaauaaccuuuuuuuguguuuucaauauuaguuucacaugauguucuaaagcaagugacauaauacugaaauaguuuuuuuuucuuuucuuauuucacauauauaucaaaaccaaauucucuaaaugcaaagaauuaaagcuuguguuuucacaaacuucaaaacaaaguuguguguuuuguauauuaucuaugggguugaauucaagcacuuacaaaauaaaaucauccuuauaaagugauuacaauccuaguuaugauaauuauaguaaaugugguaaaauugacuagaaaccaagcuuauuuguaugcuaaaguauuguuuuaaacuucaaugugaucuauucugcuuguaauguaauuaaguaaacuguuagauuaugagaguggcuucagguuucccauacuauggauuuuuuacuuuaccucuggcugaaaaggcugauguacugauuucuguaaccagaaaccgcuacaugggcucaaguucaaguagcuuggugagaggagacagacucuggcggacaacacggggcacauuuuacuuuaucacgauugagaaaccaugacucuccauccacuggauguggaagacgaaauuaaauacugggcaguguauguguuuauuuuacguuucuaguggcuuaaugguuguucuccuugauguauauauguuguaagcccauuuuaaaauuauuuuuauaauacaacuguagcguguaauuucaaaagauagaaauaagccuuguagaaaaacauguugcucaguaguuaucauuuacaaccuaaagcuccugacuuaaagauuucugaucauuuugaagagcgaaggcuucacuuuuaauagagaagagggagagggagggagagaugacugcagauagaugauguuucaguguggaugucaagugcucuauugccuccuucacacauaacuguguauagacagcuucauuguaguuaaauguucaccuacacuacuugacuacuucaaggugcauacauuaccuuauauguaguuucacuuaaaaauggccaaguagccuuacgauucugagguuugcuuaucuuguguguguucgcuggggugugaacaggaaagugaaagcauagguaauguagcagcugugaugaccuucaccugggcagaugauuggcaagcguuuggaaacaguccauuguaucagcgacucaccaagucugacgaguccucggauuucagagggacuucucauucccucugaauguacucacuguuuaaauacgucaaccauaaucaucauacgcaaggcuuuaaauaagaaaguuguccugugggguuugggggucugaaauagaguagcauggcuguuuagaaagcagugaaguacccaagagaugaaguggggacgguacaggaaguauaggaccacgucaccuuugcuuccucccacccucuuccuaugucugcagggaacugaagcaggugcugugaaguugagaaggaaguggcagccuugggugguccuccuagcuccucuucucuccggaggcuuuucccuccucuuucuccucuucagcucaccaaagggaauugauagaaagauaauauaagucaugcagugaauccagggaucuuuucccccucucccuuccccaaagcugcaaguugguuucuuuucacauuugccuuauugcaggagaacccugggccauugggagauaguguguguggcagguguagaauaaggaagggauauuuuagagaaccuguuaguuaaagugugaguucaagaaguaguagaauagaaaaauaucugagaggaaggaagccaucagugauaccaagccuucaaggagugucugacuagauugguugagaccccucuucuagcauaacacagugcuucucuuaaaugcaccucaguacauucuguuauuuauuaacagccucccagaauuuugugaggaaaagggguuuccuuaaaucccagacaagugaguuauagaauaauuaaagcauuauuuuucucugaagcauuuauuucuucuauuuuaagcuggggggggggggaugaccuccgacugugugaauuuguugccuucacaacacuacugacaccuccuaucacauaaauauuucugcaauaagaagcugcccucuggcuuaauaucucuggggauggccuagccuucaguuucaucuuguuuuuuguuuuuaguuguauuuugaucugcuaauugguucucuuuaaacuuucggauuagaaacaauacauaauuucaagaauggaugccgacauuaauguaagcagcucugguguuuguuuguuauucccucuagauuuguccuccauagaugguggagcaaaacaauaaaaugaaaacugaagugucuggcuuggcagucauuccucaguugccuuuuugacaugugcugauauuuucccaaguauuguuuuaugcaauuucagucaagcccuaagaagaaaauuaaaaacaugauguaguuuucaagugcagggccagugucucugcugcuaguguucuuggggcuccuuucuaacccaauuaguugugucaguguaacgaggaauuucccuaaagaguauucuuguuaagucaaaaagacuaaauggcucuuuauuacuaaauuauucuuucuuguuauucuuauuguaagagacaagguccuugcagaguucugccuuauaugccaggaacaugaaaaaguuucaaaacaaaugaaagcccgagcgaacuugccucacguaaucaagaccgggugccuguuucagcagcuugaaguuggggacaugagacaccuccucucuuuuuuuuuucuuacauagaagauuugagugacgcgucuggcagaacagauggagcaagcugccagugcucugggauaaauguagcuucagccuuggaaguauugcaguaugauucauccacaccccgcagcaaaguugccuguuacuggcugccucucgucucuugccgugguaccuggagagacaccuaauuagauuaagagagauugauggcaaacacauguuuucgugaaaagcuuuccucucacugagcuuccuuucaaacauuucccagguccauuaacugggcuagcauaaagcaaguguggggucuggagccuguuaccucagaaggagccuccccucuaaagcaagccugccgaggugcaaccauagcaaccugaugaccguguaugugaugcugccuggaugacugggauccaggccugagcagcgcaggaaugcuccuuggccuuacauggcuuguggugauuguguaacguuuuccagaacacuuaacuuuuguaacguggcuuccuguuauaugguuuccuguuauaugaggcagcaguggacagaacagaugggaaagaugaggacuauagagagauaauuuuagguaggagggucuaagagggccucauugaggaagaguugguagucaucugauugguugggauuugaaaaauucaaagauccuaagguaggggaggguuuuguauuugagacugguagaaaggccauuggggcuacaccaagaaaagccaaguaacagugcugccaacauguagaaaaacagccaaggauccaaccugaaggccaguuggucaaucuuucauuucguagugaucacaaauucucuauuggcugucuacuugguuuuccuuuugcccucucuguuguacuccaaagaaauauguuuucuauuuaaacauguuucuuuaaaaccaaaaagcaauugccuauuugucauuguuuacaaagguugaucuaauacuuauauuuacuuaaaaauuaucaaagagccuuucuuucccuaagcaugagaaacagugucaucggcguguguucucuggguaauugcuuuccauuuauuuauguguuuagcccuggggcucuauuuuacggaauuggaacuucuuggcugugacucacccgggauacauggcauuucucacguaugaugaaguuaaagcucggcuacagaaauacagcaccaagccuggaagguaagcacuaaucuggacgaucugcuuaaggagaaaacgcccugcuguucccagcucugagaauuacccauagccuccaaaggcaagguaguagggaaagcaggaagacugacugagagggugcauauuaauugagcccuuaaguugacuuuuaacauugucaaaagucaggagcuuaauaaguuuaaagauucuguaauccucaguucucuuucucaaaucugucugggauguuuucacaguaguuuuguuggguacacaguguuccugcucaaacuuacguauguauaauugaacccuugaguauuguacuuaagacaaaaguaaguaguuuacuuaugugugcauuauuuuagcacaguguugaguaguuucagguagcagcucugauuaaacagaauauucagauaaguacauaaaaguauaugaauuuaugauuacauuccaaacuacucccaugcccuugucaguuuggcaugacccacuucuuuacaucuucaaaguguuauguuuugcuuuucaaguuacuaacccaagugacuaucagagggcuugguuucuagucaguucugcuggcaucguccaagaaaucauuccucacgggcaaauaagagacuggaaaaaucuaucuuucucagcucagaggauguucacacaugugucaccuaaauauguguuaggcacacaaucaaugacaucuaagaaauagucaauaauaccuaagcauaguccuggggacaauaucagugacaucagagauacucccuggaagacuuuacguuuuagaguuggucacuguaccauuagacuguuccauuucuaugagaaaauguuuucuuuuuuuaagucuauauuucugcuagucaucuuuauuugacuuagaauaauuaagcuuggccuuugacacaguuuucucaagucaaagccaagaguuuuaauuccuucucugauaaugaaaaugcucauguuccuaaagauuuaauaugacauauuuaaagaagcuagugguaugaaaaaaagucagaguccaauugacgcccucucuguaaaaccuacagacaugacucugcugacccagagcaguggucaguuaacuuucguauuuuccaaaguuuagaugaaucauuuugcuucauucaaaguucauucaaugaaaccaauacuagaaagcaaauuauaguacgugcagugugcuuuuacuauuuaaaauacauagaaaaccuccuuaugaacagauauucacucgcuuuguaaaauauccaucuaagcagcccuuucucgucaaaaguauuuguccucuggccucacauuuaaaaauaaaacauuuaauuccauuccaaggacacugugguuccuucaguagugauuuaucugucauaaauaaauaaauaaauaaaaugaaauauguaauaugauauauaucauacuauauauuauauauaaauaaauauaagacuaauaaaucauuagcuuuuugcccuaaaagaauguuuacugagcaugcagaagggccugcauuugauauucagcacccuuccaaagaagugggaaucuaagaaaaucaucuuuucgugccuuuuaguauuaaggguggcuuucaaccaugagcuacguuaugacacagaucuaucagauuauguuaaucacaccaguuugcagaacaagguacaacagcugaaaguaacuuuacuucuuccuaagggaggugagacccgcaggggucagcagccaaugacuuaaacaguguugggcaaauggaaucgagcagaaugcugagagaaauaaaucgcucuuaagugucaucuguggcccucacaauguguuacuaauggcacacuuuguagggagggcuugaacuccucaguaaugacugguuuuagaaaugccaucaugaaacaaugcaggaauuucacaaauauucaagaugcauaaauaggcaaucacuuuaaaaaauaaauaaauaaauaaaauguguaauaugauacauaucauacuauauguaauauauaaauauuaaguggugaauuuuugaauuuucuuuuagcaucacauucaacguguuuucuaaaauacauaggccccaccaucucugagauuucuacauuuuguucuuuauuugaaaguauuaugugcacuuuuuaguaaguuuuucuaauugggaagaaugauuuacugaguguuagguaugaacacagugugaugcaggucucccuagaggucagagaggggaucacauauccuggaacuggaguugcacgggauguaaaacaccuuggugugguugcugagagccaagccuagguccucuucaagaacagcaaguguccuuaacugcugggccauuucuccaguucauuccuuaauguaacaagugaucuuccaaauuauaauuagacacucuauauuaucugagaacaauuuucauuauguagcauuugucugauuugaguggaaauauuuuccuguuucugauuaauaguauuaguaauuuauauguaaauacuuuaucauuagggucacuuaggggcaucaguuuauacuaauuugaaaauccccuucugagaacucuuugaacaaacucccuuuuuguucaaagccugauuuucuuguuaacugacauguaauuguacccuucaccauaugagguuauuaaauguagcaacaaaccauccuguaugauaaacuauagcagcaugugaaguuuuuuuuagugcacucuauuuaucaauaacuaaaacaugagaaacuuuucuugcuuuucccccugauguaugcauucauauaacaacuuaaauauagccaguaggucuuaagaugacuuuuggucugauugacggacagauuguauaguccagaucccaauaucuugauggcaagauugaguggcauucaauccuacaaagugggauaauguacugaaauaaauaaaugaugauggauuuaaaucaacgccaguaucucccuuuauuggaaauuaauuuaagagauuuaucacucauuugaaugaccgguguuugaauuauguucgcugccuuuggaaaauauuugaauggcagguuguguagaagcuaugaauguaucacaugugcuuuguaauugauauaguucagcuccuuugaaauuuguuuaaagaugaaucacugaaaggcuugcaagaaaacauuaaacaagucuaugaccaaauuuuaaugccuaaaugguaaaguaauauauugaauuccuguuucaguuuccaugguggauaaauuaauuauuuagcuauuugcuucauuuuauccuucuccaaagaugauuuaugucacagcucuaucacagcagccacauccccacacaucucuuugagggcgguaauaaaucucuugguaguuuccagccucauuuauuuuaaauagaacucuggagauacuuaaaugaacaagaauuauuaucaguguuucuuacacagauugauaacacuaagguacaguaguguuagauuguggaaaaggauugaaauuucuaucaggaauucuaaaugaugcugcucaagaagacaaaauauuaacaaacuguuuacugguuggcaugccuccuugaguuugaacgaacaucuuuuuaccauguuucguaguuacauuuuccgguuaagcugcacucggcugggacaaugggccauuggcuaugugacuggggacggcaauauccuacagaccauaccucauaacaagccccuguuccaagcccugauugaugguagcagggaaggcuuguaaguaugagcaauucuuucaacuugcaaauuucauaacuagaaacugucugggcauagagcauaccaugggcauagagcaggcgaguaaggcuaaugaucucauaguuugcgguuuaccuuaagacgaaccaauagcaauaguggugccuucaguguguugcucaugccuaagcugcaauuuuaugaccauaauuacauagagcagacacaucccagcaucagaaagcauuacuaaaacauaaaggcacucuuaaaauauguguauaaacuauuacuacuucagaguacuucauuucuguuauuuuguguaaagcuaaauugaggcugccuuuuguguggaguacuagauuuuuuuccuuccuaagucaaagaaacucuuugcucuguuuguuacugugugagaauauucuguccuauaacuccaauuuucuccuugucuagcagaauuuucuaauauugauuacuaugcuguuuguagacacuucauuuaaagaagguuuuucuuuugucaucaacauuuugcagacuuuuucguuaaaauagucauuacugugcacuuuuaaacuuuuauuaagcucuacaauauaaaaaauuuucaaaaggaguaacugugaguucuagucacuuuuauugaacuaguuauaccagcaauaacauuauggucauguuuuacuaaaaaugacauuuaaugacaauaaccuugacuuucaguauacuuaugaacgaaaaucccuuauuguagcuuuagcucaaguuagauucuuaguagaaaaccuugauccgcaaaccugucuguguggcuuuauugaagucagugaauuguggaauugucauacuuuccaguuuuucugacaugcaugugcacauauuacaaggugcauauuugggcauugugcauaugugugccuaucggcaggaguggacagaguaggagagaaagacagggauguugggaaaggacaccaugggagagcuucauuauucaggccauagcuauggccuaaucuguuuucucuccuuggaauuuucaacauguaauaaguaugaugcaguuugaugcuuccaagaaaguauauaacaaucugcaaguagagcuugauuuaaacaguuuuaggauaggcuauaacucacuacuaaauuaacuuucuaacuuuaugaggacuauauuacuaauugauuuuaauugaaaauauuauauaguggauuaguuuauauuauacuuuuccuaugauugaaaaaagaagugcaagaguaugguguugauuuaugggaaaaggacaaaugaaaaugugaguuuaaauauagaguacucugauuaaacugaacacacugaagccucauacauuaaaauaauauggucucuguuuaaauucaguuaucuuuauccugaugggcggagcuauaacccugauuuaaccggauuaugugaaccuacaccucacgaucauauaaaaguuacacagguaaggagaauuuuuggaaagauaauaauacauaucuauaccaccccagaaauaaauguaaacuucuaccuacauuguguucaaaagcaugccccaguguuuaacaugauaacaucaggaauucugagaauacgaauaaauuuuaugauuucuuuuagauacauuuuuuuguuguuagugauaaugcuuguaaucuaauauauauauauauauauauauauauauauauacacacauauauacacguacagagagagagagaaacacauuuuaaguauguucauacauugauaaacaguaaaggucaaaggugguagaaaauuuuuuauugguuuuaguguccacagucuugauaugcugcaguaugagaggguaccaguauucauggaaggcuuuucauagaugacugccauuccuaucaauguauagcaguuuuauaauguauauucuaauauguauaaagggauacuaaugagagaucacuccucuuucugaauccacuuuguaaauugaaacuggcugggcaugacuucagaagacaaacaccuuccuggcaugccugagcucuuuaguuugaacuccaguguuacaaaauaaaauaaaucaguuaaaguguacauaaaucuuccagaauauugcgcucccuagaguuucacauaaaauagccuuacuccugagaaugcaguaaauucccugcucgugacuugagcaugcucuaauugcagaccgacucgggcagaucucauugcuagagcaggaugcucaggcguucauucauaaguuggcauggguuauuugguaauaauucuuuuccacuuucuuucauuuccuuguccuuauuuaguuuacuaaauaucuggcaaauaucauaguggacgagauuuuuauguauccaugcaugcauucauguauguguguauauguaugcacaacuagaacauuacaaaguuuuaguaaucacacgauaagaaugccauuuauguauucuauuucaguaucuguucacugagguucagugugccaaacauucuacacucgacucagccaguguuuaguuacucagaugcuuacuguucacauccuucagaguuagaaacuuacucucgaauuugagagcaguaccugaaaccucauggugagcgaacgcugcgcucgcacucguggacuacaguaagucaggcagcaagcacgcaugaggaacgaacguugcuuauccuucguccucagauuccuaaagaugccuaagaaauaaaauguaacauccagaugacacuuacucaguuugucaguguagacaaaaaagaaaagaaaacaagaaaaaaagaaaagaccgagucauuuauauugucaucuuaaaacuguacguacugccuguugcugguaaagcaaguucuuucuuaaagcaauagcauaaaauaaauuaaauaaccgagagcgcuaagaaagaaaagcuuacauauaaacugaugccaggaguucggacguuguaaaaauugauuuuuuuagaccaaauugugaauaucaauuuaaaauguguccuuaaaugguagcagaauucugacaaguucaagugugggauauuuaccauaagucauuguauuuuagggaauuccauaugacgacuucaugcuaguaaaccauuaaccgccggcccuucuucccuguguuccaggagcaguaugaacuguauugugaaaugggcuccacuuuucagcucugcaagaucugugcagagaaugacaaagaugucaagauugagccuugcgggcaucugaugugcacuucgugccuuaccgcguggcagguacugccuuguugucugucccguucacacuuccccucucagccuuccacaucuuacugacucaggaaguaauacucagaacuguuuuaucuaaaauaguaacuuacauuaaaaaaaaaacuuacuauguugaaugcguaaaauugauagcuuugcugcguuuuauauuguguuucuuacaugcguguaacuuaaguuccuguugauuauaagugguucugcauccgucuugccguuagugucaugaugacgccaagagagaguauuuaccaggugagcgcuuccagucagcucacgucgugcuccugggaagauucugaaguucgguggaccacagcagauacagcuuacgcugcugccguccaucacauuucucuucuccugagccaugggucaugucucacacguguuuaugguugcuuucaugaaaccaaaacaggggaaucagagaaacaugacuuugaagcaguuuguacccaaacaggcaauuuccaguuuugaaaaacguaaucaaagacuaucuuccuuccugcccguggguagucagucacuaaauacaaaaugagucagugguuuagaauaaggccguggaaaagcuguuuucccaccgaugacuuuuuguugugguuuaacuguugcaacaguuggggauuuaaaaugguuauuuuugacacaauuccaguuuuagcuaacuauuuugaucacgccaucuugcaauuugcucuuuaacggagcccuguuaaaacuaggaguauguugcuguaauuuggcaaucaaaacacuuaauuuuuaaaccucagcccucucauucuuuggccaucauuuucuaacccugaauuccgauguaaggggaaauagagcaguaggggagcgaggaguaugaaaagagcugugucaaaggucaugguaccugugcaacuuguggauuggugaaaagauguaauaacuaucacaauuucaaucccuaugugaagagagcuuaaaaggugguguugaggagacagugaagucuagcugaugggauacuucuagcugauucacacacuucucugugcacucacaggcaucguuaucaccccagucaaccugcucagcaucuccauggcuguccucuccgacaugcuuuuaguauauauguuuccuuaaguuuuuuuuuuuuuuuuuuuuuuuuuuuuuuuuuuuuuuuugcaaucuauucauuuugaagaugaaucugcaccuuagagguaggaagaaagggacucggugugacaucaggaagaguuguucucagccaauggguacccaccuugcuaggucuguuaacagccaucauucuguaaacuuagcaagggguuucuugaaacugacuugcgauaaauuuugauuugcugccaaaagucagauucuucugcaccuuaggacauuucagaugaaacuguacaaagugcgguugaccuuucaccuccucugacugccuguguagggguauuuaggucugcuucaccugacacgcaugcaggaugccaggaugagugcugaacugagaagaagucaaguuguaucgcuuuggucuaguaaugccguucuuaggcauuccugagaggggaagaaagcuucuuuuuuugcuuuuguuuauuuguuuguuuguuuuuauuguuuuuuuuaaaggaaugcauaaauuuaggauagugcacacccgggggccucaaaucugcaauacggccauguuaugcauucugggaauugacauguuugaucuagugcugugcuuacuauugggaagguagaugguuuaacauggugcuauuugcuugacugggaugaaagcuauuguuuaauacacucugcauauguagcuuaccuuguagccuaaggugggucuuuuaacuguaugcuugaguguaaaacaagaaaaagugugguaauucuguauacucuuugaaggacugcuuaucaucuuuuuucagcuuucuguaaagcuuuguuucagucugcugcauaaaagggcauggcauucauuccagcuucuuccuccuguguuguugaugcucugccccuuacguuaccacagcuuugccuauaguuccucuuucuagcugauaaucaguucccggaugccuugcauacauuuucauaguaauguuagagaccuuacauguagauauguccaguaguguucauaaauuauuagcccuuacuguuuccccuuuuaauacuuaacucccucucaguuucacuguuugaaauuggggaagugcgugcacgaucaagcacuggaaacaggaggaaaucaguagacguuauuugaaaaagugcuaguaaauuaauaacuuauuaaguaaaauuuuaaaaaguaacuauuucaaauguguucaugaaauugaaauaugucucccguuaaauuacacuuacaccacuagugaguacuguuaucuuaaacagauggucagcuuuugcauauagacaaagaaaaaauggcaaaauuuugauaucuccucacaaaaauaguauuuuaauaaauguucugguucagucuguacaauuccauaagcuucuuccugguuacauuguaaacaugucuauguauacccauuugcagucuagaguauggauuucugauacagggaucgcuuugcauauucauguccgugcauguaggcgguuacccaaugcugauuuucaggucagaugcuaugaaggaaaguggaggggguggggggggggcaugagauucuucuaacuggacagugcuguaaucaucgauggaaaaccucauggagugcuuguuuuagacuguuaguucuucaugagaaggcauuaccuuucagagaccuuggcguccucucucccugacaaugugccugaaaacuuguagccacagguacauguguucugugcuguagacauuguacccuguuauuuaccucugcugcucgcuuaaccucuggcacagauggccacaagaccuggcuucuacuuacuguguucucucaaggaauauuugcagugacgucugaugcacauuuuccucauuuuuaaguaacuugucauuuggacauggcuugaaauuccuaaaguggcagucuggaaucacugcaucucagugggguaucacuagugaaaacucgauaaucaguaaaggugucuacuacgggguaaggggcauuccuacauccacauacagguaucacucaauaugcccugcugacuagguuaucaguguucaaagccuuccaguuagugcaugagcagcaauauugugugaucuuuuagacauguuauuaaaaaaguuuccuuuauuaagagcaaguguuacaaauuuaauucaauuaaaacauagugaaaaaacguucaguaacaagccccuguugggagugucaguuugaggcucacuggauuuaacugauggugugugccugagcagagcacaucuauagaacauuucuuuccuucuguaauauauugucaaaccuugaaucuaaacuuacagauuuacuggaagauuucugaguuucggagcucugggcugaaagaaaggcagguuguaacagaugucucuguguuuuuacuuugcccguguuccaaaaugauacaguacagggucuuuuuuuuuuuuuuuccuuuuuucuuuaaagcuguuaguuuuacuucacgggauuuuccacuguuacagccuuauaaaaaguuaagcuuuuaaggucaaucaugcacagcacaaaucuaucguugaacaacacccuuugauaggaacaaaccugggcacgucaacauuugcuucccgagaagucaagccuguugcuuugacuuuuauuuuaaggaggaucucuugagcagcucgugucucuauagcaaucucugagcagaaaggaaguucagacguaguuucuacuuuaaacucacugcuagaaguuuuauagaugggauuacuaccaguaauuaccugaaacgaguaucugcuucuccugcagcuuuaauuagggacaugaaaccguuuccucuaccuuuacaguucuuugguuaggugugcugauaugaaaaugcuuuuagggaaaugcaugccucccaaggaguuaggauguaucugucagcauccaacagggaacacugaaccuggacuacaaauuauaauguguucaagaaagugcauuuuuagcaaguuguucuucacuaaaauugucuuucauuugaugcccuguuuuaguuuaacuccaauucauuggggacuuaaauuugauguaauuaacagcaaaccuaacaaaggcacaguagugguugcuguuacagucugucagugggugcuccuuaauugcugucauaauggccuauuagucaugccuccaaagaggugucagauuuuuuuuuucauuuucugaaacaucuguguuauuuaauaaauugaauaaccacggaagaguuugcccagaauaccaaguaaguuaaauaauaugcuuuguggagcauuugaagcugaguuucucugggugcggcuucucuguuucacucuugaucaguaaagcucgcgggcaccccucucacuuucaccugucacuaagaggcagagaaaacaucuccaugcagagucccgagagcaucuucuuccuguguacacagucuguaaagcacugcaguaacccagcagcggcacugcacacaggguaagguaaggagcugcgucucucuugacaaaacagaggcaaacaagcaguucugcuaaaccacgucugcgcuuccagaugacgcaggcagcaaacuuugaaugucucacauaaaaaaggccaucacugucaaugccacgcagcuauacuuugaauucugccaacaacccuaguuuuaugaaauggaaacuuaacuucuguggcuuuuccccuagacuuuucuucagacacguuugcaggaaagacuuuucuguguccaaaguguuguaagaaaacagugagugcauucaaauaugaguguggcguuaaugccguacgaucaaauagagcacuguggagaggcaaaaaucuagcucacugcguaugucucagugagaaacagauaugauucuggcuuauuuuaaaagcaacauucgcaugucuaaccuucuagaaacuuuuuaacgaaaacuaaaacaauauuugcuuuuaagaccguuucaaacguacauuucucucuuugccuucuacugucucuuuucuggguuagugugauagaacagacuggagcgucucuuucucagagggggacugaaggaguugggagucuuggugagcuagugcaauggagcaggcgugaggaguacccaggccugagaggagggcggguugacggugagguguaaaucagagaagccuuugaagaggcuggccucucccuacaccuugcugaggcaccgacccucuuauuugugcccagucuagcaggccucagauuccuggccagucuccugucuccaccucccauuuuguccacaggaguggugggauugcagacaggugccacuuaucugcauccaacugucuguuccagucugcgggcuugaaggaaagggccuguaccuguggaaccaccucacccacugcagcaaaaauaaacucccggagaacaagucuaaguuagccuaagucugcuaacuaacucaguagacggauucucacagcaccacaguguauuugagaacugaaauggacaauuugggaacaguauuaguugacaccaacacucuacugugggcuguucuuuuugaagacuuauuuuuauuugauguguaugaauguugugccuguguguugucugugugucacagcuguaucuguggaaaccagagaauggcauugggucccauagaacuagaguuacagguaaugugaaccaccaugugggugcuaagaacugaacccugguuuucugcaagagcaauaaauguucuuaaccucagagccaucacugcugccuaagccaucuaagcgaguugcuguuagucacagcgcuucacuaauaauucagaaagcaaauaaauuacauguguaacgcuuaucuuaagacguuuaagagacaaugugucauggugugugugucugugugugugucugugugugugcgagagagagagagagagagagagagagcaagcaagcaagcaagcaauguggugauucugguaauaguuucaacuugcaguguucauuugcgugcuuaaagacuguuuauaguaaagcagauuuguuuucuucauuauuuuuucuguauuuucuaucauuggauuguuguggccuaaaguuauguuuauguauauuaauuuaagguguuaauggaugguauauaaaucuaaauuacuauaugauggauauauuauguagguaauauuuagguaacuaguuuucacugguaacuucucucaccuuaaauuuugaaguauuucuacauuggggaagugaaagccacugagucaauuagaauagaaggaaucuuaaauacuuccuccuaacauucacaaguugugaacaucuucaggacuaaguacaaaauuauuuauuguucuuucuucuccgguaacauauguucuucgaucuugacuuaaguauauguugacaggaacauuauuuuaauuaucgacgccccauccugaugaguuaugugucuauucuagacauucuucaucuguauucaaucaaccauaugacagaaacuagggcagaggaaccaaagucucauuugaaaauuuauggcuaugccucauuugcauacgacaguaguuaaaugaaagccaaagagugaugggugaagucauaccagaggauacacugcagucagugugagccacuugucaaucaaauggguagucaguguagcuguugacauuuaacauccacgagauguacauauguuagaucuaagaaaagggaucacaacaacagccauguaaacagguuggagaaagaccuuaaguccugguuuauaacagccaugcccgggcuuucuuguguuaucugggugcuguugccuaucaccuucuuccuccucucuccacggaaaagucauucaaucuuaggaggaaagugguagcguaaauucaaacaauccuugaccaaugcugcaggaugauaguucuggaagugagagcaugauaaagaguauuacagcuucuagucgcuguacuaacaaauguacagcuuuaugauugaauuugaauaaaguauuucuaguugcaguaguugcacuuagauuguuaagugacuuguggcuagguauccauacuaaaauauguguauaugaauuuauacaguguacuucaaaauaauagacaggugaaagacaugaaggcauagaggaaacagacuaggcaugaacugaucauuauucaaggugggcauugaauacauguauucauuaugcucuauaucuuaagauaagcguuacacauguaauuuauuugcuuucugaauuauuagugaagcgcugugacuaacagcaacucgcuuagauggcuuaggcagcagugauggcucugagguuaauuugauacaacaguguuuaaaguguauuaggaaugagauguccacauagggcccagaauucuacuuuccauucauuugucacacauucuuguuacagagaacgugaguuccuuuucagcuuacacaugaagagcucccuuuuuugaaugacucgauauaauguagaucuauacagaaacaccaguacauacacacaguacgaacuuuaaucauuacaguagcgagauuucauccagaugauaaugcguauuaaauugguccuguaacuuuaagguucuuuuuguaaaauugaacuaggaagguuuagaguucuuuaaaguuucuuaguguuaaaaggucaaauuaaggagauuacccaaaauggaagaauucaaucuuguuucuuuuaaucuuaugugaaauuaugaaucacaauauuuuuauggccaucagcucugaacaugauugcuauguuuucucucucucuaucucucucgcucacucucucccucccucugcucccucccucucuuucuucaaaaucauauguauacauauguauacacauguacauauuuauccauguauuauauauaauuguacaauuuugagucuuaaaaauauguaaagacauauaaauaauguuguuucuuuuaccaaagcuauucaaugauaauuuuucuuuuugguaauauacauuguaaagaagguauuuagucuguugauccgagagaaguuaaaggaaacaauagaccaauaguaucugcuucauaguagacaucugggaucuguccagagguguccagagaacuuuuuacaagccucugaagccacacuguuaaaggcaggugauucagcuuccacaggccaaguggcuauaguacagucguccugaguuaaguacaggauagcuuuuuaaaaucaugauacuuuguccagcuuuuuuuuuuaaaaaaauuuaaauuuuuaacuuuuuacaauguaauacuaaucuuaguguacaauaucaaaaugccagaguagugacugucuuuuaacuccucugucuagaaggcagggugagagggcaucucauuuugucugcucccuacugggaauuuucaaugcuguuagagcuuagagauaugaauuuggaaggcugaaccaaaccuaaugaucaccaauaaaugcguuucucaacccaaaguauuuuaccaaaucuuuuguagccgcugcuuugaacucuagauugggagguaguucaugucuuccagugguagauuccacaugagcaagucaagacugcaggcucggcaguagucagcuucccacuguugagucagaacugagcuaagucaacugaacgaaugaaaucuugguucaugacuccugagguuucaggcuaugcuuggugggguuccuugcuuugggcuggugauaaagcacaugauggagccaagauguucaccucgugucaccuagaaauuggcgagaaagauuggaaagagggcagugugcugauaacaccuucacugccacacaccaguauagcucacugcauuccaguaagcuuugugucaugaaggugauaaaguagagugauaacugagccuuuuagaggauguauaagauguagaccauaaugcuuuuagccuagaugguuacuucucaauaguuuuauuuuccauacucauuccuuuauuaaccaagauuugacaaauccuagaggauguaagcagaaauauuuacccacaguugguaagcacaagaacuuuuccaaaguagacuucaaauagguugcuuagauuacuauuaauuauugcucuagucauuuuuaauuuugccaggauguucuuuuuauggacuauuuaauuagcauuguuguuuugaagagggacauaauucauuuuucaguauuugaggacuguaaauccuugcucauuagaacuacaaauggauccgugugaaaauuaaguuaagcuucuuuaccuguccaagcuuuauuuuuuugcauuugcucauaaaauauuuuguugauuuaccaccuuugugcucaacugcuucuucaagauauacccaucauugauccacagacuugugaagcauuuuauaaacguccaaccuucagacuucucuagauugguuugagccagucaguuuguugucuuuguugcaggagucugauggccaaggcugccccuucugucgcugugagauaaaaggaacggagcccaucauuguggaccccuucgaccccagagaugaaggcuccaggugcugcagcaucauugacccuuucagcauccccaugcuugacuuggacgaugacgaugaucgagaggagucuuugaugaugaacaggcuggcgaguguucgaaagguaaacgugagugcacgagugcagcuugugugcuacaauuaauacuauuuaauuaguaguaccaaucaauuagucucuauguguguccuuggcugagaaagcauuguugauuuaaaacuaagguucaaauauaagcaguauucccuuuuucaaaaaaaguauagcccucauuccccaucauggaaauuucucuuugcagcugauaaagacaacugcccccccccgcccccgccccaaaaucccacaaugaaguguuagaguugugcagcccagucccagucaaugcacccacagaacaccccugcagcuaaagcuuggggaacacugcaaaguggggaaaagaugggaggaaccagaggacuguggauuuucuuucaaucuaacaaucucagaaggagggagucucgccaacgugacuggguaacaugagcagaacaaggacaacaauaaauaaaaguggaugggggaagaccaugaggccucaaccauacacacauaaccacagacagcuaaggaauacagaguggagaaauagucuuucccagagaaaaguccaccaauaguuuauccaaugaucaacagucagcccugaaaacauacauacaaguaauauuauacagacugaguggguuauauuuaaaaguaagugugugugugugugugugugugugugugugugugugugugugugucucaaugauuaguaaggaaagaggccagacauuugaaagagagcaaggagagguauuuuggggagguuuggagggaggaaauggagguuugugugauuauauauucucaaaaauaaaaauaauaauuugaaacacuacauucaguauuaaucaguucagaaaaauauuagaugaaggggaauaauuuguuuaaaccuagugggagucagaugagaacauuuguauaaaauuaaaaauccaagaaugagauuaacaaauguggagaaaaauagaagauaggaaguuauuuuauuugaaauaguaagauuguacuugauuaccauuuuuguugaauauaaaaguguccagaaacgacauccugcugcucuaucuauaagaagucgcauaaaaucaucucagugaaugcacuauaacuuaagauuugcugguuaaguuagagcacugaccuuaugaacugaaaguaacugcuccagcccaucagugauuacuucacaaaagaaucagcguggcaguugaauaauuuagaaaucagaaaugguggguagauggcuagaucucagacugcccuuuguauagaaauacauaugaaauccaaauuacauggagaaguugaaugcuguggaccucagaaguggcauugguugcuaugagagcaucuguaauuacgggaaccaucucccuccuggcuccugcagacaugacuacucagccacaucccucugagguucacauuggccuaugagcuuuccaacaaagccuuaaggagagcccuuugccacugagguggaguggugaugauggcagccacuuuaggaacuucaaccuaugccccuauuacuauacaguugggaaagaguaggugcagaguccagaggaggccauuucuacagcuaauucaaggcugauucaaauauugcugaagaaaacucuuggaauuucuguccgggaguuccacacugaccucagacauuccauuauccuauuuacuugaaaaaucuuacaugugcagguagguugacaucaccagugucacuaugcuccaauucagcuuugagcugaaaggauguugguucuucacccuguuagauguacauaaguuccauaagguaacucauaggcugguguuuuucuccccuuuuggggauaacaucuguugaguuuuguuuugcuuuguuuaauuauauggccucuuugacccaagagaaaguuguuacuccucaguaacucuaaauaaugaauacagaagaaagaagucucaaagagaauuacaauuugagcguccagacaacuaacauucagccuuccagauaaagggagcagugaaccagcucuguaacaggauagaacuagcucuguaacaggauagaaccagcucuguaacaggauagaacuagaacccucugaagcaaacuacuuagcacccuucccauaaucugcauccucuugcaaagcacgacagcaacagccauuuccuauaauaacuguugaaaugauccaaugaggucacauauuuaagaggcuaacacauuguaacgucaguuggaccacaaauaguggcuauuuuauugccuguauuaauugaaauuaagaaagccgcagauugugacccacuucccagucugaguuaguacagaucauugcauccuguccauauaaaaggagcuacacuggcacaucagggaugaugcuuccccauccaagaagacaucagggacccagcucacuguucugccagucuggccaugccucauguccugcgugagagucauucaaaaucaagaaaggaugcagacugacagugagaauaaaggagcggaugcuguaacauugccuuuauugauugaugggacuuucucccuugaaguaacaauuugcauaucaagugaaauguguugaggugauaaugaagcaauaacauagucacuuugauuccuaucucuugaucugcucagccuaaaauauuccuuaccugacccuuucagaaagcuuguugccccagguauagcuuucagggugcacuuaguuuauugagugccagccuggguaaccuccgauggcaggaaagcauuugagaaacccacaacagcucagacaguucagacaauuucuggggcaccgguuucuagcuaggaagaaggcauuucuguuuuucugacuaaaguucagaguucuacaagaagauugggguguggcugcaagaaaaauucucucgagaacuuuguguaccuugcuacuuagagaaggagaaaacaccugucuuaugucaguuugaauuaaauugaagcuuaggccucaucucauaggacucuaguacuacaaacugagaauggaguacaaggugagggacagggcugccuucuguccucuccagccucuccugauugguucuuccugggacccugcgaggugucuauuuggaaaaugagagacuuucaguaauccucucucuguguuguuuaacccaagagaaggaugcucuccugcauucuuggcucacaucucucaaugauucugugaccuucaguguuccacuccccuacagcagucagauauuuuagaaaugcaauuaaauugccguucuuuaguuuuaauuugaugucaugauuuaauuaaguggcucuuaugucuacuaaucugucuagucaguuaagcagaucaugacuuuuguauuauuucaccaaccuuugccacuuagcuuucauccuuaguuuugguaugggugcaagcauaaauucuuucugaguaguuggaaaaauauugcugcaaaaucauguuucuaugcuguguuuauguguuuuaguacagcugcuguguagacuuauuacagaagacuauaagugcuaaaaccaggccacgucuaauguuuuugucaccaagacacacucaguaauuaucuaaaauaaaccaaucaaugcaugugcaucuucugucugagggugguuaccugaucaaaucucgugcuuuaaaaaagaaaaucauuuuaauuuuaaaaagaaaaaguucaguagauuuuauccagaagugaguuagaaaacagauuauaaacaacuccuaacauugacauaggacacucuucaugcaugcucuuccuguuuuguaagcaucaucaacuuauucuguauuuuuuuuauuuuuagucuugcuuucccaacucaggagcgaugugcaucacugaccaacaggaagauucaauguucuaaucugcuacuuccguugcucgucuuucucuccuuucauaaacugguugaugaccguauugugcgaucguuccugccugucuuaagccuuuugccuuuauuaaaguaauacuccuuccaucauuacauagagaacugagccaacuguaguuucccguuaccauggagauuucacacuuccaguauuuguaaguugcccauacagauuguuuccuuagcauucuuucauuaguaaaauauauuugguaaaaauggugguucaaauaagcagagagaaucugugacuguaaaaugaugaguuguugccuuucuagauaggaagucguuuuaugauuucauucaaaaguguuuuaagauuuuguccagauuggggccauuaucuaaguuucugaguuaugagauuucccaaguaauuuguucugcgugcugugagccccaggaaguaguauagguaugaugggugggaauguuggaguuuucucuguuauuacagggacaauaagauacccauaaugcuagucagauaacuucuuaauauuggaaaagaucagcaaauucuucuuuuaauuguuuuauuuauuuacauuccaaauguugcacccccuuccccguucccccuccaagaguucuucaucccguucccccuccucuuugccucuaagagggugcuccuaccccccccccccgccccccaacacacacacacuguauuccucuucccuggggcaucaagucucuauaggauuagauucauccucucccacugacgccagacagugcaguccucugcuacauaugugccaggcgccacagaccaguccaguccauguaugcuccugguugauagcuuagucccuaggaguucccaggagucuggguuaguugauacuguuggucuuccuaugggguuaccauccucuucagcaucuucaauccuuccccuaacucuuccauagggguccccaacuucaguccaaugauugacuauaucugcaucugucucauucagcugcugacagaaccuccuugaggauagccaugcuaggcuccugucuccaagaacaauauagcaccaguaacaguguuagaaauuggugccuaaccaugugauguaucccaauuuggcccagucauugguuagccuuuccuucaguuuccgcuccauuuuuguuuguuccugcauuuuuguaaacaagaauaaaucugggcccaacauuuugaagguauguuggugacaccauucuuccacuggguacccugucuauguacuagagguggucucuccaguuuccauguccccacuguugggcauuucggcuaaagucaucuccaucaaguucugggaaccucucacaucccaggucucuggaacuuucuagagguucccccuccucccacuccacacagcugcauauuuccauuuauucuucuagucccccgggccaaucuuuugucucccccuccccuagaauuuuuuuaauaguuuguucguagaauuaauauuuaauaaauccuggcggcagauucgauaccuggaucaaugguuuauguauccgaaugaaagacucacacauugccuuuauauuugaauaugccuaaacuaacucaauagcuggaccacugccuaaccuccaugagguuaaucuaccuucugacaauaaucccaaguuuuuauuacuaaguuuuauauucuauuuuggcugcucugggcuccgcucuccuggcuccuucacguggcagccaugccucucuguacugcacucuucuuaggcguggcaucacuccucuccucgacacuccccuggcaugaagggucuuucucccagaggacuaauauauaaugucauuaauaccaucaaacuuacaacugccuucauuuugauaauuacaacaacucaugucaauugaaaccauuucaaacaguuauuauuccuugagauaaguuuucucuauuucugugccuuuguuuccuacauuugagaucaaacgucuugguuagaauacauuacuugccaaauauauaaaauaauugagaagaguuaacaacuuacauguaaaguaaagcaauugaugaggucaacuuguaagugaaccugaauuaguucuguugcauugagcacuguauuuucuaaaaaaagcaaagucaaaugaaacaaaaacaaaacucccaguuuuucuuucacuaagaucgaucauuugaugugugucauuauaggugacuggcaaacacaacuguacaucacuccaaaauuauuugaauauauagcauaggaggaaaagcaagcauuugaaugcuaacgccccaccuuguguccaccucaacuggcagauuugagcuuccugaggggcaagucugucccuuccuuucaguuucagggacuccugguguuggugagcacaggguagcccucugagcacuguuuagugcuuggugaccugcugaugcuguuccuaacugugcuucuccgagccacacgagucccacggccacgugucucagucuagcuuugugcuuagugucugugcgucuggcacucuuccccuccuuguguuagauacaccuguuaaggagaagggugaauggguuaaaacuagaaacgacaauagaaucaugcggaaggcaagcaucaauuguuacauuaguuuuuacauagugaaaguuaaaacuccuuagaacagugcuguccugcugagaauuaaauauuauuaucuugauuuguccaugagauugauuagauuuuacuacucuugccuuuuuauggugaaauuauauugauuuagcaaaaccuggcugcauucuguaauaucucguuacccaaaugguaguccugcauuauuucuucaguacaagccuauccccaaaauaauuuacugcuaaaacaugguucaugcuuuaaaccacacagaaaaugcaaagcuguuaagaugucagguaaauacucuuuuaagcguuaaauaauuuagguaaguuuaugguauacuuauuuucuguauuggagguaaauuuuuaaaaauuaagaauucugcacauuagagagaagaacagcagucuccaagcaguaauuguuugcucauuguucugucugauguaaggagaaauagggguuucagguggaaggaagccuuugcccacuggcugaaauuuguuccuuuaauucccgaguguucuugcuucuccgccaucucuguggaaccauuucugaaucauaugucacccuucccugccuucucaaaauugcuuaugcggcugagugaaccaaaggucacaugaagccacuaaaugcaacacaacuuauuucuagaaacuuaaacuuugcaacaggauuuaagguuguaucgcaggaagagagaggggaugcaaauuuaaauuaaaaucauacauauacuugcaucaaguugugaaauucacacaaguguuuaagguaaaauguaaaacuucaaagaaauuuagagauuaaaguggcuauucaccagccaggaacuggugacccuccuacuagaggcccugcaaggagagucagugucacauugcaugcuuagcagaguuuauuacuuuaauagagaugugcccuggguuagagcugcaugugacacacucuguaguacuguaaaguagcccuucuggcaauuuuguuguuuaguucccugacagacgguaaaguacagucagccaucccuguaacugugcuccguguauaaguuuaucgccugcucagcguuuuccuuaugucugcuaggugguaucugagaagucccagagcagagccccaguggaacauagauauugacuguguuggcuuggauaacgauggucccuauaaguaggcauccgaagacaguggaacaguuugggaaguauuaacaagugugaccuugucacagacaaguaugucacuggggaugagcuuucaggguucaaaaggccacaucaucuccagugucugucagucucccccgcucaaccccugugugugugugugugugugugugugugugugugugugugugugugugugagagagagagagacagagagagacagacaaacagacagauagacagacagacagacagguaaauagaugauagauagauagauagauagauagauagauagauagauagauagagagagagaaagagagaaagagagaaagagagaaagagagaaagagagaaagagagaaagaaagaaagaaagaaagaaagaaagaaagaaagaaagaaagaaagaaagaaagaaagacagacuuuugucuguuuuucuccaucuuuugcuucuggaucaaaauguaagcucuuagcuacuacuccagugccauaccugccugccugccugccugcuugccugccugcugccaugauggucauggaccaucugaaacuaugagucccaaauuaaauaccuucuuucuauaaggucaucguguuuuaagauagcaguagaacaguaucuaagaaaccagccuaccuucucuccacaguggacuaacuaugucuuagugaggcagcaggauggccacacuacuucucucagagaaugccaagaaaugcuuaccacauguuucauuuucaguuucuucccagugucucaauuugaauuucuuucaaaugcuuacagguugaggcuucugggagcuuggcuguggagaaauaugcugcauugguucuauaccaugugcuucauauaaccuuuugcuuauuacugaaauggggcagugcuagagauaaggaagaauagagaacauuaacugucugugccuaaccauaaacugugugaaaauguuugagugugaacuaaacauugucauuguguguaacuucugaauaauacuuuauacuagcuauuuuaaauacuuuuaauuucugaugugcccacaacuuaauacaauaaaugaagaccaagauaauaguuggaagcaaagaaaauagacuuaaaauauuuucuucuauuuuaugugguuaaaaaauuaccucuauucauuaauccucaggcauuuagagaggaauauugacucucugaauccuucccaucaugcuuauuauaauacaagcaucucccuuguucaaauaugaaauucauuaaguagagaucuugcucgaaguaucauaaggcgacuuugauuaucucuguauuguuagaacucucauuaguuauugggagcuuuucuccugcuccauuuuuauaauaaccugccuagacuuagagcuccuuagcagaugucucgccauuuccauaauaauggaucucauuaaagcgucuucuaaagucguucuuuaaagguguggagaaagggaaaagugacuccagugggugagccccccacccccaaugguuagcaauugcugagcaagaggcagugaaguuuaaaugcuuugccucuucggcuuguuccgugaagauuuucuguuaaagucacagauguggauccugccgucuguauggcggucacuaacauugugucuuacguaguaaaacacauugcacauuuugucagagaaguaaaugaguaagggggauugguaggcauaagcacaugaaacugugguucugauauuucuagagucuccaaaucccugcccguggaagauguaaacuuaggagaugagguuagacacauaggcugaugagguaaucuggagacagaaaucaaggccuguggauucugaccagagcugaaaggaaaagaucggguucugaggguacuaacgguggcagagacccaaaaucaagauuaacaaaugauuuguuacucauuucccuaaacuggaaagaauggcccguucuccccagugugaaugguuugaauguuauaucauaaauucuuuguauuaaugccacacauaauaguuaauuucucaguaagucugucugucacuuauucuguaauggaaaaucuguauggucuuuucuuuaaagucuaauguuaaggcuacauuauaauacagacagacaaugagcccagaacaaguccucacagcaggguaaugauuguuaaaugccaggguaucuauucaaagcaccuugagaacugcguucugggaucauauuuaauggugguuagauucucuugguauagugcuaagcaguguagagcagauucaaaacugcauuuuugguaaguaacaagcaucaauagcaauuuguaggaauuaauuuaaaguuuacauagugaaaguauauauuauuugcauuagagagcuaauaagugaaacaaauugaaaaacauguguggaaauuggcaccauguccagggaaacauuaucaguuacaaagaaugugccaauaugcauacuucuaaacuuugcacauuauaauuugggguuucugacuuuuaaacucugccuuagaaaaacaugaucauagaaaagucacuucuaaauuugguuucguauugaucacuguuaguacaagaaaacaauccaccaaguguuucuguuuuaauauguuuguaauagaagacuucuauucuuaauauuuaugcugauuucaguacuuuaagcgauauuagcgguuuuuugcugugauggugaaauugcacauaagcagugggagaagaugcuucucuuacguaccacugcaaauucuuuuucucccuauuuauuuuuaauuagcacaguucuuucauacugucauaaguaugacaacuuugguuugcacaugaauuucuagcugucuaaccccagggugucaccaguuucugacaucucacuuggcgggcaguauguagcucuccgcuuuacuaaguccuugugaggacauuucagacaguagcuauccuauguccuguccugugggauacuagcacucaccugcacuguuagguucauuuucauacucauuaccaaacacccaucuaucccaguccuacccucuggugcucacuguuucugcuguccugugagugggcuuuuuuuucacuuucacauagagaaugcacagcaucugccuuuuaguaucugccuuagcccauaggacccucuaugcaugucaccacagauaucccugaauaauacuccacauucuuuauccauugguagacacagugauuccauaucuuggcugcugugaauagugcuguuguacguaagaggaauacaagacaacucuuacacauaauggcaucauaucuuuggaugcuuaccuaguggccgcucagaugauuuuuuuuuuaaaaaaggauuuacaagggggaaugucauucaccauccccuaaguguagcuugagcagugacucccagagaggacgaagaccgugacgcagcauagaaccuugacuucugcagcacaugcccgggcccucugagauuugcauagcugcuucugaugaaaagcauuuagcuucaggacuuccuuuccauauggaaguuuaaggaaaaaauauacuugguugaacuguguguguuuuacaugucuccuuguuuuaaggcugaucuccguuccuaguuuucccugagcaacauguggaauaaaugcacaguguguagaaucuguuuacaggugugagagaaacccuucaguuuguucccuugguuauccuccccucaaggaccccacugagaucucccgaucugucauucaucauuuacuuuaacaaguaugcagcuggccuucacuguccuccucagcaaggacaggcuguucuucccuuugcacacagguacccagcauccucucugcuucucuccuagugcacggacaggcagaacucaccagucacaucgccaggcuccucaccccuugcccagagaagaaagccucagccagacccucuccagaucccccaccucagccugccaccagugccuccccgccuagaucucauucagaaaggcaucgugcgcucuccguguggcagccccacaggcucgccaaaggugagucagcgccucccucgggaacacagcaggcaguucucugggcuuucuguguaccuauauauuacuuaggcuuguuuauaacaacagugguaaguuucucauuuuauuuauaccaagccugcugucauaucccuugcuuuauugcuauaaaauuacuaugaaaguuauauaauuacucagagccugucuauagaccccagauuugcuuaaguaaauagcaguguaagguauaauaucuauaaaaugcauuuaaaaggucaucauaugcauuacaauaauuugcgugcuguuauuaucaaaugguauuuuacacuuacuuucauaaugucauaacaagaaaaaugccaggggaguguauuggcauaagggcuugaggugugauacauuaucacccaugcugcagguuacucagaggacggaucauacagacugcgcuucaacccaggaaauuaauuacaacaaauuacaauguuugcaaagucauuauuuuacuguuuaauauuaaaggcauaauuuuaacuuaagccuacgguucauuguaguuuuaugcgggauucuuugaaauuuuaaugauaaagagcauguauuuuauuaauguaaauucauaaaaccuuuaauacgauuugcuaauggacuuauagucuaggauugccaaagaguacagcacauuuagcgcaguuuucuucucuuacgcugucucgaacuuggcuucuaucccaugacuccuggcuaggguagaacuuugaauuauauagacaugcagcaaauucuuguuccuugacauuuccuaauguaaaaacauaaacuauuuauuaaauaaacuuuuaaauaaacacuaaaaccucuugaggggcgugcagaguccccuugggaggauuccucuuccgccauuuguccccuggcaguuaagacuggcagguguucuucuuuucauuuuaagaacccagaaagucaugagucugucagcaacugcucugccauuuagaucuucacuguucuaggaaugcuguucaaacugccaaagcgaagggcccacccauauggcugccauuguacuauaaagaggaaaacagagaagaaucuuaagacucuaaauauugcaaauaauuucuguuuucaaaagugaagaagcaauaaaaacuguguuucugaaucuuugugucucuggaaucacaggaguuuacaaauucauugauaauugccaugauaauauaauuaauauauaauuguaacuuucuauuucuuuucuguaugauuucuagaacucuuacauguauaucgucauuuguuuaaaauuguuaguguggaacauugauguaaguuuuucauuaauuuucagauuuuucauuaguaguaaaagaaacauaaaagguuauuagaaauguaauaauacugcauuguggcuaaaauggaaaucgaguaaucugugucugaaggucuuuucaaugcaugguacaaacaacgugcucucuuggauuuguguuuuguccccucucucuuuuagucuucuccaugcaugguuagaaaacaagacaaaccacucccggcacccccuccucccuugagagauccaccuccuccaccagagaggccuccccccaucccaccugacaauagacugagcagacacuuccaccauggagagagugugccuucccgggaccagcccaugccccucgaagccuggugcccucgggaugccuucgggacuaaccaggugaugggaugucgcauccucggggauggcucuccaaagccuggcgucaccgcaaacuccagcuuaaaugggaggcacaguagaaugggcuccgagcagguucuuaugaggaaacacagacgccaugauuugccuucagaaggagccaagguaagaaaaugugcaauacagaagcuggagaagcagccuucgagcuuucccugggaggcuuucugcuggggcugagauaccggacaguguuuaggucgguuguuuguaccuggauggcacaguacuuccuccgugcucuuuaacuagcuccauguucuggacagugaggagcucacuuaacguugaacacgagggaagggaggaaaagacugucccuguauaauaacgagaugcagacacaggacagcuggacagagauagguccacuuccucacuguuuugcugagagccucccccaugcauaacucgguguuauugaagggacuaggucuucuugcucagucagaaucgggaauguugaaucacugcacguaucauaaaccagucuucugauccaguccagagucggaccucgcaccuuauaaaacaugacccaauucacuccuguuugccaaucaaacuauuccuuauaaugacauucccacacucauuuaaacaggaacccucucuccccuacauuuagggacgaaucuaagagugcaggcaucugaagaggcagcaccagcagccauugagacuagaacacugaguggucuccccagaaagcauccugaaauucuuucuggugcuuuauucugguguuagcugugagaucagaucuguguccucucccucuguacugaaaagaauuucaccucuuuagcucagauucaguuggccccagcuuuuuauuggcuuuguuaggagguguaaucuaguacuuuaaaacucuggauuguauuuaauguguucaucugacauuuagaaaacagcuuauuggcacacagguguaaucccaauggggaugagaaguuuaagguuacucuggggaacucaaggccgacagggcaacgugagacccugugucacaugaaggaaggggaacagauacaaagaaacuaugcagugccauguacuuacguguguguguuugugugugucucuguguccgugugucugugugugcgugcacuugcauguuuguauacaaacaccgugauggugaaaacuuugcuuccuaacaucacuccuacaguggucuaucagguauccuguggugaaaagagccagcucucacaggcaucauacuaaagccgagagcauuaguugcgaaccacaguugccagugagcugccauagcaugguuuucaauucuuuaagguuaauucacuacagugugaguguaaggagaaugcauauagaaaaaaacaguuugguaauguccucuagacguuaagagccuguccucagaggacuucccacagccuggagucccagcuggagagaauuucugggauuugguuuaguuuguguuucuccuuuagucucuguuggcucauuugugcauggugacgcuugucaugggaagagccuugaaacaagcucucaugugaagagacauuuauccucagggugcagguuacaaguuauuucugaaugacuucagaaauacauaguguaguugacaccacggccaguucuuugaaggcccccucuuucaggguucuuuuggauguugccauaaauguaaacacaaagcuggccuuccagagcaaggcuguuaacuuuuucagauguuauaaucugaaaagugggaugaagacuuccuuuggguauggauuuauauucuguaauauuaacacuaguucucauauaguaguaaaggguucaguuuugguucuguugaggauuccaacuacaaaaguuaccucuuacugagagguggauuuucauccuauuucuaaucaaccucuuggauagucccuggacuuggauucaaacucuucccuaauuuuuuauuuuugucucaugauugaauucuccuucagaggaggccucuuuuuuuuauuuguuuauuuuuuuaauuagguauuuauuugauuuacguuuccaauguuaucccaaaaguccccccacgcccccccccacccagucuccuacccacccacucccaauucuuggcccuggcauuccccuguacugaugcauauaaaguuugcacgaccaaugggcuucucuuuccagugauggcugacuaggccaucuucugauacauaugcagcuagagacacgagcucuggggggguacugguuaguucauauuguuguuccacuuagaggguugcagaucccuuuagcuccuuggguacuuucucuagcuccuccauuggggucccugugauccauccaguagcugacugugcgaaugcacuucuguguuugcuaggcccuggcauagucucacaagagacagcuacaucuggguccguucagcaaaaucuugcuaguguauguaauggugacagcguuuggaagcugauuaugggauggauccccggauauggcaguuucuauaugguccaucuuuucgucucagcuccaaacuuugucucuguaacuucuuccauggguguuuuguucccaauucuaagaaugagcaaaguguccacacuuuggucuucauucuucuugaguuuccuguauuuugcaauuuguuucuuauauguuggguauucuaaguuucuggacuaauauccacuuaucagugaguacauauugugugagcucuuuugugauuauauagcugaguaguacuccauuguauaaaugugccacauuuuuuguauccauucaucuguugagggacaucuggguucuuuccagcuucuggcuauuauaaauauggcugcuaugaacauaguggagcauguguccuucuuaucgguuggaacaucuucuggauauauucccaggagagguauugcgggauccucugguaguacuauguccaauuuucugaggaaccaccagacugauuuccagagugguuguacaagcuugcaaucccaccaauggaggaguguuccucuuucuccacauccuugccagcaucugcugucaccugaauuuuugaucuuagccauucagacuggugugagguggaaucuuaggguuguuuugauuugcauuucccugaugauuaaggauguugaacauuuuuucaggugcuucucagccauucgguauuccucaggugagaauucuuuguuuagcucugagccccauuuuuuaaugggguuauuugauuuucuggagcccaccuucuugaguucuuuauauauauuggauauuaguccccuaucugauuuaggauggaggaggccuccuaagaggacagacucuuuaaggucugugcuccauuguguguauuagcguggcugugcuuacauccucaaagauuauuucauguugcaacaaaacugcuguuugaacccacacuuugcaauaaauauuuuaaaauaugauacaaaguuaaaguuguuaauucugggcaucaacaauguucccuugagagucugaggauccagcugauucuuagugacaaacacugucuuuaacuuaucaucugccuggcgaggacauuacagaugaccuuauguagaacaaucuuuugaaggaaucucuagauaagauugcccuaugaucuucuucuugugauuauaacuuuuugugugaggaagcacauguucaugcauaugauauuaaacuuaucuguaaguuccaagauuugcaagagcuggcuuucaaaaugggagccuuugugcacacgggccucauuugcaguguccuacugaacaacacaugaagacaugcucucuagauuguggagcaguuauaaucacaagauagaaaauacauuugcauuugauaauaaauaaaaucuaggcacccaugaugugugugucugucuguguguauguacaugucugcguguguguguggggggguguggguguguguguguguguauuacuuacacauaucaaauaaaugcaaacagauaaacauguuuuuagaauaaaaauccuuuucauuguacagaauuuuuccuaaaauaucacucuaaccuuagacaauauagucgaagucacaggaaaagauuccgaacauacguguuaagacuauauggcaccuagaggcacacagaaaaaccaauguaggagagccagguuuacaauagauugcacagcccacauuggagggcuuccacaccgcagacccuucaggaauggggcucauuucgucauccucacucagcugugcaaguaguuggaugucugugacacagugagaauauugugaauggaacaaucuuaagcacaggacaguccagggcccacaagagugcucucugaugugugacaaacacccaaaauauauguaguugaaaggaaaagaaguugaaauccugaaaggaaaggcagaaaaggaauaaaguguucuacaagcuggucucuaccagcugggcuaacagagauggcagacaacgggguagcccuccccagcccugccaccggaccuccauggcaauaacagaaagggauuucaaguagauaggaagcaggacagugaaaugaagucaagggaaggaauugcagugcauauaaggauaaaggcaugugcccccaaacuggguaauacaauuugaaaccaguucugguaugacguuuucucaguccuuuauguaggaaagagcuuucaaaguagagauagcacgagacuaacgugaccagcgaugcggauuuuuaaaugguaaaucccuaagauuucugguagaauucuaauggauaggugacagccuugaaggagccugagcccagaggccagcaucuugcagacuguuguuuccacuauucacaaacagguccuccagauuccuaaggaacauagaauauucauuuucagcuaggagauggucguguacuccacucuccacucucggguagugacagccaaauucugcuuugaugaaaugggugaaguugaacguggaauucagaaucacauguuagauuuuguccuccaacaacuccuuuucagaaacaaucauauuagauucacagaaaugagucucagcacuuguaagccuuugacuguuugcaugcuugcauaauuucggucuccuaauuaggaagaacuacacagaauuucaugugugguauuaagaauaugcucaacucucaagacacaguuuagaacugauuacagcaugaucaaauacuaagcaaaugauguguacuuuuaaaauaauauaaagacaaggugucuuccauuuauagcaaugaaauuucccuggucagugccuccacuacugaggucaccugcccuguugucucucaacauucauguaagcccuauugcacaugacccauguaagggaauuugcuauaaaaacaagugagaaauaaaagacuguagucugaaauacauacaauauugcauuaauucuccacaaaauagaacuacacuugcagcuaucaaauaaauuguucauuaaaaacaaaacaaaaaaugaaaaaaauucuuaacuuuucagagacaggagaaaucuuuaagcuacaguccaucaauacaauucaugaagccauuaguuaaaaugcuacucacauuuugaaacauacuaaucugaugaaguuagaaaggaguugcuuaauccccucaaguuaaugcccuaccagagaaugaaugaaccugaguaauagauuuuaugauuuuuccaggaaaaacaggaaaaacucuguugucaguaugauaucacuuuauuuuuuuauuuuacuguguguauguauguguuguguauguauaugaguauucuuuuauauauacauauuauaugcacaugcauauggaugcucauguccacauccaucuuccuuugucauuuacucaccugacguuuugauugauugauuguuugauugacugauugauagguuuaugcguguuuuaccugaauauaugucuguauaccauguacuugccagauccccugaaaguggaguucaagacaauugugaggcuuugugugggugcuggguaucacaucuguguucucuagaagaacagaaagugcucuuaaacaccgagccauaucaaaugcuucugucaaaugcuuuucuaggcugggaauguccaguaagcucuugugaucugucagcacagugcugggauuccagaugcacacagcugugccuggcuaugaugugggugcugggaauaugaacauagguccucuuucccgugcagcaggcacucuagcagcugagccguuuuuugcaacagauuucccuuugagaaauuuaguaucacacagagauguugugugaauuguccuaucaaaguaucgcuccuuuaucaagguugaaacaugcuuuuauuuccauaucaguagauguuuggguauauugacauuccugcucaagugugcucauaauguuuugauuaugaaauuauaguuggcuuauuguugaaguugauaccaugaacucuuauuuccauaucauccuuuguuacugagcucuuaucaaguaguaacgugauagauauuauuaccgaaaaaacagcuuaguccacauuuuuaaaaagaaauccuuucauuuuacacaacuuuuaaguguaauuuugauaaaaaucauuagauuuuauugcaaaaaucuuagcacuaugucugcucagucaaugagaagaauuuugaugaagaauacuuucaaauguucaacacuauaauuggcauuuauagcuggaugcauguauucaucagauaaaagacaauuuuuauguuaaaggauuucauugaaccucaucaugauacauaucucuuaggaaaauucucuucucuagcaaaguucaaaaaauuuugucauguucugauacaugguucucagucaaaagcccacgauaaaaucacuucauuuaaagauguguuuuaucaggauguaacugcagcgcguugaaucuaaugaggggagacuugggaaagaaaaucugaacuaacauagucacucgcuucuagagugaaauuucaaugcuauaaaauuggauuuuuuacagcagaugagagcauccauauaucucagaggugaucuugcagucugcuguuugguaggauacccauggccuuugcagguuuucauuuuaaauccucaccacuguuuauauaaccaagaaucuaagcaguggaucuggauuuauuuagccaagguacaaaagguacaacucacccaucagggcucauuuagccaagacuacuaaaaauauaucucaaccaucugggcucauuuagccaagacuacugaagguacaacucacccaucuaucccuaguauucaucucccuucucaauaugaguuaauaagagcuuaugaaagaaagaaguuuauuauaaaaaauaccaauucaauucauuacuuacaaacuuuaagagguccauagccuuguaugccuuugcaaaguuacccuuccauuucuuccaccauuuaaguugauccaguucaagacuauaagagaggcaaggaacaguuggccaggugcuuccaccagcauuaccacugcgccuguaaaccggaagccccugauccccacugauaaaacguuggcucugagcuuuuugcaaaccaaaaguagaugugggauuuccacacacguggaaagucagaacaauuggcugacuaaaauggcucugaagcuuggcuuggacaugacacaggccugcaggggucuacucauacccugugacaucaggaauugaagauggcccugggagcccuaagucuguuuggaggcauguaaaaugacaguuguguccacauaguuucuuccucuagccagccccuauucuugugauauaaucugaucguuccugggaaauucucaauuggauguauauaaauuauugccuugcuucuccguuguguuuaaaaaucauaauguaacaucuuuucauauaaucugugauaugguagaucaccacugauccugcugacuccugaauaaauuguaugguauugcacuagucuaaauaagccaaaauuauaugagcucugugaaauucuaagagcugcugugguuucaggcuuugccaggaguugaaguccaggaacuaacaccuuugguuuacuuucaggucuuuuccaauggccaccuugccacugaagaauacgaugucccuccucggcuuuccccuccgccuccagucaccacccuucucccaagcauaaagugaguuuccuuggauuuggagaucguguguccauaccuaauauaggaaagaauguuuuucagguucuuaguacagcaacuacaggguaaauagaaggaaaucaguaaagacagaagcgguggaauuggguuuaugacuucaaguaucagaugguaagacuucugcuucugggaguagcuccuacagacuuccuaaacuccugagaagaugaauaacagaacgaaagggcaagaaaacuuagccuaaccuccaucgaagcagagggcagagcagcacagcaagcucucuacuccagccuucuucuuuaugacuuuaucucacuacccaaguucaauaaaguucccccaaguucccugcuuuucaaaacucuucagugcccaagaucugugcauguauccccauggaguuuuuuccuauccaguuaagccuccccuugcuggcucagacucagcuagacuucugagaaugucaguagaucugcauugaguugggaccaguggacauaaagcugggaauuggggccacugcaugcuggacagugagguaauguccagccaaguugccacuccuuccauuuccauuuccuucugagcucucuguagcaguaugagccuacagaaguuuagucagcuagaauucucaucuauuccuagugcuugcacuaugcagcaaccaagccccgccuaucauguuccaccuuuuccucaaguucuaugucucagcguuugcuuuuauaaaaacuaaugugacuuguguucaauaauuaauagugguugacaaagcagagauuggcaguauauauaccuauaaucccagcauugggaagcugagaccaggaggaucaucauuaauuagagucuaccuucagaaggauauaaugagugccagggcagccugcgauccagagugagccucuguaucagaaaacaauagaaaagacugacuugcauuuuucuuguuacaaauuauuguucuugauguaaguaauuauguacucuaauuuuaaaaagauuggaugguuugcaaaucauaaacaagguuuaugcuuucaaauacugccagggaaaauuauuuuaagggguguguuguuguuuuuguuguuuuugauggcuugguuucuaucuacuaagacugccagguuuuucuuuuuucuucucuguuuuuaauuuguuucuuuuucuuucucuuuuuuucucugggaguccuauacaugcucagacagcgcucucucucaggugcaucacuaacuaugcaaaggccuucuuuuauaacgaaaagccuccuuagaacuucuucauuccuuucccuggagguccuugaguuuccauuagauuuauaaaagaaagaaagaaagaaagaaagaaagaaagaaagaaagaaagaaagaaagaaagaaagaaagaaagaaagaaagggaaagaaaaagcuaacucucaaccuuccaggaaucugauaugcucuaaaaguaaucuuuuaacaugugugacaucacaagagaacacugcaccaaacgguguacugcucauugacuaggguuuuugguuuuuuuguuuguuuguuugauugguuuguuuugguuugguuuuugguuuuugguuuuuuguuuuuuuguuuuuuuuuuuuuuuuuuuuuuucguccuuuaaggaaagccauuacaaacugcaucagcaaaguguguuucauagucgggacagaaggagucacugaagaugggcacaauuagauacugcagugccugaaauuaaaccagagugcaauuugagauccuugagggaagaguagagaagcugagcugagacccagcaguuacaaucacgcugucauacagucuaagucugugagagcaaaccugauagugcaggccuugcaaauaaaccuuaaagugugcgcauacaguaagacaucgccgcucuauaaccucuacagucaggguuuuaagaaacaaauuacugagaugguccaaguuccugaucagcucccccagcccucuguuucuuuaauucacagagugaaguaugacuagagaaggggucuugguuuuguuuguuucuauuugguccuuuuauaauuagcaugaaugguaaauuccuagugaagugcacucacugguaaguuuguaauguuuaacucugcaagaaccacuaagaucgggugauauuuucucuccacuuucuaauuuuuuucucaauauuuucuaguuuauacuaaaaaauauuuuaacaagcauuuaacaaguauuuuuaucagcaacuuaguuaauuugcauguuacauauuagccauagcuguaagcauuagauuuguauuguauguuucucuuccccuccccacaacuauaucuguagaaauuaaguaaaguauauaagaaaauauaauaaaagaaaaggaagaaugaauaaaagaaaauauauaaaauaaaauaauccuaacagcagaaauaaauacucaaaauaucaacauccaaauuuuauccuugggucuuuugugaaauugagauuuauuuuaacauuauuuaguucauuuguggagaugacaucacacucuccuuguccuuugauauugucacauccauuuuuuuuucagaauauauauacuguuuuuucugugaaaucaugaaauucugaaguaaaaucugcaguagaguaaaaucauguuggguuccaugucuuacccuagcauuuauuaauugcccuauuuugaagaagguucccucucuggacuuuuggcuucuaucuggcuaauacaugagaggauauguuuaacuuaaauguuaccuaaaaucuuuugagcuucugcucccuaugcagcaauuguuaugaauuauucacuauauggugcuaauuuuauuggaaacuuuggugaccugaaugcucucuacuauagcugguugaccacuuccuauugcagaagccaucaugagaugaacuaucgaccuuacuaacauuacuaauaucauaaugcguauaauacuuucauuauaaucauuauauuguucauauuauuauuauaguaucugauagaauguugguuaugaaauuguacuacuacauaauauccaugcaauuuauuauuaauacagcuccacuuugacccaauggagaggauaguccauguccaaggagcauccaucauaggaggaugacagagcaaacacauaugcucacugacauggcgcuguuagacauucagguccccauugccaucuuagauucuugguccguguucagacaucaaggcaaaggaaaauuacaaaucacugucuaaauuaacuuacaguucuuacaaauguuggaagucacagagcugcacauaagaauaccaggcuagcaauuaucuuuuaguuucaacuccagugauaguaacaguuaggaagauaugaauuuucggcauuugauacuggcccuugaugccuauuuucuugagggcagaggauauccugugagguuuccauucaggccagucuucaucugggugauuaugugacucuuucuacacacuuuauaauuuauuucugaaaauaugguaucauaaagugauagugaaaagaaacagucgcuguuugaauagauacuccauuuucugaauuuuuuaaaaaauagauucuacauaacauuggcacuaucaauauaaagcuuuaaguaaaaacuugaaauguagauauuuauuauaacuuuuuagaagagagaacaaaaaguuccuuguguauuauuuuauuuuauaauuaaauuauaauguauaauauguacuuuacauauauauguaguauuuuauuacauauaugcuuacuaaauuauauccaacuaauuugauuuuuaaguuuaaugagauggaagacuaaacaauugaaauguuuauuguccuuggcacacuauacuaucaaaugaacacauaugauauuauagauaauaagguagugaauccauccaaguaaaacaacacuguagaaagcugaggaauaauuucuuuaugcuuugcuguuuacauggggacaauuguaguuuuggcauauuaaucacaagcugucgaauaccuuggaaccaaagcuacuugguucaugcuuuuccuaacgguccucugucgugggagguggugacguuuguuguuguuguuacacaucucuuaauuaaauaagguacuaaauuugggagguucgcugaaaagaaaauccaauuuuugcccagcucucuaguuuuuguucuguugcugugcucagcugagacuugcggggggccagauggggcaagauccaacucccuuccccuucggaaugggugcucuaguuaaggaaaagaaagugagaagaaagucaguuaaccacuuagcgguaaucuccgguaggaaaaucagacguggggcaggaugacuagugacacacagacugucacucuagaugugguccugaggaaagaccucucugaaaggcgcuuuuaaagcaguaaagcaagggagagagcccagcugugcgugaaaagccugacccuggggcaccggggugcagcuguccuagcugucuccagguuuucagcaaaucugugagaucgcucgcagucaaagcuuaguccaaagcugcaggcugcagcaagcucaccuuuuccugauagugugaaaagcacccucucaaucauuguaauacucaugccaggguuuugggcaaaugacuugugugcugcagacacaagauaaucuugucgaacaucacuguuuguuuugcuggcucuuugggcuuugguuugucugaauuggagauguuuucuguucagguaagaacaguguagcacaugaaacaugaaauaaaacauggcagcuugagcuuuuauuuaauaaaaacauguauaucuuuacuuucugccauuaguugcuugaacagagaucuucugauaugggaagcaaguaaaauggcauauuauuuaaaaugcuuuucuguccaugaaagguucugaaaauuguugcucucucuccuuuuuuaucggcauggugauuuuccuugcuaauacccccucauuauuuuuauuuaaaagcuuguaagugcucaguuacgugcaaaguaggguaauccuugauggccucaaggucuucccuuaaacauguugcaauuguagacaaaaacaguaaaauaacaguauaggaaacacaucaauagaaggacauaugcuaaauacauauaaccgaaaaggucaaagaaaauuacugaauuuguugccaguuucauggggauuuuuauagacacugaaauaugaaggggucugcuuuuuguuuucggagaaaaguuggugugucaaggguugcuccaauuaggaaugaaaaccacuugaagagggugauauuugagguccauuaucaaaguaaaugguaauggcaugugcagucagucugcccugugguuauucugggaguaggcaguucuugggaggaauauguuugugaaccuucagcuuugaaagguggccucagaaaguaucaccgugauggaaauagaccucuuucucaacauggcgaaugugccugcacacucaagccagugagucaccaugaggauaggaaggcucagaugaguuucaaguuaaggggauaaugguuuugcaaccuggaaaaauguaccuccugugcuaugacucaggaacagcagcagaauggaagagguagcaggaauguggagucauauaacaguguaaauguguguaaauggaugcaaauggcuugguaucuuuccuuuggagccagccagauagcuguccuacuuuguuccuccgggacccuggaggaacacaaugaaaauaauaucuuucccuuaagauauaccagugacugacugagucuccaugucccuaaguccaccaucuagauaacauacacacagacagugacucugugucuaguuaugcugacaccuguugacucauaggcuauacaaaaguuuggauacaaugcauagacuuugggucagcuugaucucucugacuuuuuuauuuacaaguucuuuaugauaaaauuuuaauaaauauuaaaacauuaaccuaagagaaaauagugaacuuucuuacaagacuuuauuaaaaugauaaguagaaaauaccaggaugggcuggugagauggcucaguggguaagagcacccgacugcucuuccaaagguccagaguucaaaucccagcaaccacaugguggcucacaaccauccguaacgagaucugacucccucuucuggagugucugaagauggcugcaguguacuuaaauauaaucaauaaauaaaucuuuaaaaaaaauaccaggauguauuuuuuauauuucaauacaaauggcacauagcuuucuuaacuucuaguuauaacucaccaagauccauucaaccuaauaaaaugucuaacuaguagcuucuaaaacugaacccuuaguuuuugauaaaaugauagauaauuauugccuuucauauuuacaucagaugcucucugacuaacaaaagagugagugguauuuagccaggcaagaucuucugucaaugaaggguagcauccagagcuaaccacaacaggugugguuuguuuguuuuuuuuuuuaauuguuuauuucuugcacugacaagaugguuucuugcuacaaggucugaucaccugaguugaaucccugggaacggcaagauaggagagaguaagaacugauugccacaaguuguccuugaccuccauccauaccuuggcaugagcacacacaucccaauacauacuauauguuaugcaaauuaaaaacaaguauucuuccuucagagugaagugcuucuuggaaaucauuaaauuauugaaguaaccuguaagacagauuugaacuuccaccucuugauguaguuauugaauauuaagucaaaggucccuuuugucucugaaguauuuacuuaagugguauguauagagaugguguucacugagacuggaagcagagcaggaugaggaugggaacaugcagggcccacuuccucugccuauagagacguccuggucuuugcagagguuggugagauugaugucugucuccaagaauuuaguguuugcaagaaaauacaguuauuucuauccuaaccauauuaaaacaccaucaagucaucauuuugaaacaucuuuacuuuugucaccuuuaguugcaaggugugucuucuaggauucaacuagagugacuauaacacuauuguuuguuuaugaauuucauagccuguguucugggcuguguagagaccccucugcuacuacaacaaagcuucagguuaccauuaacugacauuuggauccugaaguaucucuuaacaaacagagcuuuaaaaaucaauacugaaaacuucuucaaagacaaacuaaaaguauaagcuuuugaaaacucccaagggaagguuuuccgugaucucugaauacaguugaaacuuuaaauaugagcacacacauacaugcacacacacacacacacacacacacacacacacacacacacacacacacauacaaaacaccucugacauuuuuuucuauuauaacggguguucagccacacugacccaaaagugaaaucauuauagaaaguucuccaaaauccaaagcuuuuuugaggauuacaugagggauacgacugguaaagucugcaacuguuccaaaauuugaggggaaaaaauaaucugaaaaaauguuuuagucccaagaaguucagacagggacacucagcucucggagagaagaauacaaaaugaaaaugaaacuuuguggugagaagaaaugaaaauggaaaaagaaaaaagacaaaaagccacauaggcaucgacugccucacguaccagagggcuccugcucccucugccgaaugugcuggaacauuacacuguuuuguguuuuuuuuuuuuuuuugggggggggggaacauuuuccgugaaguuuauaauaauuaaaguggcuuggauccgaguuuuucuagugucuugcaaacuagcugucuuucuaccuguuggccaaguugcauuuuaacauuuuuuuuuuuggacuguugucuugggcaguagcaaagguuaaauuaaaacccacacaggaaguagaguacuuuucaauuuuauuuuauauauuuucccaaaugaucaaguaaaaugcucaaauccaccacgguaucccgcuaaguguuuuauucguugcaguuagguauuacacuuagguaucaugaguuacaaaaacaauccaucucaaagauuuauuucugucaugaucggcuucuaauuguggacacguuucguucuuaauuguugcagugggaggaacucuagcacuacaguuauaaguugacaagauaguuaaauuucucucauguauggcuuuuuuaaaacuauggguauuagccauagaccaguuugaaccuuuaaagaaccucuuguuuccaguugauuucaguguauccuuaucacuuuugcugauuuccaguacaugggagggagcaauuaacauuuuaauagcuuggacuugaauaauuguacacaucuuauguuaaagcuuuauuuauaaaacccuuucauuuucguaauuuucauuuuuuucuuaguucacccuuaaaaaccacagguaugaauaucuuaucuuaacauuucaaggccuuccauuucuauuggauguaagaacaguuuacaguugaaaacuuccagugacaaagcaguuucuucauuguucuaugucacaucagaccuuccugcucugguauuuaugaugcuuaaaccagauuggauuuucuuuucccucuugguagguguacugguccauuagcaaauugucucucagagaaaacuagagacacgguagaagaugaugacgaugaauacaagauuccuucaucccauccugugucccugaauucacaaccaucucauugccauaaugucaaagcuccuguucgguaagaagaugagcaucucuguaucauccugcaucggcauaagcaucgucaugcugucaaacguggggguuguuucuaugcgguucaauaguaugugauugguuaaaaauccuguuccuugccuagccuguaguuccuauauauuuccuucauugcuuccacauaaaagauuuuguugccuucuuccccacccccacaaaaggccaaauuacaaucuaauaaaaaggagcuauacguuacauauaaugaugauuaauucaugcauuuccccuaagauauuuuaaugaauuucaaaagguccaagcauauauaucaugaagaaauauuagugcuuagaaacuaauauuaagguacuaggucaaccugcuuaagaauuuuucuucauaaugugaaggcuagaauaauuuauauucauuuuccuucuugauauguaauauacuucuacugaaaucauaauacaaugggggggaagccuuaacguuacuucuguuaacuucuuuuuugagcaaauaccuucucuugcaugagcuaagaauacaaagaucacuggguuuuguuguuuuauuuugcuguguuuucuuuuucuuuuuccccucauuauaauaggagcauuauuggucuucaaagugccagucacauugacuuuuauaagaauuauugauaauggcuuacauguuuugaaauauguuugucucuaagcaaaaucauggcuuugcaugcaugaaacuuaauacaguuacaguaacauuuauauaauuugcaucuuacugacaugucaaucuauuagcuuuauuuucugaacuuauuuucuggccugcauucuucuugcauaguauuccuggagcugugcuuggcuccaaguugcucagcucuguucagacacuguuaguggcugagcugccuggggccuccugaugacugacagauaggagacugcaaggccaucagucauccacgccaucuuuacucagugugcugcuuccacuugaggccagcucagucgacuuaaaguauuuuaugaguagaguuuccaucuuuggaguugaaaacgcuucccaggugucucacagagguagagaaagaaauucuuggaaaccaagaguugugccuccaaagggaugcuggugggcggaguuacuacccaggcuaagugaugcacugcagcccacgcuuucccugauuacagcaagaaccagcuaucucuuguuaaucgugcugaugagugcuccugcaaagacgauaacggagaguguuacccugggagagccacgugcccgcugagcuagcugagggaaagucacgcuugcucaucaaguauaaacugugaacaaaucccaguuucuuuggcucuuacuaauuuaguauaguaauuuuuaaaugcuaaaauugaacgagauuuuuuuggguucuuugggauucucauucuucucauggcuggaagacugaaggauaugauuuuaauucaucaaauuuuaauugucaugucacaguagaugauauuuaaguggcuaaccucuuggauacugaaagucaauuugaauuauaaccaucauaaccaaguccccacaguuauagagaaauaauaaauguugcuaauuccuaagcuuaauuguaaugaauacuugaucuaauuuguucuugaaaaccagugaguggaguggcacguugugucaucugcaaaguccccccacccccccuuagaacuuccuuuuccuggaugucacucacucccccuuuggaacagcaagaaaaauaaauugucaguaugugggaagugaaacaguaaaugaaucauucaauucauaucaucauuaugaagacucaauacguaacuguucuuaaaugaaccauaucgugcccguuaaaaagaaauggccaccagagagaauagaaaugaauuucagaugaaucacucucucaauaucuacugaaauaucgacuaucuccuccauuaugaauguaguuucacuuugcucuaagaaaucagacuaauucaaaaggaaaguauaaaacuucacucucucucugaggcucuuuguuagccagccguuacuaagcuaggagcuuaagggcaaguguguucugugccgccucccaugccucaguuucauccagucuugauggcaguaccaaaaucacggcuuuuaaaugagcuacuauuuucccccauauuaaaccaucuuggugaugugcacccaaagcuuuugcugacaucacuucccuaaggugucagagggccagcguuuauuaaacauagugguuagauagguucagaaggaguaggucuuggaguguucccugcagaacuuaaacgaaauuguccaaugcuucauagugguuccucucuuuuaaggcccuuugaauuucaauucaaagaaugcuuaaguugaaccaacaaacacauucaaugccaucaacaaaaauggaggcccuuagaccuuacauaguuuucgguagcguauacuccgucacuucagaacucuggccagguguaacuaaaaucguacucaaauguguuuaggguuucggcugcuuuaguggccguaaauugcagugagagaaagagagagacauguuucccuucagacgaacacgucugauuuuaaaguacaggucaggguagcugcauguuguuacuaguccuuuuucuagagaagauaauuguuuuuguuuuguauucuuauuaccuuaguaggaaugaccguucgcucuauuguccuccccucacgcccgccaugacacuuaaaugauucuugcccucuggucuccacauuaggucuugugauaauggucauuguauauugaauggaacucauggugcgccuucagagaugaagaaaucgaacaucccagauuuaggcaucuauuugaaggguauguauggaguaugcuuuccuuugcaauauacaucuuaguggccucaaccuaaagggagaguucccuuguguuuucauacugagaaugcauuaagguuuuguguuauccucuaggaggugguucugacucagccucugauccaguaccguuaccaccugccaggccuccaccccgggacagcccaaagcacggcucuucagucaacaggacgcccucugacuaugaucugcucaucccuccauuagguugaaacguuaaaagcaguuuaaacaacccugaccugcucuccauaucugcauuauucgaauuaagaguucaauauaaugcagacucuuaguugagaauuggccuaaacuuaguuggguucucugguugaugguggcuccugcauucacaugacaucacucuaacagaugaacuaauugcauaggaaauagcugggaaauuuuaagcgauuuucauagcaucuuucagaguuuuuaagugucugauuuuucugcaauaaggcgcugcuuuuauaaucagagaaaaaguacuuaacuuuguuuuaagcuacauuuccacaaucuuauccuuacauaacuacaaaggagagccuggacgggcgggcgggcgggcuggcugccgccagcagggauuucaucaguucucucaucuagaggcaguucugugucaagacccaagaguguugcucgcucccuuggccucuguccagaggcuuucaagugcgguucuggagcuuuaaaccagggcccuccaaauuuacuaauccuuaguaaacaugacccacgcucugcuucagcaugaaauugcugggcccuaacuuaugagaaaggauauacuucauccuagaaaacacgaacuaguucuguuuaaacuguuuauaagcuuuucugaauugucuguuaggcugcuagaaauacuaagugagcuuuuauauuucucauaugcaccccagaccaguaguuugagcuguccuauuacagugucuuuugcuucugauuuauugaucaaagguuuucguuuuguuuuguucuguuucuccucuugugcuugaauucuacguuccugucuacagucugguuuccuuauuugcuuuuucucuauacuggaucuugaccccucacucaggcccuuacgaucuagaugacaguguuuaauagaguuugcuguagggcugucagggaccuauguguuugcuucuggucuaguugauuuuuuuuucuuguccaauauaauagccauggaugauugaugaccuuucugcuagcuauucccauagaaguuaccuccuaccucuucucuugggccuuccuccagcguggccugcguauugguccuuccuuacuguucucuuggcuaagcacaggcauuaccugucuuuccugcacauguauuuuugaaccucugauguuccacuugauagcagcacuucacuggaugcugcuuguauuuuucuuuucugcucucauaaauucuccuuuaugaggccaauuaaacccuuucaccugucagucuuaaguguuugcgaacagguuuucacuccccuugauaguauuuaagcuccuuaaguuuugaucuucauaucacucaauuccuagcauggugccugauacuuaagggcuggaaaaaagauuugaauuuaauuaugugacagcaagagccugaaugauaacaaaucucuucuaaaucuucaaauacuuaaaauuagaaaaauauuugugaugauuagaucaaauauucugcauauuuuugcaaggcaagcacaaugauaaauucauuuuuauguauuuaugucaaauucauucugcuuaaauacauguguauuuuuauuauuagaaugugaagguguuuacguauagccugucucacugacagcauauuugauguacauacuugcaaauuauaugcaguucauuuuauuuuuuuaaagauucaagguaagaaaaaaucuggucuagcaauaaguugcagggauaaauauauagacauaaagucacacugcaguauucuauaagcauugaauaaaccacauauauauuacauauacacauguggguaacuagcuuuggagccaccuaauggggaucuccauugacguguucuucucuggagaugacaacuaagcaaacaguacacucugcugcacuugugcguuugcucuauauuuuuacaguaaaucaaauguguggugcuauauaacugaauuacaguccaguggaacaaguguuauggagugguuagacacgcucuuugacacuaaauuaccugugcauggugugauuuuucucaggagaggccaugaacucucuuuguugcucagagauuucgguuuggcugguuuuacugaaaauacuuuucaguucagaguucuaguauacuaauaggguaaacgugacaaagggacagugagcugauauguuacuugcaaugcugcuuuuuauagaaagacccaggaaacagaaaaaugguuucacagagggguguuucauuggugugugugugugugugugugugugugugugugugugugugcgcgcgcgcgcgcgcgugcgcauagguacauucgcaugcauguguguguuuauaugcauuuucuauccucacacccacaaagcaacaccauucuguaagucagggaagugcugaauccacccugcaagugaacuuacuugucaggugaagcaguaagggaaaaaucagucauaauuuuugcuuggcacugugguuugauuaaugaaguuccacuguuaauagugcuccuucuugaaaugcaggugaggacgccuuugaugcucucccuccaucccucccuccucccccaccuccugcaagacacagucucaucgaacauucaaaaccuccaggcuccaguagccggccuuccucagggcaggaccuuuuccuucuuccuucagguaggagugagugaaaagccaaagagggggacaggagggggggggggggacggggcuggagagauggcucagugguugagagcacugacugcucucagccagagcuccugaauucaauccccagaaacuacacuguggcucauaaccaucuauaaugagaucuggugcccucuucuggugugcaggcauacaugcaggcagaacacuguauacauaauaaauacaucuaaaaaaaaaaggcaaaagcagcauuuucuuuuagagcaaaguacaucugagaucaugcucucaaauuuauguuauuguuuccugagucucugucacauuagcagaaagauuucuggauagugagagcugugauugccugguuugcuugacaccagaucgauuuaaugaccaaacaucacaaagauggcagagcaauaaggaaucacagugcuugcacaugacccaguaaacaacuccacacccaaguacauaugggcaauaccgauggaauuuaguggguuauuuaauacuguuuaaaaggagagauguaaagucagacuggagauguguuaguggagcagaguugaagguugcuagguuggaauugggguugaguuguauauuguacauuguguacauauauaaaguucugaagcaaaagaaagaucggaaggaccgagggagcaugcucugcauauuauagagagcaagcgaugccuucagaugacagcagaguuccugaaagacauaugacagugugaugggccaauaggagaagcacaaucuuuagguucucaauccccuauuuccagugaaauguuuuucuaauaacggacuucaauauuuuuuuucaaggugugcuuuaauacccugguuuuauucaaagcauaagguuuuauguccuaacaagguagcucuccuaaauguuuguguuaacaauuuuaagcauggagauauauugucuucaacgggaaacaaauacaguuuucuauuagugcacaucuguagaguguggagcagauauaacaaugaagagacuaaaggaaacccucugcacaucuugggcagaauuaucagaaaaaggaaacacagccacacaugacagcaggcuauugcuaucacugucuccagucuccccagucugccuggggagagguguguggucugugugccuugcaaggcuacccuccuggacuagcuuugguaaagcagucuagguagacguggagggacauggcuguaaucccagcagcugcaaguuugaggcacaggacugugaguuugacgucauccugggcuauaccagauuugccucaagaauagaaacaaauguuuuuaauguuuucugcacauuuccacauaagauaaaucaugggaaaucuuuuaaguguucugauuguucauugcuucaccaguaacucauugaaagucuguggagcuguuaauuuccccuccccaucccuaccaccacgaccaauggcucuguuuucauccucucuccuucgcucugcccccacugccccacccccacucugcuuuacacucuucucuuucucaccugguuugauaauguagagacauuggagagaguucaugaaacacaaacucuggucaccuaacaacacaugucacuuugcguuucaaggggcugaauauggaaagaauaauuuccaguugagguuuucaacagcaguugucuugucuaguguuugguucauuauuaacgcauccuuccccccgugcucaugguuugccagggugagaccuaaggccaaguguccuaaggucaucugcugcaagcaagaguuaagacaagcaugcagccacaacucuugggugcugagcuuuuggcagcuucugguuagcauccuccucuagcuuuuguaauguacucucgauuuaauacccgacuggugaagccucuguacagugggcucccuuacaacaaagucaaaauuucuagaagcuaccagaaaauauuuuguuacauuuuacaaaaugugugaccauuuuucuaaagaaauacaguggcacauugcuagugguaauucuucacucuuaagaguaaaacuugaugaaagauauacuuacuaagucacaguccagcucacugcuuuuacaauuguaaaacugaacaaagguagcugcccaacucacacugcagcagcuacgacggaagucucccucaugcccaguguuuuuaauuaauuaguggacucauaaauuauuuugcaguguugagaugaguuccuugaaaaguaugccaacguaagggcagaauagauaucucauaaaaggcuauugcauuuucucagacuauuauauaaaauccccaucucuuucugauagccgucuacgcccugcacagcugagucagggugccagccuuuccacugcuccagaguucagcuuucagacugcagagccgccuuucugcagagaagccucaugaguccagccagcuagcagaaggacagccaugcagagacucagcucuguucauccuuuguguuucccaccuugggcuuucacacaagauuucuuuuggcaaaauuauaauucccacuaacgugcucgagccuuccuuuuggacgagccaaucaaaacuuaacaaaaccggaguccucaacaaaagcuccaugauuucccguccacaaacccaaggcaacugcuggcauaggugccuuuuucucuuuguaacaaaaagagaaaaaggcagucucccugugugugggaagguugaaauaggcauuucuacaguuuugcuuaaggcaaauagggcaugugcuuaagcaacaagagcuaggaaagcacugagucuuagucccacccugcauggagucuuugggaaggacccaggaugcgccccaggcuucgcagcccuaccucaccuuccucucuuucccuguaaccuaggauccccaauauuaacaucucaauucaauuuuaagaucuagugacguuauuaaagguaagcaguacucuugacucugagacaugaauauucaucuguauaaguaaaacucaaaggaaaaggaugcagugggcaucauuuauucaacccuauugagacaucaucaauaacggggcuaaucagagagcucgugccaucugcaagguugacagaggaaucacauaagugaugucaacugcgguguccuucccguguggaggcugccauguucacaugugagaaguucaagggcaagaacugggcucuugaaacucucucuccagcucagcagcagccucuggggauuugcuguaagaagucaggcaggaccugccuaggcuguaaauuagaacgacuacauuucuucuuagcaaauugaacacauuguguguauuacauucucgaaaaaaauuauauuacuguauaauuacacaugggcuguagcauuuucaauuuguguguuuuaaucauaaauauggacauuggccuuacuuaguuuuaaacgaauuuaauucagcaaagcuuuauugauuuucaaauuucccuuaucagaggacagcuaguaauuauagcacucuguaguaauuauucuaugucacgccauccccuuuggaacaguagcuccaauuccauggcucucaacagggagcauccuucucccugucccuuaccaggaacaacuuggucuaaagcgagguagagcaugucaugauggaacagauucuaaguggguuugcugcugauuuaaauaauuuauuguauccagucccuucuuagguaaaaugguuuaaugggaaaacauuuuuaaacugcaauuguuuauuuuauuuaauuuguuuauaauacuaaaacauguccagauuuuaauauucuacguuuucaguuucucuguaaauaauguagaaauguccaguaagccugaguuuucucuaggguauaaugauauagcuaaacuauauauacuuauagcccaucuuucuuuauggaaaguauguguuugcauggauuuauuuuuaguaguuacaauauuuauuaagagcaaguuaauugccaaacaguuugccuguugcuguauuuaaguuaagagauacaguauaauuaaggaaaauucugcccuccaaggaacucagaauaacuucagagauaguaccagcagaagaaaauagaugcagaaaacaugagaguggaggugaaggcuguaaauuauuagcgagccgaagaagucagagauaauguucuucuauucagacaagaguacacacuaaggcuuuaagcccauauacugcuaauuuuaaagcgguuaggccccugugguccuagugacuucugacaacacagacuccugucucuguuuaguuacauuuggugaacuccaucacguauagugaaauaaguuuucagucuacuauucacgcuucacaguuuuacauggcagaguaugaaagaguacauuuuuaauguguauucaaucuuuauuuuuagaaaugcuguauuuuucgcaguugaauuaacuauucagugagacaaccugagaacuuggucuuagcauauuuugggaugucuaauauaguacaguuuuuaaaauaccuuauauuuacugauuuuuguacaggcauaaauucauuuaaaaaucgcaagcuucaggucuguuuacagauucaucuugauguccacuucaggaauccaagugacccaacaguucucucuuaaggcaaaguaggcagcauuuucuucaaguuuuuuccccucaucagcuuucuuucauucauugaaaugcauggguagggauagaaauuugaguuaggaggagguucaguaagugaucugcaaagaugaagaaacaaccauggucuuaguuuuggaaguaaauggaguagcucucgccugaacaagugaaugaguuugaaagcugcacaguccauuuggguauuacugcucaugaaauuaguugaccaguuccucaucaaaaucuacaguccugagaaaggucccagaauucuuucuucagccaaccagcugggaucauugucuuaauuuuuuuaaaaaaugucuuuauuuuucaagaucccuuuuuugacccaacaaguggccaaguuccauugccuccugccaggagagcagcaggagacagcggcaaagccaacagagccucgcaggacuaugaccagcucccuucaucuuccggugaguuggcugagaacaguaacaauauuguccuguguuuuuacagcgccuuuucucuguagccucugccuuuuguuuauugcacuauaccuaagcauucacuuacuguccauguccuuaguauuuggcauguaaagcguacauuaugaaaacaacacucagaaaaauaccugggggaaagaagaagugaggcuuacuauucugagugaacagucaguaaacucacagucuuuauuuugggaugcauucuuucuuuugauuuccuuuucuuauccagauaauauccuugagcaucugcccuuacugguuuuuuguuguuguuguuguuuuuguuuuguuuuauuguuuuuguuuuuuguuguuguuuguuuaauuucucauuaagacugacaacucucuaaaauucauaucaguaacaaaccauguuacuguuaauuguuuacuauggguuuuuuauuguugcuuuuguugcuccuaauguugugguucguugauugauuaguugguuggcugguuugcugguuggcuggcuggcugguuaguuaguugcuguuaggguuuuuuuguuuuuuguuuuuuguuuuuguagugaagugugggccuuuuuuaucugcauauuaaucccuuuccugagaguuccacucucacaacuuacucagcuacuauaaaggccugaagauaguguggcccuaugccuugcucuuguguuuguucuucaggccuuuauccaacuaaccaagcaacaagccacagcaaugccagcacuuggaagcugagcaggaaccuuacaccacguuuagcaacagacugagcuacacaguggcauaggaaagccaagaccaguguggccuauguagggaaaccccaucuccaaacaaacuacucaagugagacacaaaaguauuccuguaucucaguucuccuucuggaugcccaacgcauaaauugauggggaccgaaagaagaggugcuagauguaauaguugcauaaugggacucucugaaucauugagcugcuuugaguauuaucagcacuguacuuuuccauagugcuguguaggagaugcagaauucuccauaaaaccacaaaaguguuaacacuuguauaugaccugggaaagcacagaauaguuuaacccuuucagauuuugguccauguugucugccugaucacauggagccacucagggcuuucagauccgucuguguauagacuguaguuccaaggagacugacaaagcauggaaaucaaggagggaaaauaucugccagccccaugugacauaagaaagcaaagccauuacugaaauauuguugaaguacaccuuuggccaaaacaccacgucugacuugaaauaauauauucagcaccucuaacucuuaaaauaaugguauucauucacaucaugagucgagucaucacuaaucacuguuuucacagguucuucucugugggcugcacaacaugcgaguauuguggggucaauagcaucauucaugugcaggauuucgaguguuauagauugggguugacauuacaauagaaacuucaagagugcuuugacuugcaaacagagaaacacccauauaacgggacuaaacuaggauuuacguaagaaauuagaaaauaauucuaauaaucagagccagcuauagcaucaaguauuucauccuacuuccuaaaccuuuucuaacacuagcaaagcaugggacuggugcccuguguuacacacuagcaaagcauggaccaaugccucugguucugaccuguguuuguuagcaagaaacaugcuagguuuugguugguugguuggguuggguuggguuuuuuugggggggguguuuuuuguuucuuuguuuuuugguuuaguuuguuuuuuuggggggguuguuuuuuuguuuuuuuuguuuguuuuuuguuuuguuuuguuuuacagauacacaucuguacuagccucugaauuaggaguucucauuuuaaaaccugaccuagauacuaugugccuucacagucucuucuugucaaaggcccuacuaaauggccuaacaaggauucuggugugauugugaacucuaaaaccaagaaugucuaucaucuuucagagcuacauaaauaagugauaguagcuuacucuuccaugaacuaugaaaagaacaguucuaaagauucagaaacaguguuaucaauauaaaauuauguuccuuguucaucugucaaaacaucaugugcgcaagugcaucuguauagcugcgaugcacuucaagugcauucauuccucucaaaggaaguauuucauagauuuaaaaaagugaauguugccaucgauauuuuuaccaaaugauugugugauaaaacacauuuauaaaaauaaaaauaaaaauuucacuggcuuauuuuaaaaaucacauacuucuggguuggggcaacuuuccugccaguaaucgacuuacucuuuauacaagcacauuacucacacauagcuugugucacuaauagcuauguguaaguuuuauaaaauuuugaugccacuuuccaccuaauguauauugugcugcaguuugaauuccuugagcauuccauaaugccuguucuuacaugcagcauuacccuugaaggagauuauucauaucauuaguaguuaaaagguacuucaaggacuugaaacaaugcuaagaugucugugacucacaugaaaggauuuuauuucugaauauacugacaaauuaaggagguguuguuauaaggggaaugagcugcagugcuguguccuuuguuuauuauuggcuuaauggaaaauugaagggcuguugaacagauuguuauauggguaauggguuuggaaauuucagcuggaaaucagagcuguaauucacacaagguguagagaacuguuuaaguuauugguagucagugauggguaguuugccauuaacacucgguucggauuccaggaugggaaugucagugucguugaucucuaccaguucagccgguaguugaugccacuugaaaaccuucacacacagcuccaguuuaaaaccucggggcuggagucuuuuuucacaaagaucugaaacagucuugaguucugcauucuguguauucuaagcacaguuaugugaagauuuuucauguguucguguuucacugaaaacuuuaugugaacucacaguguccagacuaauucagcaacacaauguaaauaggcuccaaaauuaauuaacagugcauauauuugaaaacaagauuguaauauauuuuaagauuuuguucauucuuuauucaguuuauuucauauuauuucuucuaauuaucaacuauuacaaaacauaagaaacguaagaaaauuauuggucaaaggguguucaugcuuauuccaagaauuguaugcauuuccuauaucacuguaagucuauauguaacuauauguacauguuauauaauauuuaauuuauuuaacauuuacuauaggauagauaacuauuuuaggaggcuagaaaugagaaucacauauaucauuuaguauacaaaguauauuacacacaauuuuuucuauguagauacauaguugauauuuuacauaauguauauacuguuauauacuuuaaacauaacuauaauauaaaauauaaauaaauguguacagcugcaauaaguuuaauuuauagauuaaagaaaaacagcauguuuuacuaaucugccaaggaucccacaccaagugucagcccaauaaaauauaaguugauuucaacaauuuuuaguaagguguucaaacauuuauucuuuuauuguuaaugaaguuuguguugugauucccacaguagccaaaccaaaaaaccaaguuaggacauaauaaaaaauaacagcuuuguguaacaaugguugcuaaagcauucguggaucaccuuccuaguaaaacagaggaagggccaugaaggacgagcagugaccauagaguaguggaaggcaccggaagcagugaacgccccaggaccucggcagcgccccucccugggucugcuacucucucauaucagacgauccucagcaucucagucuugguucaggagcagcucgcgucgucuguuuagcuguggugcuguggaucgcacgagcgugacauacgcauucagaaacacaauguaguguagacggcagcgguaagaaaggaaaucacuuagagcugugccacgggggugucccauggauucccaguugguuucguuccgugguaagauguagggguuggauuucaauccucuccaugagauacuugauuuccccagcaccauggccgagacaucccuuuccccguugugugacuuuuagugacuguaagaacuggcuggcggcagaugcguagguucugaaucucgguuccaccagccuccgaguccguccuggugccguggcucugugaugcaucuugcagugugguaugggaagccuccagcucucugcugugcguucaguguggccuuggcucuuugagauccccgagcuuucggguggauauugggggaauccacagauggauuugaaucuauagaauaauuuauaaauuacagacauuuuaucaguagucuguugguccauggauauggagaguuuucauuuuuguuuuucaugucaguuucuuugauuauugauuuguaacuuuaacuguagagcuuuuacuucuaggguuagguucaucccugaauguuuuaucuguagcuuuugugaguuuuauaucauugaguuacuacuaauucuuguaugugagcucugcguucugccacaccauugaauuaauacuuacuaaugcuguuuugguggaauccucagguuuuguguacaaaaaucauguacgcacaaaaucagucacacgaaguguccauugaacucccuucuuuauuuguauggcuuuuggguuguuucuuguuaagauguucgguuugaaauguaugguugguucugcacugaguaaccugguggcaaugggcaacugaacucagagaaaauccuugcagcuucucuccauucacauuaaugccaucuagggguuguacuuaauucaugcuguguugaggggcuuaaucauagagaaguguuaagugguaucaagugcuucuuguauaucugcugagaucauauggucauaucguuuccauauuuuauugucaguauacacauauguguauugauuuccauauguugaacuaucuuuuaacucugagaaugcaaccaacuugaauaauagugaauaaacuugaguccuugggaugaaaccagugacuuacuagugaguuugauuccaugaaacuuuguugagaauauuuguauccguguucaucagaaauauuaauggucuauaaguuguuguuguuguuguuugcugcugcugcugcugcuguugcugcuccauacuugucugguuuuggaaguuggauagugcuagcuagguucuuggaaaguuuucacuguugauaaauugcaaaaaauccaaugaaacgaaacuaggcaguuaaacaucacuggugagccuccuggcugugggcucccggugagggacuucauuggugauucaaucccauuaccaccauuguucuucccagauucuguguccucuggauuuuccuguguguuggcauaaguucauaggggucucuauguuuaccuuucucuggcugagaccgcaaggcuuccuuuucccuuucugaccauaccuacuugcuuucccaauuaaccugucuggaagcuuauccugguuaaguuccugaagaacaguuaaugguucgacuaauccuuuccagcacuuauuucugcuuaaauccuuguuguuuccuuccauagacuacauuaggcuuaaguugguuccugguuuucuaaguacuggacaucaccgggauauguauuuacuuaaggguuuugggagucgguuugaguuuugggguuuuauucuuuguuucuucuuguuguugcugcugcugcugcuauugucuuguggguuuuugguugguugguuuugguuuugguuucuuugcuugaugucccuguuucugcacccacuucccgcccacucaugccccgugaagauacucacagccuguguuuauaccuuuggaugccccuuguuacauaucacacguuuucucuauuguguuuccauuuucauuaguguugcgaaauuuuugaaugcucccagcuuucuucaugacccacuuaguuguuaaaaagaaucuucgguuucuaugaauuuuuacaauuuucagaaucuuuuuguugagucauauguuauuccauuuugaucagaaagaauagaggguaccacuucaguuauuuucaauuuguugacuuaacauggacuauucuagagaaaguuucauguuccgaugaaaugucuguccugcagcuguuggauaaagaauauucuguagguguuauuuaaacucauuuaucccuuucagaguuuagcucugguguuugcucauaucuuuaucuggaugaucuugacagaugcaggauauugacaucuugucgccaucacuauauugaaggcugucuggccuuccauauccaaugacuuuguuauauaaaaacaaacaguauucugaugauaaguucauauagauucagucauacugccuuguuaauuggcuucuuuauuuaauaacgugacuuucuuugucuccuuggguuuauuuuuagauguaaauguagcugguccugucugucuuaagcuucuguuuaaaacauccaucauaaaccauccuuuacucucggccugucuguguacuuaauaaugaagugaguuuguguuugcuugacucuggggacugauuuaacuggagagugagagaaggaaugacacacagacauacacacaaaagcuaggaucagguggccugagacucuccauguauuuauagagauuggaaggaggguuuuuaaagacagacagacaaggaagcaggguuauuauauaaaacuguaaaacugaacaaggaguugauguagcuaguguucauaggagcaguuccuguaggggaacaguucucaaacuguuuacaucuggagagagaccgcuauggugaacauuugaugcgcauucugucaacauucacauucagacccaaggaaagcuuuuccaucccugagcaucucuagggcuacuccuguaggacugaguccuuguccucgcuuugcccaaaucaaacaauacacauuuacagagggcuucucuugcucccugcagucuuaggagaccuguuauuggaaauuguuuuacucucgugugugugugugugugugugugugugugugugugugugugucuuagacuuuauccuuuuuugcucguucacugugcuugcuccauuguucuguaguguaucucuucagugagguuuccuauuuuacaugcuuucaugauggugauuacauuucuuucacuucagaacguaggaauucuuauaccuauuuggaagccgucuaugguaauccgacaauuucucacuggcagcugucuuggaaggccuugguucccuggauggauauugucaucauggaaagcauugcuuucuuucaagaaucugaauguaucccuuaaugcuuuccuggccuauaaaaugucugcucaagcauucagugucacucugauacgguuccuuugugugacuuugaucuuuccaguggaagauuuaaaguuguuucuuuguguucuauaguuuggacaguuuaauuguaauaaguuccgugaugaucuuuucuggucauguugauugggaugcugcauuuguccucuacccaaauguuuguaacuguucuaaggucaugaaauccucugcuguuauuccuagguuaucaaugagcuuuuuugccccugaugaaauuuuucucguugccuucgguuauuccaaaacgucaguuugggcuuuuccguuuugguuuuguuuccguguuuguuucucauuuacuagcaugccagagaucuugagugcuuuauguuuguguugggggcacaaacaggaugcuucccaagacacaucugugagcccaugccucugccccucgaugcggugagcugcagaccuuuccauucugaacuccucaugucuaaacugugcuugguucguucuccuuuggagucucacuuuacguuucuuauccuuguugcccacacugacuuccucauuucacucaccuggugcuugcuugcuugcuugcuggcuugcuugcuugcuuuauuuauuuauuuugagcucuaauuuuuuuccuacucauucuuuuuaaauuauuuuguuuugucaagcauuuuaucugugucucuuucuagcuuuuccuagaggcaacaugcuaccuuuuuuuguuucucaaauuuuugugcuccuguuuugaaacuugcaccucuggcuaauuaguuauuccugcuuuuaugugguagucuuauuagagguggggccuuugagauuaccccauccccagugccuuucagcucguguuguauuuauacaggucauaaguauuggagauuuuauggguacagcuuuccuuuuauauauaaaagacacugucucacagcagguguccugguccucucccucuuacaaucuuucuaugcucaucuuccucaauaaauguucccugaaccuuaggcauuuguuugauauauacagcgcugguuuugcaucuagcuggucaccaacucuccuuucuuagauucuuaugcauuugggauuagugaguuugggcacuguauauguauugucaaaaucagguauaccgguucucugugcaucccacaggaacggagacucacuagcccuuugccagguaaggugggaugggcagcagacagugugaggagcucacugcauaaauacuccugaaauugaaacagugguccuugcuguggcuugagguggggguggaaucaacacaggcccuguggguguuaauucuacuuaauuaauuaaguuaauucaguagauguugugcuuuuugugcagcuugaagggacugaguuuggauucccagaaugcguuugaagccagguauauuagaaggcaucuauagucucagccaccuacagugaacugggaguaagaaacagagaaucuccagagucuuguaggccauccagccugacguaugcagcggaacaagagacgcugccugaacaagguggaaagcaaggacugauccacaguugucuuaugaccaucacaugugggucauggcaaguguggacccacucucgcucucacacacaaauauagacacaucuacacguacugcugcccacauauaaaagaaugaauuaccuucaggguccugcaccauaagccagucuccugcugaugcuuuuuuuucccucuguuugcauuuucuuggacaaaaaugccuacaucagaaucuaaaguguuugcuugagcaaaaccacauugaauuugcucaaccuguugacugacagagucagaccaucugcggguuuuguuucccuuuuccuugguauaaaugaagugcagcagauuaacuuggaaaaccagggaggaggaaacccuacacugaauuucguggaguagcuccuccaccagagcaugagcaggacagaggucauuuggggacuauucugcacuuuuaaaauuuugucauugggaugcuuaucccucugguaggaaccucucaacuccauccuucuuccuccuucuucuuucuccuucuccuccuucucuuccuccuccucuucuucuuccuccuucuuccaggagcuacagucagugccacaguugagaaagauauaauaugugacuaauccaaucuugucacuuuuauucugaacuucaacuguuauugcacuaguuuuuuuuguuuuuugguuuguuuguuuguuuguuuuaaagcaacucuuuucuggccuaaaaaguaaaauauggaaucagaaauuaaguauuaguuuucagucaaacuacuacauucucccccuagauccuaauuuuuaaaaugaaauaacauuuuccauucugcaauaaguaacuaacaaauaaaaagaguuggagagaaaaugaacaauaguauuuaacauaaaauaaugacguaacaauauugucuucuauaguguucauuuuuaucucacuguuucacugguaucugucuuugacaaucuccacagaugguucgcaagcaccagcuagaccccccaaaccacgaccccgaaggacugcaccagaaauucaucacagaaagccccaugggcccgaagcggcguuggaaaaugucgaugcaaaaauugcaaaacucaugggagagggguaugccuuugaagaggugaagagagccuuagagauugcccagaauaacguggaaguggccaggagcauacuucgagaauuugccuuccccccuccugucuccccacgucugaaucuauagcagccagaacugcagacaccaaagggcaguuaacaaauauuccaggaguaugagacagaaggacugagagggaaugcaggagccacggugucuuuccguguggcuuccccagaaggcagccuggaguccagcuucucugguuccacagcucucuuaggaugcccacacugaagcuucuguguuugugcuagccauacuuugaaaucaggguugaacugauaaaauaauuuaaagacguuuacucccccuugaacuuugaaucugugaaaugcuuuuccuuguuuacacguuggcagaauugcaguuugucucuguuuuugaucccuguacuguguuccugacaggcccuuugcagaguugcucaggucugcuguaaguuucuccaugccugcccuggugcccacaucagaggcuaaaccaucucuuuguuuugcucucuauccgggccccaccucauguccccagccagguccaauuccauuucucccauucacacggcacgcuagucugaagguccugauuuuucaguguuucaaacuaaugcagaaagaaaaaggaaaauguguguggucuugucuucacuacugagucuuuucuuugggaaccaucacuguugagaggugggggaaaaccugaauguaaaaagcauuuauuugucaauaaacugccuuuuguaagggguuuuuauauacuauaaaagagcuucucuuguuaguuuaaguucugugaccuuuagguucccgaacucucccucucauccacccaggagugucauaaugcuguaaaagugacugcugcagaugcagggaaaacaggcuugcaggagacugcuuguacuccaguaccauaaugagaugcccugauauuaaugccugcaucacuuucaggagagauggaaaaggggaccaccgccuggaaauauguuaauaugccuuuagauaaggucauggacauacaugccuuucccaaguggaauagagcccauuuucuauuuuaugaugucacccuggcuccucacagugugggagcccccuaaggcacugacgacuguuauguaucacugcaacugcaggccuuguaaguugcaaaacucuuaguacccuuucuccacucaugguaggaguccuguuuacucuguggguuuuguuguugacugcucuguguugcccccauccaggcagaugaaacugugguuacuucuaaucuauggauaucuuuugaccaucuguaaugugcguugcacucuugugggcuuugaaagcacaaacucucacacauggacuccaucauauuauuuguguagaugcguuuggugguaaaugucuccagucugauggaugaagcuuccaagauugguguaaggacuuuagaccucuguggcaauuucagguuuuuggguuggguuggguuagguuggguugggguuuuuguuucuuugguuuuuuguuuuuguuuuguuuuguaucccuaauaguggggggaaaagaauaaaaacuaucucugugcaagaaugcuugaaccacauuuugauaguuucuaaacauugauuuuaggcuuguguggauguuucuuaccacucguuacuccacaccuagucucacauacagagaugccucggauaaucacuuauccugacaaaugacaagauaguaaguacaucagacagauccgauggagcugccauuguacaagacucauggacaaagcuguguuuguccaggaagggaacccagcacauucuuuuacaguuuggcuuuuauggaaugagacaggauuugaggacucuuagucugcauauuuuagguuuguuuggauggucuuauguugcuucugcuaccagagguguauuuuuuuuuuuaauguuuucauauccuauaccugggaggagguaugaauacaaguuuuuuuuuauacuuucuacaauuggcuauuuguuguuuucuuaucugcucuuacuuucuguacuuguuuuauaaguucugaugucauacugauacagugcugugucuguugggcuucauguagcuugccagcaaucagcauagccuaauaccuagaguugccccuuuguuguccuuacacuguuaaaacauccuuaaaggaggaggggguagguuuacaagaggaacccugggacccacagcauauucaccuccacucucagaaaguacaagagauuuuccuccagaauuuaaaagcuaaggaugugcugacacaguuuuuuggaaccugaaguuucggcaggguagggaaguguaaauaauuuucuggauuguaccaagaucccuacugcagccacucaguagccacuguugguuuucucaucaaggaaagugaaucuuaggagucauauguaagacaaagcaaagagaaaaugggaaaacucacaaaauuuauuugaaaaaaaaauguugaaauuauuuuucauuuugaaagggacuacuaguuaauaguugcuaacuaacacaauguuccacacuuuguucccucugauccagaaauugaggugcccccccaugcucaagaucugauaauagaauuacccucaauccaauaucuuauauagucugcacaauuaaaacaaaccauggcuaauuguaaccccuaccugggauccaucuccaaugauauuccagucauuguuuuucuagaaauggggaguuauuuuuuuccuuuuccuuuuauccuccccaccccccacccugcaccugacuucuugguaucugauauauaucacagccaaauuuucuggacacaaauacuggcauuuugaugcuuaacuuaucauggucccacaauuccaguagauagcccuuuuccacguucucccucccuacaguacaacagagcccuggcuacaaccuucagaagucuguuugcuaacucaguauuucacacacccaggacacaugcagagcucuucauaaugugaacuuccuaauuguucaguuccagaagcauuuccugcaguuugaacgugacuuugccucucggauuuucaacuugaagccuuaguuugcacugaauugucucaucugguuuuaaaaugucucaaauggacugauuuggaaucaaaaugugguauauuuuaaauauugaugcagguacuuucuguaagccugaaauguugagcuucgaaggagacuuucuggaaaaagacagcaauagaaaguuuucuucucaguuccuauuuuuauuguuuugaaaugcaguuuuuacgacuugucuaauguggcaaaauagcuauguguucaauuaauuuauauuuuauucuuuuuucauuucuggauauguaacaaaccucaaguacuuuaucuguucuuuuaagguauuuuauaaaaugaauguuaacaaaug

SEQ ID NO: 8269 - RNA, 2382 nt, Mus musculus
guuguauuuuuuuuuuuuuggcaaucaaaacacuuuauuggcagaauaaaaaaagugcagcaugggaaaaugauauuuuuucuugagggggcauucagcaugcccucuguuguaggcaggaggguguaaaaacuggcuaucagacaaaggugauccguguccgagaaguauuaaccugccagacguuuagcuccucauauucauccagagcugccuggaacugggcuggugugaagccaugagauaugcagcgcuguuuagccucagaaaaguggacacuccgcccccgugacaccaauucacggaugguggcaaauaucauaucugcuggccucuggguccuagcuguuugucccuuuucaccuagaagggaguccuucgacaucuccaucaaccuuauggcuucauuuacaucuuccuucuccacaaugucuaccauccgaagucgagccagagcaguggaaagucggagaauggccagcagaguccgggcagaaguauagguggcauccuuacuggcucgggccucuagccucaucuccacauaugcugcagugauguagucagccagagauucaggcacugugggcugucucucguggcacauagcuauguaccgucucauaaguuucauguccaaaaguucaaauugggcagggggcuaccggcugugcugguggacauaggugaugugcugggccaaccggaggucauugucucugucgggccggucuugaaucagccagaggaggucgaauugagaaagcagagcagcuggaagcuggauguucugcuccagacugcggcggggauuauaucggccauaggcaggauuggccgcagccaggauagaacaucgggcauugagcauggugagaauuccugccuuggugauggagauggucugcugcuccauaaccucauggauggcugugcggucagccucggccaucuugucaaacucaucaauacagcacacacccuggucagccagcaccagggcaccacccucuaaagucaguucuccacucacagagucucucaacacagcugcugugagcccuacaccagaggagccacggccuguuguguacugacuucggggugccagacggucaauguaagauaggagcugagauuuggccacaccagggucucccauaaggcagauguggauguuuccucugaucuucaugccuuaaggagacugguccacaccacccaccagaagcagcagcagugcuuuccuuacaucuucauguucauagaucuccggagcaauagaagcagccagcuucucauagaaauccuccucugcaaucugcuucagcuccucugagcucagcucuccggccccagagacaucauauucacucuuuguuaucuucacaauccagugggcuuccagguaaguuucugagaguaagcccugugccaucuguuggaauccugugcgcaggacuggcaagaagaugccagugacgcugacauggucaccaggcugggcaauucuuguguucucaccuucuagaaccacugugaugcuccgaggaauguuucccacaggaacuuggucacuauguucuugaaucuucauuuccuggaauuuaacaaauuuggagccacgagucuguagguacagccgccccccugagcgauuggucuggcacuccuggcuggggcacaugaucagaggcaugaaagugggagacuggauuggcugguaggucucugccccacgcugaucacaaguguauguggccaccaccauccugggcuugacuucagacacacgagugacaaugccacgcacaguuaacaauuuccccacagagucagcucguacuucccggaucacucgaggcuugcugcuacuugggcuucagaaauacaacucaaaucuucgcaugaguucagaagaauacugguuuuggggguuccggacugccccagggucucugcuucgcugcuccaucaucagccgguguucaauguaaacaucuaggacauccuuauucaccaccuccuucuccuuguacucaggcaaaagcucuugcacaacaucaccaaacagucuugaguagcgcuuggcauucucgcaaauugagucgaccaacucagggucaucuucagcuaugucauccagguccacauacagugccacuuguucccgauaagccagaugaaccaacugggucccauacuugaacugcuucuuuccaagcucauucucguaauaaaacucuuggaggaacuucuuaacuuuuucuuuuuugaucgcggaguccuuaagcaccaucgcugcuggggacgguguggcaagacuugaagggcucaaaagucucucucuggggaagcagaaaacgaacacgcggcgggacg

SEQ ID NO: 8270 - RNA, 1929 nt, Mus musculus
uguuuggguuuuucgagacaggguuucuccguauauuagagcucacuguccuggaacucacuuuguagaccaggcuggcucgggacucagaaauccaccugccucugccucccagugcgccaccacgccuggcuguaacaguuccuguuaccugcaaaugcuuagauggaucuuaauuguauuggcaacauucuuuuuauguguauucucaagauuugauucaaauaucccguuagcgguuuuuuuuuuuaaaguacaaaggucaugaagccacacccuguacaaaccuguaucugaaucucuugggagaaagaugcucuccauuuuuacccuucauuuccuucauagacgauggaaacacucuaaccacugucugguuucuugagcccacugccaccugcuugcuccuuaccugugguaccacaaacguuuaaaagcgucauagauaaugugugugucuucuaggcagaaauaaagaaaaauagcuucuuuaacuaaagucauuggguugggaagccuggaaccuucuagcuucaaggaauaagcacaaagcguccgggcauuacaaggaaacgggauugagaguuacuucugcauguuauuuaaucaucuaagcaaucuggaccugcauagucgucaccauggugauguuucuagaaaauuacuuagguaguuuggagaaaauucguaacacugaagcacuuaaugcucgguaauacugcgacaguauuuggcccagaggcucagacaguggcaaucaauugcuacaguuucaaacucggcgguaucugguauaucuagucucagaguauacagaacaacugacucaguuaccguuuacggggagggucucagggaaacaaacagcgaaccgcucaaacacguggcuuuacagagagcgugggaaaggaaagggagggcggugggggagggcccugccaagacuuaagaugucugcugaggacccccguaucugcccgagagagcgcguucccucuuccaacauguccuccgcaguguugacgucacaccgccggcucccugggagcgcagagccguagcgcgcuccaaucgggguggcggccccgccccgcucccgcgcgucacuuccgguggugcagcagccauuuugucagucgccagcggaucccgcgcgcugccgaagugcaguucccccugguuaccagguggucgguucuuccccuccgcgcugccggcgggcgggcaggcgggcgcccucggagagagagagcgcccaccacaggcgucgccuucgcuccuccccgggucgccgcggccccucucccgagccgcggcgcugucugccucuccuuaccacugacaggcgcccccgagggcgcugccggcggcuaugucaagcgaggagagcuaccgggccauccugcgcuaccugacgaacgaacgcgagcccuaugcgccgggcaccgagggcaaugucaagcggaagauccgcaaggccgccgccugcuacgucgugcgcggcgggacccucuacuaccagcggcggcagcggcaccgcaagaccuucgccgagcuggaggugguguugcagccggagcgucgccagggccucaucgaggcggcccauuugggccccgggggcacccaccacacccggcaccagaccuggcacgaccuguccaagaccuacugguggcgaggugagugcgccgggccccgggggccgaggggggcggcucggcccggccugcgugcgcacccgcgagcccucaagucuggggaccgggccguauccuuagcccggaggcgugcgugcguccguucggcugcgcggcaaccgcgggacccagccgagccaagcggagcagagcgggcuggggacgcgaaagcagccgcacuuccccuacaggaaggaggcccgggaggcugggggcggacccucgcccg

SEQ ID NO: 8271 - RNA, 5217 nt, Mus musculus
uagcugucuuaggaggguuuuuauuacugugaggugacaccaugaccacagcaacucuuauaaaggacaacauuuaauuagggcuggcugacaguuccaaaguguuagccuguuacugucauggcaggaaggauguuggcagguacagugcuggggaaggggcugagaguucuccaucuggauccacaaauagacugacugccugccgcauuugcauggccugagaucugaaacuucaaagccaaccuccuagaagugaugcacuuccucuaagggaaggaagccauaacuauuccaacaaggccauaccuaacagugccaauccccaaggaccuaucugugggcaucacuuuauucaaacaacaauaacuucuaagacguauuuaaaaaccauguggcugaagaaacaguauuuccuagaaaugcuauccauacaauaaguacuauguauuaaccagguauuaaugucagcuuuuguauucauguguguauaugccugcaugagcuguguuuaccacauuucauacaggugcccuuagaguccagagugugucagacccaccagaacuagaguuacagggguugcaagccacccaaaguggugcugggaacugaauuuaaguucucuacaagaguccacugagacaucauucugguccagacacauuuucuguccuaaaaaauugcuuuuauuuacuccaaacucaauuuucauaguauuaggauuuccccuaacaugcuagggaaaaccaguuuuuggacaaucaagauuauguaaugcaauauaccuuaacuuagugccuggaacacaaccaauguuauauacaggcuuuaauuucauaauuagagcuucaaauuuuaaaagcuuuaaucuauuuccucaugaaagaacaguuucuaacauggauaaauaaagaguauguauaauggagccagucauggugauucaggccuguacucccaucauuugggaaguggaaguggagaauuaggguugaaccuggcauaggcuacuggagacgugccuucccucccccaaaacaaaacucacaaaacaacccaaaucaacccucaaaccaaaauggacaauaaagucugauauucaaagaaucgauuaaaaauaaauaauauuaacuuuuauuguguucaauucuagauuaauuauaaacuugauuguuuuuacaacaaauaaaacauacuuucaaaguuuugcugauacauacgucuagucuggccuugauggaggacaaggcuacauggaaauccuguugcaaaaaagcaaagaagaagaaaaaauaggcaaaccucuacuguuagucuagagagacugacuuuaagagauaauuccauuuaggaauaacuacauucuugucaccauacuuucagccuguuuucuucuuucaccauacuuucucacuuaggucaccuuuuccacgugcgcacauuuaaggagccuuuucgaaaugaauuuaaagucuuugucuucuucaguuuccuaacaaguuccugagauugcucagaaaccucuaaauaaccaguaugcuuucuccugggaacaaacuugagagccucuucccaguuaccaguguuuuucaggcagagcaaaauucggaucaucugaucuaaggugagauuuuuguuaccaauuucccauuguaaauauuuaucuaguggaaggcacucuguugcuauguuuaaccguuuggccuuggcuaaggauguuccugucuguguauuuuuaucaacaaaugauccaauuauauaaauuuuaucaugcuugaagguagucauaacauugggagaaucugcaguuaaauauauaauacuguccuuuggaaauaaaucaacaggagacuuuucuguugcuguuaagagcaauuugucccauuuuucucuauaacguuuaacuaauucucuaugauaagcacuaucuauuuuaagauugcagaaauaaauguggaaaggaucaacauuucuucuguuccauccuucacuuucuaaaaguugagaaacaguauucugcaguucacuugguuucauguaauuaucauaggccaugucaaaaaccaaaggcuguccaaacugcauagccuggacacccuuccaacccagugcaauguugaucugucgaucccauagucgaagaaacaugaagucuugcuguuguucuucugcgguggucucuagcaaccuggcccuuuuugcuucuucccuggccuccgcuuucaucuccuucuuuaccugcuuagcuuuuuucgccuuuuccuucccauacagauaccguaaguauuucuucuuggcugauuuagaggcacauuccauaaggguuuugagaucuucuucaguaauauguucugguacuucuuugccaagcaaucuccacaucucaauuaguucucugguugaggcgagggaaucuucaucuuugucugagaccucugaaacaccaucuucuugaaugcucgacuucauuguagcuuuccacccauccaauucuagcugcucaggaggggaugcacuguccuuauuaugacaagacaaagaaggugcuuuggaggacauguaucucugcagaacuccugaauauaaaugacuucucuuccuaugaaagguauauggcaccagacaucuggcaaaaggucuuaagaaacggacagucacauucauuuugaagaaaugugaggaacccuguaaaagaagaaaaaauuaaguugaagauuuaaaauuuuuuuaacuaugaaacuggucaccccgcccugcccucuggcagacuggauaugagagcuacuaaugaaugauuggugagguauaggccucagcucagcaggagcagaagccuuuaugaaaacugggucugccauaauuggggauauucugauccuacacucaccagggacaggccacuucucagcuaccauggcuuuaaauuuaucugcacuaaacuuggugaagccccauuucucuaggcugaagauuuucuggcucucaggaaagcugaaguuggccuuagucacagucacacgcuccuuacucugcagauugguauggagagacuaaccaaucaaugugccacuggucaccguggccccaaacacucguauagagccuagguugaaauagcauugaaaugacacaugacugcaccugaagacugucuccaaggucccuuugggcagccugcacauucagcaggcugcauacacuagcaaggaggaugcuguuugcaaccauugcacaccagacuccuaugaggaaaggaaccuggucggcuuaauuggcugcagaaggcaacugauuucugaaguucagcgggaaaccuuugaaaaucuuagacauugcacaccaccaagucaacugcuaagcugcgaucacuuacuggucaauuuuuuuuuuuuuaauuugugagacaagggucuuguuaugcuuggugucaaacucaucaauuuaagugaucuggcacuauagcugugcagcaccacuuccugcuccacgugauuuuauauaguaauuucaacauauucuuaaacaaaagguugacucaaauuccucuuuuagcuuuguuauggaacgggccuaaaugagcaauauaauaacacagcaaaguuauauggcaauuauagggcugagaacaagacacuauaaucuccuucagaugcacauccaaucucaagauccuuuaugaaaucaacaauggagacaaaaagcaggaaaguuacggaagaugaaaccugacuuaaaaacaaacaacccuaaagcacugcccacaaaugccuuugcgcuuccacaacagaaaugcaaggcagcugacuaaaacagacaguaaaugucucagcucagacuuuauagcagacguuauaaaauaaaauauacaaagccaggacaaauauauaaaagguucuauaguuuuaucucaaagaacuagauguuccacaaaacagcgaaaacacuuuguuugagaacuuauguaaaaugugagggagaaggaaaauucuugaaaaaucccacccaucuuuagcuucuugucugacucuguauacccgugcguguccucugcuccaugcaaaugcccggaugcacuccauuccacagcaguauaguccuaacuauguguuccguugagauccaaguucacucaugugguuuaagcggguuuuugcaguaucacccuuugcuugccugccuuuucagcugcacaucuucuuuucccacuuuagagcaaacaauccuauuaguuuuucagagcacccugugccuaugauaauacuuguuuuccccaccagaaacuaaagacuauauuccauuaggauaagggcugugccuauccaguuaaacguggccagcuuagucuacauauugaguuccaugacagccaggaauacuguaagaccgguaucaaaaagcaaaacagcaaaaccauucaaaaacaaccaaaaaauaaaaacugauaucagacuuugagaauuauuauuuaacuuagaauccucaggaccugaguuugacaaaguuaucauccuggguaaggcuuauuguaggccuuccagcccaugagacccuacuuaaaaaaaaaauauaaaaacaauauaguugauuuuugccuuuguaacuaguagaaagaaauuucacaccaccauagaaauuaaaaacaaaaacaaaaguauagguucuccacucuuuagcgccggcuggcaaauucccuuccagacaauucuccugccucugccucccgaguccugccccaccacacucacuauaacaaccaaauuuuaaaaauauuuuauaguaaaguucugugugugagucugcgaaggggguaauuaugugcgcgggcauggcgaugcccggagagaucgaaagcauggggagcaccuaggcagagagacagaccccgacgacuuacacuuuaaagcgcgacacaggagacgaucugggugaacgcggcuuccgcuucagguagcgccgugccuaacgacuccuacagcacggcuuccucucgccugggguucucagaggccacguuccacgccccgcauccuggaaagccagcggguccacccagcaccccagcaccggcagagagaagcuccgcagguacccagacugcggccggcggcugggcugcaggacuccggagcagauccgcgugcacaccgcggccugcacugcaccgcgaggguuuccgccgcggccgccggaaguccggcaccaccggaugucccg

SEQ ID NO: 8272 - RNA, 2882 nt, Mus musculus
uuuuucgguuuuucgagacaagguuucucuguguagcccucgcuguccuggaacucacuuuguagaccaggcuagccuagaacucagaaauccgacugccucugucucccaagugcugggauuaaaugcaugugccaccaccucccagcucuaaugaugguucuuaaaugcuuuaaccuuuauuguaacucaccacccaccagagguaguggaacaggaacgagaugggggaaauggaccuauuuagaaggauucugugaagcaacuccugcuguguuguuuagauaucggcaguucacuucacagguuagcagguagcagcagcuugauccacucacaaacaccucauugauacaccagcaguucaguagagucugguuagcaacaguggugacacaaccuagcaaagacagccgagccuuauccucugcuugagucagcaggaggguccaacgggaacaccagaaguucucagcugugccucucagggaagugaagaucugugaagacaggagacccacaagcauugcacagcuagcuguaccagcaagccaagcucugccuccaucacucaguggaguccuauuuauacccuccaaacaucacguguccacgugccuugccucagcacaugcauccaaugagccuuggaagcggcaagaaacugcagcacacuaccaggaguuuugguguuuuucucuauggagucccgacaaaugcagcuuaacucugcaauguaggguggagcaauacaugcaugucauuagcaaagaaucuuucaucacaaguccuuucaccugcuugcuuuaguagagcaucuucucuccugggucugcuucaacaaaaugucuuagucuuucacacaugugucuacuuuaacaaaacauuucuucacguguuugccccagcaaaacaccauccaaucgacuuuccaaagaacccuuaaguucucacuucauauaguaauuauauauuaaugcacuauauauggcauauauacacauacauauguaauuauauauguacucuuauauauauauguacuuuugaguaaacauaaaacaaugugauucccuaugacuuuuaaaaauauucauagugccauuuaucuguccugccuuuucuucuguauugcugucccccuccaccagagaaagguccucaaauuuccucauuuccccuuucauagcacccauauucuaucacuccucucucuagagcuccuccaccacuauggcuccuuuuuuuuagaucuuagcauagauuuuaaacugaacuuaaucuggauucucacuacuuuuggcuuugugaauguucucauaauuuuuacauauugauucaauauagacauugauuuuaauauuauuaaaauauugcuuucacauuuuaaauaacaaauauucaguuuauuuuuaaaaaauaauuagacaaaauucuguguuuuuugaaaaaaaaauuauuucuuuuucuuuacauuuaugugcgcuugcccacagacaccaggagaaaguguuggcucuccuagaacuggaguugcagauaaugugauccaccaugugggugcugggaacaagacucuagucaucuacaagagcagcaaggcucuuaaccaccgagcuguaucuccagcuuccuagauuuaaaaacugaaugugagguuuggugguaaaaagaaggaauuaguuuuuggaauuuguaaucuaugauauaauaauguaauacuuguauauauuucauuuaguuucagcucucaaaaaauucuuuuaggguugguaaauuguuuagaaucagaauaacuuuccccuuacuaugguagugcuuugauuuuacagccuauaauuaggaauucccccucccuuccuuuuuuucuggcuuucugagacagguccuuacuauuuacucuuuguaacccuuggccuggaacucuccauagauaccagacugaccuugaacucacaaagaucugccugccaccucccagcaccacagggcgguucacaaccaucuguaacaggaucuaauguccucuuuugccaugcaagcacacaugccaaugcagcacucacaugcauacauuacauaaauaaaucuuaaaaaaaaaauagucccuaguucucccccuucccuaguuccuggcauucagcugaggucuagguuuacuaagcucagacuuguuucaaaguauaaacagucuuuacuuucaacucacccuuauguuuguugcccuuugcugucugagugacuggcucacccauauacuaagcucuguaaauuagaacuugggaauggcuguaacucccuuuuauuuucauuccuuacaucucaucauugugauguaaaucuauacagaaauaguguuucaucuuuauugccagcgcuccagucuaaguguugugggaaauauuaaaaagaaugacaaguucccgugccccagcagccuggccagccaugcacugguggacaauggccaaccuguuuuuuuuuaaucucauggagacucugacucagagcuccaaaaucucuccacucagcuugcuaaauucccacuggcggguagcuaccacaccagccccaugcuucacaacccucaugaccuuuguggugccccucaggcaaacccacauuuugccagcaguaccuuucucucuugaacccagacaagcuuccaugugaaggaaaacacaacacaaacuuaguucagaaauaaugguaacucaaucucugggcgcaacaauuaaaauacuaacuuguaaacccuauuaaaucuaaauccucugcuggcaaauccugauggauccaccauugaaacuaggagacacugguaauuaccucuuguccucacgguaucucaguccaaaaagagcccucuugcuuccucuccu

SEQ ID NO: 8273 - RNA, 2882 nt, Mus musculus
aggagaggaagcaagagggcucuuuuuggacugagauaccgugaggacaagagguaauuaccagugucuccuaguuucaaugguggauccaucaggauuugccagcagaggauuuagauuuaauaggguuuacaaguuaguauuuuaauuguugcgcccagagauugaguuaccauuauuucugaacuaaguuuguguuguguuuuccuucacauggaagcuugucuggguucaagagagaaagguacugcuggcaaaauguggguuugccugaggggcaccacaaaggucaugaggguugugaagcauggggcuggugugguagcuacccgccagugggaauuuagcaagcugaguggagagauuuuggagcucugagucagagucuccaugagauuaaaaaaaaacagguuggccauuguccaccagugcauggcuggccaggcugcuggggcacgggaacuugucauucuuuuuaauauuucccacaacacuuagacuggagcgcuggcaauaaagaugaaacacuauuucuguauagauuuacaucacaaugaugagauguaaggaaugaaaauaaaagggaguuacagccauucccaaguucuaauuuacagagcuuaguauaugggugagccagucacucagacagcaaagggcaacaaacauaagggugaguugaaaguaaagacuguuuauacuuugaaacaagucugagcuuaguaaaccuagaccucagcugaaugccaggaacuagggaagggggagaacuagggacuauuuuuuuuuuaagauuuauuuauguaauguaugcaugugagugcugcauuggcaugugugcuugcauggcaaaagaggacauuagauccuguuacagaugguugugaaccgcccuguggugcugggagguggcaggcagaucuuugugaguucaaggucagucugguaucuauggagaguuccaggccaaggguuacaaagaguaaauaguaaggaccugucucagaaagccagaaaaaaaggaagggagggggaauuccuaauuauaggcuguaaaaucaaagcacuaccauaguaaggggaaaguuauucugauucuaaacaauuuaccaacccuaaaagaauuuuuugagagcugaaacuaaaugaaauauauacaaguauuacauuauuauaucauagauuacaaauuccaaaaacuaauuccuucuuuuuaccaccaaaccucacauucaguuuuuaaaucuaggaagcuggagauacagcucggugguuaagagccuugcugcucuuguagaugacuagagucuuguucccagcacccacaugguggaucacauuaucugcaacuccaguucuaggagagccaacacuuucuccuggugucugugggcaagcgcacauaaauguaaagaaaaagaaauaauuuuuuuuucaaaaaacacagaauuuugucuaauuauuuuuuaaaaauaaacugaauauuuguuauuuaaaaugugaaagcaauauuuuaauaauauuaaaaucaaugucuauauugaaucaauauguaaaaauuaugagaacauucacaaagccaaaaguagugagaauccagauuaaguucaguuuaaaaucuaugcuaagaucuaaaaaaaaggagccauagugguggaggagcucuagagagaggagugauagaauaugggugcuaugaaaggggaaaugaggaaauuugaggaccuuucucugguggagggggacagcaauacagaagaaaaggcaggacagauaaauggcacuaugaauauuuuuaaaagucauagggaaucacauuguuuuauguuuacucaaaaguacauauauauauaagaguacauauauaauuacauauguauguguauauaugccauauauagugcauuaauauauaauuacuauaugaagugagaacuuaaggguucuuuggaaagucgauuggaugguguuuugcuggggcaaacacgugaagaaauguuuuguuaaaguagacacaugugugaaagacuaagacauuuuguugaagcagacccaggagagaagaugcucuacuaaagcaagcaggugaaaggacuugugaugaaagauucuuugcuaaugacaugcauguauugcuccacccuacauugcagaguuaagcugcauuugucgggacuccauagagaaaaacaccaaaacuccugguagugugcugcaguuucuugccgcuuccaaggcucauuggaugcaugugcugaggcaaggcacguggacacgugauguuuggaggguauaaauaggacuccacugagugauggaggcagagcuuggcuugcugguacagcuagcugugcaaugcuugugggucuccugucuucacagaucuucacuucccugagaggcacagcugagaacuucugguguucccguuggacccuccugcugacucaagcagaggauaaggcucggcugucuuugcuagguugugucaccacuguugcuaaccagacucuacugaacugcugguguaucaaugagguguuugugaguggaucaagcugcugcuaccugcuaaccugugaagugaacugccgauaucuaaacaacacagcaggaguugcuucacagaauccuucuaaauagguccauuucccccaucucguuccuguuccacuaccucugguggguggugaguuacaauaaagguuaaagcauuuaagaaccaucauuagagcugggaggugguggcacaugcauuuaaucccagcacuugggagacagaggcagucggauuucugaguucuaggcuagccuggucuacaaagugaguuccaggacagcgagggcuacacagagaaaccuugucucgaaaaaccgaaaaa

SEQ ID NO: 8274 - RNA, 27124 nt, Mus musculus
gcuugugcgccuggaggcggggcgccagggcaguuuuuuuuuuucuccccuucgcucccgccccugcgcuucccaccugccacguacgggaccguggcugucgcuaggcucgucgggugcgugcgauuggccagcucugcgcagccugcagcucggcgaggcucggcggacggcggcggagcggacgggguuuggaagccuccucugcgacaccgagugagcccgcagcggccgggucagcugagguggacggccucggcaagcgggguauguccgccggagugaggcgcgcguggcgacucaaggaggaggucgggggaaccgggagggccgcagggcuucuggaaccucccagcgccgggugggaggguggggcuggggaccgugggaaggggcugggagggagggcgcagggcccgggugaggcggacgagcggcccggcaugggggaggggcggcugggagggagggagggagggggaggagagggcgcccggcccggccugaccuggagggcguuuggccccgcugauaccccaaguccuguucccuccggccccagagaguagaggggagccuggggguaccucuuacggaggucgagaaccagggaucgaagaagccuggggcguuugcucggugcuucacccucuagagcaacuuggaagguggagggugaaucauggaagacauagaaagggggcuugagaaagcccaaagcguuugugccugauccccgggaguggcuuggacguuggagcguagaccuggaguuaaucgguagauugaggacacagaaaggagccccauucggucguacacucccgugcuuaguguccucuuggggcccuacccaguuuuacugauuacaguugccaacuuuuguuaaguugccgucucugggcacgguagggagaauuguagauagguaaucucaaagauucuaccaaaguagcuuguuaggcucccuucgcaugugcagaaaguacgccgcagagaagaacuugagcucacauagcuaccagugaaaaugguuacauucuugccauauacacugcgugucauacagauuuugagacccacuuacaguuuuagaauaaucaagguucuuuaaagaaagaaaagaaaagagagaaagaaaaaauagagaagaaaaaggagccaguuggugguggugcacucaggagucagaggcagguggauuucugaguucggggccagccuggucuacagaacagccaaggcuacccagagaaauccugucuuggggaggcggggacaagaaaagaaagaagggaaaaagaaacuuguuuagagggugggcguuuuagaagcuucugaaagagggccucuucucagguuaagcaacaggugccugaggcugagguauccuagugcaggggcuauguccuuggacacaucaguguaucccaguuaccaggaauuucuuggaugaagguuaaguuccagguugagucacuucuggacuuaggaaguaguaagacagcaacgagaugcaucagaaaaugcauagugaucuuaacaguaguucuaggaacucauucauguuaaucucuaccugcuuagagaaaggcaggaccagaguugacagcuguguggacgagguuuucucuugggacaggaaauaacgguggugccugacauugcuacacaaauggacaacuuuuagcuaagacugcagggaggaaacuagaaaugaaacugggccacccaugguagauguuaaggauauguaauguuagcuuuuagguccacuggagcugagugcuucccaguuccaucagagggcauauuaauuaccaaguacauuugugcuggaacuuggucuuacuugggaguguaucuugauaugaggugccccuucuggccagguaaagaagguacugugagaugguucuaugguucaggaacugagaguguucagcuuucuaagcaccgguccuuagucuauauugcugacuuauauggccuauagauagaaggcaguaaaugcagauuuauuguaagaucuucauuccugucagacuaucaaugaaaguaugagauaguuacuaucuuucuaaacuuaauauguuuuagagccugggguagaguagauguuauguaaauguuuucuaaagguggagaacaaauugggccaacaauguaagaguugguucuauagaggugucacgucaucacagccauuagaagucaccugugagacugaucaaacaaaacccaacagugcucuuuacauuaagauaacuguggcauccagauuguggaacauuguuccacuuuguucuucugcuuugaccuuguagugaagggcuguuuucauuugagggauaguuagacgcaaagacuagauagagcguuuaugugaggacuacugggagguuuauauuuaauauucaugauauaagcuaggacucaugaaaaacaauucaagaugaauaguuuggugauuuggugagggauuuuccacauuaaaggggcgggggugaaaauggagguucaguaaguuuuagggaaggagacagaaagcuggcaauagugaaaguucaggaaugaaagcagaguagccugugggagguucaggacagcuuaaauggugcucuuggucauuuacuuggaacagguaaaaagaguaggaacauucugugucuauagauaagcauguuaaggaauuacuuggccuugcagaaaaacaaauauuaacccauuacuugauccuaaauaugcacuuuuauaguaguaauuugaauuacuaaaagucuuaagguucagaauuaggauuauaaauucauaggacaaucauauugaauaaccugaaaugagauaauaauaagaaaaacccaugaggggaaaauucuguagcaagccaguaucaaauagcuacuuuuaccauuuaaaaaaauacauuuuuuuaacgugguaccaaguauuuauggaacccaaagccuuaugcauacuaagcaagcacuguaccacagaucaauguccuuuuuuagagucugguagccuggacugaucgaucgaucaauuauuuauuuauuuauuuaugguuuuccuaggcaggguuucucugugcagcccuggcuguccuggaacucacuuuguagacuaggcuggccuugaacucagaaauccaccugccucuuccucucaagugcugagauuaaaggugugcgccaccacggcccggugccuggacugaucuugaacuuuguaguugaggcuggccugaguuccugauccuguccauccuauacuuaguucucuucuuuuuaaaauaaagaaugcauggcuggggagauagauggccaagcuauuagcagcaguacuacuuuugaagaggacccgaguucaguuuucaaaucagaggucucacaaccacccaugguuccagcuccugaugauccaacucuggccuccuggggcaccugcacacagaaauaaaauaaaucuuaaaaaaauaauaggagaauacagucuaaucauacacacccauuuugauuggagguaauguggguugacagguuaauggaguuguguugcuugaucauggauaguuguucaaaagcccaggagaauacuacucauuugcccuuuuucuuugaguuuccaaaauaggaaauuagaaaaaauacucuugagauuuuauuuaggaaaauauagguucuaauuucauguucauacaugcuuccucucccagguuaacauuagaguugcaaguuaauaauuuuguagccauuguccauuugaauaacuacuauguacaaggcuucuucugcaaucuagaaagauaacaaaagcacagcuuuaaaaagucacauaguguuuagggcuuugaagaaaaauaaagcagggagagaagacagugaugaggugcauuuuaaguuagauuguuagggaaaccucuagaagauacauaauuagcaaucugguuccagugaggggugugaaagacuugaaggcaaaggacagaguaaacacaaagccuucaguugggaggugaucuaaaacugguauagcaggugcgaguaaggcagagaaguagaaaaugccggagguugggucauuuguacguuuuucuaugggaauucauuggaagguucuaagcauaaugacauuagauuuuacuuaagaacaaacgucugguuuguugauucagugaaaguggguggagguaauaagcagaucauuugagacauuuugaaauaaagcagacaaaguagggaauugguuucaauauugguacugaagaugccaaauuggauggauuaccagaacacuuuaaaggugguggugacaccagguuugcugacacuuuagaugugaggugugagaagagggaagcaaggccuucuugaagaguugccacuaacagaugugaaagccuuaggagaggcaacuuugggguagaagucaggaauuuauuuuuagacagaugguauugucagcuaacuaguuaaaauaauauaauacauaaaauagaaauuacauuaguaauaaaacacuucccagaccauuuaugugucaaugagaggcacuauuuuuaaggggcacaauuucuuaacauucuaauaguucugcuuugaucaguuuuuuuccccuagaguuguauauauagagcauccuggacuccacaaugaacggacaguuggaccuaagugggaagcugauuaucaaagcucaacuuggggaagauauccgacgaauucccauucauaaugaagacauuacuuacgaugaauuagugcuaaugaugcagcgaguauucagaggaaagcuucugaguaaugaugaaguuacaauaaaguauaaggaugaagguaagcuuuuaagguauuaaguacuauacauguucuuucacccauucccccaccccccaguagacuaauucuccauuuccccuagccauuuuauuuuaccuacuauuuguauaguucauacaauuccuuuguauguuaaaaauguaauugauuaguagaagggagugucugacauuuucacauguguuuuucaaauacuuuucuucugcucagauuuccacauguauguucagauuugaaagggauucugauacuauauugaauggaaaaggaauuucuuuaccaacugugauguuuguauaugcuuggcccagggagugucauuauuaggagauguggccuuguuggaauaggugugucacugugggcaugggcuuaagacccucacccuagcugccuggaagucagcuccuccugcaccaugccugccuagugcugccauguuccuaccuugaugauaauggaauaaccucugaaccuguaagccagucccaauucuuauaagaauugccuuggucaugguaucuguucacagcagucaaacccuaaggcagaaguugguaccagggacugggguauucuugugauaggccugaccaugcaucuguuuggaaaaauguggauugggggacuuuggauuuggaaagcaguagaaugcuuuaaguggggcuuaaugggccauccugguaggaauauggaagacuuuguugcugagggugauuugaacuguggaagccugguaguagaaguuuuagaggagaauuuuaauacaugaaccagagacuauuuucuugauauuuuggugaagaauguggcugcuuuuugccguuaucugaagaguauacccaaggccaagguagggagauuuauauuaauugcauugacaaaggaagucucaaaaaagcccaagagagacuuuguucucugguuaagucucaugaagagcauuuugaacaagaguagcaagcuuagaaaggaaaaauagaaaacauaugguucagguauuaaagggguaccaagaagugaaaugaagcuaaguacuauuuucaaggguauuaaauugaauuaagggaguagugaucuuggggcaagaucgcacccagauaaguuaagauccaggcaugguagcacaagccuuuaaucccaggagccuaagacaaacagaucucuugaguucaauuccagccuagaacaaagcaaguucuaggugaagagaaacuuaaauccaggcuugguggaccacaccuuuaaucccaauguuuagaagacacacauguagaucucuugaguucauagucaguuuauggagcaaauuccaggacagccaagcuuaggcagugaaggaguuggaaaacaaagcuagugauaauguaauagagcaagggagccauauucuagcuccagcagcagcagaacucggcagcuucagccuuguggcucugagggaggacuuuagaguccagaauagaaggcauuacugggacaauugauucugguuagguagagcuaagaaauuaguggugauuaagaagagaccagcaucacugaggugaaaucuucuggggaguguuuucugagagcacaaagaagcuguguuccagagauagccaagguuguaacuccugcagcagcuguacuugguauuguguaagagucacccgcuuuuugaagcaugaaguggucauggagagcagcuaagcucagcauugugagaggccauggaaggccauugguaaaggugcagccucaguugcaguugauggccuaggacugaaggagucaugaaaaggauuugaggcuuggcaguuggugaagccuaguugccccagaagaauccaguguauuggagaugccaguaccaugggaugcucaccaagagcagcagcagcaguggaguggggucaaccugagcuuagagugcuacagaggacagagcuggagaaccgauaccagcccuuuggaggagcccagaaugucauguguggaucccagacauugaaacaagaaccuguaauacugaaguugccuuggauaccccaugauuuuccauaugccagagccauagaauaccugcugaggaaugcugcuagcagggagugaaaccacccuaggagaaggaaguuuguuguagucaacaaaguuaaaaaaggaguuggagaucugaagaccaccuuugauaucaggcauggagauguaguuuggacuuuguccagcugguuuccugucuugauuuaaggauuacaguuaagugauuggaugaaucgcagaagagaccuugaacuuuggacuguuaacacuguugagagugcuauagacuauguggacuuuggaaguuggacgaaauguauuuugcauuaugguauggguagguauggccuccauagauucacguguuugaacaagcucaugggggcuagggaguggaaugugauguauaugcuuagcucaggagguugcucuauuagguguggccuuguuagaauaggugugucauuguaggcauggacugaagacccucacccuagcugccuggaaaucaguauuauguuagcagccuucagaugaagauguagaacucucagcuccuccuguaucaugccugccuggaugcugccauguuccugccuugaugauaauagaaugaaccucugaaccuguaagccagccccuuauaagaguugccuuggucauguugucuguucacagcaguaaaacccuaagacaccaaccaaauacaggaaagcuggcuuaaacaaaggcagaugucucucuguaucucuuuauucuuuuuuucuucuuccuuuggcagguucuuacuauguaguccaauacugacauggaacuugagguuaacuacaccuggccagaugucuuuauugcaggaguuauugguguucauuauguuaauauacauugucaauuuauaauaugcaaugcucuugggcucauuuguccacaacuauuuuuuauggagauauauuuugcuuaacaaauauuucaccaaacauagaauuacaguugcauuuccugauuuuauuacugacaacugcuuuucucugagaacugacuuuaaaucaugaugguuguuauuauuauagaaaucuuacauucucaguggcucaacaugcaagaaaaucuagcauccuguggcuuacccugagcguuaacauccagcaugcagaugaauacucugaagagauuuuacuuagcuagguuuugagauguuggauaucuguacauauagcauugcucagagccuggucauguggcuucgcugagcugcagauggaaauuguucaucccuuggcaccuauuuuggacaacuuacacuggugaucagcuaaguuggucaucuacugacauguguaaauucuccuuuucuguugacauacgaucugaaauuagccaaacaaauuuuugagagucacuguguucuuccuauuuccuugagcaaucuuaucuguuuauaaauacauaguuuuaacucuauacuguucagcuguaucccuuaguuaagucaauuucuucucuuuucuugaguuuauaacucaauuuuuaauuuuaaaaaauuuuuauuauucuuuaauccuuuuauacaguccagauuucauccccuucccagucugccuuccaaccgauccucauaccauaccuacccuccuccccgcccccacccccguuuccauucuccaggaagauauccccacucacccccaaccccaccugaccucccaauucccuggggccucaagucucuggaggguuagguauaucacugaaacuaggccaggcaguccucugcuguaugugugucuggggccucauaccagcuacuguaugcuuccuggcuguuggcucagugucugagagaucucagggguccagguuaguugagacugcuggucuuccuaugggggccacccuucuccucagcuucuuccagcuuuuucucaauuccaccaccuggguccccggcuucuguccauuguuuggguacuaguaucugcaucuuacucuuucagcugcuuguugggccucucaaagggcagccaugcuaggcuucugucugcaagcacagcauagcaucaguaacaguaucagggcccugaaccuccccuugagcuggauccaauuugggcuugucacuggaccuccuuucucuuccucuucuccauuuuuguucuuacaguucuuucagacaggagcaauucugggucagagcuuuugacugugggauggcaaccucaucccuccacuugaucuucugucucuccauuggaaguagacucuacaaguucucccucccuauuguagagcacuucauccaagucucucccuuugaguccugagagucucucaccucccaggucucugguacauucuagagggucccuccaccuccuaccuccagaaguugucuguuuccauucuuucugauggcccucagggcuucaguccuguuuuuccuccucuccuccaauaccugaucucauucccuuuuuucccuccccucucccacuuaggucccuccuuuccucaccucccccccccacccccccauugcuuucuucucccucccaagugggauugaggcauccucacuuggguccuuccguuuguugaccucuugaauccuguggguuguguccugaguauucuuuguacuucuuuggcuaauauccacuuauuagugaguacauaccaugcauguccuuuugggucuuaguuaccucacucgggaugauuuuuuuuuucuaguuccauccauuugccagcaaaacucaugauuguauuucuuuauauuucguuccucaguccauucauccauccacccacccuucuuuguuucuaauccaucuauccauccauccauuuuuacugggcuggggaccaaaucuucuaggcaggcacuuuaccagagucacaacucaaaauuuuaaaaaucauuuuaacucaagauacucuauucuugccucacacuuauuagcacaucuuaaaacugaccuuaugacuggcauucucuugucucccuuucauguaggggaagugucagcaaucugugaagugucagaaaauaaauacuguugcuuugcaucucacaguagaauucugucauacaaccgucauuuuugaugaguaaaaaaguaaaagacauaguucauuuuucugcaaaaacaaaagagguucuguugggugugguuuguggcucccacuuuaggguaucuuccuuauugaaaucuguccuccauauccaguuaccacauuguauuuucuuccuuucucccucucuccuucccuccuuuucuucucucccuccuuuucuuuuuuaugguauuuuuuaaaaaaacuguuuaauuuguucagauuguuguuucauagucuguuagcagcuacaugagauggcaacuuauauaacuuuccuacggagauacucguucugugucuuaguuaagguuucuauuccugugcagacaccaugaccacagcaacucuuaaaaaggaaaacauuuuaauuggggcuggcuuacaguucagagguuuaguccauuaucaccacagcaggaaauaugcacaugguggcgugcaggcagacauggugcuauaggaggagcugaaaguucuacaucuugauccucaggcagcagaaggagacuguuccauccugggcauagcuugaucauaugagaccucaaagcuugccccaugguagcacacuuccuccaccaaggccacaacuaauagugcuacucccuaugaaccaauuuuucaaacauauguguauggggagugggggagaacauauuuauucacacuaccacauucuguuacugaugugggauucaaguaaagaaacaagauuaagacugacugcagaaaguuucacuauuuuugcaucaguguguuaauuucuauaaaaugucuuuauuagcagaaucccugagaauugagcauuauuaagcauguaugcuauacauauguaugggccugcuuauacaguucuaaaaacaguuacaaaguaccuagcuaugucuggauuuugacauguuuguuuguuuaaaauaauauggcuuaacaagucuuaaaauugguuuaguuagucucaccccguuuugugagacauaguuaacugugucuucugacugguucccucuaccccauaucauuucuuaacuuugugaauguguuuaaaacauucaguuaguauucuaauuacaauauuuuuauucuuaggauccuaagggaccucagucuucaacaugcauuauuuuuauauauauauuuacagaagaacauguauuaacugaaaaaaauuaggguuucauuuucagcauggucagugaucuaaagauuucaccaugguuuauuaaagcagucccauaaucccuuuugcagcucaugcuacuaauuuaugaaacucuucccucaauuuguguuagugcauucuauuaaaaauaaggauuugaacuaugggaauccuuguuuucaugcuugauacauuuauuuaagcauuauacaauggaaagauuuuucagucuaauauaguaauuugugauauuguuacaucucugaguacuaaaaguuaaugcguaugaaacauuuucaagacaggguuucucuguguaacccuaguagaccaggcuaucuucaacucagagagucacuugccucugccucugcuucugcccucugcuggauuaaagccguguaccaccacacccugcuuaacuuuggcuacauuuucucaugaauguaugauaaauauuuauaagauuaguagauaaaguugauuuaguuguucuaaaaaaaucuuucuucgcugauacuuaugggagauucuaauucucuguaauuuuacauuuuuuaugacaguuuauuacugaugggacucugaauuuauuuuucuuuugaauuucagauggagaucuuauaacaauuuuugauaguucugaccuuuccuuugcaauucaguguaguagaauacugaaacugacauuauuuggugaguggcgaacuuuaaaaugaauuuauuuauuuuuggacugaaaugcuauuagauaugaauuuuuuaauaauaaauguguuuuuauuugcuuuggauuuuuccucuuaauggcucagaguuacauaauaguuuaaaauauuugcguucaggugagacuuugaauuacuugggacuuuaugucuuagaaguguaauucaggcagaauuaaagauuauuuugguuuugagaugaguguaacuuaggaaucucuaguaaguguaguauaguuuuaauuuauaaugucagaauuuuggcuuuguuggguuauuuauguuugggaauauuaaugucuuaaguucuauauuuguuuuguuaccccaaauaguaaugccuuguaugucaaauuuagaauggguucaaacuaccuccgaggucucuaagaacuuauaauuaucuuccucuauaguauguuuuguuuguuuguuuguuuguuuuaaggcuuagcauauaaaagcuacuuuggguauuauuuuucagggaguaaaaacuaacaaugaugggucuuggauauuguuccaggguagccaggguuucugugagggagauaaaaaaggaaguagggaauuuagcaucaacuguguaucuuauuugauuuuuguuacuuuuuaaagguauauauuuuaaugcauuuaaauuccaacauuguaaaaauacuacuggagaauagggagaugauggcccaguuggucgguuugcugcaguacauacaaccugaguucugaucugugaacagcugagcauggggauaugucuguaacuccagcucucaguuggugaaaagcugguucagugaaagcccucauuccaagaguaagguuaaaaaagggguagaggaaacacucagcaucagccuugggccuccgugggagcacucaccugcaugcaugcuccacacacauaaacagguuaaaaugcauggaugaaaguaaacuuagugucuguuauuuuaauggcaucauucccuaaguuuaagcaaauuaaugcuuuuuuuuuaguuaauggccagccaagaccccuugaaucaagucaggugaaauaucuucgucgagaacugguagaacuucgaaauaaagugaaucgcuuauuggauagcuuagaaccaccuggagaaccaggaccuuccaccaguauuccugaaaaugguaaacuggauuuauuuuauuuuauugucaugaauucuuuuuuuucauuuuuguggggagaggauuauuugauugcuucuuggagucaggugucauccuuaauaucuuuauucuccuuguuuaugcuuuuguacaugucaacauuccccaacuauuugucaagauuacuguaaacuugcacuacaguacuuuaauugaaucauagagcucugggaggacagggccuggaaucccauuuugaaguacucucuaggacgggggaauaacucagugguagggugcuugccugacauaugcagcacucuguacucaguccccguacugaauaauaaguaaaugugcagauggcugcauaaggagugcuuuugugaugauuucuuuaguuugucucagucuguacaguaggccaguuuucaaacacuuuugauucacggauuguuauuagugugauaauuaaugaaucuuagaaaucgauuuucuguaguaaaaacuauguuucaaauguaaaauacuuuuagauuaguacuauaaguauuauauuaaaguuuauuuuaacacaauuuuuaauaauaugaaacucuuuuugcauuuacuggugacauguaguauuuauaaauaguaaagauaauuuaaggcuuacugacauauuggaagcugauauaguuuaggcaccaaaauguauuuuaaaauauggacagaaauuaaaagcauaugucauagguugaaaguguguguguguguaucuguguguguguguuuaaaaaacaacuauucaacuuuuguuuaauauucuuaacuuucagguaaaaugauuuuguaacuggcugcucauaauuuucaaaugcuuaaaacuauacaaguuuuaaauguuuaaaauacaaacuggcaacuuuuuuaagagucaagcuagcuacauguaagugccaugagaauuucuguggaaaaaugucauguauaacuucuugaaagccuuagacucaaauacucuaguuuuugcuccuacauaguuuaagaaguuggcucuuauuuuuuuuucuuccuccccauucccuccauuccuacgugcuuguuuguguccucaaucucugccuuugaguaucagacucaggguguuacaugugcuacugaguuguagacacuuuuuaaaaauaugguuagguuuuaaauagaacuauuuucuaucauuucuuucaugcccuuuagccauuuggaauuauguugaugauaaaagcuaaauaaauauuuucugaugaauuaguaauuuuagucuuaccucuauuucagauuaugguaaaauuuacugaaauacuuuaugaucuuagacacuuuauaaugaagacuuauuuauauguuacagaugaaagcagcuugcuuauucugaaccuugcccuuguuuguuuuguguccauacuugcauauggguggauguccauacaagggcagcauggagcucagaagacacccuucauucuucaugugccuuccaccuaguguuuaggacagggucucuaaauggccuggaaccuccccaaguagaggcuagucuagcuuuguuucugccuuccaucuugcuauugcuggaacuacaggaugguauuaccuagccagcuuuuuuugugaauucuggagguuuagaaaucagguccucuugaauacaaagcaagucaugaccaugaugucuuuucaagcaauagaacaaguaacuaagacacaaggacacaguacaaaugcaucuuaugaaaguagcccuaacacuaaaaaauccacguuuacuuuaagaauuaccuuaggucagaucaugccuguuuauacuuuguugccuuguauauuauuugaagcaaauucuaaauauauuuuuucuacaaguauuuuaauaacuaauaaguaguacauauuuaaaagaggagcagaauuguguuauuuuacugaugauuaggaauucuggcugccuuggcuuauuaauagaggaauagacaaaacauaagaguugaguuccuaaauuuagacaagauuuauguuguuuuacaaaauaaaacauucauuacuauaacuguuucuugggcauuuuaccuguauuuguaggucauugggguaugggcuggauaaauagcucaguugaugaagcacuugauguagggucuguguuaaguuuccagaacccaugugaaaaaaugucugguaugaugguguguguuuguaauucuagcacuguagagaugggaacagguagugaccuggggcuaucacuggccagccagugguagaccauguagccugcuggguaagcuccaggccuuugagagacccucucagaaagcauacagggcagcuuuugagaaaugucacuggaaauugucuucugaucucuauguacacaggugaacacacgcaaacauaugcacaccugaaugagcuaggguucaugcugugcugaaacaccaucaccaaaagcaacuugaggaaaggguuuauuaaaaggcuuacauauccugaaucauaguccacugauauaauccaaggcaggagcucaaacgaggcaagacucuggaagcaagagcugauguagauggcaaggaggagugcugcucgagguuacugcuuaugguugccuggccugcuuguauuacccaggaccaccagccuaggggugccccacccacacaaaucacuaauuaaagaaagugccuuagaggcuugccuacagccugaucuuaggaaggcaguuucucaauugacuguagcuuguaucaaguuuacagaaaaacuagucagcucaaggcacuauaagaggaacguguaaaauguuuguguuuauuaaggagauuauuaaauaauaauaaugauaauaaugguuuacuuucuccuuuuuuuguuuucuuuugcuuuugagauaguguugcucuauagcucauguuggccuagaacuuuugauccucuuguuguagccuuuuguuugccaggauuauuggcacucaguuuaauccaguaauucuaaaaggggcagugacuguuagagacaauaauuauuuuggaaaacuguucuuuaucuuuuacucauuuucccugaagcaugaacacaguucuauauucacaaaguccugacaguauuuauacacauguauauauauauauauauuuuuaaugugguuuuggguauagauaaaguaaacuugucuauucuuuauuauagauacuguggauggcagggaagagaagccugccgcuucugacucuucugggaaacagucaacucagguuauggcagcaaguaugucagcuuuugauccucugaaaaaccaagaugaaaucaacaaaaacgucaugucagcauuuggauuaacagaugaccagguuucagguaagucgguuccuuuuucccucucaucuuuaucuuucccuuuuuugacuauggugaaauacuaugucuuaaggguucagccaguuauuuuuuuacauauuuaagcuucuauaaaacaagaaaauucaugauuucagcaccccaaaggagauuuguuuggccuuuagcaugcuuuucuaccuuaaaggaaccacuguuuugcuucagguaaauuuuauuaaaagaaguauuuucagauuauuuuuuuuaaagcagaacuuuuauuuuaaaaaaaaaguccagauuuuuuuuuuauuuuguaaauugcauuugauacaucuugcuaucucuucuaaucuuaggaaauuuaaaauuaagcagauuucugauuaauugcuuuuauaugaauaagguuuuagcuguaaagcuuuaaauuuuuugaauugugauuuauucuuuucucuuauuuuugaccuaucauuuugucagcguuguaccuguuuuucuugguggggacggagaggauccuaaucacacacauguuguagagugcuucauguuuuuacuggcugcuuuccaguauuacaauaugugucuuauuuucuuguuucuauccaucuugcagguuuucauuguaaagugagcauuuucauuaguguaucuugcugacuuguaauuuuuuauuuuuauuuuuuuguucuugcgcuuccagcagguucuuagucuguguggacguaaauuaccagagagaguaguagcugguaucugugggcugguuuguuguuguuguuguuguuuuguuguuuuguuuauguuuuuauuuucagcaguagaugcugcaucuuccuccucuuuccuccuuccuuuuuuauuuauuuauguuuuuuuuuuuuuugguucugagaccucuuggauuuauccccauuccauaaacagauaaguggcuaaggauuugguuagaguuuauaauuauucuagugcaaguaacuaggccuucacugacagggagcuucauccuucauuuccagcuccuugucuaaccaugaaauuguuaccaugaugguugucuugaaauucuuaguucacugugucuacagggguaaacucccuuuggaguugagauuugauuuacuaguagcuauuuuaaauaauuguuuucuucuacuuuguucaagcuuuugcuacuuggggaaggguuugccugaaccauuuacuuugccaauuuuagcaguuuaaaauagagaauuuauuugauuuauucauuuugauuuucuuggaaacuuuugugggauuauuuacugaagagaauuauguuagauuuugagaaaauauuugaauauauuaccuuuucauguggauauguuuacuuaguugucuucacauagauaacaaccagaguauauauuuuuuuaauucuaaaggugugauaugguuaaggugggaaauagcuaccacaguaauguagagugaagagaaugaagucuuagaaaaacagaauagacaacaguaauaagcuacauauaagggagaaaagaagagccaagcacugaguauuuuuaggauuaauaguacaguaucuucucuugggaaacugugugcguuaguacaaguaaaguuguaagccagucagucauguauuuuaaccugguggucaacauuccuauuaccauaaccuagcauagcuucucauuaguacuugacuguuaauggacaagccguaagccuaaaaugaugguauaucaacuuugucuugcagugacaaaaugcuugagaaaaaauaacuuaggguaguggucucaaggcugugggguagcucuuuuggagguugcauaucagagauccugcauaucagaaauuuauauuaugauucguaacuagcaagauuacaguuaugagaaugaaauaauucuaugguugagggucaccacagcaugaggaacuuuauuaaagggucucagcauuagggagguugagaaccacugacuuaagguaaauuucaggucaugauccacuggcuccauuagcuugggccugaaacaaggcaaacaccuuaggggcuugaguauguguaagagaaggcuauuuauuuacucugugguggucagaaggcaaauaaacaaggaagugaaaggggcuaccgacaagaugcauucauaaaguacaugcucucaagagcccacuccucuuucuuccucucaccuucugguagcccaccagcuaucaguucauuggugggauagcccaguuacgauguccaagcacucguuucaaacacuucuugucagcuuuaguacuugggcuuuggugaugcuuucgauuuaaaccaugauaaguucugauggcaugccacuggaacaguuagagacugcuuucaaggagagccugcuaauaauagugguugaauuaagcuuucuaagugguaauugccuuuagaagauuuugcuguaagcuuuguuuaacucauaacccuucaaaguaaacuugaggucagaauuggugugcccuuugcauaaguggagaagcuguggcacagaaggauucaguagcaugcccaaagucagcagccacuguuagcucgggcagugcaaucuaauaauuagcuccaggaacucuucacaucacccuucuguguugcuagcguaacuuaaagccguaagccaugugucaucuucagaguccacuuucacaguauuagacguauacagaaaaucuagaaucucuguacuugcuucuauguuuuucuuauccugacagaguuggauugaguauggguguuuagaacuagaguccugggccuaucaggaaagaacaagaguauggccaaaguucucacagucuuaaggaaaaucaaaguggggccucuguagacauuuauacaacguagcaaucaguguggcuuauuuaaaaaguaagccauagauaaauucacuaaggaauaaagcauuuauaauucaaagauuuauuagaauuauaacuagguuuuaaagaaggccauuuaaguaugugacuguugcaguuaaucauagagagugaagaaauuaugauaaaugaaguagaggccaaaaaauaauuagacauccuaugaaacuaugaaguggaucauuuuaacuaaaagagaacaugugagaaguuuggaucucugaacacaaccagggagauuaaauugaguuuacagacauuagagaccugguuaauaaagcagcacugguuuugguugacuguagauaggaguuuugauuuuugaccuggggagguuaggacucaggaauuuagcauuucacacauuuguagggaagcauuucuaauuuugacuuuggauccuaaagacuggagcaaaugucaaaauacggagcacauaagcuuaguguguccucggugacauggcuguuucauagugauuuuauuucgauugucaauaaccugaacuuuaaauugugcuuguuaaggaaagaccuugggaagaguaauuaacugacuuuucacgaccacccaggcccacccagugccccuacagaagaccgcuccggaacaccugacagcauugcuucuuccuccucagcagcacacccagcaguucagccgcagcaaccucccuaugcaggagcucagacacaagcaggucagauugaagguaaaacagcguucagagccguguguggaagggcaugugcacaaguguuuauugaggcaucaguaguccauuuaccuaaguagucucacucuuuacacagauggaaaauagucuaucuuacugacauggugugauuuaguauuguggaaccaaauaauauacugaguauguuucugauuauugaaaagaagaaaaggggaugaaaaauguuuuaaguuaauauaaacacaaagugaaagacuggggagaaauuacuuuauaaucuccauuccaaacacuacauuuuucugucacuuaaaaagaauuuauaucaagaugaugauacauaauuuuagguaaagaauguagauuuggaucaauucauuugagguggguuuuuuuuaucccucuugaaauuaggugucuucaguaaguaauuuaauaucugaguuuugauauuuuuuucacugauuuaaaaaauaauacgaaaauuggacuaaaucaguaguuuuaaaaaauaacucuugccaggcagugguggcacaggccuuuaaucccagcacuugggaggcagaggcagacgcauuucugaguuuggggucagccugaucuacagagaaaccaugucucaaaaaaauccccccaaaaaaacccaaaaaaaaccaaaacccaaacaaacaaaaccaccucauuaauccugaaugaaauugaaagcucaguauuuaaaagggcuauuuggcacagaugacaucagagcgugacuaaagaccacacugaucucuagggcaacccuuaacauggcucccuccacccccaaguuaacugcuuauacauguuaggaccuuuuaaaagaaacaccagauggugcucuaaacagucuguaccaacggguugaucacaaucauaauaaauaaguccacaguaccuaaagcaacauuuacauuaaaacaaaaacaaacuagagcuuuaggcuaaaaugaucugugacuagaaucuucuuguccugugaugacacuugcaugcuugcucagugaauucauaugagucacuggggacuaucagguggcaucuuaucuuaggguauguauucuuguguuaagucuuuucuccaccaacuugagucagucuacuccgcaucaaaaauacaagagccggagcuaaaacaaacuaaaacugaugcagacauugguucaaaugggaggcuaaagcagaauacagaguuuggguggacaaagauuccaauagccaugucaggugaacuaaaagcuauuguagcacugauguacauucuuauuuagaaggagaauuguacaaaauaaggucaguggcaggaaugagagcaaaauuucacuuaucuuuugagagcuuuuuuaaauugcaaaaugaucaaaucuguuaauaauaguuucuauagugaaaauggucuuccaucuguguucuagcaaccgugcaccucuuuccagcagcuucacauuacuacuacugaugcauucucuuugcagugguauuaauuauaugccuuacuacaguuauuucuuauauuuacggauaaucagccaaguaugucuauauaaauauauaagcaucgauuuagaaagagguugguggauuuugcuauuauuauuggauuuuauauauuagaaaugagacagugauuuggaacacuuuaaacaccauacguuaugucccaguuugaacuagcucuaguucaguagcucaguuguauaauauguauaauauauagcuggagauagugauguaggauaagcugcuuuagugaauaucucuugauauauaauauauacauuguagacacugccaguuauuuagauugacuucugauuauauuuugagcaaaguuaucaacaaaguaugacuuaauuguuuaacaucucuuacgaaauuaauaauuugaaauaaaauuaagaauuucaaguuauuaauugaauaccauauuuucccccgaaguauguuuugcuacugauuguaauucaaauaucuucuuugguuggaaggcucaggcaagcauauaccuaagcuuaugugaggccuuagcuuuaauuuugaaaagugaaaaaacgagagaccagccaaucucuguguauaugaguucaacugggucugcucuauaaaguuaguuccaccuagccagggcuucacagugagucucaaaaauaaguaaauaauaaaauaaaaacugucugagaaauguuauucaauaacuuugacccugugugaacaacaucaagcaaugguucucuacuuuccuaaugcugugaccuuuaguacaguuccuuguguuguagugaccccaacuguaauauucuuguugcuucuacuucauaacuauacguuuuacuguuacaaauuguaauguaaguaucuggguuuucugauuaucuuuugggagacacagcccacagcuugaaaaccacugucauagagcauguuuauauaaacugagguggcuccaacaucacuagguuauuacacagugagugaccagguugaaagucauuuuaaaaaaaagaaauacaauguuacucuaaagucagugucucucuuccucuguauaauucgauaguugcuaaaauccaaaugacuuguaaugagaaacgugcuaugaaucgucagagagguauugcuaauuuauaaggacacauguuugucccuuuucucugauuacuuaccugauggcauauagcauggacaauguacuucauagaauuuauaaagugguagccacuggaguuacaucauaaaaacacuugcugccagcuaauaugcuuggcaguuuuaucuguagccgagcaagcaaucaccuuuaaguuauucauucuucucuucauagacauuuaaauaauacaaaaauuauaauuauuauucaaugugcuugcauauuaaauugggagggaauauaaagguacccuaaaaguauuucucugccaaguuauuaagccuuucuccuuugccuguauuuucuuucguaggucagauguaccagcaguaccagcagcaggcuggcuacagugcccagcagccucaggccccuccucagcaguaugguguucaguacucaggugaggagggguugaaagacaguuaacuuuccguucuucuuccugaguacuugaucuguaauguucacacugucggaaguguuacuuaugagggcaagcaguacuuaguuauguuuuaucaaaucagcauuuucuauuuuuagugagcaaauucaacguaauuauagagaugauucuacaguaaucuacaguauaaauuguuuuacuacaaagcuaucucuuacauuaacaaucuaaccucuuaggugacuucaaauugagaaaaaaauuauaagauuuucuucuauuuguaucacucauauuucuagaguacucuuaguauuuguagguauaucaacaauuuccccacacaugcagaagcgaauuuaauaaaaacuaaguuguuuuauuuaaggcuguuuaaaauacucuagaauaccaaaaauaaaacauacaaacaaaauuacaguugaauucaggcaacuaagaguauucaguguuuuaacugugcugacgugaaguggcacaguugaaaacccaggggauuucaacacauagaaaucugcaucgccugaggagguuucuguaggugguccguuccuauacacagaggaguuuguuugaguuuuaccaucucuccacugaagauuaucuauauuuaauaugauaaauuucuuuuguuuuaacugugguuauaauuuagguauuucuucuaguuucaucagagugucucucuaccauguauagucaaagauuaaaauaacuucuauaaauugaauuuuaacaaaauuauauuuugggaguuuuguguuauuaacuaaagaauaggaguauagaucagcaaauugcagauagauagauggcuagcuauagauagacuauagcagauacagcuacaguguaaaucugcuacugccugguuuuguaaaggaagccucacuugcacccuacauguuucucaguugucccuguugcugcugcacuuuggcacugcugagaguagagugaguaguuggaaagugagagaagcaguguagcccacagcaccuaaaauauuuacuaucuggcccuuuaaaugaucuuuuauugguccagacaguugcugauugcuaaccuagacuacaaaauuuugucauuacuaaaguuugguauauuuuuacacaaagaauaauuuuugggguuuuugcuguagagugauuuuauuuuauaguuguuagaucugauugcaaaaaacagaugaauugauuuuaaaggaaaugccauuugaguguguuauucuauuaagcaaaaaaaaaaaaguauaugguacaaauuguauaacauauagacauugcuuggaggugggccuuaggcuuugguauuuuaaaggcaucacagguuacguagccacagugaggaccacugauguuguucuacucuuuuauaaguggcuuuucaagccaugcagauauucagcgaggaggcugaacagaaugguucucuugucuuuauaccguuuuauagucuccaaucuagacuugaguggucaguaucuuaggcuuaguuguagcuauuuauggauuuuaaaaaauaucuauuaccuauuuuguugcaauuuguaauauuuuccaccuaacguuacucauuuuaggaguguuaggaggguguagaaauggagacaaauagaccuaauagagcaguauugcugcuacugaaauggucuuguuagcacguaaaguuuagauuucagguguaggauggaaagauaguuuuauugcuuuccucucaauuggaauagucauuuucaauauaaaaguauucccccaaaacuuaaaguaaaaaguuaacauuugaaaguuuuugucagggcugacaaguuggcucagaaauugcuagcacuugcugucuuccagaguaacugggcucagauuuuagcauccauaaugauggcaguucacagccaucagacauguccaugcccucccucuucugccuuucauggguagcuacacaacacacacacacacaauauuuaaguuuaguauggaagacgggagaaauuaaugacauccaagaucuuauaaauuuauuuuaauucaguauucaggaacuaccaugagugaauuacaacuuaauaccuaagcuuuuucugggaaguuuaagacaggguuuucacagaguaaaauuuagugcuuuucaaauugccucuguauuucugauccugcuaguucuauuuccuugacuucaagagcuauggaaauagauaacuaacuacucugcauggagacuugcugguugguagugacauugaccaaucucucauacuuuugguuugccaguuuucccucugaccuuuuccaguuuuguucauaaagguuucuuucauaaguaaauuuugaacccagguucaaggugaguucagaauauauacucaaauucauucaauccuuuuuuuuuuucuucuaaaugcaggguuguacacauuuuaauaauugucuuauguaucugguauuuaaugcugacaggauuccagucaauggagagguuucauugcaaguagcugcagguguguuucauaguagagauaaaaguuuucagugaagcagauuuuauuuuuuauuauauucuaguaaauaaugaauauagauguugauuaagugggacaauaugauuuguuuuuuguuuuauuaugccaugcuaagucaaaauuugaguuuuaaaggcaaaaguaucagguaccaaauauaaaggauuuaagaacuauaaacauaguagucauuauuccuagauauuauagugaauuaauuuauauaaaacaauguauaugaagaguguuuguagcacuguuucacuuauaaagcacuugucuguaaugggauuucaugugguacuguuaaauaggauuucccuuuaaaccuaauuaaugacuacuuugcuuuuaugauuuucgucuuccuagaaaguguaauuauuucaccuauuugagcauucauucuaggaauuuugugcaaaugggaacuugcucaaggguuauuauuaguuucaaagcaguuguaaugaaaauacaugcuuauagugacuugaauuuuaggcuauagaauuuaaaaagugucuggaaaaauuuuguaacucuuugguuuugagauguuuuaugcuggacucacuacauaauuaugaauauauuuguuaauuuuuuaaucauuuuugguccauagcaauaagacuaagucucuggaaaacuuucaccaaaaaacccaaaacauuuguuauguauuuugcuuuuuucagcuaguuacagccagcagacuggaccccaacaaccucagcaguuccagggauauggccaacaaccaacuucccaggcaccggcuccugccuuuucuggccagccacaacaacugccugcucaaccaccacagcaguaccaggcgagcacuuacccuccacaaacguauacuacccaaccaucucagccugccaacuauacuguucccccuggcucucagccuggaauggcuccaagccaaccuggugcuuaccaaccaagaccagguuuuacgccaucuccugcaaguaccaugaccccuccuucuaguggggcuaacccuuaugcucguaaccguccuccuuuuggucagggguaugcccaaccuggaccugguuaucgauaaggagguucagccacacuaauaauaauggcugauugccucccaaaagacuauacaauacuauuuuguuucaauuuguauuguauugaaguuuaaaaauuuaaaaagcagagcauuuuuuuaugauaucauuguugcuguuaauugaaaauauaauuuaccagaauacagacacaaaaagaccaaaaugaauauuguuuccuccccugcuuaaaauuguagccgcuuccuaguuauuuuggaacacuacucuuacaugcguguaaaaugauuggcuuucuaguuucccagagaauauuaaaaagcuaggcuaagguauagccaucacacuuggcuauuuacuguuaacaugauguacuaaaaauagagcccucugagaagaugacuagacauuauguauaaaauguaacauugauaggcuaauaaaggugauugaauccaacugu

SEQ ID NO: 8275 - RNA, 10707 nt, Mus musculus
cggcucggccccgccuucugcacgcugcggaggagauugacuggcaggagucccuguggccugcggugcaccguggaagagccaugucuaguaaguggcucguggucugguuguccagcucccagcgggagcgggguccuccgugcggcggugcagaugagccggcuggguccuugcgucccccggucagccaugccgguggcucuugucaccgguguccgcggcgcggcgaagcccaggggcggcuggccgugcgagcacaggccuccgcgcggggcguccugugcugucggagcuggucagcuugcggguuggguggugguguccaacucguggcucugacuuccucgccucacaaagcgguggauaaucacaccucacuccgcaguuccucgucuguaaaaguuuauaguugcacuguccuggcauauucauguaaauguuguucccguaauaggcccgucacucgagguguuuucgugcccuccgccccgacuuguucaucuucaaaaucauuaaucgcuuuccggagaaggggaagcaacaagucuugcacacggaggaccccaguggagggguuuuccugcguaagccugcagagggcgcuuuugcaccggccccuaaccugggucgggaccuuguccauauuggguggcuuuuggaagaagcuagaaacaaaacuauaguuuuauuauccuuuccugccucaggagcagaggcagucuaacuuccuaggguuaggggagauauuagugaguuucugugauacucuggugacagcucaaggucuguuaaccugaaaauaaugccagguuuugguuucauuuguuuuuauacagauucuggcacuguucaauuaagagguguuaggggcuaaaugccuuuuuuuuuuuuuucucucucaucauauuuaggauaagccaaggaaugagcgaucauaguuuuuauacuuuuaaggagagcuucggccuucuucagaagccagguuuugucaguguugucgauauaccccuuuagauugccaguaguugggucaaucaaaaaccauguucaaauacugccugauauccuguuugagaauccuggcccugggugaacuuagugggcagaucugaugacuuuuuuuuuuuuuuuuuuuuuucuuuuuuccccagcuuuccgccuggcccucauacagcuucaaguuucuuccauuaaaucagauaaccuuacccgggcuuguagccuagugcgggaggcagcaaagcaaggugccaacauaguuucucugccuguaaguaucagggcagccugcccauucuucaggagcuguggauccaccacaguacugcgugcuggcagugguccucuuaugucccaccuccagcaaugccuuuuggaacccuaauauuguuucguauuugucucaucuuucacaaagacuaguagcgaccuuuaucauaagaugucaaacgugguuacaaguuuugaacaagaucaccuccccuguucagacaagcaguaagaaauccauggggggcuuccuuaaagacucacucagggccuguacaauuacuugguaccuuaccuaagucaggcuuuuuauugucguguuuuaggucagaccacauugcuuuaguacuguucaguuuuugaaaaauugucucgagguuugaguugaagguuguaucauauuuggugguaaguacagccucggagauccugaaugaccagggaucaguuagcaaagggaacacuuugaggagccagaggucaguuccacaggagcagucuuacuuuguuguuucaaggcaggcuuucucuguguagcccuaguuguucugucacuugcucuguagcccaggguggacucaaacucagagauccaccugcuucugccuccaagugcugggacuaaagcccugugcucccacugucuaaccacucuguuuuugaggugaggucucucacugggacuugggacucacaaguaagcuggacuggcuagccggcaagccucggagagccucuccucacuccuccgcugguguuggaguuaugagugcaucuccucacgccgggcuuauuuuacaugugugcugagcaucuaagucaugcccucaugcuuuugggacaagcacuuuacugguugagacaucucccagcacaauccagucuuccuuuuuagaucacuguguagccauggcugccuggaacuuacuauauagaacaaaccugauguucucugugcaucaguuacaggacucaucuguaccuggcaccuaaccauggucucuuguuaguugauguuguugagaugaaguacaagucuaggagggaaagugcuuggaguuaugugcgugcuugcuuagcucgcugacucuugacaugcuggucauuuuuagcauaaugccugguacguagacacuguuguuaaaugcaaaaugagugaacuuaaauugauauccgguaaauguuuaccuguuguuuucugacaugucaaaggacugcagaaggcagacguguguuguaugcaaguauuagugucuuugucauuuuuggugucugugucccagcccugucuuuguuucauccucacccacuuuuccuauccaugagagacaucauaaagaugucauaaaaaugucagaauggaguuagaaacagcuuauuugcaguuaauaaaacaguuuaacuucuguggcuuucagaacuuuuuaaugcauaacuuuuauugcuuuacauaauaagugguauaauuuugagcucuagacuucaccucaggauucaaaaaucacagaguaaacaugauuugugauggaccuggauguccaagaacugguaauccacaggcuccaggucuagccuucugccagguuaccaguccccuguccucgccugggcugguugccugucugcuuuccauugaacguucuuuagcuuuaguugaaucuuuuccugcugguguuuucuccacuccaagccgaaugggcagugcuguguuucuacuuucugcagaucuuuaaaugguuugccugguuucccccuuuuuccuucucuaacaugacucuaggagugcuucaauucuccauauggaacaaccuacuuuccugacuaugcagagaagauuccuggagaguccacacaaaagcuuucugaaguagcaaaggagagcagcauauaucucauuggagguacuucuugcaccugguguaacaccuaaauauuaaaaaggcuagaaugacuucuguuauauuuaaacauuuuagcccuugaaaagaaugagguugccaggaguaguggcauacaccuaugaucacagcacuuaggaaagcugaggcaggaggauuguaaauucaaggucaguuugggauacacuucaagauauacuaaguguaaaaaaugcaaguuugugucuuaacauuucucaacuagggcccgugggauucaguuuuguuguaagacuugauggauuugagcaaugaggaauuccugauuuugcuuggaaguuacauauuaacugcugcucaauaucaugacugaauuucaagggcauuuugguuauuuuuuaaaccuuucuuuaacaucuggacuaguuauauuucaucacuaauuuggagcuuaaucacuguaagauauauuuaagggggaaaagaaugcuuagaauaaauguuauuauugggcccaaaugacuguuugccaggccuuuaaccuacucucacaagguuauuggcccauuccuuuuuguuacuguuuugugugacuguguauuucuucaauggaaggcuccaucccugaagaggaugcugggaaacuguauaauaccugcucuguguuugggccugauggaaguuuacugguaaagcacaggaagguaaguugugccgaucucaucgccuuccaguuucuguuucuugcaaggauagagauguaauuaaucuuuaagccacugguucuguauggcucaaccuuguugaacuuguugcucuguguaggaucucagacacaccguuaaauuuuaggugcucuuaggugggcagucguagcacaugccucuucauuugaggcuagccugguccacagagugaguuccagccaggacuacagagagaaacccugucucaaaaaucaaaaaagaaagaacguguccucgagucguuuccagucucagaagaaacauacucacuauuuuacucguaaauaugacguuucagaagugcuuaguaugacuacuagauaaaaagcauucccuuccuagagaguguuucugcuuuguuuugaaaaccaugguugguuguagaaguuuccuggguacaggcuggagaggaagcucagugguagacugcuuucauagcaugggcagggccuggguuuagucacugucguugccccuccccuccuccucaggcacagcauacauuacugucucucaguauauguccuugagaucauauggcauuuccuuuacuaaugugauaaguuacauugcuuuaucuucugauaucacaacauuuguugugcuugaaacaaaaaaaucuuacuuuagcuaggcauuugguggugcauaccuuuaaucccaacacuugggaggcagaggcagguaguucucuugagcuggggaccagccuggucuacuaugugguuuccaggagagccagggcuacagagagaagccuugucuugaaaaaggaaaaggaaggaaggaaggaaggaaggagggagggagggagggagggagggagggagggagggagggaggggaaggaaggggaagaaggggaagggggaaagaaggaagggaaggaaaugaauaaaucucauuuggaauuguuuugcaaaauuuuaccuggauuuuguguuugucuugagacagggucuuucuggguagccuaggcugacuuugaacuccaguaguccagacuggcccagaacuuguggcaguccuccuuucagagcauccuuaguguuagaauuacaggcaugugccaccaugccaacuuacuuguuucuaaaugcugcacauuccuuuugcuuucuuuguugauaguguugguuuguguuuguuuguuuguuuguuuuuuugauaugggcucuauguagcccuggcuauccugguagacugguuggaccucagacucagagauauaccuguuucugcuucccaaaggccucuucuucuuuugccaguuuugucaguuugaugcugauucugagaaaucuuccuuagcauuuggggugaauaaggacaacauaaugcgucuaccaugagccugcacauuuuucacaucuggagacaacagggguuguaaaagccacaucauuucaccauuuuccuguaguagaaaggauaggcaaaauuguuaaccuguuucuucagagacugaaaacaagauaaagacaccaauuacuuaaggcccugccugagauccuacacagagcaauaaaauaagugguuggauguagcuaguuguagguacaauauggccaaaacuggggaugauguuugugcugucaaucuuagagcauguccauaucugaccaucaagagauaucugccacuacugcucuugaggccagagguaaccaaaucaauuauuuaugaugcagauccaucuguuugacauugauguuccugggaaaauuacguuucaagaaucuaaaacauugagcccuggugauaguuucuccacauuugauacgcguacguaccagauaaguuugccucuuacaggaaucccagagaagaggagcagguguuuucccuuuuaugucugucuccaaguuuuucacacauucauauuaaaaguucagaauuaggagaguaagcagucagagaucuagaaagucuggggagaauggaacccugggauuuugacauagcucuuccauuggguuacagccucuggaccauggcauccaggguguuccugugggccaccauugacacauuguacuuaauucauuacauuaauacauugcauauuguucagaaggaaguugucaaagcuauccugaggcugacaguguugucuuugaacgaugucccaguaggauugaacuuacaccuugucuguguaggaguccuggguuaauucuuucuagucaggguuuuaggaucagagcagcucuacucccccauucuacaccagagguucacuuauuugugcaucguucuuuuuggaaauagcuuacugcaaagugggccugggcaucugcuaugauaugcgcuucgcggagcuugcacaaaucuaugcacaaagaggugaguuagggccacagauggguuacauagcugcuugggguuugauucugggguggugucuguggcaugaagauagccccuaacaaaaguugcucaaaaaagcaaaacacaauaaaugugcacagaaugucgaaaauacaguguuaaugucucugcauccaguacuuccacagcagcucgcuaaacaggcugagcaugggauacuaugguuacaggggugaggguaugugugaucucacacacuccauccauaguaaaagcuuuguucuggaauauucccuuuacccuuugaggguaaauaucaugguauuuggaguuacauggggccagguagaaaugcagcaauggucuguacucucauggguuucaacacucacauauauagucaguaauauuuugauuuggacaacuuacugccuguaaaaaaugagacaagucagaaguucugguagcacaugaacacucauuuugccucucuaagagggugugguucccucagagaacugguaugacagaagauggagagaauuuacaaacuucugaugccauucagcaaauaccaguguccuuacuaagcuaccgaaaugacugacacuuaacuaagugcuauggaugauugacagcuguuuagcagaugaggugcaugcauucugggcuuaagagugucugaaacuguacugccccaaaucgguugggaagucacaguguacaucucuucacuauguggugcugagcaucugaggccaagugacauuuugauaacaucauucuuuuuaaaagugaaguuugacaucagccauccacugcacuuuucuuguggucguguuuuauacguauaucucuaaaaacuuaaauucagagccugucuuacuaggcugaccucuuuuuguguguggaagaguuugaguucggcucuauuggaugaggaauaagggagggaguaacugagugcucaccguugcacuuucucucuccccucuggaggcugccagcucuugguguauccuggagcuuucaaucugaccacaggaccagcccacugggagcugcuucagcgagcccgguaagaaaggaaccaagcaucucagagcugauacaucuaucagccuuagauggagcccugccccuugucugccugccuucccuggcacccagacgcacuuagaaaggaugacucugcacagagagcucugcuagguacugucuccgaugccauagcaguucccucaagagaugcugggguuaaaggcauucuacaguggcugaaugccacucuauuguacguggguuuuaucucaauaguuaauagacacaggauguuuguuucuuguuuccugugauaguccaaugcuggguucacaugucuuuccaugugcuguuucauuuccuuuggacuuguaccuuuuagugggauuucuggaccacauggccuguuuuaaacuguuagaggcaacucuacugcuuuccccaaacucuugcucauuccaauguacagaggccuuuucguguuuacuucuaguguuuucguaguuugccuuuuuuuuuuuuuuuaauuuuaaagaacuguauaaaggucugcaacgugcaauguauuugcuuucuguugacuacagggcuguugauaaucagguguauguggcuacagccucuccugcucgggaugacaaagccucguauguggccuggggacacagcacuguuguggauccuuggugaguaugucuuaggcugagcucagcuggaaguugaaagaugauacagggucauuuuucuacaauuccuacccuuucauccauacacccggacaagcauaagggaagcuuuuuacuugcaacccacaugauaagaaagcggauccugcuugcucaaguguugucaucuuugcuugucuagguaguccugguagucauacaaaauaaacaaggcagcagcguaggcaagcgguugcuuuuaggaagagaucucagaauucuuaguuugcaucuggcuaaaauuuaggcugagugacugguucaagggcaggaaugagaagcaaggcaagaguguuacuccgcguguaaugauuagagaugggggacuggguuaaagcagugguucucaugcugugcgucacaacuccuccacacaucagauauccugcauaucauauauuuacgugauucauaaucguagcaaaauuucaguuaugagguagcagccauaaaccauaauuuugugguggugguggugguggggucaccacaccaugagggucauaccauuagcaaaguugagaaccauaggguuagaagaaacugacugucccccgugaaacggcaaagaauuuuaccacugagaacacagaacaucacacagauguuucuccauggacauaucacacgguuggcaacuguauguguaauuugacauucacauauagaaucucagucagacacauguccuuacuagaacuuuggacuucaaaaguuggcuuugguccaggcuacuuguguauacacacacaguauuucuacaauuucagaauaaauaaaggguccuagaaaggaguguccccuguguguaugauucucaguaguugcacacaccaggguuuaugggcauuggagaaguggguuaggcuggauucugucacauuccuaucuagauguuggugaaaggcuccacagccaguucuccugguggcuaccuagaguggcuguugcagaguaauuuuuguguguuauaugcgcuuccuuuuuuuuuuucccugaaggcuuuugaggccuuucagccuaugacuuuaggguggucggugucugggugggagugacauuagagaaagaacuuugaauuugccaggacagaugggugggaauuaggauucaaucaaaugaaauuaaugguauugguauuucauccuugcugagagucuguggcugucugauaaguacagucaguuaauugugccagaugguuuguuuugacauauuuggaaauuaaucauuucuccagauagauauauuauugaggcccugcacugggccaaaaggcugguuacugcaaaguuuuccagaauagccuucaccuggucguuugaagggcuguugcuccugucagcacacucuuguuauucagacacuggguaaagucuuguccuccaauccgaaacuccaaagcauagggagccagggaucucagccacacagguagaggguucuuguaaaucuggacccuguauaggcccggccucauuacccucagaugugguugcaguugggagcacaugagggacagacggagaccuuccuuaggaggggcuuuuuccuguugacucuuggcagcucuguucccagauacuuauaaucaugaaugagcuauggcuuuccaggagugugcaguuuauuaaacauaucccacuuuccuuaccaagccucacaggacuccuauuuccacaugaugugccacacguucuuaacauaaauaacagaaccagaauuuauacuacuuuuuuauuuuagaucuuagaaucuuuuuuuggccugguacacaaggaggaaauauagagaacuugagguuggcgaauccccauucauucucuggauuuucuucagggggcagguccuaaccaaagcuggcacggaggaaacaauccuguacucagacauagguaagcuuugcccugcugugguuaugguuucuggggcucccacugcucucaggccagucuguggcugacuuggaaggguuccguugugcgcugcucuucuauccuggugauauccugguguugagggugagcucuggggcuuugucucacuagguuuuguuuaguuugaacugacccaggaccaacuccaggucaccagcauccagacaaggcaaauguuccuaggucacuugcugagacuuuggucuggggacaaaauuuaauugcuugguuaaguaguugcaaauuauuaaucauguguguuccuguuuuugcagaccugaagaagcuggcugaaauucggcagcaaauccccauuuuaaaacagaaacgagcagaccucuauacaguggaaucaaagaagccuugauaucuguuucaaaaaugucaccaacaggaugaugcucugucagaugaucaacucuacuacaucucuuuuuuuuggagggaggggggaacagggccauuucauguuaauucuaucaaugaucugugccacaagguccccuauuuuaauuaaaaguuucaucuuuaauuaaaaugugcuugguaacaauguucuagcucuuaacuagucugaugguuccuaggcauuucagucccaagauccuuuugaacaauuaaaaacugaagccucuaagcauuguuuccauguguggugggcuggucccaucugucugagaaaauguacauuuaccagaacacuaauuuucauggugcuaauaucccaucaacaugacacuuuuaaaacuuuuuauuaaaaauuguuuucauacaauau

SEQ ID NO: 8276 - RNA, 7023 nt, Mus musculus
uguauuuauauuaauugaguuguguuuucauugcuggggcauauuuggguuggagauuuaccaaaacaucaaaggauguugaacauuucuuuaggugcuucuuggccauuagacuuuccucgguugagaauucuuuguuuagcucugugucccauuucuuuuaauaggguuauuugauucucuggagucuaacuucuugaguucuuuguauauauuggauauuagcccucuaucggauguaggauugguaaagaucuuuucccgaucuguuaguugccauuuuguccuauugacagugcccuuugccuuacagcugcuuugcaguuuucugagucccauuugucgauuguuguucuuagagcauaagcuauugguguucccuucaggaaguuuccccugugcuguuuauuaagucagaaacuggcaaaggggaacacugccuucccugccucgagaaaggugcuucucacugacaugccaggccacaguugugacaucuuuucucaaaagugcaacauguacucccaggaguuugaguggacuugcuuacuguaaggguuguuucccgugucucuguaacagaaccagcaggauuugaagugcuuccuuuuguuucucacugucaugcccuacuuuaagaacacaaccaauaguuugugguugcuaagcaguguguccacaugcuaagaaguguccacaugcuaagacguguccacaugcuaagaagugucacaugcuaagaaguguccauaugcuaagaaguguccacaugcuaagaaguguccacaugcuaagaaguguccacaugcuaagaaguguucacaugcuaagaaguguccacaugcuaagaaguguccacaugcuaagaaguguccacaugcuaagaaguguucacaugcuaagaaguguccacaugcuaagaaguguucacaugcuaagaaguguucacaugcuaagaaguguccacaugcuaagaaguguucacaugcuaagaaguguccacaugcuaagaaguguucacaugcuaagaaguguccacaugcuaagaaguguucacaugcuaagaaguguccacaugcuaagaaguguucacaugguaagaaguguucacaugcuaagaaguguccacaugcuaagaaguguucacaugcuaagaaguguucacaugcuaagaaguguccacaugcuaagaagugucacaugcuaagaagugucacaugcuaagaaggugcugauggccuuaacccuucucuucccucccagaugaaaucgacagcucguccaugucagaugaugauaggaaagagguugucaacauccagaccuggaucaacaagccggacaucaagcaucacuuucccuguaaagaaguuaaagaaaguggacauauguuuccuagguacuuuugaacauguuuuuacaaguaaacucgcacugggcaaagucaauauagacauaaagugcaagggacuuuuuauucaagugcaaaagaccucauuucccacugucaacuccuguuaagugucuguuuuuaaaggucuuaggcacuuuguauuuuggaaauucugagacaggacagugaauaguacauugaacacucugaugccccucuccuggacauguuggcucuucacaguccccauaauaagugucaggcacacccaggccauccaugagcagcucacccuaagugcuucagcguacaaucccaagaguaccagcaguuucugacauaacucugaugccaucacuuugcccgaguguuaccagugcugcccacauuagccuuggcaguuucccuccgcccugagugcguccugcacugccugccuguucucacgcaguguaugcuagggcuuucccuuuucuccuacgugccuguucucuucaugagucuaggccaugucuggcaaaauguuucaaauucuaggcauguuuaauaguuugccuuauuguuugcuauguuaaaagugagcuaagauauaagaguuuugagguuuucugcuuuaauuguuuuuaagcuaugcccauuuugccuucggaauuuaguugcagaauauuauaaaauauguaaggaaacccaacaauuguguaauggacuuuaugauauuagacagagaauaguuuugaauacauauaauccuguuaaaaauucugagaauggagcugggcgugggggcgcaugccuuuaaucccagcacucgggaggcagaggcaggcagauuucugaguucgaguccugccuggucuacaaagugaguuccaggacagccagggccacacagagaaacccugucucgaaaaaccaaaaaaaaaaaaaaaaaaaaucugagaauggcagaauaguccauuaaaguuaaaaauuauuuacacauuacacucaacuucucauuagaaaacauaccuuuacucuuaaauaauuaugguauuaucuguuaauaaaacaauuuuacauaauauuagaugaaaaaauauauagcuuguuuaucaaauauauucauagauaacucaaaaauaauucuuugaaguugaauuuuuuacacuggagcuguugaacugacaugucugucgagacccaauucacuuaaacuucuuuucucucaagccaucugcugguuaccgccacccauauguacugcuuaagggagauucuuucaaggaaaggccuggcuuacauccagucucggcaagcacuaaauucuguagugaaaauuacguccaaaaaaaaacaucccgagcuaauuaccuucaaguauggaaacagcagugcuuccgggauagaaaucuuggcuauugaaagguaaguuguuuauuauuauuauuauuaauuauuaccugaauuaauagagcccauuaagugcaggcuccuucuggcuuuuggugaguggguguuggcggagagcacugaggugcuccgcuccuggaacagugucaucugugagcaucuuccugguaucuguggcuucuacacuggugcaugauuucaguuacgcuguagcaaauuucacaccagagucguuaaugauaaucuaggggucaagagagacgacggcucagcaguuaacagcacuuguugccaagccugacaaccugaguucagacucugagcgcuacuuaccacuccaugacauaaguacuccccacccccacugaggcagugucauauaagaacaaaacaagaaauacuguaacagucuagagacucugcucuguugugagggcuagaccucaguucccagcacccagaacccacguccaauggcucacagguguuauacuccaaccugcaagacauccagcuggucgggguggcaugcgcuuuuagucucggcaaugggaggcagaggcagggggaucugaguucaaggccaucguggccgauagagugaguucuaggacuacacauaaaaaucaaaauaaaacccaaacaaaaaagacaugcagcacccucaucuggucucugugcacauagauacacaugugcaaaauauauauacacaaauaaaaacaauguuagaaaaagaauuauacaaaugcuacacuaaaugcugauuugugaggaaauaaauuugucuuagaauguuaaguugguauuuuauuuuccaucaucaaaacuucuuaaccuggagaugguuugaaucuuguuuagacaacuuaauguuuugcuuaaggucaaaccagcaagucccggaguugccauugucuugggaauugcaugccaucaaauccuaauuguagcagcuuaaaucccaucuguacuagacagcaaggacggugauuuacccgccuuuucuuuggacaucacacauacuuaguaguugagagauucuuagcugugugauagaugaaaagucccauggcuuugacuuuggagguaaguuauggagcacacagcaaggcaucucugcucccuuaugugaccccucagcagagagcugaagggaaagugcuguacuaauccauaugugucuuucccccauagguauuugauuccaaaugcaggagaugcuaccagagccauaaaacagcagaucaugaaaguguuggaugcuuuggaaaguuaauguaaaagaaaguuauuuaagugaaauuaaggcaacgaagagaaauaugaaaauauauuuccugacucaauacuaagcagagaccuuugauuugcucauggggugccugaguagagggucuaaaugcaaauuauuguaaucaauaccgggauggguucacuuuuuuaacaguuucuuuugcaucuuugguuuuauauaaugauuuauuauaaaggucaguuauuaaaugacuuugaaguaacuggccuugugcccuauggauccaagggcacagaaugcaguucuguuuugaagagcuguuuuaaaggacaugcaucauuuucagguuuuaaaacaacuguacacauacauauuugcaaugucuucacugaaauuuagggauagaauuaguugaagagauuuaauugcuacauugaguuuuacuacaaugagcauuaucgaaaauaaacgguuagacuaaugauuagcucacuguucuguucuuaaaaagauugaagucuguuggauggaauggauggagaucauagcaacucaaaacacagcccagagugagacaccgaaggucagcuuccccaucuuccuuccuccaguagguaauuauccagagacuaauugccucagagauagugagccucaccccaaguugcuaaggaacaguuaacagcacuagaaguaaguaggcauguuaagguuaaaauuagcauuugggggacagaauuguaucuguaaaaauguccuuggucuuuauuacaaaugggucauuuggucuaggcuguuucaaaaugcuuugccacacugauuauccuccuugaaaugaucacccgugaccacacuaauguccaguuuuuaaaagaaagauaaucagagagcuguaggaauuucccauuguuucucuaucacuuucuaaaaguuccccgguuuuugccgucgcaguaaaguuugcgugguuggcacuuguuccauccuuacucucugaaagacggacgccgucugcuuuguuucgcagcuugcucagacuagucacugugcugagagagccggaacagcuuccgaccaugggaugauuuuuauaaaaucugucugaaaaauaguaaauagaaccugccaugucauaacauguaauagauuuuuuccaagggguugguugauagaaauaucuagauguaccccaccaguagccaguguuuuaauuugcuuaauggaaaucaagugaaugguaacauaauuaaaagaacucuauucugauaucuaaauaaaaacaauguauuugagugguugaagacauuugcaugaaauugcaccuuguacgguacuugauauuuauaacucuucccccaaacuguuguauuucauuucuuccauuuucucgacacccucuuugagauguccugaagucucucagcuaugggacuuuuuuucauaauauuaauguaaagauguuuguguuacuguuuauaaauuacaauuguaaauaaacugauacaaguuugcucaaaacuucugcccuggaggaugucuguucucuuuaucuguauuuugccugcagauuaaacauuugucuuauauauguaccuuaggcuaaaaccaguggcacuaggugggugcuggggugcucauagccccagcuauugaaggaggaaggaggaucaguugagcucagggagugagguuucugugaccuuuccccccucuuucuacuagagcugucaauagaucugucaccuuagaccuggcuuugucuucaguaguugccauggcuaccaggccacugcaguuucuaaugcaagaugaagaugggguaaauauguuaacccuggaagacauaaggccauacugcaacccauccccacaccuuccuccagcgcauacauucuuuguucaccccgcuuccccaguguucucagguucuuggaagaaacaauucugugauccccucaggacgauguaggugcuuagauccaaacccagguccuuugcaagagcaccaagugcucuuaaccacggagccaucucuccagcccugcuuuguccuuuucaaacugcuguuuaugguucucucucucucccucucucugucucucuguuuggcucucucugucucucccaaaguuugugaaaagcucagccccacugaagacagcugacuaaaauuucuuuuggggaucugaucugcaggcuuucuuuccucuugucaagcucucuaauccccuuggcuccgugcucugcaaaugugacaagguauagacuuuaacuugcaagcacugcaaagcuuagaaagcaaugucacuagcuggguguguugcuacaggacucaaucccugcacucaggagugggagcaggaggauuagacgucaaggugagccuuagcuacauagcaaguuaaagugcagccuaggcuacaagagacccugucugaaaaccggaaaagcucaaaacaaaaauaaauauuuacauaaaugauaaugaauaaaaauuaaauaauaaauacaaaggucaaaucguagaauacugcuuagcaccaacucuaucucuuuccccagcccaguuaggagcaagguucugaaguccugcuagccuaaaacaaccaggugcacuuccucaagccagucagcauggagcaucguuacccuggccacugccaugaucuaaccugaaauuuauguccuuugugccacaaguaggaccuuucuaccccagaccauuuauggcacacuaccauaacguaggcuucucuuuuuugacuuugcuuuugaaggcccuauauaaagaauuuguaauuaucacuucuugguguaugcaaccgcaaagggugagccauuuuuaguacggugcccaggcaagaauguagacugguacugaaugugcacaaagucggaggcuuacucaccuacauuacagcacagcacaaaacaaaacaguaaaauccucaaagcucaucgaggcuccgccccucgaccc

SEQ ID NO: 8277 - RNA, 563 nt, Mus musculus
agggggaagaagcugcuggggagagagcuguaagugaaaaagcuccaaguaaagaaggugcuguguaaacccaacuuggugucugugucguucuugucucuguggguugaagacaguggcagaaccgaguggccgaucuuacaaguuauguuggaaaguuaagaaucuuaaaguuuagaaacagaaagaaaaaaaaaaaaaagcaagaacaagggcaugcugaggguguauagcaucaugcguucgagacucgcccuuucgaccucucuauuucuugucccuuucagguuuuggaaaggauuugauggaaaaugcaaacccagcauggagcgguacgaugaaguacaagaccaugaaguugauugaacucaccuccauuuucuccggaagguaaaaaggaagagaacaguugcaugcuuugucaaaauuagaacuauuuucccggagcugagcgcaauucgcacacgucuuuguguaauuuaucugucagaaucgaaaaacaauaguucacauaaaggucauaugaguccacaucuuaaaauucaaugcccaagcuucccccc

SEQ ID NO: 8278 - RNA, 24479 nt, Mus musculus
ggggacucgauguguaauuuaauauguuccuuuaaaagcugugcucucugcccugagguguggagugagugugcucagggcuacaaggaguuuggugucaaucucuaggaagcuuuggcagagcuuuuuuuuuuucauguaaccugugaauggcauagcaaccacagaagaaaucacacgauuaccucugcugccacgcggcaugcuuauuuuuaaaaaagucuuuuaacuugugcuccuaacuaucugcagcuuuuauuugcuucuugcgaguucuuucagaaauauaaauuguaugcuucugauuguagccuuacucacaagcagggcagggcagcacccacauuaaguaauuuuaggaaccaaauaacacagagcaagaauugcacuuuuguuuugaaggagaauguccagaaguuuaugucauaguggcugauuccagauuuagauguaauauaugcuguagggggguuucagucugcuugagaaaccuaucagcccuugauauucaagcuaacuuaaaguuccaaacucgcuuucuggcuuccugucaccugccagagcuuuuaauuuuuaccaucaguguauuugugugcucauuaauagaaacauuuuaauauuauuuuauccugacaucugaaaacauuuucugacuucugauaguucucuuuugagcacuaaaaauacugagguacaucucaagaauggcaguacguuuaccauaguuauuuugguucauuuugaagucauggaccugaaccacuuuuuccuccuauaaugcgugaccagaacuauauaugacaaauagcuccugcuuauucuauaggaaaaauuauuggacaucuuaaacaggaaauaaaaugauauuguacaugcagauauauaacacagaaugaucaaaugaaaauucagcaagcaauggcaaaaguaacaaacuauuuacuguuuuauaauguuaaguaauucaccaagacaaguugcagucaaauuaaagugaguuauggaaaaugaaauacauaaagauguauuuauacaagugcagacuaaauauuuuccauacagguauguaaauaaaaagauauacaguaagugcacacuugaugugacuaugcaggcaacacauaguuaguuccagauacucuuguucaguccaugcacaaaucuucccaaaguacagguuuagucauucuucuaagggauuuggaggggugauuaaaaagggacugaguuccuugcaagaauaucaguaugaacuggaugagggugaggguggucaguuauauauauuacuuacuguaauuugugauugucgaggaagagguguggcuguuggugugauaguaauacugcuggugacuuuauugguuguuuuguuuagugccccauuaguuaagccuugaguucuguuauccugcaguggugcugaagggcuggcaggucucauggggccagccacagcuugcauguaaggacuuccuaagugaauguggauuuuauuauccucaguaguuaucacacuugagcuguuacuguuugaacguugaaacugccaugaugacugccggucuggggagacucugaaaauugcaugcuuggcgcugauuucuaucggcucuggggagcagccuugcucaggagaacuaggugaaccagucauagccaaaaccugaauaggugacauuguccguucuggagucacagaaccacaggacucuggggucugugcucuggcaaagguugccaugguaacuggggacaugcuuugcucuaaguucauaaggcuuucuguagagcuuuuggacuuaauugguguuauagaggcauuuuggagaaugguaauccuuugcuuuggggugccacaguuugguaucaccgcugugcugguguaggagugaggacucucugugguuggacuugugauuucaagaguagcuguauuuugaauguggucuggaguaaccuuuaugugaaguggcugcccaggugugugacuuagaacaagaucuccagguuguacaaaguugccauuggacuuaguuuguauuuuuccauucugaggauggcccuccuuggauuucauccagggaauccauaguuuccuguucauaggaagagaagaagacuggcugcaucugaaggacagcacagacuccuccucauuagggucgucauccugguccucauucuccucauagaacugaccauugaucacugcucuuuccagaggaaugaggcucuuguagucugguggcucacugucugcugcuuccguuugaacuucuuuagaaaauacuugcgggucagagauucuucuuucguugagacuaggccggaggcucuuacuaaagugccuauaccuuucuaacucuuuagugagguuuucaaucucucuucccaaaucucuguuccuguuuucuuguugguuuaguuucuuuugcagaagggaguggucuccuuggaggugacauauuagguccucuguggccauguacucaugaauuuucucuuuuaaugcauccacuucucuggacaggugcccugauuuugcuucuucuuccuggagccuccuaaagagccacugcucguggcuggacucugucuucucggccaacuuguacuuggcaagcuccaucuuggcauguuccagcuccugagacagaaacugagccuugucucucucguuagcauaccuccguucuaaggucucguacucauccucuguuuucaugaggucauccucaauggcuuucauauccuuuagcuucaguuucagauuuuccacuucuugagagagcucuuuaaucuuauuguuuucuugguguaaugcugcuguggacuuacuggagucuugguuuaauuuguuuuuuacaaaaucuuucucaauugcuuccagugacugaagccuguuuuucaauauaguaacuuuugacaagagaucauguccuuucucuucuucugcuuucaguuuauuucugaggucaucucucuccuugguuacacuguacaucuucucuucugcaucaguuuuggacuugagugcccucuugguuuccucaauuaacuucucagucacuguuguuacuuuauuuugcucugcuuggagcugagagguggugcuuuguaacuuaucuucuguuugcuuuaauuuuucacucauuguuuugcguucaucuacaagcaucacaguuaaaguuuucaguuuaguuaaaucauccuuuagugugauuucugucuuuucuagccgacuuucaauggcuucuagcucuuugauucuggcauuuaaacucuccagcucuucagacaauugcuuuguggucaucuuuucuuuuucuaaauugcauuucagagaguagcauucuuguuugcuuuugucuaaagcaucuucuaauuuuuccagagcugugauccuuacacuaaguuugucaaccucuaguuugaagucuuuacucuguacugucucuuucucuagccucuuauugaggucucugcacugcuccuccauuuuuaugagcucuucaucuuucccuuccauguccagcacgcgcuuccugagcucauccacuucauccaugaugccagaguuuccauauucucccuuguuuauuuugucuuuuauauccugcagcucuuccucggcuuuucuuaaagaccuguuggucucuucuaacucaucaauuugccgacugagugcugccagcuucugucggagcuggcgauuuugacuguccucauuggugagcuucgccauaauuuugucuugguuuuggugaaacucuguggucugugucugcaguucuuuuucuagucugguugccuucugcucuucuuccugagcucuggccucagcaagggcuaguuuacccuguguuuccuuugcacuuguggucagagcuuggauuuucugucuuugaagggcgaguugagcuguaagccguuguuguucauccaccaccaucaaagcaaaggacuucagcuuggucagcuccuccuucagggucuugauccucuucuccuuuucuugcuccuucuuuuccugggacgcaguuucuugaucaauuaguuucuuuaaucugaaaauacaagagcacagacugcaguuaguacuuuaggaauucaccagcuguaauuaaccuucuuuguaauaaaaagcaauugcucauaguuagcuuccugagaaguguuauuaaaaaaacgaaaaacaaaaaaaccaaaaccaaaaaaaaaaaaaaaaaaaaaaaccaacccagauaccuggcuuaaaauuuguuuaacauugauuaguaacaguucaaggucaccguuaggcuuagaagaguaugggcaguaguauuuguucuaaauuguguagcaugaucccuggguagugcaaccugaaagcuguaaaggaagguacagacuuaagacuucaguuagacuuggcuuugaaacuacaccggcccugaccagcuaauuaaccuacacaguucuccauuuccucaaaugaucucaggggcuuuuugugaaagugaggcaauucauccaucuaacauuaucucaguccuggcauuugguaaacacuugauaacuguugccauggcacuuuuugaauuacucauucuugcccuguguuaaguggcuugcuugagccauuacgcaugugcuauauuacuaguuacuguuuaacacguugguuauucgguaaaauggcauuuuauucuauuuguuuaggaguuauggacaccacggacacaaaaguguauuaaaauggugguuugcacuaauaagauagcauguugggaaccacuucauaugucuuugucuacugauugucauguaagaggggaacuaagaggcaacugaguuacgguuuggaguguucuaacauguucaaaggcaaggagcuuaacaguaaagagcuuccugauaagaaagguaacccaaucacaaaagaacucacaugauauguacucacugauaagugaauauuagcccagauacuuagaauacccaagauauaagauacaauuugugaaacucaugaaacucuacaagaacgaagaccaccuucuuagaauugggaacaaaacacccauggaaggaguugcugagacgaaaggacgaaccaucuagagacugccauaucuggggaucuaucccauaaucagccuccaaacgcugacaccauugcauacacuagcaagauuuugaugaaaggacccucauauagcugucucuugugagacuaugccggggccuagcaaacacagaaguggaugcucacaguuagcuauuggauggaucacaggguccccaauggaggaacuagagaaaguacccaaggagguaaaggggucugcaacccuuugguggaacaacauuaugaacuaaccaguaccccccagagcuugugucucuagcugcauauguaucagaagauggccuaguuggccaucaguggaaagagaggcccauuggucgugcaaacuuuauaugccucaguauaggggaaugccagggccaaaaagugggaguggguggguaggggagugggugggggaggguauggggaacuuuugugauagcacuggaaauguaaaugaagaaaauaccuaauuaaaaaaaaaagaaagaaagaaauccagugcuagaaauaaagaaacccuguuagcaggaacauagagaauuccucuuaaaugacucuaacacacuacuuuucuucauuuaaaauuauuguaacaggaagacaugcagaauauaugcucuuucccaugcacuuggcuaccucuguaggauuguacauuuaacuugugagucucuuaauuauacugggaaugggcuaauuauagaugauauaauugcagcgcugugguauggugcagaagcuaaaauagaauggaauuacugaaaaguaaaaggacuaacaacuugaaaauauaaauaugugcuuuuuaaucaagccuguagaguucauaauaugucaauaagccugcuuaagccagccugccugccuaucuauccauccaucuaucuaucuaucuaucuauccaucuaucuauccaucuaucuaucuaucuaucuauccauccaucuaucuaucuaucuaucauaucaauaagccugcuuaagccagccugccugccuaucuauccauccaucuaucuaucuaucuaucuaucuaucuaucuaucuaucuaucauaucaauaagccugcuuaagccagccugccugccuaucuauccauccaucuaucuaucuaucuaucuaucuaucuaucauaucaauaagccugcuuaagccagccugccugccuaucuauccaucuaucuaucuaucuaucuaucuaucuaucuaucuaucauaucaauaagccugcuuaagccagccugccugccuaucuauccauccaucuaucuauccaucuaucuaucuaucuaucuaucuaucuaucuaucuaucuaucauaucaauaagccugcuuaagccagccugcuaucuaucuaucuaucuaccuaucuaccuaccuaucuaccuaccuaucuaucuaucuaucuaucuaucuaucauaucaauaagccugcuuaagccagccugccugccuaucuauccauccaucuaucuauccaucuaucuaucuaucuaucuaucuaucuaucuaucuaucuaucauaucaauaagccugcuuaagccagccugcuaucuaucuaucuaucuaucuaucucuauccaucuaucuaucuaucauaucauaucaauaagccugcuuaagccagccugccugcccauccauccauccuauccauccauccauccauccauccaucuaucugugugucuuguaguugugcugaggcuggccuugaacaugguccuuuuugccucauuuaggauaguacuuuaucgugccuggcuuaauaaaucuauucuaaaaucuaauuaauuaacaaucugcuaucuuucauccuugucccagagcacuuguaaauuaagaaucugagagaacuuuuuuuuuaaguaaacaaauuuagggcagucuggagaauaaagacuucuuuaugagauccuaaucuguucuuuguauaauauagaagaaggaaaagggagcauguuuaaaauaaucacauaauguaagaauucuuaagcuuuuugggugauaggaucuuguuuuaguuuguccuguuuuaaggaucugacaaaaggcugacauguaaaguucagaagcuacugggcaggaugcuggggugcggcugcuggugagcucaucuguggucuuggcaggagacuucaugacucucccugccugagacaccuggaagccugagaaccaugccgauucuuccuggagguuagagaugugcaguucacugcaagggucaggguaagcggcuauggugacugaacagcccugccuuagcuuccuuuucacacuugauggugacaacaagccauugcagcagcucagagucuuccuuuacuggagaacacuuucacaacaacucucaaggauuucuucucagcuuuuuaaacaagagcacaugcuguccccucuuuccgaaaagagggauagguuuucuuuuaaguacaguaaaagacccuuaaaguggaauaacuaaguccugucacuagaguaaccagcuuauugugcucaguguuuugguggcgagcauggugcaccuuuccagcaugauggaagugccauucaccuucuuccugguuuucauaaucucgcugauauguccaucucccuaagcuccaccaccaaugcaaacauagagaacugaugaggccaggagauuugcuccaauccgaggaacauguacaccuagugauacuauccucccugcugacuaggcccaaguuuuacaccucauuuuuacacgacgcaaauucaagccagacugcagaccacaucccggaauugauccagacacaugaugucuaucagggaacuaucugaauuggaaacuggaguuaaaggaaagaugucacuuuuaauuguauggaaaaauauacauacacacauauauacacacagugaucuuauaaaccuuauucuuuuaacaccuacauuuuuaaaaguucaaguugaaauugguauagaagauacauuuuacucucuaccauucaaucuaaaaaucuccacuaacaaacuagguagucaagucauucuuugggaagagagucuaauuuuuaagugauagcuguguaggaauguccuaaguuuuccccaguguccccagaugagcucagauaacuacugcuuucuauccagagcugcuauuguuccugugcucucuugggauucucuguagcucauucuggaggaguuuuuaagccuaggaaaauucuuuugguaagcauuugcugaguauggaggcuacucugaaaggguuguugggaagggagagcucacuggacacaaacuuaccaggcagagaguauaugggaaaugugaauguaagcaugguugcagcccugccaaguuugugugcccuugggugugcaugcaccuccauuugaagacuacugucuugaaggacucauguucauacacaaaugcugacauuacaggauuacaggaacauccuguccaguaaaaacggguugaagaagcugauuuuauggacacaaaugugagguaaagaaauccaaacugacuuaaagcaaugucuuauuacagcuuuugaguuucuuuuauggcuuaaaguuguuucagcuuacugugauucaucacuguuacugugugcaaugccaauuacuugcuuuuucaaacauaucacaucugucaucuugagugcuuuuuguaccaaccauaaugcuggcuugagagucuuuucaguuuuuauuuauaugcauauaugucaacaugcaucagccuguauuuuucuucucagugagacaugguuaauaauaugcaccauauaaugcacacauaaaacagauggugcccaucuaaauacuguauagccagucauacccauaggauuuauuuuacaguucucaccauguugcuuuugauauuauuuauggacaucauaucaaccccacuaaaauauuaacuucuugagaaugcaccaugcguguaagggauuuauuuauguuuuucacacuggcuccugagaaguccuauggaaggaaccaaauaagaaguguuugaaugaaugaaugaaugaaugaaugaaugggugguuuuuguuuuuuguuugaaugaauaacuagaacaaugaacaaauaugccauacuauggagaauguuagcauuguccuaagcaguuuuguuuacuuuuuaaagaugauuuucuaguguuuaacauacagguuuuagguauuuaaguaaaugugguaugaguagguuucuuccucaguauuuucuaaauacaucauugugucuauuucauaauuacggagccucuaaaaaaaccaagacuacuagaaccauuucuuucuuucuccacaucuuugcaccuugacucugucugguuauuugguuaggagaguuucagugaucacaugcuagcccaucauguuccuuaauagaggcuacuccgauacuuuuucuuucugauuuggugcgcugauccguaagcagaauacugcauccacacacugcuuucuucacauuuauaagugugcucuccuggcugucaguucugguacuuugguuguguuauaccccauuuuauguuguuuuuaauucuugcuuuauuaugucauuuuaaucauugcauuguacugauacaaaguucuagcagugugaagaguaaaacauggaauuuguuggaaagcuuccuccuuuuaagauaguuacuauaauuuauguuuccugcugugcuccuugccuugucaaugggacuuuucacuguuuagucuaauuuuuaggagcauucauaaaaauacuuaugaccagccuuuuuaauucuguguaugccgcuuccuuuuauuuaucuuacaagucaaaggguuguucuuuuuccccccuuuuaauuacaguuaccgcauaccauagcuaugcuguaaugcucaguucaucugacuuggucagcaagaucuagaagaacagucagaauuuuuuuuggcaucugcuagccaaguaugaguguacaucugugucugcuuuaugucucuguuaccgaagauccugucaucauuguugagaucauuuagagauaccauaaaugggcccagauucagcaagcauuagaguaugaaguaaaggagaggagguuguuuggguauauaugaaaaaagugaguuaggauucauaauuuggacaaucuuacuuaguucucuauuugucagagagagugaaauaacagagcuugggaaaugucaucagauaaacagaauucugggaggaccucagagcaggaacugguaagagaacaaaguaauaaacugaagguucccuuaaagaaaaaugcuaaaagguuagauuacagaauuaauaaaaggccaaguucagagaguuggaguggaaaaggcagacaacuacaaagaguauauuucaucuuaaagccaaaagagagguaccugugaaaucugggcuagcaaaaauacgcccuggcccccacaccagguggccauuuggaagccuugggcugggccugggaaaggaaauggaacagggacagaagacuaccuuauugaacaugagcugaauuguguguugugugcuccugagcuauaguaucaggaacuuuuguaguuagaacacuuaugguaaugaguguuggcuuaauggcacugaugugggccuggauguagcauuugucuagcaugccagagguucugggcuuaauccccaguacuacaacaagauuaaacaaacgauaaaacaaaagauuuuaaagugcuacaaaucuugugacccagccauuuuucaguucaaaaauuuuauacuaagaauagaggcaggcggauuucugaguucgaggccagccuggucugcaaagugaguuucaggacagccagggcuacacagagaaacccugucucgaaaaacaaacaaacaacaaaaaacaaaacaaaacaaaaacaacaacaaaaaauacuuauucugcuauuuaugugaacaguuaggggagguugcaguagcaagagggaacuuuaaccaaaagcauauacuacugaaauuguauagaaaaccuacuaacuucuggaggguaaggggacagggucaccuuugcucacucccuucugaaaugugcuucuuagcuauuuggaaaagaugccucagaucaaaaguguucucccuuuccagacuuuacauuuugguugauuacauguucucucuuuccaagugagcagauuuuucagucuucaccagaccaaguuucaaguagaguucuucuugcacuuccuaggucugcuugggccugccacagccaugacaggacugcucugcacgucucuuuaggggaaagcauucaaaguuacuuggcaugcgaugcuuuggauuaucaugaagccuaugucuucccaacaguguuguggcaccuagcagaacucuaaaugucacaugggggugguguucaauucuuaaugcugugacuguuuguucuuauuauccuuuccaacccuccugagcuccacccuuuaccuucuuuuguuccuucauguuugccuucuuucaccuagggcuuguuccccacucuccuuacuaguaguugacaauaaguaauauagauaguugagugagaguagccugugcucuggucaacccugaaacauguguuaguggucuguaccaacuaaugagaaauauuugcacacauuauagguguaccagcacucgggggucgagauggagaauugucuggcuaagaauugccauuuaggaugaguuaauuuaugagaaaacuuuuguaaaaauauccucguaguaguuaccucugguauucauaccuuuuuuuuuuuuuaaucugcugcucaauuguauaugagaucagccauuaguuuucauuucuuuuuuuguucacagaucuacucuucagcucuucucccuucccagaagaaagugaauguacaauuuccagugcagugcagcguaccaaauggaugucacuagcugaccuccccaaagccugucugacacucgagucagacuuauucuuccuccuguaaaugugaaagugcaccuucucugcggggcucacaacucaggcuugaucuguucgggcaugcaaagguggcagggugggccagcugacuuaggacagaccugaagggcacagacuuuuguuuuuguuuuccuguaaauauuugguagucuuugcuucuugaguuaaaaauaaauuguuaagaccacuaagauuauuuauguuuugugaucuguucaaaaaaaaaaaauggaaaaaaaaacaaacaagguuuagaggaugcagcuaugcaaagcugccucccuccugagaacauaagagguugaaagauaggaacugguaacuuaaggcuuuuauauugggagauuuuugacaggaucucccuagaauaguucaaguuguccuugaacuugcaaucucccugucucagccucuaagugucuggcaucaccauuagugacucauauuguuccauuagugaaguuguuguugauuuuauaugcuuuuaacuccuugagcaauauggauuucaguuuuuguuuacagauuaguauuuacaaauaaauaucuuaacauuugaacauuaaaaguuggcaucccacuuuauuauuuaucuuccaaacuguaacuacugaugcuaauuucuuccuguacuuuccagacuagagugucuagaaacagacaaacaaaugaaagguccccggucucuccucuuacaugaauacuacuuaauccauccuuucugucauacagcccuucuuggagauuaguccaauagaucacuguccucaagcaggggcagaaaaaguaaauuaaucuggcuaugaaauaagucuucacaaguuucauuuaaauuugccagacuuuaaaagacaaaauaauggguaaaguuaugggaaaguuuuuaguagggagauaaauucuaauagugaaaauauuaacguaaaacagcagcuuguuguauauuccugccauugagcucacagcuuuuuagucuuggaacuggacucuaggucccagugugcuauguggcacccacacaagagaauacagacagacugaaggucuuuagugucucaccugauuuuacuuaauucuuuuagcuguauaagcaagcacuuaucuuacaggauagggaggaacuaaacauauauaauuuagaacaguuaacuuacugaacagcacagauaaccaaaccagaauuagaauauauuggcagcuaaaccugugcuucacacagucacaugcccaccccgacuuaaccaugucacaugagagagaacacacauaggccauagaagaguuugcuguuucucccaucugaccuacuggucuccccuuuacucaguaugccccagucauaccagguuuugaguuuucugugugccuuuguuuugaguuuccccuugggagguacaggacucuuaccuuaucuagucccauuuaccagaccaucuauugcuuauuuaugugacuauuccauagaauauaaacuucagggucugcagaaauggcuuagugguuaugugcuuuggcuucucuuccagaggacucagguucaauucccaguaccuacaugauggcuuaccuggaguuaucuauaacuccaggggauuggacacccucuucugaugucaguaggcacaagguaugcauguagugcacagacguagauguaggcaaaacacuccuacacuuaaaauaaagcuagaaaaaaggauauaaacuuuauagguagagguuguguguguguguguguguguguguguguguauguguguucaugcaugugcaucuuauuuaguaaacuggccagucacugguaucuguuauauucagugcuucauuuccaccuugaaagcaaugaauaguauuuacuugauaugcaguagauauuugaacggacaaauaccuguucugcuuuuguaucagauacaauauuagggaguuagaggauaaauauaaauagcagacacacaguagucccuuuccucuagaguguggaaauaauagaaacgguugagcaauuguuuuauagcauguagaaucauuguccuuacuuuauaaaugagcacucagacaggcucagaaaccuuuaguaauugucagaaguccagcucagaauuagcagaaccggaaugucaauagaauugaugcucugaccucugcucucaucgcuaagcuauguuuacacccaugaucucauguaucuugugcaccauccugucugaaccuguguguuagaacauccuaccugucaaaggcaggaagagucacuacuacuacucgccauugguuuguucucuaugggcccauggcacuuugaaccuugguuauggacauuaacaaauauccucuucuucauuguaauaauauagcaaguuuagucacucagcauaaauuuguaauuauuuuuggaugguuuuaaaaauugugacuuugccaguaauaacaucucacagucccuagaggagguaacugugucauaaauaccauuuccauagaacauuuuaaggaacuuuuaaguucucggaaaauauuuuuaacagcauuuucucagcgucuugaagggcauaauaacuguaugcucuuggaaauguuugaaucauuuuagcuuguucauaauauuuauauguauuucucuuacuuaaaaauuauauuuaacuguuauuuuauaucuuaguagauuaaggaaguagaaauggauuuucuagaaaaguauucuaacagguguuaaauuuuucaaaaucucauugauuacuccccccccccuuuaaaacuuuucuagaccuuguuauuuucauucagauauuggaaguauauauuugaaagauuuauggguugguuuuguuucuuuuagucuccuuaaaaauaguuguaaggaguauaucuuucuuuggguguuuuugagcauauuuccaaaaccaucaccccaaauuuuuagccuuuuuuccuuccucccucccucccucccuccuucccucccucccucccucucucccucccucccucccuuccuucccucccucccucccucuuucucucccuuucuuccuguuacccucuuccucaauuuucucuuucuuugacuuacuuaaucaauuucuuggcauuaagacauccaagcaaggaccggucaugagccagaguggaugaguucacugguuuucaccuccucgugaggagccuggcuuuccacacagaggcagcggcuagcaugguaugcuugggaaaccaaacauuuccaaacuuguuugagggaaauucaaacuucagaaauuuuaaaaccacaacaacagaggcuuaugguuuacugugacuacugaaaucauacaguuugccauggaaacuggguagauaaaaauacccagaguguaaaaugagaaacauuucaauucuuagacaggacuugggguuuugguuugguuucauucuucauuuuaacuguaauaaauuagggaaaugggaacauuuaauaguauuuagaggguagaguaguugaagaauggguuguuacucuguagccuguuuucuuguuaaaaggacuacaguggccauucucugucugcuaucaccaacuuuucuuaguucuugauaaccuaagcauugcuuuaugacuuuggaaagcuguaguuugaggccauauguaaaaccaaauuacaggcaggcaggaaacguuuuuguuucugcuuuuucuuuucuaaaauauauuggaacacagguaacuauugucuuauggauuuguuuuucacacccuuuacacucauuguacuaauuaaaauuauguugguuaucagagccuuaauuuccccuggaccaauacuucagagcaguuuggguuacauuuuuauuuucuaacaucucugagccuucagaaaacccauggguauaagcauugcguuacaucugaugucuaagcucaggcucaugacaugaaucuugcuauacucuaggcacuuccaucaagaugucaguauucagcaacaguuuuccaacacacaugaccacaacucggcgauaccugacgugucuugggacucugugugcuaguaaaauguuagucacuguaguuauguuucucucuguaaggcauggucuauguauggcauaauuaaagagaaaccuccaaguguauuuuacauuugcuauaugaauacccauccauaaaacuauaguuuacauuuauugugaauuuuaagagcaggcaaacuauucauguuuucauuaguuaaaaagcuacuaggugugggggaagcaaaacuaaacuuuguaaacaguugaaaaccaauuuuaacaagucccauuucaauaggcagggaauguggaccagaaugcucucaaaacaaacuguuggcccuucuuucaccugccgcccaccucacagaugcaggaagaaggcaguaguuuugugacuaagaucuggaaagccuugaacaauccucagaccuccuuuccauaaaacaaaagccuccagcaaccuuuugaguuuuucuuccuuuccuguuuaauguuguuuacaaguuaauauaucaagagaucacauggcuuagcaagccuuaguggguuguaacuauauugagaaccuuauuuggaauuucaugacauucagauuuuugcuccuuucuauaggaagcauuuguugugguaaaaguuacagcuguaguuaaaagcaaagaaguaaaccuuaguguucuaacacuuaaaaugucaugcuaaauugaaaauacuugaaacuucauuugugugccucugacgcugaggcucggugaaauuucaagauuaaacagguuccaggauaguuuuuaagccuuuuguguuacuugcucucuucuauacauuaauagcucaguaacuugggucuuacuucaagcgaugaggcaccuuugacaccuuuaggagagcaguggauuuuucauggguuuucauugccuuccagcaggggaauugggaccaaggauaacuucucucucaguggcugagauuaggucagaaacagauuuucucugguugauugcugggugucagagaaccugacccuccucuuggcugcauccuacaaagcauuuccuggguccugaggcaaccccucuaucucaguccgguagaagauaauaguaagccuagucaaguaagaagccuuguagaaagacaggcacaacuuagucauaggcagcauuuacugaacaucugcucuagggauggaacuaugccaacugcuuccgcagcacacaugaucccuucaccuuagacacugaaaucuuuaaguugucuuccuuuccauggaaguccagguugcugugagggcuaaguaguggguucaauaaucacugugugugucuugacccuauuuuaaacuuuuguuuuaaauuuuacuuuaggcucuuugccuaguagacuuuuaugaaauaaacccaaccucucuacaguguucagaagcccagugacauuucccuuuuugugagcagugcuuugaguugucuagcucuggccuaccuccauucuacagucuucacagcccuuaguucuaugacaucuauucaauauugucuuguacugcuuuuuaauuuguuuuauauuguuugcucuuaaaggauugauauacuucuauacccuucacuagguuuggacucuauauacccaagaaaaaacauuuucuuggacuauaauaacccuccuugaaugagugggcuaaaacucggagaacacaggaaacagugcucucaugcgugucacuucuuugcugugaggagaggaacccugggaggcaaaggcagaugaggucagguaggacuuggccaggaagccugaccuuugucuuagauuccuuguaucuaugcucuaccuaacgugcucagugagacuguaaggagacuccugcagaguauaauguggaaagaggugacuggaaccacaaaucccuugacaaaguuguggccuuuauuugauaguuccccauacuguuguauaaacaugcguguauguuuauauauacaaguuuuauaucuuauaaauguuuuuuauuuuuauauaaugccuccuaccuauaccauuucauacaugauggauagaauguuuauguuaacacugaaugaagagaugcuauuuuuaaaugguaauuuucccuguagccaaaguggauucauuucccacaaauuccagagugauucaccucuuuuguuguucccaauuagcagacucacaagcuaaggcuaggcuaagcgacuuagacagcaucucugcauuccuuuggguucagaaaaaaaacaaaaaaacaaaacaaaacaaacaaaaaaaaaaaacaggacauuucccaugugcuccuuagccuagcuguuccuuucuucaaguuuaacaguugcagacagucaguccaaaugcaaugaauauuguacauuccucuuaugaucugcucaagagacuguuuuuguuuugauuugcauuuuuaaaaaugucagagagggaaaaaaaaucaccuuuaaacuuuuguucccagacuagugggcuaugagaccgcauaaaucaggcuguuccgcuuuuguaggagcagccuaucucaaaagacgucccuucucccugaggcugcuccauuggugauuuggagcucuugcagggcuaauguccguauguuaggccgaacugcauuaaucuguuuguauugacagaucaauuuuuaaauaaauucucuacuugaucagaauuccuaaaaggacuauugcccacgauucagucuuugcccaaauacugagauacuuggggauacuuggggaaugacauuauuuccuuuaugagguuuggggaaacaaggguacaagaggcuggcccagugaaugaauggcagagccuauuauuccuaaaacucuuuaguuucuccaaugagacaauacuaucugucuguaaccaguagcaucacuaacaagcaagcucagcaauuaacuauauucuguuauuuaauuugggggugggaaggaggcagcugagcuaagagucugucuagguuggcugaaccgguucuuuaaccaaggauggcugugaauucuugacuuuccuuccucuaccucuccaguacugggaucaaaagcaugcacccagucacaucaggcucugguuuuggggggcucuggguguguguguguguguguguguguguguaugugugugugugugucuuuaauuccuguguuguuuaauuuuuauaaagagcuaaucucuguaaucuacaguuuuucacuuaacucauugagaggcagagaugggaccaaggacaacuggagccacaggcacuguugagccuguucuucaucaucaguucaaaaguuaggcuaagagguuaaggcuagugccaagagguuagugacaaggugugguguguggugaccuugcuuucugucccaccagcccaucuuauucuuagcaagguuugcuugccguuucugaaacaagauauaagaaagaccuacacuggauucauaguaggcagugaaguugccuaacuguggaauuaggaaaaaauaccucucauggaaauuuagauauaggaaguacacacagaaagucuggaaucaaaguccacaggaaaacagucugcuccuucccaguuacauggaguguuaguuauuugaccacaugcuuguaccuuccaagcccacagccaaggcacagagaucagagauucagaggaauccuucuucauuagggagaaaccacuauacuaugcuguguucuuucaugcccuacggcaauucaccuggugcucuuucaccacuuucaaucucauuauuugggggaaggaguuaaaggcaauagagagaugggccaagagcuaggaagcuguugacuguagucuguguauacaauauaucuggaaguuuaaagcaguuucaugcccugacuccauugacucugguuuguuuuccggccuuuuuauuccuaagucaauucuguacuuaauucagauaguggcagagauguguuugggacuugugaucaaaauguagaagggccccuccucagccaucauuggcagaguauaccuucuuccaaagucaagagcuucuggguuggaggaucauuuauucauacuuguauacaauauccuucuuguccuagugacacaccuaguaacaauagcuagcugcuucccuagaugcuagggagaaagcugguuguaaaacugauacugaaguacuuuauaaucccagauauagacaauaaaccaguuaauguaugauaugucucaguguguggugucaggguaaagaaagccagguaucaccagucauaaauggccuuccaaggugacuuugcuacauuuuauggggagaguguuuuaaagguauuaagucucugguuucugaaagagggcuuguugacagcuaaggagguugguggauuacagacuguuguuugauacuagcaaguuacuuguccaguuagcucaguaugaugucagcacauacucuguccacagcaccucucgccuucaaauaaagggugggccuugccauccagauggccugguugaguuguaucaaccucaucucacuccuuucccuuuguccucuuauuauguauuaaugagaccguagccacccuucuuguuaacgaauuuuauguccaaauuaccacauacugugcugaggcuacuucugaggccucuguuugcuugucuuuugagcacuaauuaacggagaaaccaguagugggcuacaguccaacaguggaggagucuuggcucugcccuggaguugcucagcaucgcuggugcaggucacacuaguuaucagugucuuccauaaugccaggcaucuagaccagaugacuacugccacaagcagcugugaaggucugcugguauucuuugcuguguuagcaggccgugggcacacacaugcucuugagguauccuauugucucuuuagaaccuacuaauccauuuagaaccuacuaaggccuguuuuaagugcauuucuguggaguugaauguuugcuauucuggugucuacuuaaugucauuugcugauaauuggccuuuggacaagaguaaguaauuccaaauggaaacaagaaauugagugugccugcaucuaccuguuccagugucaccuuccuaucuugucuccugugcagugcaggcauuccuuaacuucuucauaacggaauuguauuagacuuauuugggaaccaguugagcauagaaacgugaggcuggucagguuagagaaagaacacugcuacuguguucuuuacuguucuuaaacucagaaguacaacuguucugugauccuaucuuaaucugcugaaaccuuucauacaagcaugaagagggagguuucuucucauggcuaaaaauguuugcuuggcaaggccccucaccuuuguuggccuagcuuucccagucagaggcacgguuaaugcagauuagugagggaaagagaaucucaaguuuguuuuuuaaugaaaaggaaggauguggauuauuuacagccgcauuggugaugaucuaucaguaaucacuuaaccucauagaaggaugagacaaaugucacacacaccucacuucaaauaagcagccagaggagaaccuaauagucuuugcaguauauaucaaacucaagugauuggguugguggcucagagaugcuguggugaugcagaagcagccagaggaauacuugaaaucucuuuaaagaucauuuaaacauaguucacagaaacuaguuaaucagcugaaagugaagcagcauucauaguccaucacaaacuacauaaacuuaauaucauuuuuccaaagguagugauuggauguaugaacaacagguggcacccuucggguccccagggaggcugaagccaauguugcuuucuguuccgaucaggacucugccuggcccacccuucuuuuuuccuguaaaugagaguuuggguuuuuguuuucuuuguuuguuguuuuccuauuuaccuuguaaaaaaccuacaaacaauuaguggaaauguauucuuccucauuucucauguuuaaaugaacucuguuuauuaccagagguacuuguuugaugggaacagaccagagagaaucuuaaaaugcaauccauaguguguguguguguguguguguguguuaugggaaauuaguugaaauuucaacaagacuggaaaaugaggacaaacaacuugauucauguauuaagaaaauacaaugaaaguccacugauuaacggcuagguuaauuguuauaacaggggaaaugaauuuacaagccuaaaacugcaguguaaaaaagcagagagagaaagagagagagagagggagagagagagagagagagagagagagagaaagagaagaaaugcucaccuagacagcccacuuugagauaguguauccaugauaaaugugguuuaacuuucaguuuuaaaagaggucuuaauuuuuuaaagcaugcuuaaaauugucuaucugaaaaaaaauuguaauuuuaaaauaugugauugaaauguuagaaaaauguuuguaugcucaaaaccaaaggcagacucugggacacagcuuccagggcuuugacagaggcucugcuuuucaagaguugaacuauaguuuauguuacagauggugcuuugaaauagccgacacaauaauugaugguuucugguuuccccuuccacuacuauagaaaaugcagauaccuuuucccaaggcacggauuuuucuccuuccaaucacuguccauaaaacacagacagacagacagacaacaaaccuccucucuucuguuacauauucugaacaucuucacuguggccuggcuggcugcuggccccucuucauggugagagaguuaguucccuuggauugaaguaaugguuuggaggaaucuuacuucuuaguacuaacuugcaguuuauuuauccuaucuucagaccugacaacauguaauuuauuuuuaggauagaaaaaaaaaaucagccuuuuauuucuccaaauaaaaauaacacaaaacaaaaaaucauauaggcagcaaaaauaguaggugugucauauacuuuuaaaacucaacuacaagaacuacuaaaaacauuucucaauuuugaucacauuaaaaaauguuucauuuuaaaaucucauauuuaacucccccccccccugacaaauacaaauaaaauaauccuuuguaccucaaaaugguuguaguucgugucuguaaaacauuugaacaguagcuuguauggucuuucccaugccaacaauaugaaagcguuuucagccuuucagccuaagucaacagaagugguagccuggggauccucagcuuguaauugugcaaauuuggaaaacagaggcuuuuaaaaaggggaagugauucuuucaguuccuaaaguuuuguuucacacuguguucagaucauuaaaaagguacagaaguuucccaccaccucuagugugcuaaaauugacauuaaaaaaucccuuugcugaucuuuauuuugaaagguccaguaaauuauguagcuucucaguaucugccaaauguucacuguacggugagccuuuauuaauagcuauagccuuuuuagguuuagguguaauuauuuuugguuaaaaaugccagugauuaagauuauuuuguagaugcucccucccuuccagauuaguuuuugaauauaauuaagaguacuaauccagcgaggauagcuucaucuuuucaaugcagcuuguccuacucaaagucgagcugagggagaaagaacuagaaacggaacaaacuuccugguauagauugacacgcuuuagagccagaagaggaaacgauuuuuuuguaucaucacaaaguuuuuuuuuuuaaagguuaguuucauacuaauuccaaccguauuuccacugauuuaaaaauacuuuuauauucauauuucuaaggaaaaagcuggcauuaacaaauccagucccauguggcaggauuucgcacucuacucuuggaagagcugaaaguuuuaaguccugaggagauaagauacugggcuggaguuguuccaguggaaucuccuuuagauuucucaguaccuguagccacuugggaagccuuggaauccauaguccgcaccucccauuuaaacuuaagucuucuccccgcagccaagaacuuugaagucuuugaauugggaaagggcuugaggcuggcagucacugagcgcgcucugcaaaaccugcccgccgcucugaagcugagcgggugcugggcgcgacccacacacuugccccuggcccgggggcggcggcugugcgggagccggagcggcggcucucucgggcuuaccugagcugcgggcgccgggccgggccgggcggggcggcgagccgggccgcgguugcgcugcgagcggcugugcgcucuccgggagccucccgaacaaug

SEQ ID NO: 8279 - RNA, 62755 nt, Mus musculus
ucuggccgcucauuggucucagcaugaggaggaggcguggccagcgcgcgcgggagggagggagggcgagagagcggggccggcccgcccgagagacggucggucuacgagcgcggcgggagcgcguuccagcucgggccccggugcuauccuccgauccgccgcgcuccggccuggggucucggggcgggaagcucggugaagcgggcgcggggagcagggcggaggggacgaggcgcgcugcgcugccgcccgguccucaccgggugcugcgggccccgggcgcgcggggcuccgcggcgcgcgcacuaugcgggcggauugccggccgccgcgauggcgagccgggcgccgcugagagccgcgcgcagcccccagggucccggaggcccggccgcgcccgccgccaccggccgggccgcgcugcccagcgccggcugcuguccccucccuccuggccgcaacuccuccuccaggccucgacugcuccuucugcugcuccuacugcuccaggacgcuggaggccagcaaggugagugguggcccgcaccggucggccuccugaggcucuuggcuguuggaggaaccugccgacgaacccagagaugcagagacaccacacuggcgaggcugauguggcggggaccggggcggggugguggugccgcccggugucucaaguuugugucgcuuuacuuuuccgcaaagccauucauuucugugaaagagggacguaugagacccugccguggaggccuccuugcugucuccuucuggacugauggacggagucgggagcaaauuaaaaagcaucuugagcuuauuaaagacaggcagggauugcuguucuuagggauagcgcccagguucuaacgcgaaugaagcaaauugcagugcucucuagagccuugcuuacguuugcaauucguucuucagagcaccugcccauuacugaggaccgugguuuguagauugucuugaucaaacacagaaguggcccagaguagcgguccacuaccaaaagcgcaaacuuucucagaaagugacaaagcuucuuuuccuucuacaaucccauuccagaagcgggaacaacuguugguugauaaaucaucaacaauagaaagagaauacaggacugaacuuuuuaguguugcugcuuugggcagcguaccacauucuguuuggcuuuauuucuuccauggcuuuucuuguuacuaauugcuagggagaguuucuugaaauacguuuuccauuucucaguucagcuucccacugugugcacuuuuugucaguaaggaauaucuucaaggucaugggauugucucuugggaaggugcagccuugauggacgugugagagguaaucgcuaagagaaaaacguaaacuguccucuuuaauagucacauuuaaacugagcaaccuaagguuuagaggucuaauaggcagauuucagucagcgcuuacuguuuuagaguguggaagccucugaaguuuuggcaucuauguguguguuuuucuuucucgugguggggagacagacuuauauggcuacagaagcuuagugugugugggaggcccgggacuaagugguuuguguaaaucagugcauuuaacacacagcuuggugaguuaguuaucccguucccagcagagggaaaccgaugcacagggaauacagcauauuuuaauguagaaaggaauaugaccauuuaagcaguccacuguguuugaacauuucuagauggcuuacaucuagaauuucacgucauguuuaaaacaaaucuucgaguaacagagucagcuauauaggacaccauuaucuuuuggaguagucauucccagacugauguaacaugcaacauuaucuuauuuuaaaugauuuuugaaucauuuuagucagcauuguaacaauauauuucuucucccauugccaaaagauuccaaaauaaauagaaauaauuuuagagagcauaaaaagacaugauuuuuauuucuucaaaaucggguaguuuuguuuguuuaauaccuuuguaucaauuuucugucuugcucauaugugaaugcaugucucuuucauagacuaaguaaaugaaccagaaacacacaguuuuacaaagggaaagcauaauguauuuaucaauuauuaaacacgaguuacuaaguuaguaaauuaaggacuaguuuggugaguaucugaaaauucagaaauuguaugagaugagaauucccugauuuuuaaaaaaucucucccucugagggcccuaguacugcuugcagugaaauuucuuugaaguuagucuuaacuaagauaacacauuccuucagggucagcugacauucccucacucaggaugugaaucucuuaaacaccucuagcgauuuuaauaugagaaugcccauguguuccaagguggacuuuguacucucuuaagaagccuugggaagaaguuuggaaggaauaauauaaccuuaucaguugucucugagugauagaaccuuuccaaaugucugcuacuagcauguaguuauaaugaaaaauaaacugaagaaaauaggcuggcugaaucagucuugcuccccacggagccuacccagguagacacauauuccguguccaugggagugcguaaguggguuuuuaucuuccugacacuguuuugaaaugaugcucucucuugccuuuguucuacuuaaggccauacauagcucuuucucagcagauuuccugccaaaagugauuuuucuuucugcuuggcuuagaauaaaguucaucacguuuuugaaaaccuaauucuucacaaugauguaucauaacuaucuaauauucuuuaaauuauaaauagacuugguuuacuuacauauauuuauaguauagacauuuuagauguagcuuauauacaugaauucuaaaauucaugguaaguucaccuucaaaucuuuauauuaagaucauuuucaaaaccuuuuuuaaaaaauacaucuuuuuaauaaaacugaaauuaguagagcuuagccugauugcauauuugcugcuguaauacauuuucauaauaagcagcuaauacucuacugugauagaauuucuaucuccaguuuacauuaugacuaggaauuugggucaccucaucucgguaacucagcuuccucauuuauauuacagauuugucuaccuugugggcuagaaugugacuuggaaaugauaugauaccagaauauaauuaauuuuuaaaauccauuaagagugauuuguuugcagccauucauauggcauguugucaaggacauugauuuugcaauuuaauaaccuaugaaacaggucagguugauucuuugaaagaaucauuucaguuaaacgguaauacuuguaguuuauguggaaaaguuuuauucugguaagcaguaccuucauuggcuugugugaugcuaaggaaguccagaauuuagaaacugucagaaaugaagaacuucuuccucagcaaagaaacauuuauaauuauccauacuagguagauuuagaauuuucugucuucucuugguuugacaaaacaugccgcacaagccagcuugccauccuagcucuuggcugaagcaggggagucagggcuuucugauuagcuaccccauccaucuugugagacccuaccucaaaaagcucucaaccaaccacucaaccagugguucucaaccuguggcucccagccccuuugggauugaacagcccuuucauggguucacauaucagauauccugcauaucagacauguacauuacuguucaucauagcaacauuggagugaugaaguagaaacaaaaauaauguuaugguuggggucagcacagcauuaggaacuguuuuaaagggucucagcauugggaagguugggaaccacugugcuaaaccaaaacagggcucuuuuauguagcucuaaucugaggcugucugucugucugucugacuuuuccuaaucauucucaguuuaggucaucccuccaaauaaccaagauauggaaguaggugcccgauauuugcauguguuuaauucagguucaacagaguaauuuauguaguuguagucuaacgagcaauaugaauauaagacugaaaauggugacccuggauuaaauacauacaaguagacaguggcuguuuggaaggguguggaaugcuggccuaggaugaggagugguagauagucccacugcccaaaugugacugcugagacaggaagugagccaggcuaagcaguguuucuugugggguuccugcuuuguuugguuuuggauaacuuucucacaacuuugcagccacagcacuucauauauauccuagaaaauauuuuacagaagauaguguuaauauaaagcaaaaaucucagaugguaacgauccacagaugucuuuuauuuuaucaauuuuucguccccccuucucuagucacauaguuccauaauuuuaacacaggcaaacauauuuauaaaucaccagcaaauuauaaaauguaaaauuuuaucacaaggaauucacuuuuuaugaagcugucacaucacuuaagcuugcauuuucaguauuuucuuuuacauuuuauuaaauuugucauucaggagagaauguuuaagaaaguauuucacuugaaaauguuaguuuaauaaaguacaucaugauaacuuuccaggucauuauuuggacuaaaucaacauaauucaagagcaugggaaaguauucagauaggcuaguuuuaaugaaagccaguauauggugacuucuauucucugcaagacuuuuguuaaguaccuuuaacuuuuggguuaaauuguauuguuugggaugugugaggagauaccaguauucuguugaauuuucaucaagaacugggagugggguagccacccugcacucucaggagaacauucaugugccauucaguacaacccuguaacauucagaggagauaaaacaucaccuugucuucagacacuccacaaacauugaguaagugauuauguuccacugagugccaugcacagugguauggauuacaggagacauuuuacaaugacuggggaagccgagacuuugcugauacguaguuuuagguggcugggcuuugcaggauuggcagauguuugagaaguggugaugguagacucaacagaagggagucaaaggccuacccucuuacacugaguagcaagcuucggccagugcuccgugccaucacuccuucccgagcacugugcccuuuguuucugccuagucauuugucagguagcaguugacugguuacugugagccagcccugaucuaauggaguaggauauugcucuccauagugaccucccuagcaucugucaucagcuccuguaucacuuacaggaugcuguccaaaagccucugucucucugucucugucucucugucucugucugucugucugucugucucucucucucucacacacacacacacacacacacacuagccacacacuagcgacugguucuuucuuuggucuuuguucucaccccauacagcaccugucaacacuuuuaagcaauuucaggacauuuuguuuuagugucugugcugguaucuuuauauagcaauguccuguacuuggagcccccgcccuuacuuuucuucucuuauuaaucauacuugaaaagcgccaagcauuguccuuaggaagaguuguguaagcaucuccacccacccauauccagguuggacuuucugugcuggguugaguguuacauauuuugcugcugcuaauauuuccccaugcugucugcuauacugaauguuuguauuaaccccguaucugcugcagaucuguugucccagcacauuauuuggugucagucuuucaugcuuuugccauuuggcucagucccacgaguagccaugaguccaggauuugggcucuuaccucauuccccaaggaauggagcccucucccagggccugggagucugucggucuuucccaggccuacccucccaggaguaccaguuccuugcuauagugucucagcucugggaguucucucaagcuguaacucugacuauagauuccuucucuuggauuggcugcuuuuaagaacagugacagcccaaaucauuggcaaaaaguugagugaacuccuguguccuuucuuucagauuugcacuuaaaguuugguucuaauaauugccacuacuccccccagccccggacuaauuaugucaaaauuuaccagccgcacagauuuaaaccugucuucucaggucauucaguaagugaauuaguauaugaaauuaguccaacucuucgaaacucagcaguuaaaaccucccaaauucaaaugugugagacccacuuuuccauucccuaaucuugguucccaccucauuuacuguucauagaaguucugcguggcucaaugcgucaaauucugcaaguagaagacucgguuaucaagguaaaauuggaggauuagucuauaaguggccacagugacuaacuaagccuuaguucugccauucacugacucuguaacucuaugugucucaguuguucuugaacuucagccucuacagucacaguuggauuaugguuuaucuuguccuuucuugcuugccaguguucacauuguauccuaggagcucacugucuggaugcgagggacagcaaggguggaggcuagguuuuagucaggacucuugggauccuagaaacugaaauccaggucugcugaguguacaguagaaccuacuggauuuuagaauagagcuguaccuugcuaagucaagggaaaagccugcaguugcucuucagaaaccaagguuucagcuucacuuuccucucgcagguuucucuguguggaaggggucauggcugcaggaaguccccaagacuugaagugcuaaaguggagucacucuggguuuuccuuuuugagcaaaacauagaaauuagagggaagagugaguaggcggagggugagucagugcccacccagaaccaggcagcugaccagagggcaugaggucauauauaucugucccucagugcccacccauggaccaggcagcuaaacagagggcaugaggucauauacaacugucccucagugcccacccauggaccaggcagcuaaccagagggcaugaggucauauauaacugucccucagugcccacccaugggccaagcagcugaccagagggcauagggucauauacaacugucccucagugcccacccauggaccaggguacuauguauuccuggcuggccugauguaagcuauuuagcucaggccagcuuuaggcucuauacaggucucuguccccgccuucugugcaugguaacaagugccaccgcacacagcuaaguuuuauugaauccacucaauugcccugagagcugcaggguauaaaucccauuuagguagcuuacauaaaguugugggaagucucagaaguuaucugggguuugcuucugaauuaagcaugguguguuaaagacuguuuuauucuuguccguggcuguccaugugaguagagugcauugccugacacauaaccaugcuaagcugacauaaaucugaguaauuaagcauauuaaaauaugaacaaggaguucuugguacaacucacccucccuggaaauacuugcuguaucuguccugcuauaaacuguauggacagggcccaccaugccaugcaaaagcuguccauugucagcuugcguauauugaaugugaaauacugugggacagcugagcagaaguuggugaucuuauaauuagauaauggauuuugaggcuuaggauaaagaugaagagaucuagaacuuuccaaguggacaagcugcucaguuggaguagaaauaauuaguaaagagcaacucucaggaauuuacuaucauccucauaagaccagagaccaucugggccucugaaguugcuauaaauuucuaaaguaaugaggcauuguucuuccuguuaauuggcuagauuguagccaaaguauaaaugggucaacacaaaagaagacaaaagggguucagauguauuuucaguaguguuauugugauaauaguccccacaaguguguauuaagagcaugagugugaauucugcccuugcuaccaggugugcucauacaauaaaucaguggauucuuaccguugccauuuuacagagagcaaaacuguagcauagcuagagcagcuaaccucaaggucacagugaguccuugagaauggauaucugagcuugcuauagaauucucaauaguuuaaccaugguccuggguaaagucuuucucucucucuuucucucucucucucucucuuucucucucucucucucucucucucucucuguguguguguguguguguguggugaagaucugcauuccuuuugaauucagaucuguaaauuauugcaugggucggauaaccuaugggggcuuaugccuggaaaagacuaauucgucuucuccuuauuuaccugcagcucuucaucuagaguggggcccaugagcugucccuauguacauugguaugucaugucagcugguguugucauuguucaagucuacuuuagguaaucauauuuuggagauuuaaugggugugguuucacuaaacauauacacaaaugagcaacacuaaguggacucaggaggcucuauuuguuuaugcacaugugaugcacacauacacacacaaucuguaacugauaacuaaagaagagguuaugggggccuggagaggugacucaguggauaagagcacucacugcucuucuaaagguccugaauucaauucccaacacccagauggcagcucacaaccgucugauaccaucuucuggugugcagauguacauguagaaaaauaccacuauauuuguaaauuccuaaauaaauguuuaaaacuugaauaaaacuaagaggagggacacagaggaguuggagaggagagaggaggauguaaauacaguacucguaugaaauuccuacacauaaauacuaaagaucacauggagggguggguuuaggacaagagaaugauaggacuguuuaguuuucuaaaaauuuccauugacacugcauccauaucugccuuauaucuaguauuaagaaaauaaauaagagaaaggggccaccaggcaauaaaaaaggaggcacagagccaaugugagaagccagcacagggagugcguccaccugcuggcauucugggagaggcagcacugugcauauuaaggaacaguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagagggucuuuugguauagcauuggaaauguaaaugagcuaaauaccuaauaaaaaauggaaaaaaaaaaaaaacaaaaaaaaaaaaacaaaaaaaacaauuagagcauuuuaaguaucugggaaaaaaaaaaaaaaaaggaacagugacugccagagagagugugaagauuggcaguguggggaaggggugaugggaaggagagagauauguggcauggccauuagcauccagugauguauuugccuagacccauagaaugugcaggaccaagaaggguguaaacugagcucugagaggugaugcaucuguugcgaucagucgguucuaagcagcccuucgugaugacccuacaugcugaagguuagagcugcucuaggaaagaagucuacuuaaaagugucacugugcuacguggaagagcuaucaugugagaacgacaagcaaaaggaaaguacuccaccagcauuaacauccgagcucacuuucggaacucagcacauuaccaggggcaaagaccaguaagugaaaugaaguuauaguuaagguuaggcuuaggaaaccugggagucuuaggcuugccucgcauuucuagucugaaaauucacagugugaguaaaaacugcacuguaggcaaaugaaacuggaugaaucgcuugcaguuguaccuuuucucugugaacuuuucuccugcucacuaagugcuguguguuuuucuaaccaucuaacggguguguuccgagguaugacaaaagcgaugcuuagaggcaguucagucggacucaccauuucacuauacaaccaaaguccuugaaaacucuggacaaguuucaguguaaugaaguuccacugcucuccauuuggggcauauuucugcaguuuugcagcaucuguguuugcugugguaaaagaauacauagggcuccuauuguuaaaauuuggcaacuauauuauuuauuaguaaccguaucacuaaugugcaaggguggcuggaccaucacagcacacacuugucuaaaaaccauaccugguuuggaguuuggauaaaacagcuugaaauaaacuguauuccuaguuggauuauuucacagacauuugaauauguucaauguuuuccuuggggaaacucuuaaaaaaucgaaacaaaagaaauucauucaguuauuuuccuggaacaguaucaaaauuuguuaucuggcuuaacacgucugacggugcgcucuuccgaggaagugaauacauguucucuaaguaaucccaggggacgccugcaucggcagggcagucagaucaaguuccaguguucuuccccugacagaaguacauucaagaugaaaagugcacaauaacggcaucuacccuuucuggucaguuauagucucgaggagaccaucagggaaggagaaggaaguugguggugauggcguugaugguggaguuugcccaaauuguagugcuguaggguugagaguguugucugguuaucuuucuguggugguacuuauaccucauccguucugucauguacgcaaacaugaguaagagaggguaguguguccuaggcacagaacaccacugcuaucagaauacacuagucuccaaaccuggggacaguacaucauuaaaaacaaaggguucacuugcuucagauacugagaagugggagauaggacucuccacacgcuagcuguacccugagugaguugagccacacuguccuuuggccagauaagcccaucgaggaacuaagacacugguuuucuagccuugguccuaagucauacucuugaaucucagucuacucacacuucaggccauucauucucugguccaugcugagaggcuuggguagcacuccagccucugccucagcugucuggaacagcccucugccuccauuagagaugacugaaaacaggcugugcugccugggacccucugcugcuggcagcaaguuagauggcuuugauaauugucuagggcuugguuccacuuuuaaauguuuuuacuuuaguuuuaacacucauaaaaauaaucaggaaaucauugcuucuucugaagugaaagcaaggaccugguuuuuccuugucuugaauuuaacacggggccuuucaguggugggaagcguuuuccacucugcagguguggaccuuucaguagugguccucaaccuuccuaaugcugggaccuuuuaauacaguuucuccuguuguagcaauuccccccaaccauaaaauuauuuuuguugcuauuucauaacugcaauguugcuacuguucugaaucauaacauaaauaucuaguauuuccgauggucuuaggugaccccugugaagggguuauucagcucugaggggguugugacccacagaguaggucaaagaucguuuagcaggucaggagucugugugccagcaugucacaauauaaauguauuucuucauugaaggcaacaggaaaacagauagcugcuggccuaguagauauggguacugugccuggugaccccuucgaacugagcuguuuggacacauaggugauggcaaauucugucuaguuggguuauuuaucacuccuugaaauguaaaacauucgagaauguucacugcagcagacuggagacauccuuuuaacuggggcuucuggugcacaucaucugccuggagaggagggagcgcugagcuccagcgcauauuuuagagcauucuuggcacgcugcuguagacucguuggcuaugcccucccucccccgacacaagaguuugaaaaaagucagcucuguuuuaauugcuuucauccucaccacgcauguggaaggccuguuuccaucaauuauuagguauuuuguuaacuuuaaaccauuguuaaugguggcgaaaacuagaaacaguuucuauacuuuacugaaaguuguccucuuugguaacauugauuuuaaaauaacaaucucaaguugacugaugucugcagaggaaucgugaggucacaugugagucacaugugaguggcgugagguaugucgcagucacaugugaguggcgugaggugugucgcagucacaugugaguggcgugaggugugucacagucacaugugaguggugugaggugugucgcagucacaugugaguggcgugaggugugucgcagucacaugugaguggcgugaggugugucacagucacaugugaguggcgugaggugugucgcagucacaugugaguggcgugagguguguugcagucacgugugaguugucagcaggugaccugugacuuugagaauuccauuacacuuccaagguucugcauaucaaaaauagcauaaucugaaauguuuaauuaucuaucaaagaauuguuucuuaaauauuggaacacuucuaggaaucacaagcuaguuucaaauguuagauacuauuuuaggguaguuguuuuugccucuggaagggaaaauguuaaugauuguugaaaagggacuuguauuucaguugcuuauuuucacacuggagguuuuuauagccuuaugauuuuacucuagguuagauccaagagggacagagagaggcagcgagagggaauuuuaugguagcuuuggaaggaaaugguauuuuuuuauuauguaagagccuguuuuacuguaaaaucaguggguguauuucacacccacauuuacuucauucucuccauauuuuuuauauuauuaacccacuaugccuaguucucgugcaugaaugaaaucaggggucggaaauaaaguauaguguugacugaaagcuaaacuuuauaugagaaguguuuguucagaaagcagaauuuauaguauccaacucaaaaguagagcagcauguaguacuaacgugggucagagaguaaaaccccagccgaagccacugcugcuucaggaccgucaagggcugcguggggacuguugcugcauuguggacaugaaacugccuuuugguaaauugaaguuacucuauugcugucagugacugcauacuuccuugccccaccucuuaccagcccuauacuacuaagcuguuguaacguuuaauuuguucuagugaaugaaaugcauaguacauuguuagguaauaacaugaggggaauucuguuaccaccauccaugccuguaaugauuaaguuaaacccacaagugucaauuuuaauguuuucuauaaguucuauacuauuccaaaagaugauaaugaguaguucuuuuaaaggcggaaaccccauuauuuaaaacgggauguauuuaucauccuauuaaaaagagacucacugaaucucguuguuacugaauguugaacauuaccuugggagcaacagcugaaucuucuaaauguacauuuuguuaaugacuucuauacucaguuaaaaaucaucugugagaaaguuaagaugcaaacaauaugcuguuacuaaaacuugauacucaguugcugaagaaauuucugaaacaaaguuauccugcuguuaagauauuaaagucauuucugcagucagccauugacuuugugucucuuccuuuucauuaugagagggaaauuugggaggagaagucacacagcccaauuucaauggaauauagaaggaaaccucaccaaaucuagcuguagucccuugucugaagauggccaguugucuaggacaucuuggcaugcauuaguguuuucucaaaauccugccccugcucauagagacuuuagcagcuggccacauuguguuuacuuugacugguuacuguaaauacauggugauagucucuuaacaauaggauuuauuucaguaugucuuuaaguacugcauaacuguauguucacauggaaagucuuuugaacuuauaaguuauaguacuuugaauuguguucgucauuguugauuuugacuugccuucucuuggcuccuucucuccaucuugaguagaugugcuaagaaccguguugucugcuguguucuuugaaaaggaagaacugccucugucaauaugugcuguccuccugcacugcuauaggucuguguauugacgcugauuacaugcaagcuugaggagggagaaccauccauuuggaguuuuguuuuuguauuuuuaggugauggauguggacacacuguacuaggcccugagaguggaacccuuacauccaucaacuacccacauaccuauccuaacagcacugugugugaaugggagauucgagucaggacgggagaaaggauucgcaucaaauucggugacuuugacauugaagauucugauuauugucaccuuaauuaccugaaaaucuuuaauggaauuggagucagcagaacggaaauagguaaggcauuaaugcauguuaucuauuguuuccuuaaguuuuaaaacugaagcgguuuuuguuacuuaauacuaacuaacuggcacauaaaacauuguagacaauauagaaaucucaaauugaaucuucuuuugugaagaggggaugcuagucuuauuagcacaugguuacccucguacaagaugcacaugguacccucguguaagacacacuugguuacuuuccugcaggaugccacuguacugcuucuaagaagguagauuuuauguucccuuugaucguuuuauuuauagucaagaggauucggauauaagugaugcauggucaggacacaguguagcauacugaucauggguuuggaauccaaacugcucggauuaaagccuaaaucugccauuagccugcugugaucuguugggagcacgugaccacuguuuucucaguuguguguguguguguaugugugugugugugugugugugugugugugugugaagagccuggaacagcgugugauugcagaguaggugcaaagaacagaauggugacuguauuccuaguguaagagcagagguucucaguuagaaccguguaacagacaccugggagacuuacacacuauagaccugcuuuccauccagauccaacagauugaacuugauugugugagacagaagccuuggaguuauaaaagguuuccaggaaaaucuacuuugccuccaagauuuagacgcuuuggcuuagagaucacugccauucuguuacaaaaggcugaaaccuguaaagguuuuagugaacugauacaaaguaaagaccacucgacuucucugaguuuauuuggaagcauauauugggaucaacauuuaacauuuuucagaauuacaguaggaaugugcuguuauguccagcuauggucacccucugacuccuccaucccuagcugagucuuucauccuagcccauuuccugcugcugauugauagccucugaguucgcaggaauuuuugguuacccugguagcuugaguagcuccuccauaccuucaccauacaauguugggugagauugucagaacuuaugccucuggagaguguggccaccguggaccuguagcacuggugggagauguguagauagcgcuuccgagggcucucaggaggacucugugaguguaacugagacagcagugaaaacgaacacacagaagauggaaaauaaaguauaugugcccauaaggacuaaguuaaaacuaaaauaggagaagcucugucaaaacaaguggucucauuucguccacauauuauaaugugucagagguaggaggagaaugcgaaggagaaggcgccgaaagcuaugacuagguccugguuacucggauugagaauugaggauggcuaauuuuaaagacauuuuaaauuuuaauuuugcuugcuuuuucaauuuuuuauguuuuuaauaaggucuuuauugaauagaguuccaucacgccccccucacauuucuuccagcccuucccaugcaccccacucucaaguugauagccucuuuuucuuuaagcauguguguaugugugugcauaaguacauauaaauacagccugcugggucugggggauguuguuuguguguauauaacuacagagcugaccacucugccuuggaagcccaauaaggggacuuccugagaguuagucauuuuucuucucucagcagccacuaguagccuguuaguuucugucuggggugggaccccugaaaauguucuccccuucuacauuagaauaucccuugcuauugccaugguucugguccuguuuauguggccauuucuaggagaggcuguuucacugcguacuuccugcucuuccagcuguuagaaucuuucugccccucuuuggucccuugucugcguggaaugggucucuagucgcaggugggcaaggaguggguggcgauugacagacagacucgauacaagggaguguggaucugaauguaauuugucaaaucaagcaucaaacuuuuuauacagaagaaaauagggaaguugggugacacaccggcaagguacaaaaagguuacuggauucuuacacaaaacagaggaaugcaaacacagcagaacgggcaggaaccaacugggauaaaauucaauguuaacaacugggaucaaaaacagcuccaccuaagguccacuuaaucuuagaagccaggggcaagggcuucgugcccuugccauaguuccuacucuaguccgccuucccccuaagccauuguaaauacucauguauggguguaacucagcuaucuauaguucuaaguaucuacucugguuccacuuuaggucacaaacuuccuucuuucuagguaaugguaaauuucuguguagggcagugacuuagcuauccaugcccaaggucggaucaaggacugccuagaaucuaacuuagcuauaugucaaaauaucaauccuuaggagcacuuguaauaaagcaauauuaagggaaagcacacagauccgcucaccaacuaaagcaaggacauuggagcauucauuauacaggaugccacgguuccaggagacuaaguuuccaugaacuuuucgccucgggacagcgcccagguuuucgcggccugucgcgcuugucacuacuggaguagauauagcaccucuucugcaaugcaaccugaaccauaagugcaggagcugugauauccagugggacuggacuccccaugaucuguucaugucugcauuguggccacuugugcuuuucugugaugguauccauuuucuguagagagacuucuuugaaaggguuggaaggcacaccuagguguaaggauaaaauuuagaaugucgucaggaacugugcuugucuagcugaguggcaguaguacauugucuucuaagcuccuugcacucacuaguucgcugggaagcugaucagguuucccuccugugcugugggcuauaaguucaauuagacucacaggcacgcaagugcuaucuguuccaucuuuaugcauuucuugccaugcuugcaaaauugucaagguucauggguguugcaacaggguagggcaauuuauuugcucucauccauugacagguuacauaguauuuucugggaccaugggcacuacaucacagaaagaaagcucaaaggucaaauccgguuugaauuauccaaguccuggguccuagguguaugguguuugaaagauauuuuuaagcuuauuaaagaaauuuaggaggcauuggucauucacugauaauaaagaaugauuguuuuaggagugaaaaugguuuuaaaguauuucuuuaagaaagaggguaagaaaaggauaagccaaaggggucauguaggagcuaacauucuaauauuugaguguuuccaggauaacguuuuuaauaaguuagugaauucuguauuugggcaaugaaccauggccuugugaccagggaagaacaacagaggcccgggacacguugggggcauggguuugacauugcucugucuagccagcauccaggaccuccuuguggaaguccuucccaccagccaugagccugcccagguuucagucuucuacuuuuaaaggcauggaaucauacuuaacccugcuggcauguguuaaguguuuaauggucuccuuuuaaucgcuuaaaguguuuaauagccaccuuuuauuucccauuuuuucugcuuuuuccuccccuccucuauccuuugcacaauguacaaaguuccaggaaggccaaaggaccaaguacugauggcccgugcugaagcucagcuuuugugccacauugccuccucaugcaugugucauagaacaccugcaccugucacuacugacacacauccguguuaaugguagggauguguuuccugacacaucgcagggaagugaaaugcuuucaaaauaggcauuuaacauucuggccggugccucucugcacuggauuauaaaaagaaagacaagcauaagggcuuccagacuccaaugauguagguucugaguucuuuaucuucucuagucuugacucacugccccuucagaacagaggcaggcucaaauacaccccauccauuuuaguauugaaacuuagguuugggguuuuauaaguguuaaauuuauuuucccuaagaaguaguagucuggaguaaucaguuagaggaaacaaauagaauggcuucuagaggaaggauguuuuaaguccugaacucauuaggauguguuuaacugacaagggaucgguuuacgcugcagcuggacagcgaccucuuguucucuuuaugucugucuguuagcaaccuuguuguuuauagcugacuucugagcugcuaaacuguaaagacgguuuuggaauaagucucuguaguacuaccaugaauagaaacauuggugcacaagugccaugcuuaaugauagagucuaaaacagcucuccagaucugcagucuguccccacugacgcagacuguguuggaauaaggggaaaagagucuugacuuauauauacauauauauguuaguccuuaauguaaggcacagaauuuuuaaauuuaucuugcccagauuuuacaauucauuauuucuucaagaaaucuuuuguucuuuuaguauacaauaaaauuagaaaucagacucauuuuuuuuuuuuuuuuuuuuuuuuaguucaggaauggugggcugccauauccucugcacacagacucauacauugaugugcagcuaugcaucgagccacagugcaugcaugcauaaguaauuguaugcauacauguuuuuauauuuagugguauuuauuuaagauguugaguucauacugauauuuuaacuguuaucuaauacucauuauaugauucauuuaauucuuuucuguguuguguuaguuaugguuuccauugcugugaagaaacaccauaaccaaggcagcgauuacaaaggacauuaaauuggggcuggcuuacagggucagagguucaguccauuaacaucaaggugggagcauggcagcauccacacaggcauggcacuggagaaggggcugaguucuacgucuuguucagaagggaaccaggugaagacuauaauuuaggcagcuagaagaagaucucaaagcccacuccaacaguagcacaccugcuccaacaaggccacaccuccuaaucgugccauucccugggccaagcauauccacgccaccacaugcgcgugcucuaagucacuucucucuuagugagauaucuagcucucauuguaguuaacccugaagagcugugcaaugagcuuacaaaagcaaagaucucgugcugcucuaagugaguuccuggauuguaggcgguugguuggccaugccugcaggagccuguuacuuaaaauuauuugucugggucuucaccugagggaacgccucuacacuguuacaaccaaccaaccuucccuucucuuccagaccuucccugugcuuaugucauccauuugagguacaguugguucauuugugggucuucuuaggagugauuuaaaguuuugauauuucgcauaaaaguuuauuuuucgagaaaagcuuugagagagcuuucuuggcgugccgugcaugcugcccuguugcuuggcaacaggacugguuuuacaagugcgacccucugcuuuuuagacaacagugguuggcauagggacuauccuuacacuauccuacgcuauccuuacaaagcugugagcuuuagaagagccaggaucuuuuaacaacacccuuuuagaagauuuuaucaagacauuuaaauagaauaugaaguuuacuuuuagccagacagaaguuuguugguuuucuggaagguagcucguuuuuuuuuguuuguuuguuugaucuuuugaggcagggccucauaguguagcacaggcuagccucaggcuucgaauaaguuuccugucucagcauccugaguacuagcuacaggcaugugccaccaaacuggccuucagaaaauaauuuuuaaaaauaauuacacuuauuuguguauaugucugugaaugcaugugcauaucagaggaggacuuguaagaacugguuuucuuuuucaaccaugugaaucuguaggaccuaucauaccucuuaagucucucuuagagaagucucucuucuuguggaaguaucacaagggugggggaaggucuacucagaagagugacagggcaaaucagucauacuaaguggauacuuugaucccuccggaugcuguaaucuuuguauuaggaugcuuuggucugccaugcuagcacuccugcaugccucagucagcugcaaucccaagagagaauauuucuggggccaguuauacuuacaaccaaagacuuuaaaaccagcugcauuccuucccuauguuuuacauaagugaagaauuuuaaaguuucagauguuuuguugguuugauuaagguagcgcuguuuuuauacugaggauaccauacugaguggaguuggcuugggugguacucuuaaagagccagcacuggagaacuuaacauguguuagaaugauguuuguugcaguguuagcauuauauacuauguagaaaacuuagaagugaguccaacuucacacuaaaaaugaugaaguucuuccuguggugugaccagguuuggguaacugcuagccguccacucuggacucagcacgcguuucuauacccaggagaguucggggucauuuguugauaaugcuuggauuucuggacauaucuaggggcuucagugacugcagugagugcugaguuguaccucacuccacugcaguguucucuaauuuuauugguaucacugucuaggaugugugcugaggcugccuuauaauucgcuuugugucuccaugauggcucacgcugugcauggucacguuuaugaaccaguugaaugcuuucucuugugaagaguguugauuuuucuguacuuuuucuauugguuaauuccccaccucuuuuuuuucccagaaucucacuauguugcugaggcuggccuugaacucauggccucaaaugauucucuugcuucagcugcagacaugugucccagugccuggcucuucuguuuuuguuuguaucuuuauucauuuguaggaguucuguaaauauagucaguccaguuaugaguuccuuuuggacuuguagauugcaaauauuccugucauucuauuggcuaucuuugcacucccuuacugguauauuuugauauucuucagaacuuggaacuucuagagaguugagaaaugacuaccugauguuuaagccuauaguacacuucuuacacuaacauaaagauaacacacacauucucucucaugccccaucuuuuuucuuccacauauuacucccucauuaggaagggggcuaaugauacuuuggagcagaucuauaguguccagugcucucuuccucccacagcagcagccuuuggcuuuucccaucaacagccucaccccugucuaaauuagcaaauauucuggcucauuuucggaauacucuguggguguauuucuuuucuccugcauagauaacuguuuauaaauugccaaguuguuucagaauugucuguuuuauuucugccauuaauuuguaaagguucuaauuucuccacacccuuccugauacuuaauaaacuguucuguugacuacagcuugggauguguaaugauauaucaucaugguuuuaauaucauuucuccagugaugaaugauaucaugugaaaugcacauuauucuuauucaaaugaugaugucgcaacaguuugaaacaauuucuaggacucucuguuccagauuuacugguuccauuacaagccacauaaggaaauccuuuuuaaucaccuauugguggcuauuuugugucaauaauuuccuucucucuucuaucuuaguucacuuagauuugcucuaaguguauauauuguuauacauauguguuacacauugaauacaugcaccugaguuucaggucaaggcuaugggcagacguuaaguacugagucucugguucauagcugaggccaugcgaguccaccugaucaccgaaacaucaagaaagaucugauaauaccuagaaauaaaacugcauagcuucagcuugaggacauuuugaggaaugugcugaggugaaacuaggaggccccgagggaacccuguauaaacacugcugaccaaucucuuauuugcugcuaccacccugucugcaaugccuaguucuaaagcuauuucaucaugguuugguaaagcauaucugucuuuuacagaaauuaaaucucuguaaguuuaguuaaaaaucuuuagggcuuuuguuuuguuuuguuuugaaucaguuaaauaguuauuacuuggcauucaguuuuuccuccauaauaauuugauuuuuaaccuaaguuuacuuauuucuuucuauuaauuuagcaacugguuuauuguauuacguuguuaugugcauuacaaauacugaccuuaugagagucauacuaaaugcaugcuuuucuuucauuccuaggcaaauacuguggucuggguuuacaaaugaaucagucaauugaguccaaaggcagugaagucacagugcuguucaugaguggaacccaugcugcugggcgaggauuuuuggcuucauacucaguuauagauaaagaagguaauuuucacuuuauacuauagucccacauugugucauuucugacagcaagaaggaaaugauucaaaugcccgccaucugacauuggaguagaacaggaagccugagcaucucauaaugcacacacgccaggaagaucugggucugcacugaaacgugacuguauggaugguuauaaaaaguccuugaacuuucuuuuccuuaguagaagaaauauugguuuuuuauuucugugagauuagaacacaaacugucuuaauuuuaacagaaaucuguaaaacauugagguaaacuguaucaacuuaaagguuuacuaucuacaagauacaauuucacaauucuguauaaaaggccauauuguugcuuacaaagacucagcucucauaucagcaagagcguccuaagaaaugcugaggccggacauaacaaggucuuuucucauuguucauguuuaggaucuaaaggggaugagggguuaaagucaaggauauuacauagaauagaauccagaauguauuuggucucuaacagaaaacacugcaguggcuuguguuucaucuucauuauuagaggcacugaagaaggcagcucagaagcggugucauuggaaggacuauggaaacagccauuugcauuagaaaauagaugguuauuccuauguucaacaguaaauauucuaaguuggccauuuaaauuuaaaaauuaacuuuaacuucaugcuuuuuaaaugaaaaaaguucaagagccucccaaagaugagaccguugagcucugggaacugguacggguaaaucaagcuggcugucuuaagaucucuggcauucuugguaaugccacagagucagcacacugaagacuuacaaaucucuauuccaaacuagagauaggcuccuuaggaacuugauacuaacacuucccaaggggacaaucuugagaaaccccauuucccaauugacaucugaaagcauggaguuuuguauguccugucccguucaucaaacauaguuuaauuugacugaagucaguuggcaaaaacauauuugagggaacacuggcugaauuucuuauuacuucuuggguggccucucagucacauuuuuuuuucuaggaacucacuuuacucagaggcuguuuggcuuugguuaagaucucaguuuguuuccauccaggaaacugagcugccacuaaauuccguaaauacauagaaggaucaucgcuacuugucccuagcuaaggagucuaguugaaauuuagaguaacagaauaaaauguguaugugugaacagucuugcuucagcagcugcuugguuucucauagacucucacaaagauugcuaauguaugucuuaugguuuauauguauauauacuauauaugcauacuauauaguauguauagagucacaguuuuguguaagauagggugacuucauuauuuuguaucagaacacacgcaaaguuauggucucuuacauuuugugcuuuagacuugguagagugacuugaccagguuugugugugugugugugugugugugugugugcuagauacucuuccaagaauuaaaaggucaugugauacaaacauuagagugaugucaauuuuuaaagacauggacagauuaacuuucuacaagaacacacuucagagaauuagaauuuguugucuuugugcuuuaaguuauaaugagagauuuugcugauggcaaaucucucuugaaggggcccagaauugucgaugcccaugucauucuggggucuuucccuagcauccccuuccacuuuuguuucuuguuuuuaaaacaucaugggguguuucccucuuuccuguucuuguuuuuaauuaucagugagcaguaguuaccaggcuuuuucuccuuuuuccuccuuuuacaccaaagagagugucuugcaucuacugugggacagugcucccuggucacugcaggcaaacagaauaacagcagaaagggggcgccacaaagccuuagggcgguccgaggaguuaccuuuccuuugcugugcuaaaaaugccacggccaaagacaggagacaggguguguugggcuuacauuuccggaaggacaggaacaagaguccaugauggcagagcagaggcagggcagcuggaacaggaagcugagaauuugcgucccccacucgcuggcggagagcgugguuuauuuuagcucauaacuccaaguugcugcaggcaagaaaccgagagaaaagucaaaauaguucucaaagccagacuccagugacgugccuccuccaccaaggccacaccccuaaagccucccugaacagcaucuccaaccggagaccaaguaucgcagugcccaagauauccuguucaaaucaccacagccucucugcugugaacuggcagaaucacaucacaucccaacuggaauuucugaaaagaugugugugagcccuugagguauccggaacauaggagcaagaacuaaggagguucuccacagagaagggcuccugaguugcugcuggucucaguaagagucagagcuagccucucagaguucauaacucuguaacucagaucucucaaucaggguugguaauaaaugcaacuauuuucaagaguaaauuucaauucaaaaacaucauuuagagcuggagagaugguucagcagcuaagaguacuuguuauucuuccaaaggaccccagggucauucccaacccuuacacagugguugauaaguguugcuaacgucaguucuaggugaccuaccacucucaucugacaugugagggugccaggcauacauggggugcacauacauacaugcaggaaaagcauacacauaaaauucuguuuaaaacagcauucaauuggacuugaaaaauaaaaucaauucuauaaaugugugaucuaaauuucugcuuucgaaucacgucaacccuggccaacuucuaaaaguauuuucaauagugguucuagaacuuuuguuacauagcagugagcuuacaucauacauugcaaguuucaggcuggagagauagcucagugguuaagagaacugacugcucuuccagagguccugaguucaauucccagcaaccacaugguggcucacaaccaucuguaaugggaucugaugcccucuucugauaugucugaagauagcaaugauguacucauauacauaaaauaaauuuuaaaaaaauuuuuaagaagguauauaaaaagaaaggagaaaaagaaagagagaaaggaagagagaaagaaagaaagaaagaaagaaagaaagaaagaaagaaagaaagaaaguuaguuaguuuguuucaaauuccucaaggcaguguuccucuguauguuccauaacugguguguagguagguguguacacacaggauuggaaaauuacaauuuagacacauuuuagagagguuugaaucaaaauguuaaagguaauacuacauuauuuugggucucgccaacccagaauuuuggaguagggagccuaaacaugccuuuauuguuuuggaggaaaguaguaaauaguuuaugugacacagaacggucaguauggauccgcauucucuuccuagcgugagcucucauagguguucuacccuagagugugcugacacugaacguaagacuucugaacagcugagccugaaaacaccccauuggcgggucgugguugcaggauguugaaguguuuuuagaaucaacaccaaugucauaaagguuuucugauuguuucuuucuuuuaacuacauauuuugugauuuuuuucccauuacuucagucuuacaucagaguguaaaauauugugacacauagggcagaauaaauagauagauagauagauagauagauagauagauagauagauagauagauagauagauagagauauauauuuuuauaauagaguuuuaguuucuguugcugguuacuuuuucuuccauguggaguguuuuugcuuuugacacuaggguaugaauuuuucagacuguuuguugccuugacugcacaguggugacacaagaucaguuuuaugucagggucugcuuuuagucagguuucuguuuguauuugccaugcugcgguuuuaguuuuuguaauugucguguccuacacacguuuuaaaacucagaauguagugaagcuguuagugaagcuuccauuuauauuccuaucuccagaugugcccuuguuuauaggcagaugaaaaaggaacccacacagucguguguggguaauauaaauagcauaccagaaaacuguauuuuaguguuaauuuaggcaacaagcguauugauuugcaguuucaccacauuugcagagaggacgaaucuuaaacaaaauuuaaaauagaaugaaucuguugaaauggugggccaaaagaggcauuucagcccaugggaugaaaacauacaaacaaccugaagugugccauccuggcucuguuuuuguuuuguuuggguuuuguuuuuauguuuguuuuguuuugggggaggggacaagauuucucugugcaguccuggccauccaggaacucauucuguagaccacgcuggccucaaacuuguagauccuccugccucugccuccagagugcugggauuaaaggcgugcgccaccaccgccucgugaccauccugucucuaguguuuucuguguuguuggggauucugauaacuuagaaacucugugaaagaaccacauagguauuucacugaguuaaggcaaacagucacuggugacuagugacacuaguuccuaguguccuagaugcuguguagaugacaaaagaaacaugguguugaauguaugugggaaguuagaugggggugggggggugucucauuugaugacauuaacuguauguggcuuacagccuaucuaauuauacuguuaacuacuuaggcagcuuagccaguucuuuacaucguuguuaagaaaucuuacucuucaucacagaaaugugcccaacccccuguuauagagcucugcuuccucagguaucauugucuaagagaagccuaauacuuaaucucugccucuaaguauugaucagagaaaucaucuauauuccacauccucuuguuucuaaacaaagacaucuacauacccuuaaguaaaguaauuaaaacagugcugcuaugccagggacucccucagguuguggggagcuggccuuuuaaggaauuuuagaggaaaugaaagaguagaguuuguaaguguauauguaggguuuuuuuccccuguuuucucaguucuaguaaguaaauauugucaccuacgaacaguacuugauguuuuguuacauuuagguuuuauuccuguagaaagaaaugauuauaguuguacaaaauauuacauaccacauguguauguuuuauauaauauaguguaaacuguuauauaaugguuccuaaugcuacugggaguuuuugcaguucaaucaagaacagacuaaaguaugacuuagggaaagucuaaauuaaaauagucauaauuacgcuaugucagaaaaaguuaguuaggguugucaaucaaaauagccuauucuaagagagaaacuaauguguucuauguuaaaugauuugcuggcauaaaaaaguuauauguacaguguuauauaugggucagccaaagguuuuaaaguauguguaaauacauguucauagagcacuugcaaaguucucuauaaauuauauuuaaauuuauuuuuuaauuguauaaaaauuguugcaauauugugugcaaugguguuaaauuucaaguugcuguagaaaaauaggauggucucuaccaaaauauagcugagucuggcccuucaggguuagaggguggauggggcuuugggugggacuuaagauugcacucccucuggguuagacucuauugcgacagcuaguguagugcugccucugggggugcugguuucuccuugagcugcacagaagagcaagagugaagggcccugaagagaaguaacaugcuguauaauaaugugugugcacauguucgugugcguaugugugugugcgcgugcgcgcagucuuguacauauguauuugacuagcaguuauagaaaagccccgugcagaagcucuuagcuaagcaugugauuauuauuacuauacucugucugcauaucuaguagagcacugauguucuggcaguucagaguaaccaaguagauuccacaucaauauuuauuauuucaauauuaaauacuuuacauauugagcuggucuuuuaaguuauucaguccaaagaucuugccauuauuucuaaacuuccuaaucaucugccauuccuugagguauaugaaaaucugauuacauguccgcagcuccacucuuagccacugcaguugaaguuacugucagcguugaccucaauuacgauaauggauuucuuucugaccuuuguuucuacccuucucuuugacucugcuuuuaauauaguaguagugugaucuuauuaagaugaaauucccaucuuauucugccaagugcccuugccuccaggacccuauaggauucaauugccuauugcucuuuucacuuuguuucaccguggcuucauagguagugagcaugcaccuucaccuuugauuuuuuguaccuaccuucagcuccacauaccccaaaccucaucacccaguuaaaguuuuaaucagauguugccuuugcaguaaaguucauacuggacauaccucuuaaaaguuaaguauugagcuuucccugacuucuucuuuuuaaaaauugguuauuuuauuauuuacauuucaaauguuauuccccuuuccuguuucucuccugcaaacccccuaucacauccuccuccccugugcuucuaugggggagcuuccccugcccacccacuccugccucagugccuuugcaucccccuucauaggaccaagggcuugugguugguaguuuagucccugggagcucugggggggggggggagccugguucauugauacuguucucccuaugggguuacaaaccccuucagcuccuucagucuuuccccuaaaccuccuuugggguccccauacucaguccaaugguuagcugugagcauccucaucuguauuggucaggcucuggcagagccucuuagggaacagccauaccaggcuccugucagcaagcacuucuuggcaucagacuggguuuggugucugcugaugagauggaucccuaggugagacagucucuggauggucuucccuuucgucucugcuccacucuuugucccugcauuuccuuuaaacaggggcaauucugcguuaauauuuuugagauggguggguggucccaucccucaaccaggggugccaugccuaaccacuggauauggucucuacagguuuucuccccuuucuuggguauuucagauacugucauucccacugguccugggagcuucuugcuuuccuggcaucugggacuuucuaauggcuacucccaguuccccacucuguacugcuacacuccucuguucaauuuccugacccucuguacuucucucccaccccgugucuccucccacaccugauuaugcucccuucuucccuccccuccucccucccaggugccucccucucucuacuuccugugacuucuuacugcuuuuguuugucuaaaguguguauaucacuuucagcucuaugauauauccauuuuuguaauaauauauucuccuacucucucccgcuuggaggcauacucuccauaugcacauaucuuugucugacuggacauuucgcuaauaccuauuguauuuauauagcugauguuugcugggaaauaacuguaugcauugcccacuguggcucuuuauugugccaaugcuauccagccauaacgaugugauauauauuaaaguaaaauggcuauuaauucuuauaauaccacuuuauuuuuaauuuuuaugacaacuuuauaaagaugaaauuccuauacagguuggccgucaugcucagaguauguaauuuauuuuucagaguuuucagguucuugucauccucaccacaguuugagaacgucuuaaaauucuuuccaacaucuucaaaacagcccacaauuagucuuagucggucuccauucaucacacugaacucacuccacccucauuaccacuccugcuugucucuagcuacacucguucuggaugcuucaucaaggauaaugugggguaccgugacugguggcuuucacuacuuggcuuugccaaguucuuuuggguuguaaccagugcuauguugguuuugcagccaaacuauauuccauuggcuagauaugcauuugucuuuuuaaugauacauuuuaauacuuuuggauauugcuucuagagucuuuuuguuuguuuguuuuuguuuuucgagacaggguuucucuguauagcccuggcuguccuggaacucacuuuguagaccagacuggccuugaacucagaaauccaccugccucugccucccgagugcugggauuaaagcugcuucuagauucuuaacagauguaugguuugcaagaauaauuuggugugccagugucuuaguuguucuucuguuacugugauaaaacaccaaugcggacauaacuuauagauuaagaauauauuugagcuuaugauuccagagagcuagaguucauaacgauggggacugcuugguggugaggcagagagcucaaagcucacaucugaaccccaggcaugcaggaaacagauuaaccuggaaguagguaaggcuguuuaaucucaaacccaucuacagugacauacuuccuccagggaguuacacuaccuaaaucuuccugaacaucuucaccacuuggggaccaaguguucaaaugccagagacuauggggacaaucucacucaaucccuguuaccagcuuucuccuuaauauuauccucugaagcauagaagucucucauuaucacuucagguuauuugaguuggguugcuguaguucccaucauuuuuaagguaucaauucuuaauccaaagucaagauuuacuccuguauuauuugaaaggucugcaguuuuaguucuuaaauuuaggucacuuugaguuaguauuuguguaucuaagguagguaacuaguucuuuugagaaugaauaugucauuauacacggaugucauguuguccuagcauuauuaaaaagacugacacaccaacauucucuuccauugcauuauccaaauacaguugucaaaauuuacuugguuauaaauuugaagguuuaacucuauuccaauuuaucacaauaacuuccucugcauugcugucagagccuguaagggcagauauauucuuuuuaacuauauucaccuugccccggcuauguucuuauucauugagagcuucauaauaacaguuuucuggaaagcuaguuccuugggaaaagcuuucaggaaaggcauauaacuucuuaaauccuuaauuucguggcuuuuauuugccuuccuggagcuguaaaugucagaguucguacucaugguuuucccuuccugucuucugucuuuuggcucuccgaguuguccacuuugaauucuuacuuuccucuucaggaacucugggcagccccaguggaauuugagagccagguaauuauuugcacauuagcauggcuugguguguggcuuuagcccugcauggaccuagugcugaagcaccauugugcguguggucuaaagguaaccgaggccgcgggcagcuagaacacagguacuguucauggcaggcuuuuacuuucagaagcuaagcuucucaccuuagagguuugaaauucuguugcuagaucaagaaagaagaaaaugauuauuguugaugcugugcaaagguggauaggcaaaccaucccauuuacccuucccgugaacuaucaugguaacagugagcccuguagauaacuccuaacacacagacuuaacuugaucguucagcuaacaguggugcacacauaucgaucucuacaaguugcucugaaaacacugcauuccuaucuguuuaacacuacacccagggucuuauaagacauacuucaguugaguagugaacauauucuuuuagaguaacuaccugaaaugauggauuaucugggcguggcacugagacuguuaaugcgacauuuauguacugacugugagguagaauagcaucuaucucagcugggguuuuacugcucugacagaacacuuugaccaaagucaaguuggggaggaaaugguuuauuuaaucucauagcuuguagucccucauccugggaauucaaaggcagggacugaagaagggggcaugaagacugcuugcuggcuugcuaauccuuucuuacagaccaggggaugaccugcacaggaauaguaccacucauaccacccacagugggcagggccucucucaucagucauuaauccagacaguacccuucagacuugcccguguaucacuuuucucaguuaaagauauucccucuucccagauauuucuagguuugugucaaguuggcaaaguuaaccaacacugacugcucauaacaagaucuguuauugccuuccagucagucuccuuccagguuuucacccuuagguuuaguaaaugaguggauguagccaaacaagccaacaaacagaaacuuuaguucuuccagauauuccaugauaaauguucauugaaaguccccuguauacucaaacacaguaauuccuaauuuuuguaauucagaaaagggaaaacacaguucuacccuuugucuaaggaugagauauuacaauaaugccuguaacuuuacagaccugucagcaaguuagucuuuuuaucacacauauuaugcugggagcaugcauguguugguuaagucaaauagaauggaaguguuguuuguggcuaaagggauuucauauguaaagggcuaggcagcucuuuugacaguaaauuugaaauauuaguagucaguuaggcuuugggaggagacggggcagcaauagaaaagcuuuucagaagagugugugcccaggaaugcaggagagugugugcccaggaaugcaggagagugugugcccagggaugcaggagagugugugcccagggaugcaggagagugugugcccaggaaugcaggagagugugugcccagggaugcaggagagagccaaguaaccaggagcugaagugaagaugagguugacagugaaguaaggucaacccugcauccugcugugggcugcaaucugggcuguguauucuauccuaacagaaggaagggaagauaccuaauguuuuuaaguaaaagcuacuuuuuuaugugccuuggacugggucuuuaauuagagguguguucgcuuuuauucauauuaauuguugaaguuacaguuccuuuauagcgcugaaacuugaaugugcuuagugauugcauggagccuugguugcgacagaaggcuugcuuucuuuagaguuaccagaagaugucgcugccgcugcuuccaccugugcacauuuggaguuaaaauuggagccgugggguuaacuuaccucuuuuguauuuuaucauuguuucuguuucucuuuauuaauagcauaggucauuuuuagucauaauaacuaauaaauguuuuucucucugacuugaggguuguauuuuauggaaaccacugaagaauauauaaacucuacuucucuaugacuacaugugaucucugaauucaggagguaauauaguaaaaagcuguauuaaggaaacaguuucagaaaugaagauacauaaaaugagagaaacugauuaacaaaaguuuguaaaguuauagguaguaacauuuuaaaauuuagaugaauacaauuugagauuauuuuacaucuuuucuagauuuaaucacuuguuuggauacuguaucuaauuuuuuggaaccagaguucagguauguacuuguguguguguguguuugugucugucugucuguauguauguauguauguaugugcuccagcacaccucuucauucucauucuuuuauacugcaugguaguguguaaagcgugauacauugguuaaaacuccagucaaacuguacuuaaagucauccaguugccauguuuaaauuuuacuucggagauuacaucuccaaaacaaaagcauaauuuuuauuuugauuauggauuuuauggaaauguguauaguucagggucucacuguguggccuagaacuagagauccucccaccucugugucccaggagcugggguucuagggaaagucugcucugaagguaaaaggcucagucucguaaagcuggcaaggcugcuccuaaauagcggaacuagucuuucuaaauuuuaucuuaauaguauuuauucuuuaaaggucuccuacauuuauaaaauauauauugguaauagccauccaccacuaccuccccucaugcauggguggccaucacuggggcacaagcaguaugccaguggccaaacccucaaggugaguaacucucucucagccaccaucacuuguucuucagauagagcuuggggcucauagucuuuauuuuucuuuucagauagauacauagaugaucgguagguagguagguagguagauagauaaauagauagauagauagauagauagauagauagauagauagauagauacauagaugaucgguagguagguagguagguagguagguagauagauagauagauagauagauagauagauacacagacagacagacagauacacagauagacagauaaauggcauaggcuauaagaacauucuuaguucuuaguguucuuacuuagcaccuccagcaauaucugcuuuaugccuuuguuuugugcuuagauaagaacugacuucuugaucucccauuucuaauccuuuguauuuggggggagugucaagacagguuucucuguguaguccuggcuggccuggaacucacuuuguauacccagcuggccccaaacucaacaauccaccugucucuaccuccuaagugccagcauuaaaggcgugcaccaccacaccgggcccuuauuucuaaucuuuguugacuuucuucuguuagucauaccucuggcauuugauuuucuuaaauucaauccugguuuuccuacuuaaaacucuuugaaacucuuuuguguguguguguguguguguguguguguguguguguguguguguguguguguuuagcugugcauauugccaacccaguuuccaguguuuuugacagguaacccuugggucuuccccgcagucuugucacuaugcaguguuuaagcuucucccaagacaguuugcauaguuacuguaucccucacugcuuagcagaaugcccucaucuuuucaaugcccuucucgguaauuucugccaugaugguauucccccaaagacugggacaguagagcuguucagucucccagaccuuacaaaaaaaccauuuagcacacuccuauaaucccagugcagaagagguaaagacagaaggaaccuuggagcccagagccagccagccuagccuaguugaugaguuugucuuucuuucuuuauuuauuaugcauacaguguucugccugcaaaugugccugccagaggagggcaccagaucucauuguagaugcucaugagccaccauaugguugcuggaaauugaauuuaggaccucaagaagagcagcuaguuaucuuaaccucugagccaucucuccaaccccaaguuugaauucuagguucaggguaagaaccuuucuccaaaaaauaaggugaagaaauacugaagaauguaccuggcauugauuccauccucuacacacaaaugaacauguauucaugcacacacagacaugugugcacauagaagauuguuauuucugugggaaacaugcuaccuucauuguuguuacaguguauucugggcaacauggcggaagggucagcugggcucccucugguucccagcacugucaucaccacccacaucugagcucucgucacccucucgugagcuucccucucauuuucucuuucuuuccuagaagccagaauaagcucucuaaaaagcuccucaccugguuaagccuauaagcugcucugauccuucacuggcuuccucuguuuaccuagaaguguauccccuacaucuguaguagaagacccacauggcuucugcggggucuggauccugccccucuaaccuuccuguauucgcuguacuuuuucaggagcacgccagacccucugucuggggccaugcucuuucuagcuuccagugugcauaucccaucacggacuuaccucagugagacccacuagcucaaauaagcugugucaagcuguauguaagaggagcccaacuuugugacuccugugcacaguucuuuuacuuuccuuguuuauaagaugggaguaauaauaauaaaaguaccuccuaugugggauucugaaacacuugggguucugccccauacauagcauguuugauaaauguauguguuuuguuaaauaguaauucucacaguuauuucaaaauccaucuucuccaccccaaauaucuguaugaguacuggcuaaguguuuucuucugcaacuugaauauggacuuaggugacagggcuguauuuauuuaauuagcauucagaagucacaggccucaucagauaacauggcagacauucauauaaaccugugagccaugguaacuaggucugacaguagaaagacgucuacuacucauggugaaguaaaauaaggaauuguagauuuuuugaaaauauuuucugucugucuguucaauauguguggguggaagaagucuauaugggcuauuuaacaagacauggccgcauuucaugcugaggcugugcuguguaugcugaauggacgcaugcaggaagugcauguggucuuucuuuggcauuuucccugcagaaagugagcauucuguaaucuuucacuuguuuucauucucaguaaguacugcccagcuggcugucuuuugccuuuugcugaaauaucuggaacaauuccucauggauacagagauguaaguugaauacagacggacuucgcugcuguggauacuguuauuuuaaacucagaaacgcuuaggaugccaccugguugucccaagaugaauaugacuucugugucucuguuuuuucauauaugucugacaucuuuauaguaaaacuaacucaugcuaagaauguguuuuguuacaguaaccuauguuucugagaucagaauauguuuugagaaagaauaaguaucuugcuuaugaauaaucuggaaaaguuuucauuuuguuauuuuguuuguuguuugcuuuuucaagucuucaccauuguguauggcuggaauccaugcaggaguagugucaaacgugcuggguggccaaaucagcauugugauuagcaaagggaccccauauuaugaaagcucuuuggccaacaaugucacuuccacgguguaagugcaaauacucuuuguaguaagcaugcugcuuucuuuuauguaauuaucuguacauccuuucauucuuuucuguguucugcccucuagagagaguuugggguaugugccauuuucuuucauauguaaaaaaguauauauuuuucagcauuuuaagaguugacaguagguuaugugccaauauuguaccaucuuauauaaaauauguggacauuugcugauuucauaucugucagggaauaugggaaguccugggacugggacccauagauaucaaggaacagcugcaugaguguguagguuucugguggaauccaagauggguguggcggugcgugcuugcaauccccaugccuaggccauagaagcaagaggauggggggaguucacagucgaguuaagcuaauuagugauuucaaugucagggaaggcugugagagauacugccucaaacaaaauuaaaaaauacuuugcaucucucuucugacuguuugaacaucauguuaagggcagggcguaacugaacacccuccaggucuccuggagucuuaaguguucuuggguccccaggcaagggaguucuucucuugucugacccuuccuccuucucagcucacucacagacaggcucauuuucuccaagggaaaugcaguagccagcucugguguguuuaccaggagacuugagucucaccucguucucugaaaacacacgucuucauguucuuucacagcaggaaaagagaaaaaaaaaguuuuauaggccuauuucaugaaaaguucacacacaauugugcaaauguccuuguaaccuuuaaggcuuauuucuucuuuucucucuuucaggggauacuuaucugcaagucuguuuacauuuaagacaagugguaagccuuccaaggacuuaagccaucaucuuugcauaauaacuaaugcuguauggagugcaaccaggcaccuagugacugccaaauugcuuguucuuucucauaugcuuuugagaacgccaugaguaaaauagagcccuaauuauguaaagaacaggcuaaauuggaaguucacuauucacuggggaauuauaagcaaguacuggaucccuuuacgaauuugauuugaacuuaucugaagaaagaguucauugcacuggucugaugcuugaagucagacagggauggcuuuacagaggauaaagcaaacccuacagaaggccaaggggagguugcccuccaaccucuggguccccagagacaggauaguguaucuccauagacuaacagcuaaugcuuguaaauaugucuaguugacgaccuucaaauccauggcuuucauaccuacagauuggaaagauucagaggaaauccuguuucugugcuguguagccuuuuuuucaauguuguuuccccccaaaaauaugguguuacaacuguguguauauaucacauauauauuuccuuuggcauuguaaguaucccagagaugaccugguguuaacagagagcaugcuaugugccagugcuguuccaguuuauaucaaagauugaagcacuugcaggucuuaguguccaccagggaguaugggauguccuggaaguggacccuacagacaacaagagacggacugcauguuuguagguuucuggugggacacaaaggcagggucccaagaagcaguuacuuaguuguuugcaaaucagaaguuuguagcaaacacuguuuuagagauuucaaaguuaacucuagggaaccaaguugauuuuccucucuccuucagguugcuaugggacucuggggauggagucuggugugauugccgauccccagauaacagcaucgucugcacuggaguggacugaccacauggggcaggagaacagcuggacagcggagaaggccaggcugagaaaacccgggccucccugggcugcuuuugccacugaugagcaucaguggcugcagauagaccuuaacaaggagaagaagauaacagguuaagagacacggcuuucugcagcacugcacugcacugcacugcagcacugaguuuauuuggaaacccauggcagcugaaauuuucggaaauuaggucacugaaaauuauauagcuucaguuuucuuugcggguauuaauguugcuuggguacuuuuuuucaauuuggccaaaagaagaauuaguauuuaauuuuuaauuguucuaguuuaaugugaucuuuuuaggguagaguuucaguaaagugaucuuugagucuugaaaaaucuuaguuauuuagaaauguauaguuaaggagaauguauuuuaaaugcuauuaaguaccuuguauuccacauguacugaguaucaacuuaacuuagguaaacuuagcagugacuugagauaauuuugguuuagauacguuuguuaaaagacugacuuuugccuaccagucaucaugcuuaauguccauacccaggcaaucauuccuaguaauuggaauguagcuucuaauggugugaaugcaggcugcaaaaguacaauagcccuuuccuugcaugugcccgcaguucuuccaucucuccaagggagcaaagccagggcuuuagcugcuaauacaauguaauuguccacaaagauagaaacaagccauagaaaugcuugcagggcguaucaggugugucuagcugacuuugggagccugaggcugcgcacucaugagaagaacucuauccugcagguaucguaaccacugggucuaccaugauagaacacaguuacuaugugucugccuacagaguccuguacagugacgaugggcagagauggacuguguacagagaaccugguguggaccaggacaagguaaggcgauccuguaauguuaaaugccauguugucucacucuacucucuccugguuguuuucgguacugcuugcuacugucuuccuaguguuucuaagcaggcuuagaaaauugucggugauucuaggucuuugugauuguauaauuagaacugguuauaauuguuauuggauaauuauccaaguauuuuggcugcuaaaguaagaacuucuaaauaguuaccuucaguuccuugguuuuuauaaagccuaccaaauaauggaaccuugacuuuguucucagauuuugacuaagcaagaggaaagggagguggaauaaaaggugaaguacacuaaagauagaaaggccauuguaagaucaccucagccguuucugugccaggacaaaucuggucuucccacugcagaauucccauaguuuccaagacacuucagcauuuuuguuuuagugaaauccuguggagacacuggaacuggacaagcagggacaacaugggagaauauuggaaguaugucacugggguguugucccauccccagcuuccugcucuacccuugagagaaucucaaaaugaaggcaccucuguccccagggaagauggguggugcuguguggaguggggacugacggcuucuuucagugagaagcgcaguacuucccagacuuucccagcccgcuucuuauuucauaaucuaucucauggcgaccgcacagugacccuguugccccuucuuguucuuucauuacauuuuuuuucuucuccccaugaaguauccuuggaggaguuuguuguuuugguuugguuuaguuuuugugggguucuuuguuuuguuuuaguuugucuuuccauuguuuuauucuccugcaguguccaaccuuuuaauuucaucuaauggauuuuuaauuccaauacuguauuuuuuuuucucuccuucauauuuaccuuggguuuuaaauuuucuuccauauauuuuuucauaggcauaugagcacggaguguguucaucugguaauuuuaccaaacacacaccucagugcuagccauuaugcuauugauugcuucuggguguuuuuauuagcauuauuaauccucuguguguguguguguguguguguguguguaaagcuuuauucugggaugcaguuaagcuaccaggaaaacauuucuuuauacguauugcuaacuugacagucaccauugagacagugucccaaguauuaugaaauuuacucaugagcugaugauggagagcguuuugaagccuguguugucauaagcuuguucuacuuaucacaggguucuuuuucugacucuaaguugcuucuggcugaggacuuaggggaaguuucauacagagcccaguggccuugcuguaguucauccauuccugcugacacucauucugucccuuuccuguccuuacucugcuaagcucuaccccagaaauucuagguuucugcugaccucauggcuagcaaguucucuagagugugggaaagccuugcccugugaccuggaaauucaccagucaguacugauaagcagagugugucuuguuugggccccuacucuguaguucugacccuuugcugcccguugcccagugucuugagaacuacugcguccugccgugcccuuucccaguucuucuguuguucauggcugagguccagcuucucucacucaguuacugacagaagaggaaggcucugaacuuaaugaaauagcacauaucuucacacuucaaucuguccaucucuucgcuucucggguaacuuguauuuguuuugacaugucuucuaggucucugcauaccuacagagccugagccagaaaguauaaccaaucuccuaaacuuccauaauuuauugcuuucuaauacuacaccauguuuguauucaggggagaaugagagagaauguguguacuuuuucaaaaauguuuccuaaggaugucuaacaaccuucccugugcaucagauucucagugaauguuggcagauggacuagagcauuucguuagggucacguauagccagcccagugugcacuguguacuugaggaagaccuugaacuugugauucugaaacugacuucauuacagaugugcugcaccacacccaguucuaugaggagaugggaagagaacuuaugacuuugugcacauaagcaagcagucuggccuacauccccagccuuugccaacaguuauguccugaaauguuguuucagucaguuccuguucacugauaacaaaacugucagcauuggccuuuaaucuauguuagagcaggagcuagggaaaguauggaagcuuacagaaagggggacuguuggaaguauagagagaacauuauagaaacuaaaagaucuuaauguaucuuccagcauguguaaucuaguuacaggcagauggaccaggaagaaauagcuguccuacuugggcaugacuuaggaaguccaguaugcacauguucucgcuuuagcuaguggaauggauguggcuaauuuggcacaaggggaaaacaaggcccugcuuaacucauugaagcccugcgauuaagucagaagucacagucagcucagcuccugcugcuggccucacacugucacucuguggccacucuuucugugcccugccuugaggaccacuaauggcaaauccaugaaaguacuguauaaauagggcugacugaggagaaaacacauuugcuugaaaggguugagguaaugagauaaucacuuuuaaucauguuuucuacuuaaagauuguuuuuauaaugcauguguagcuguugaguuccagucguuaaaucaaacacagaauagcauuucaggguuguugcuacuugggguaagcagcaaguccugacaacugggauuguggugugaggagugccguaacacgguugguccagcagguggagguagaggccuggcccaugagcugaggccuuugugugauggcucuuuuucacuuuaaauauaaacuuuagaugaucguuaguuccacagggauugacgaugauaguuuauugaugcgaugagcuguggcccugcaguugaaacguuucccguauugccagguuagcuaucacuccuguccaguucguaagccauccuaacaacauuuuuguaguuaguguuucccucagauaagcuuccagguaaaaugugcaguguuuuaauaacugcuuuuccaaaugcugauugaguuguuuucugagaagucuguucugucaucauucuuuaucgauguuguugaacaugcuuagcuggagcagucuaguucuggucucuuuuugauguaaaauaccaauuuuuguuauuuuuuaaagauauuucaaggaaacaaagauuaucacaaggauguucguaauaacuuuuugccaccaauuauugcacguuucauuagagugaacccuguccaguggcaacagaaaauugccaugaaaguggaacugcucggaugucaguuuacucucaaagguaaagagccaguguggccaacagugguccccaccauugcccuuuuaaauuucccacuuaacugacacacagucaucacacacuuaugguauaccgagacauuucaguguguguaugcguauauaaugaucagaucagguaaugaucaugucagguagauacaguuucuuuguauuugacacuuuucaaaguccucucucuaguaggaacugcucauuuguuucccuguuaaaauguugccaucagaauaguuucacaaugcaaaugagacucuccaguucuggucuuggagacuuuuaaaauuagguucuguguauuaagauccaugcauugaggguuagagcagcaaccuaagcuugaguaacuuuuauuuugaauuaacaaaaaacuggaauaaauucacccaauauuuuauaauguuuuaauguuauuuccuuauauuucacaaagcuaucauugugccagacauaguuggcucuccauacacacucguuaaaugaacugaauauagcauauauuagguuauagcuauagaauuggauagccaauaaucuucuaagguuaccuaugaauuaguuaauuauuuaauuauugaaaaucuggaaaaucuuauaaagccugaaaaaucuuaguuuucuugcauuuaaugcaaaguauaauuauccauuggauucugagauuuaaaauuguucugcagaauuaagcaauuuaggaaauguugaacauuuaacauugcucuuuuuaaacuauaauuuuuuuucaaagcaaaauguauaagcauuucuaacccccuuuuuaaggucgccuuccaaagcuuacuccaccuccucggaacggcaauaaccucagaaauacuacagcucgucccaaacuagguaaagguaugccugcuuuuaaugugagacuuugacauguccuguaacuauauuuaaaacauaaaacugaacuuuccuuaaguuauuaauguuuaaaaaauaaaaaaagguuucuucaaacuuuuuucaaggucgugccccuaaauuuacucaagugcuccaaccucgaaguaggaaugaacuuccugugcagccggcggagacaacuaccacuccugauauaaaaaacacgacuguaacucccaguguaaccaaagguagguagaucaggcacggacucuucccuggugggguucuugcucucaauuacgaguuuccagcucacuuacuucaucuguauuuuuccagcucauccaaaauaaauaaauauauaaacuugugucuuuuauggaaaagccugugggaagcucagucuauucugauacaggaaagccuggugcuuagcuguguggucuguguccucucggccuccucuuaugauccccagcagcuaagcacgagucccgagcucagaaacucagcacuucuagaaaugauuaaaccacagcagcaaacaagcuuuuuuacccacauuauauauuaauucacuaauggggagagcugauagaggagagcgaaaaacaucuuuaaauuguuuaaaacauuuaaaguuuuaaaauguacuucaauuaacauucuuguuuuuuuuaaauacccucugcuucauauacauuuguaauuuucugauuauucauucagacauuagaguuacuucuaaauugcauuacagugauaaauacaguguuacauuguacaaaucacuguccuuuuugcuuguugaaaagaaaacuuucaguuaaauucagaaaauaaaaugucagugucacaggagaauuagcaagcagggcuaacaugggaaaaaaaugcucauuuucagcaaaguaugggaaagaaagcguuaccaggaaaacccagugcccaucucagucaaagagagaaguucucuaggacgguuuuguugcaggaugaggaggagacgacagggcagauaagcuggaaauggucagagcugcagaguuggguggagaacaggaaaggagaaaaguugguaaacagggugagcgcugugugggagagaagggccucaaaaaaugagaaccagcaucccccagggguggggggggcacaucggauacccuaaaagagagaagaaggacgaggaaaagcaugcuuuacugccaggcugcugcagugcaaugcgggguugcgaggcuacuggacugaugcuaggcucuuacgccccugcacaaaaggguuguaccagggaugcaggauuagaaauaaaguagauaguuuauaaggaaaaaacacuucaggaguggaagugggcuuacugagcuaaaggggagcuuccagacucuugggccacauuguccuuuuauaggacgucuaauugcacccacacuucuguuuguauuucacaggcuuugcucacacguucucuacuugcacaugaaauccugugggaaaagcauccaguccucauauggucuggcuuucaucuugaucuuuccagccccagucacucuccugccucuagaggacgcuuccuccacaguagcucccccuccucuauaauuuauuaaugacuuugacuuucuaaacguuuauauaaauugagauaguuuucuccagcuuugcagacaugagccucuucccuguucuuaucuuccucaugguauagaggaggcuagagagaaacuggagagcucaaagcaaguacaccccagcuuuggggugguagaagguagcccucuacaggugugugugugugugugugugugugugugugugugugugugugcgcuuuccaagucuaagcugaauuguuuguguguacacauggagaccagaagacaacgucagauguguuccucaggcaccguguaucuuuucuguaagaugggaucucguucuagccuggagcuugccaaccaagccauguuagcuggccauugagccucuaauucugccugucucugucuccaucauacugggaugaccaaagcauccuaacacucccaacacucauggcuuguguguguguguguguguguguguguguguguguguguguguguguguguuuaacauggauucuggagacugaauuuaagaccucguguuucaaaggcagcuacguuacuagcacccgagucuaggcaguugucuuaaucccgaaugucugagauuaaucaaucuagccauaaaagccuauguuguuuccugccacuguaaaaaaaaaaaaaaaaaaaaaaagaaagaaagaaaaaaagaaagaaggaaaaugcauauuuguuucugauucugagugcuuccuggccucagucaugauuuuauuucuccucccccuccuccucuucuuccucucccuccccuacuuaauuucauggagaaaauccugucacagucagaugugugauggcacucuggcccccagugagcuccuguguucucuccuaacgcuuuauaaacacucccacguucucaaacacuugaccaagcgacuuucacucacucucagcuucuccuccaccuuuacaacguggaaaccauaaagaggagaaucccuuuggggagccugcgacgccccucuccucugucccaggcauugguaaagggaguggugugugcugcccacgcugaaucccucccucuagccuggcacccaugcauuugcccgauaguaucuaccugacgcuguauccacccucucccggucgcucucuucugucauacacugcuuccucucuuggaugcaguuguaguaaaggagaugcuguggguuaggcagcacagcgccugccugugagcccuccgugacugucagcauuuucugccccuguucugcucacuggcucauugugggguaaagaaaggaauuacuauuccaaguaacuuggaacagaccguuuucagugcgaugagauguggauagaccgauaggacucaaggucuaaccccagcauggcuuucugggcuuggcugcacuguuaccuggccauaucuguaacucuugucaugcuguggaaacguccuucucaguuaguagcuucucucaucuguaaaaagcacagcgcagcucacguuccccuuuccucacuggauccucagcguccuucugguuuuuacucuucuacagaaagaggagugagcaucuuuaaagauguaucuuucaauaucuugauguuuuccccaaauaaauucuugguguagacuuguagccuuuaauagauucuuguacauacugccucaaaauacccaucagaaauauauauuuauauuuauuuauaguccaucagcaaaccuguuucuugcuguacucucaauucuccuuucaagugacugccagugugauuagcaagcguagcaucuuguuuucauucucccugacaguucuuugcagcugagguagaccuguauugucuugauggguuucuaggugacaguggacuuguuauaauaugcauuuuggcccgugaugucuuacaauauacacuuuacuacauauacauaagaugcuuucuaguuuaccauucgucuuuuaaauuuuggugacuucugguaauuuaaagcauacugcuuuugccaggcagugguggcacaugccuuucaucccagcacuaggagauagguguguggaucucugugaguuugaggccaacuugggcuacagccugagcugcacaaagaaaccacccugucucaaaaaaccaaaacugaacaaaacaaaacagaacccuacacugcuguuaaauguggggcaaugggcuaugcacaaacagccugguuuccagucgagcugaggucaugaacucuggugaaacccaguggugauaauucaccuacaugggacagaaggccuucccucaugucuccuggaccccuggcuccugucgaaguuacugcccccacagccaagagaagcgugugguuaguagucacauacacaaugucccaagcuucugaccuucaggcuagacuccucucaguuaccuagcaacagcaagauaacaaauccacuauaagaggagcugcuuggccccaccucauucucucccucuuacucuagccuuucuuuucucucucuccuuuuucccuuucucuccucuuguccauggccagucucucucucucucucucuuucuaccuucucucuuucccccugccuuucuacaagaaagcucuaaaaucauagacugugucuguucaucaaggccuggacuaaggacucucuccugcaugggaaccucucucccucugcccucuucccauaucucuggggccuggugcugcccuggugcuccuauuuuguucucagcuccucugccauauccagcgugggaugccagagacugagaaccugguacggggcugccccuuguccagcccccaccggauggggucaguggcuucacacagccagaugcccacucggggacgaguggaaagcaucuggcaguccuccugcguccuccacgcccagagcacaggagcucuggugggccuucucccucauccgucuuccccuauacccacagcccugcaguuaaacgugugcagagguggagguggaaugagccagcagcaugccgagugaccuguccacuagucuguaaacacuugugucucccaguuguggccagcuuuguuucauaaaugauguguaagauauucuuggagauacaaaguguugagcuuucgacuucucugucaugaugucugcuucgcucuuaauguggucguucuguuucauggcuucagaugucgcacuggcugccguucuggucccugugcuggucauggcccucaccacacucauccucauucuagugugugcuuggcacuggagaaacaggucaguacccagcuugcuuacaugauugacugggggaggggugcggggauaggaagcaaauuucaccuggagaguuaccaaacuaaaggccacugauagaaucauacaaaucuauccuaacuagaggauacauagcuuaugaucugcucauacuaucacaagugugucuuucacaaagggcucaagcuguuugccugcuaggaugggcagaucucuagccaccaacauaacuacugaggugcugucugagcuugggucagaaagagaaauguaggguuuauuuuauagauuagaaaauucuugagugcuaagcagacugauuauauuauccgaugacuggaaagugacaggauuuacaaaguaugguccuggugccuaaaagaggaggaaagaggcaucgggauaaacuuggaaacagucuagucaaacagaaguaccacagcaugauucuacaagagggaugugcuugacagcaaugucagcaggacgcacgacugugacggaagcagcagcagccuggagugaugugagguuucugacuaguagcgaugcuguggguugaaagaacaucagaagggauggguuugauggagaaagaagaugacguauuuguucacuguucaauaaauaguauaucuaaauauguggcugcuccuuuaugccaacuguuggcccaugugcuagacucuagcagcuggaaaucuguccauccuagcaggcaagauugagcacguuguaaaagauacacuugugauaguauaagcagaucauaagcuauguauauccuuauuuauaaagcagaaucuuucuugguagccuguaaacgcuaccuuuaguuaggauagauuuucaugauucuaucagugguggccuuuaguuugguaagugagugaauaguaauucuuguuuguuguuuuuaauagcauuuuuuucuuuuuauuuguuuauugauuuuaugagugcucugcugcauguacaccugcaggccagaagagggcaucagauuccuuuauagaugguggugaaccacuauguggguacuaggaauugaacucagaacaucuggaagagcaacuagcacucuuaacugcugagccaucucuuuagcccuauaauauauuuuuuuauuaauugaggauugcauaauuauaucuugaucaaacuugacccaaacuccucuaggauccacccccccccccaauuucauacccauccaacguugucuuuacuuguucaaccuauuguuuauaugcuugggugugugguguguggccauccaguggagucuggucuaccuacugggagccacacccuugaagaaaaguaauuauucucccucuuuagguagcuauuaauuaucagcagcuccucagauagggguggaauuucaugaacaccuccccacuggauacugggauuuacaucuugaucucuauaugcuauguauauagguccacacauaccauguuccguuuguuuagaggacggcuugcaagagucuguuucuccuuccacauugugaguucuaaggaaucaagcucagguccucagguuugacugcaagccccuuuuccuacagauccaucucaccagcccaaguguaucaggaaguguccuuucaccccuggacuccuuuaguaaaaggaucuggguagauaauaauucuucacccagagcaguuucuccugggagggaggacaagucagagcucugaguuagauggaguaggcagugugauucuuguucauugcccuugugccuccucuuccucacagaugucuguagguccuuccaggccuggaggagcauccuccucccccagcacuugccacugcuaguugugacauuguuauuuguuggugugguggggugaggacaugaauauaguguguaugagaagcuaaaggcuuuucuguuccauucaccucaugccccugacuguguggucacugcugguuugcugcccuuugguugggagaggagucacuguuuccucacuuugauuuucaggaagaagaaaacugaaggcgccuaugauuuaccccacugggaucgggcagguaacuuguggauuuccuucuguuuucaggcagaaaucuccccucuccuggguauaaugguggaugaaauaaguccucggguccuuagggacuccucagguagaacuucacaugccguccugggcuggagagauggcucagcaguuaagagcacuaguugcucuuccagagguccuggccagguucaguucccagcacccacauggcagcucacaacucucuguaacuccaguuccaggguaucugacauccucacacagucgcacguacaaaacaccauugcacauaaaauacaaaugaauaaaucauguuaaaaaaaagaaaucaauaugcuccaccaugugguucauaaguaauuaaaggagaaauguaaacacacauugguaucucuuccucuggaaaguuggucuuuucuuguaacuauucuucuugaggagaccagccucccgugugaccugugaaagcacugcauaacaaggacuagggucucagggacucucucucucucucuuucucucucucucucucucucucucgcuggggugugugugugugugugucugugugugugugugugugugugugugugucugugugugugucugugugugugugugucugugugugugugugucugugugugugugugucugugugugugugugucugugugugugugugucugugugugucugugugugacugccauugugagcagcaguuggaagucuagcacuuugagaaccuaggagguccuuggucauuugaauugcugaaaguccccucccuagucucccgacuagaggagaggauggugccaugaccagaguauaguuggguacagcuucaggggggcugaaaaaauguuggcaguuuugagaaaaccuuuuuaaaaauucucuggugacaccggcauguauucguagugacuuguuccugcgugcauauuagguagagauguguccgugugcugcuuugcccugaacauucuaucagagcaaagucacacgggucugguuucuguagcgugggucccuguccguaaguaacgcgugcucccuggcuucccuucgcaaugaagguugguggaaaggaaugaagcagcuucucccugccaagucgguggaccacgaggagacgccagugcgcuacagcacuagugaagucagucaccugagugccagggaagucaccacagugcugcaggccgacucugcagguaggauuccacagcccugagggccaggcuggaggccagacacugaugcuuguaccgagggugucaggguuuaccgaauauuugaucuuucuuacauguuaaagaucaucuguguucugggaccagagacauggcccagcacuuagagcacguguggcucuugcagaggaucuaaguuccaucccccgcacccacauggcagcucacaacaccgggaacucuagaccugagugaucagaugcccucuucugaccugcaggcgccagguccacacagaguacauagauacaugguacauaccauuuuuuuaauauaugaacuauguucugaagguuaacuuuuucaaaagcuggccuugagaggacaaaucauuucuucuuagacguaucucucauaaacuauagcauuccuuuucuauggacacugggcauuuuaauccaucagccuggggauuggcuugcccccaauaaacagguccccaggucccagggagagacacugucucagaaacaaggugauggacucuggagaaauaacgcccagugugaaccucuggcccccacaugcacaugaaaccaguacacaaggcaguaaagaugaggaaaggcugaaagaaccugacuguggcauccugccacccuagugucugcagacucaccuuuccugagaguuccaaacaggaaugcagugaucuuucccaacuaauacuuaguccaaauuauuuccuuucguucagauucagcuuguaaaucuacagaacauacauaaauacugaugcaaaaguacaugaguaagacuuugguuacuacugugagagagccuaaacgacaagcuuuucagcuggucccuggggguggaaacuccguagcuuugcauugauaaaaccacagugccacgacaaaggguuugguguuggcguaaccuuuagcugucaccuuaaaaguguauaaucuccauuuuccuaagugucccauuguaucuuaugguacccacagaauaugcacagccccucgugggaggaauuguuggcacacuccaucagagauccaccuuuaaaccugaggaagggaaggaagcaggcuaugcagaccucgauccuuacaacucuccaaugcaggaaguguaccacgccuaugcugaaccacugcccguaacggggccugaguacgcaaccccgaucgucauggacaugucagggcaccccacagccucaguuggucugcccuccacauccaccuucaaaacugcagggacccagccucacgcuuuagugggaacuuacaacacucuucucuccaggacugacagcuguuccucaggccaggcucaguaugacaccccaaaaggugggaagucagcugcuaccccagaggaacugguauaccaggugccccagagcacccaggagcuaucaggagcaggaagggaugagaaguuugaugcuuuuaaagaaauccuuugacgguggugcugcuuucugacaaggcauccauuuaaagcacauggcuuuuuucauucuuagugguagugauguagaauguauuacguaucugucacugaagugguuaggggaauguggugaccgagguacaagaaacuacuugccuugccaucuugcuuuaaagggguuacugugugacacaguuacugcucgccugcuacaugucaagcguccuguuuguuacuacuguaaaacacuauuuuuaauacagaaacagagcucccuauaaugcacuucagagaaacugaaaaucacugaguauuuauuaccaaugcugcagguacauuaaugaacuugaggugguucuguaagccuugcuggcaauaaugcaugguacuguucuugaaauaccgaauggcuugaaauucucccuuugugaaaguggguacuaucacgcgucccuucuccuuuaauccuguagugccgucugcauucuuuuuuuuuuuuuuucucacauccaucagugauaagcauugcucuagcuguggccacauacacuucucuguauuucccuaggaaggugcagaguuagaacagccugccuugcggugagcuggaggacugacuccuuguuugaugacacuuuuaacaguauugacaccgccucauacagggcuuggucucagcucugcucaucccugccacccuugguggccuugcuccaaccuguguucauaaacccuggcagcuccuauccagcagcagucacgggaagccagcccuucccaucuuuaaguauacuucuccacagggaacugggagagaagcaacuuacgauguagaaaagcuauaaagggaguccucugcgucacuaaaguaaucuguaaauuacuuuagggacaaaguuaagggggaacuaaaauuuaaccuucuuugcuuucuuuacacacaagcccaaaaauuugcaaaauuuuuuuuaaauuucaauuaaauuuuuaaauuuaauuuuaaaccauuguaagaaaaagaaagccaacaugagccaggucugauggcucaagccagcaaucccaacugacccaaguggacccccaaggucagugcuuuauagucuacagagugaguucaggauuaaccuaggccgcucaugggauaagggguggagcucaggcuccgggguuuagugcuccaguauaacaaguucaaggucauagguucaauccucucuacuacaaaaagaaaaacgggcaacaggcguucuccaggucugugugauuucugccuucugucuggggagacacuuaagugguccuuugugucagaccugguugacagagaugcugugcgaucggaauuguguggaauccuucccagcaacuuacuugucagugcuugacaaccgggcugcacucacgucaggucggguaaauuaaauguuacagcggauuagcacugaagcagcacaucggaugaaaacacaaacuugaucccucgccacaaaccuguguguagguuuagaguacacucggccuucagguccccagccguuucucagcuuguaccauccugguuguagaccugccacacuugucuagauuuggauagccuugaacaguguuaacugugcuuccuuccacaaguacaucagcguuuuaaaacgucgcucugcacugguggcaggcucucugccaccuccucagacaguuugcaucgcuuucauuauaaaccgccuuucgucuugcagagucucggacacagucucucuccuuguugaaaaaaaucagugcacauuuuguuucaaaguucuuaugaagcaaaaaaaagcacagaugcuguacuaaaacauguaagaauguguagagcacaagaugcaguuguccucuuucaggugggaacaaagcaaaccuuuagcuguuucauuuucguucacgcuuagugggcagaggguagccuuuucuuugagucaccuaaccauuggaagcuuuaagagacccuuugaagaugaaguuguuuucccaaagaagccuacuauucuaacugugugucccagaacuguuucagaacagagugaggccaugguuguugaugcguuacacauugugagacuugacuccuauggccacugcucuccuugcacucuaccaaugguuuucauaacauaccuaguuauuguuauaugguuuucucuugcagauaaagagcugagccugauucaaaugauuuuuuuuuucugguuuuguacuuuuccuuuuaauuuuuuguauuauagauuacaugucugguaaaucuuuggaagacaaucaaguaaaaugugaaaguaaccauugcugaccaaaccccuugguuauuuuguuuugcuuuaauucuuugcuugagauauucaauacuuaagucacuguggcuuaguggguuucucuuuuccugauaguacaauugauuagagacagcaguguggcaagggcagccuuaggagauuucagaaaaguuacacuaacuuggcugucacuugauccuuggaaccagcacagauauuaugaauucugcuuugcauuuauuuuaaaugcuguuuauagaucguaguaguuccuguugagaguaacaggacuaguccaguuauuuaauucauguuucacuauuugcacuuuccacugaacaguggguugauuugcuguucacacacagaauuuauccaguaguuacagcuaucauguguucuguguaugcuccuccuccaccugcccccagggaugaagcaguaaaagugcuuguagccauuuccaugccuuggcuccacguugucacccagagagcaguaaagggaguaggaaagcaagauagaaaaaagacagacaagaccacuagaacgaacccagaaauuaugggggggugggagguuccaaauccucuacggagcagaacuaacggggcuccgcuguauggaaaggaguuguuaauucuaccuuuuggguugaacuugaaaguccuugaacugcaaaaacucuaggaaguuggaugguuguaggguaucuagguuaacuguggcaccaaucucaauuagaccauuuuguguguaguuucucucguuuccuguguuuggcacugggaauggugaaaauaaaacuuacucaaguacagaagaaguggaaguggcugagugucagugauauucccccagaauguauuuuucuuaccucggcauguacuguagucacuugauauuuguauauguugcuagaauuuaggcuguugaaaauagugagauucuaauguguuuuuaauaaauuauaugugugugucuugcucagauuuuuuuggauuaaauaaaacaaccuugacaucauaguccagaaaaugccaaauuucucaaaguugacaacagucacauuuuaugaccaguauuauaguggguauagauagcaucauuggucccccugccacugucccugccggcaacuccacaacccucaagccuaccuuauggaagugaaucugggcagcccagcucuguguggcuauagaguaaaggggcacaccccaucagcauggagagccagccagugccagcguccccaucaguuaggugcuggacacugccagcaugagcuacccucacugucagaccccuccuauuuacaguuugucaguauuucauuuauucuuuuucugacauuucacucuuuuuauuuuacacacaaacucuuuagggaggaggcaaauugauugccauuaucaccagcguuuccaauaauaacacuuccuguuugcucuccucccauucuacccccuuugguugugucuacuaacaguugaaagguggaacuugccucgcaggccaccauuuguuuguguuucuucagauuuuucucucaugugccugaaaugaccacugaauguuucacugaaggugaaauuuagucaugugaaauaggacauuuuuuucccuauacaaauaauaaaaaaaaaagcucaacucuuaagguuuuacuugcauuguuuuacucuuaagauuuucuucauagaaacauuuaagguuuucuucuucccacagguaggcucaccucugagcucaagucuagucugcacuacauuguaguucuaggccauccagcacuacauagacccugucuaaaacgaacaacaaaaacuuuguaguuuugaaaaaugaugcuagagggugcagcaauuggcacauagcuguaaucccaguacuugggaagcugaggcaagaaaaccaaggucgagccuagcccaggcuacauaguaagaagcugccccuccccccaccccuuccaaaucaaagucucaggaugcucguuagaagagcgcgcuuuccaagcaugcagaaggcuauuuuuuccucccucacagcaaauuauuacauuauuacugguuuaauuaauuguaaagagaacuuaaugaaaccacaauggacaccacggacuuacaggugauucucguguucugcaccuggcucccagucacaugcccaugaguaagcaaucuaaaucagcaguucaaagugauacgugacuaucagcacgggcgaaguccacuaaaucuccuagaacucuuuaagaugaaggaacuaugagaagguauuuuaaaacaccucagagcacuaaaaagaucacauuuuaaaacaacauaaucaaaacuucacauuuuucccugauaucuuaacuaaaaaucuucuuguuuuuucauaaauauauucacagaacuuuagccggugguuacaagucaccaggcagcaacagacuuaauacacauaauuugauaaguucauccaauauauuuaaaaauaaacuaaaauuugcaguacaaaaauaaaacuaauacuguuuagcaucaucaucuuuuggauccauagggucaauuuuaagucaaguugaucaccauuuuuuucuuuauaaugucguuuaaaaagagcugcucugcagucagauugugauaugcauucuggaaaagaaaaugagauaggcuggucaccaauccuacuccggacauugucaaagugagauacucuaauauuccacaugguaaaaguacccaucguaagcucagaaguuaguaacaaguugcauggaccuuuguucccugcuugcccuuuucuguucgagagugaccccaaaucucgcuuuccaccugaauuguacagagaccaaaaacucaagucaggacgugugacaaaagaguagcaucugaaacccauuuuuaaaagugggccuggagauaagauaucauaaaaccuagugguugcaggguuggugaguugauaacagcauuucuuuuagcccaggucuacucacacuucuagguagugggggaugaccuuaaacuccugguccuccugccuccaccuuuaaaacaacaguucugagccugacguggcuauccaaugguucu

SEQ ID NO: 8280 - RNA, 926 nt, Mus musculus
uauggcggaaagaaauuggacccuggugacagaguuuguccucacaggacucacugagcgucccgaguugcagguuccacucuuccugguuuuccucaucaucuaccucaccaccauggugggcaaccuuggacugauugcucucaucuggaaggacccucaucuccacacucccauguacgucuuccucagcagcuuggccuuugcugauguuugcaccucauccucugugacccccaggaugcuugucaauuuuuuaucuacagaucaugagauaucccugguugagugcuucacccaauuuuacuuuuuuugcuccagugcaaccacagaauguuuccuccugcuagugauggccuaugaccgcuauguggccauauguaacccccuccuuuauccgguggugauguccaacaagcucuguacucaguuuauagucguuacauauuuuauagguguucugaauucaacaauucacguggguuugcuaauuagauuaacguucugcagguccaacguuauagacuauuucuauugugaaauuguaaaacuacucacaauuucuugcacugauccuucaauuaacaugcuugugguuuuuauuugcucaaucuuuauacaagccuccacacuugcaaauauuguagucuccuauacccgugugcucuuugccauucugagaaagaagucugagaagggcaggagcaaagccuucuccaccugcagugcucaucuccucucugucucuuuguucuauggcacucucuuccucaucuauauccuuccugggucugagccagcugaagauaaggaacaacuguuaucuauaguuuacacaauaauaaucccauugcucaacccauuuauuuauagucugaggaacaaagagguucuaggagcucuaagaagacuaauaaagaaauaaa

SEQ ID NO: 8281 - RNA, 923 nt, Mus musculus
guuaacauuuuauaaauuuuuucagagcacccaaaacuuccuuguuucuuaagcuguaaauaaauggguuuagcagaggaaucacaacuguguagaacagagaauauauuuuauccuuuuguuuaccugauccagacccagggcucacguacaugaagaggaggguaccauagaacaaagaaacggagagcaggugggcacugcaggugaagaaagcuuuccuucugccccucucagacuucauguucaggacagcaaauaggacacgggcauaagagacuaugauagucacagagguacugauuuguauggaagaagcacaaauaaaaacgaccaauguguuaagagauggaucugugcaagaaauuguauacaguugcaagauuucacaguagaaauggucaauuauauuggauuuacagaaaguuaaucuaaauaauaauccuauauuaaguccacaguuuacaaaaccaauuauauaggauauacugauuaacacagugcagagucuuuuggacaucaccacuagauagagcagaggguugcauauggcuacauagcggucauaggccaucgcuaccagaaggaaaauuucaguaguugcacugauacaaaaaaaauaauauugggcaaaacacucacccacagauaucaugucauucuuauuuaaaaauuucauaagcauuuuuggggucacugugguugaaauacaagcaucagcaaaggcuaaauuuccaaggaaaagguacaugggugugugaagaugaggguccuuccagaugagaaagauuaagccaagguugcccaccauaguggugacauagaugagaaagaacaccaggaggaggggaacuugaagcucugaacgaucuguuauuccucugagaacaaauucugucagcagggugcuguucuucuccaug

SEQ ID NO: 8282 - RNA, 20689 nt, Mus musculus
guuuuuuuuuuuuccaaucucuggcucuucugucaucuuccaagcagcgucugagagcucugcacgggcacagaugcuggguaccucuuauggguguggcaguauuacacgaaacauguuuauuuuaauggggaaaggggucauguaugcucaaagauauguauauuuucauuguaaagaaaaaaauccaacuuuauuccuaaguuuuaauuguuagaaaguauuuucggagccagugaugcucuuuaaaggaguuauuucuuccaaagaagcaagacgagccagguuacugacauaaucuuuaugacauguguacugcaguugugccuuuucuacaacacugcauugaauaaacuuguccgaaguaucguuuuaucagagucugggaugccuaauaauuuccugguuuuccucucguguccacaaggacaugaaccagcuucuucuccuugcuccucuaggucacuacaccuccacccacaguacuaaccagagcgccaagcccccuccccgcucacugaauguauguauagagaaaaucaacaauucucugcauaaaggcacuagaguacuuggauuaaagacuccgaccagagagacagugccagguucuccuuuucuucaucugugucaaguuucagguccuuaacacgaauuggugacccgcaccagauuugcuucagagcauccacaugugauaaaggaaagcgaagaccgaaaaucugaaggaggagacauuguuuaguacaaaaauaaagucacuucauggauuuugcacaagcuuacacaauucucaauguauguauuuuuaauauccgucagaaguaggaaacuuguuucagagaaacuacuucagcuguaacuagauaacucacaaaagucaucaauuccccacauaaaaagcucagacuccaacaaccgacuuugaguaguuaaguugcugcagaauguauggccuuuaucacacuuucuauaaggucacagcuauuguguuuuaaagcugcuaucaauacauccuucacaguauugacugauguaauuguccuaucagucaaguaaaauggcagguccacaaugcuucuguaaagacacaugaccuuucagucaaaaguaauugucccagccacaacccaaacucuaggaaagacauuuuucagcuggaacacaccucggauuccuccucuucuccuaucaugugcaucugccucacauucuucagagaaugauagauguaaaccaccuuuuguugagcuucauccuuuaaagaaaauauuaaauuaucaacaaaaauacugagggcuucaguauuaggaggguuaaaaacuauaacgccaaggaaaaucuugugggggagugugagggagaaagcaggcucugaacugucuauguagagcaggcuggccuugaauucauagaaaccugucugggaugaaggcacacagcaucauaccuggcaccaaugaaaaucuuuaaagccuugguccucaaaugaaaugcaauucuguacaaaauacucuugguccaaaguuacaauacaacuguuguaauagagacaagcuagcauguucaagauucugaucugucagcucaucuguaacagccuuuuuuugcuugaaucaucugcacuuuguucuaucaaagucugacuuuccuagaacaaacuaaaaaguuauaaagugaaacugcugagaaauacaagcuguguuauuuacuaaaaauuccauuuaaauuucaguaguagaucacuacucccaguggucuuccaaaacauuauuccuugucaccgacuagccaacauaugaggucucagacucuagugauuuuauuuccaucauccuucucuaggcuucacccugacugcuacagccuggccuuuugcagccccucaaugcuuaggaauuacuacauaaauccaugaggcacagaauaguucucacagaccauguuuagggcuuaaccaaaaaaaaaaaaaaaaaaaaaaaaagggagaggauccauuucaaaccagauacaaaacaaaaccaacuuuuuuauguaugaguacacugucacugucuucagacacacuagaggagggcaugugauuccauuacggaugguugugagccaccaugugguugcugggaauugaacucaggaccuccugaagaccagucaaugcucuuaaccgcugagccaucucuccagccugaauuuuauuuucuuuuuuguuuguuuuguguuuuguuuugguuuuuuuuucgagacaggguuucucuguauagcccuggauguccuggaacucacuuuguagaccaggcuggcuucgaacucagaaauccgccugucucugccucccaagugcugggauuaaaggcgugugccaccacugcucagcgaauuuuauuuucugaaacaaacauaaagccccaaauccuuuuuaauguauauggguguuucccugcaugugugucugcauaucaccuacacaucuggaacccagaugacaggagaggacaucagauaucuuggaauuuagaggccagagaggacaucaaaugcccuggaauuggaguuacagacaguugugagcugccacgugagugcugagaaccgaaccuggguccucuggagagaagcaagugcucuuuacuacuauucaucucucuagucacagaaauuuaugauuuuacaaggcuuuccuacaagccaguuuggagaaucaacgcauaagaagugcaaauuacagggcauagauuauuuucuguucucuaugauuucuacuauagaauguaagcuagaucuuugcaguauagacaaugacagggacugggacagggaaacucaaucagggacuccaguucaugaaaagcaguauaaccugcaguagauuaggaagcaaagaccagacacauacacaagaggaggcuucucaggauaaaggcaggccuugcaucaggaacugucggacaggcuugaccucacuggaguaaccugagguucauggaaauagugugaauagaggaaaucucuucccccuggauacucacaaauggauucuuaucuggcccuacugugaggacaaugugaucuuugaacugcagucuuauuauguuguccaaccuuggcaacuguuuaccuagaacagaaagccagccaucaaaaaggaagccaacauguucaaacuugcuugugacccaucuuuuagcucacacucucccacaucuaucaugaugauuaaaagugcagcuugcaccucaaugaaccucauucuuauagugauacaggcauauuauuuagguaaauaauaaugcaagauaauaguaucuuagagggcuaagugugcggcucaguggagaacuuaacuagcacucccaaggccugcacucggacgccaacaccacacauagaccacaugaaacgugucaguagucccauuuauggauggaaagaacuguguugcuucugaaggaaagcagggccucgacuacaucugggcucuggaaggaaugagcuaugugaccauggcacauaacuuagucccuguaagucaaacaccauguccuuuaagacccaccacagaacuaaacagucuacucuuucuaaaguggacuuaggaaaaugaaaagaacugccacgagaaacaagcuggccuuauaaggccaucugggugggaaaggauuaaggaaucauaaccuuauuaacuauaguagcuaaacucgggaaaccaguagauaaacuaguaaauccuggaacuaagccaggauuuacuuagcaaauucuauccuccuaaagauuaauauguuacugguacaauacaguacucugaacagauguaaucaaaauuagauucuaaacuuccuucaaagacucuauaauaaaaauguauaugguauuaccaaaaguagggacuuucuauauuuuagugggucucaccuggugauaggugagacuuaucauggggaaaagauucuuggagagacaaagggcuggcucuguuagcauuaggucucaggacucuugaacacuguguaacagaauguuacuaucagucaccaccaaacauaccuggggucugaacucaggcaaaaccaaaaacaguguucauauuaucagcgccccaacacucuucuccccugguuccugagugaaggugccauuuaucagagguuaacuucugccucauacauccuucccguucgucguguaguaucuacaagagacccaccuacuuccagacagcaccguuccagaccaagcuuugcuuccacgagcccucuggaaacugaagugcucagcuuaagcccacacccuguaaauucuuucuauaaugcccuuuuauggagauacuuuacagugugcagcuuucccauugcaacaagucaaaauauccaacucugagugugaguguguccuugguggcuugugcuggacgcugacaguaccuaucaccugaauuccaucagucgaagacuaccugucacucguuacucacuacaauuugggagccucaugcuaucuuuaaucauucuuuuauuuucccuagugguaacacacuuuaacaugcuugccuuaguucuaacaagauuaugucauagucaaguucuucagcauuucuggacaugaugaauaaaagacuacucagagcuacauucuucagcuaaaaugaguucuuacuuccugucagcugcagggcaaguucucacaaaucacuugggagguuaaugaggacagcaugucugcgaaacgacacacacuaaggagagaugcuguccaccugaaaccugaaacguuucaugugccccacuggcuccaaguagagaccagccaguagagcaucaggucuccauaaugcccagccccggaguaaagagcaagcuccaccuggguccaucgucuccguuccauuucccucgaagaaaggagggagucugugcuugacgaaguccuucuucauaucugaugacagcagcucuucucugcccucgagcuggucugcaagaguccucagaaagccacucaacuuccuuguuacaucagcugggguuuccacauucuggaagcaaagaagugaaccuugaccagauuguuagaggcagcugcccaggucaccguuuucccuguaguauccugagcuucaacccaauacugacauccacugacauaaaucaugccauuccaugguggggagggaccaccuggaccuuaagacaaggaagccuauuacauccuuauaggcaacauuuaucuuacauuguccaucauuucuagaaauauaaauaaaaacaagagcuaaaacaauuuucagaauuuugcuuggaaaaguggauccuuggaguuagaguacuauccaggcucuaucuuugcaaagucagucacucuccuaaggugacaacugccuuccguaauaaaagcaacauuuguucuacucagcccagucuuacugacuggaaacgagccaaagaguaugccuuuucgaaaugcagaaacuaucaggaaauccagugugcacaccgagccccaggugccucuucuucaaccagaugccugaggcgugcucaauagagauuuguggccauguuuauuuguucagcuaucuauuuagccaauauccccaguuuuacuguaugaaaauacacaaaacacuuuugaacaacagucaaagauggcccacaugaauggcccuacaugaagccacccuccauuugcuguguaaauccuucugcccagcaggccagcacagcaggcuagcuugcuucaucugggaagaagguccugggcuccccugaggcagauuugccuccuugugugugacuugccaccugcuucuaacugcuucuacucucaccaggagcauccgccggggcauuccacuccuuaaugccacaucuuccuuugcaaugucaaauacgaaccccgaaauggaauccaaaaggcagucuccccaugaacuacaacaugaaauaaaaugaaaauaaccaacguuguuaaugaaucaacaagauacguaaauaaccaauuacuacccaaaacugcaaacuggguucacauuucccauuucugagcaauucagaaaauuaaacagauucuaccauaaagaaggaauuuggaagaucaaacuaaacacaggccucuauaggagcagccuuauaggaaauuucaacacucaguaauaaguccuacuaaaaacaucuuacaggcuaacagaaauacauguaggauaacagacagaucccuguacuauauccauaccucaacagcaaugugacacauuuuacucaguaagggcaaagaugauccucaguaaauauacacuagcaucacugcuuuaaaacaaaaugauuuuuuuuuucuuuuuguuuuuguuuuuuuuuuuuuuuuuuuuugagagaguguuucucugugcagcccuggcuguccuggaacucagaaauccgccugucucugccuccgaagugcugggacuaaaggugugugccaccacugccuggcuacaaaacugauuucuaaaaaucagaaauccgccugucucugccuccgaagugcugggacuaaaggugugugccaccacugccuggcuacaaaacugauuucuaaaaacgauuuuacuggcuuagagagcaagucaguguccaagaauacuaucuagaagaaaaguaccagagcucagucaaggucaccucuucugagguggcucugucucauucccuccucugaggcaguuagaaguggcucuuucccaaccguguaccaguuuaaguuaagaaaaauaaaaacacucugugggguugcuuucuuuaaacacuucuuaacuuguuuaaauuucucccuugucaccagauuucaaauugagggcuccaugcaaaauggaaauaauggaaaugucaguacagcuucugcuucacagucaggagaauugaugcuuuguuuccuacccuagaaaaauggcaaaggaugaugcaggagccuuuuaagacacuuuccccaaaguauucacuacuugggugucacauuaaugugugacuuaaagccacagcuuucuucacucuugcugaucauggaggauggaagcagcucucuggacaagggaaauggccuuuugcaggguuuuaggugaaagucauauggcaauagaucucagaggaauuagauggcagauaaacaguguucuuccacgguuaagaauauuaauuuugggagauuuguucugacauuagcaggcccuagcucuuccagagguguugagaagaggcuguacauucccuuaccacagugggagcccagguucagagcccaggaacaccucugagaggucuggcucucagauuucauucuuccauucuagcuccugcauuuccuauccaaaucagaggccagacuaggcacaugagccacagcacccacccacagcccaggccagcaacccagaaccuggaaaacucuucccuagccccagcugacugaagaaagauugaaugagacccagaggccuaccagauccagaccaaggcagguaauuaacagcagaaacagaggaaauaggggcuaagguaaggggaaauggauggaauugcugauagcaggacaccuacaagguauaaaggaaaaggagggcgugaaaauaaccaggguugacgagauggaucagugaguaauggcaauugccaggaauguguguuuaugaccccugaaaccuacagguaagagaaaacacacacacacacacacacacacacacacagagagagagagagagagagucagacagagucagagacagaaggagggagagggagaggagggagggagaaggguuuggaguggugaaaagaacuucuugaggaccgaguuuugguugucaguacaaccacaugguaguccacagcuaucuguaacucuaguuccaaagacuccaacacucucauguagccucugagagcacaggcauacaggcaauauguacacacagccaaacaauccacagaaaacaaaauaaggaaaauuaaaagaaaaaaaaaggagacaagauggcaacagauauaaaauuuaaaggaaaacagguuuaagaaggcaaaauuuuuaccauggaagcaccaaugugacuaccaagcagaauuaaguguggacaguaaugauggggcuccagaagauacaggcagacaucagcaggccagccuaugugguugcuaagacucaguuacuucggccugcaacuuuuucaguuccucugacucacuccuacaauugucccuacucuuucugcaugugugugaaaaaaaaaaaaguauguguguguguguauauauauauauauauauauguguguaaaauaucagugagugugaugaaaugcacaugacugugugcaugcuaugcugaggccagacacuugauguccucuaacacucucugcuguccguacuucuuugagacagagucccugaagguagccaaggcccagugacccucuuaucccugcuguccaacagcacuggagcacacacagcaucccaaacuccuguucuuuuacauggaugcugauaugccaacccacaucuucaugcacaguaagcaccuuuaccagugggcccccuuucuguugcccccugcucaucuugacgccucagauuuuccguucuuuaccucaucagagugacuaaguacguuggaaaccuaagacuuucugccuuccacuguguaaaaaugguacuaacccaggcaggauauagcuauaauccccagcaaaucugaacaugggugaguuucacagagcagucaugaggaagaagagaugcccuuacuaacucauuuuaccauuuccugcuuuucagcaggagggacuggauguucccugguccuggacugccuucuccuacccaccaugacuuucugauccaccauuaaucauuaagacucacugaauguauuuccuguuuucucugagccuauuccugauagccaagcugagaugagcauaucgcucuaagcuccaacggucucugaaaacuuacugugcuaauaaacccauagcuacagguuuucuuuuugcuuugcuguuccuugccucuccaagggacccucuaucuucuauuuagguacugugaaguauccaugugugugugugucuaugugucugggggggaggggggaaggggaggggcgaggcaggaaggaggagauaccuacgagguuuaaagaauauccacacaggccaaucacacauggggacacaucaaagaaauauggagggagucaacacagaguaagagguaguagauaacuuccucaggucuauccugaauguggcugcuuugggcugucccagagcugucucagagcuguccuaaaacacuagguuaggaagaaaggccuuacuuguucugguaggugcuaauagucaggugaauagaguaggccaggccugaaggaguuucugccugaugaauggucccucugggaaaguacaacaaaucuccaggcuaaaggaaaaacagaagaguuaaguacauagcacagucucuugucuuucagaagauaaacaugcucuaaguucaccauucuagaaaucacuacacaucucagggacaguuugugugcugggcucagguggugucuuuauguucagagugauaccagaugcaccugaaacuauccucacuggacugagauccaaaaguaacucccugucucuggguuggcuaaucccucccucggguuaagguagggcuuucagucacaggaccagugcgacuugcuuagcugccugagccuuagacucucaucacuaaaauggggcaagagccccaaaggcuacugcauuauuuagaggacuaaggaaaugcuguuuccaagugucagugcacaggguaugguuuuauuacacgcacugccaguccucaucucaucuccccaagaggaucuagcauaucacuccuaacccauccuccucagagccuuuuccagcaaggcaugcaguguagaacagauuaauauauguguguauguguguguguguguuuguguguguguguguguguguguguguguguguguguguagcguaguguauucuuaaggcuugcaugggugcucauuugcugaaugaccccaaaauggcaguacuucaagcaaauaaacauuuuugacaauuaaacccauugguuaucauuuuggggcuacccugagugaggccuucacagauacacuucauuauccacaggaaucuggauuaacugccccccaaguccuuagggggaagacaaggaggcagauucuccccaggagaaacgaagcucucccaacacugaggccgacuuaagguuuaagaucuguguuauuauuaacagucacugugcuaacaaagcacugacaucucacccaaggaaucugaucguaaaggagcuauuaacaugauauuaacaugauauuauauaauuauauuauaacauuauaugguguauuucaauccccagacugcaaaguaagucucaugaucccccaauuuagauaauuuguuugcucaagggcacugcaguuaaagugacuucagcuuaacugaacccuaaaucugucacaccucgcagaaaaguaaaaggguuucucuucuguacccugaaacccacacuagacccacuacauaggcuagcacuagaauagggggaaguugauaagggcuuuggaauucucaucgaagcccccuauuccugccucagccuguggugcuuuaaaaaaaaaaaauggcccacauaggcuccuacgucugaauauugguuuccaguugguggcuguguuugcaaggaucagaaggugcgcuccugcuggagguaugucgcuagaggcaggcuugagguuuccaaagccuucugccagccccaauauacucugccuguuugcaggaugagugugaacucucagcuauugcugccaccacgccuucacuccaccaucauggacucuaauucucugaaaucacaagcccaauuaagugcuuucucuuauaaauaaccuugauuaugguauuuuaucucaaguccauuugaaggggccuaccgaguaaucuuugguuuacaggccccacaacagaguagaauuaagcagugcauuagcaauacacuuugaauggguauaguugucauacauuaaacuaaccacacacuuagcaaaccagaaugucaagcaaugagcuauaaagcaaacauaaaaccaucauuauuuauucaggcuuccuauaauaaaggcauccauucaaaacaagggaagcuguuuccuccuggcuauugacagacaaaucuuaaaaucaauaaagagauacaggcagagaauaugaauuaggccugguguacccucgagaugcaagaaauaugagaagauagccacacaaaauaguuccaacauaagaaucuuugaaauggccaggcgugucgcacaugccuuuaaucccagcacuuggaaggcggaggcaggcggauuucugaguucaaggccagccuggucuacaaagugaguuccaggacagccaaggcuauucagagaaacccugucucgaaaaaccaaaaaaauaaaaaauaaaaaucuuugaaaauggucuaauuugaucauuuauauugccacugaagaaauguuugcuuucuaagccagggcaugaagcuuauuuaugaagcucuuccugucucuccacauccuuuucccaagagcaucuccugccuggcucugguauguucccaucuaaacuaacuggaucaagaugcuaaggaaacaauuuaugguuaagcuacucggcucccuugaggagaaaccugugagcacuuugcuagcuccuugaggguaggaacuacacuaucaggaagaaaacgggugguacugaaacuucuaccaagagaaggcaggcaucacugugcucugccuacacgcugacuacugacuuaaauauggagaaauaggccaaggccaaaccacccacaaugauucuagagaaguuggugauucguugaauuacauuuauuucuguugaccugagucauacauggagacguuuuuuagaaaaugagucgaagacugcccauaccuucagcaggaagucgugugucggugugccgauccgguccucagauuccacacuguacucgugugccaggggcacaguuggggaguacaggcgccaguguuucguucccuccagcugcaggauaaaaaccuacaggaggccaaagaccagagagcaucagaaaguucccugacacgggagcuucuaggacagacaccagcaaugcaugccccucacagagcuaagccgccacuccuagucauuuugaagcaggcaaucaggaagccugguguuggacaucaauuccugucccuuucucagacucuuuuaucuuccacuagucccuacaucuuccaucaccuaggcauuugaaagucauaaucucugauagaaaaaucgauacaaguaaaugccccaaagcuuaaguauuacaauaaacacuacaguuuugguuuuuguuuuuuuaaguuuucauuuggcuaaaaguaucuuaauauucuauuaagacuauuuaagaacacuuguggacaauguaaguaucucaaauaguucucagaggaaugaaaggggacuucuguuauaccuguguucacaccuuguaugaguauaaaaaugaaacuacaaaauauucagccaaugacuuauaacuuguuggaagccacauaagaaugaaaucaacccuuguaaauaugccaggaauuaaguggaaacaggaccuccauucaugcuacaccaagacuuugugaaagcgggaagaauauacauauuguugguagccacugaaaauggacagugaaagaaauguaagauuugugaucucaccucacuuuauuguuuuuaagaaagucgauuauucuuuuuuaaguguuaaaaaaacaaaaccaaaaccaaaaacaaacaaacaaaaaaacccuauuucugaagacugugugagucuuucaucagcaauacucaugcuuugagaaggagcaggaagccagucugcaggcaucccaacauggagacgcggucaggaucuucaggaaggaccagaagaacagccaugaccugguuuaagagugcccgagagugaugaagacagcccagacaacugaacaagucuggccucagcagccuguuuuuuccagccuguacaacgaaguuccucuuaccucaacaucaucauaauguggagggaggcccugagauccugcaggagucauguacacauucgagccuacuaaggacccaaaguaacauuccagcuuuuccuggauccgccacagcucauccuuugacaaagaaaaaagugaauagcaaauaagaaaguaaauucaauuaggacgucucugcuguacaaucaucauggggcagacaguuaagcaguacgagucucaggaaucucugcagugugcacacucuagguaucuaacagaugugagcagguacaugaaaaacuagaagaaacaagucaauuuauaccuuuaaaguuugccgucacuuugggguauaggauggacugcagaaauucaagacuaauuuagaagcuaugauuaagcagcacaaacaagggauggacagaguggcagggauaagagaaaagguggagacacacuguggaauuggagaggacucugcaauagaggaggagaagagacacaagcugcuucuugacuugauccaugaucugcgacuuuuauuuacugagcugggaaaagccuauggaaaaggaaguuuuccggggcuggccagugcucagccagugaaguaccugccacacagauacaaagagcggagcuugaauccccagcacccacucugcgugccucuaacuccagcuccaggaggcagagacagucuagccuaaggggggagcuacagcuucagugacagguccugccaucaaaaucagagcgauggaaagagauggagagaaauagucucuggccuuuacaugucccccacuaccaccaccaccacacacaccgguaugcaccuacaugcucuaccuauauccacaggcacacacauuuuucaggaggacaaaaaguguucaagcuggaaauguuaaucuugggaugcuaugacuuccuagggcgguuuucugaagucaguuugaggcucuaaagaaaguaagggcaggaauuuacauaugggaucuccugacaaauaaguacuuaaagcuagaggagcagaaaugacaaccugggaagggcacggaggacugagaacaagcugagugagacucccucgagugacugacucaucagcuacaaggcugagagagaucaguuaccagagucagguaggaggaagucacaagugggccuuggagauaacagcauauucuaccuucuaguccuuaccuugauaacugaacacccucauuagcaauccugucucauagggcgggaaagaucauuaacaccagucuauaagugaggaaacugaagaggaaaauagcacaaccauuaacugagccaagauuccaaucuggagagaccagcuccagaacccauccccucaaaacaagucaccuacuguggugguaugaauggaauggccuccauaaacucauacuggaguggcacuauuaggaggcguggccuuguuggaguaaguauguuccuugagggugggcuacaaggucucagaugcucaacccaggccuagugucacucucucuucugcugccugcagauacagauacagaacuuuccaacuacgucucuagcaccaugucugccugcacacugccaugcuucucaccaugaccaucacagauuaaaccccuaaacuguaagccaggcucaaugaaaugucuuccuuuauaagaguucccgugguaauggugucucuccacagcaauagaagcuaccuacucuaaacagauuaaagagacuaaagcuuuaauacaaauaaacacacagugacugacauacaggcgguauaguacaaacauuagguuugcugagaacaccgaugaacaaggcuugagagucaguucuaccacuggacuguaaggaaucuaguauugagaauagcaaguggggaaaaaugggucaacacggaaaaagcuuugagacacaucuucaugaaugaagaccaccggguuucccuauuuauagaucucagagguccuucuuagcagaggaaacauaauuuaauagccuccgaguagcucgaagaguuagcagagcuccccaagagccuaauuuauuuuggagaaaagccacaggaugccgggcagugguggcacacgccuuuaaucccagaggaagaggcagguggauuugaguucgaggccagccuggucuacagagaucaguuccaggacagccagggcuacacagagaaacccugucuugaaaacccaaaaaaacaaaaaaccaaaccaaaacaaaaagccaaaggcuacagggccuggcucucuauucuuaauaucuggcaccacugggaagccaggccuuggcucuuguucucuggugucccaagaaaucauuuaggaauguauagguaacuuuauggcucccaauauugcuaagaggauaaaaaaaaaaaaaggcacuggcauguaacugacaaagaugucuauuuucuucuuaaggauuacccaaaaugguacaguucuguagcuuucucauuuaucuuggcucuccggucuuugcaucuucaaacugugaccuauuaacaaaccauauggaguccaaacauguuggaugaaguucagugacugugcuggcuuuacugagaagaggacgcuaucuucauggaugauggccacccaggagccauuccaggaccuaaccccucaaugucauaaguucuguuauuaauauguuaacaugucucuuuugauaucugaugaaucacccagucacagcccugaagcuaccuaccacuuggagagacguaggcaggaagggaagauaaccggaaguaucacuuggguguuaccaugugccuucaaguacagcaacaggacagcacagagauccuuaccauaugcaaaacuaagucaguccacuaaagguacaaagguuagaaacuugagucuggcuuuuauagcucugauacuuacaaaucuggcuaugauugcuacagauucuaaacaucuaaacagguacuggggagauagccuaguggguaagaagaauaccugcugggcaagcagaaggaccugagguuauguccuuaguacccacauaaaagcugauguggcaaaauaugucugugauguuaguccugggagacagguguguggaacaguuggaucccuagagcucacugacuacccuagcuaaauaaaugguuaguuccagguucagugggagacccuaauuacaaaauacaagauugaaagugaaaugaacgauauguguucucaucacaaugaucuccaucaucaaaccagacauucaaucugaaacugacgugugcccaaacacugcuuucauaugucugagaauucugcccuggggaaauccacuaccuuauaucucugagguuggugaaacugaauuguugcccucuucugaucaaaaucuuuucucagcugaagaaaaugugcucugccguccuuauuuaaaaccuucuucuucccacugaugcuccggcagacauucacgucucuuccauaguacacuccuuucuugcagagucucuucagaucugagaggcugaacagagacugguaauauuuggccaguacagggucaucccucuggaugagaaggggcuuuuguucccagaauuccuugaaaaaagucucuacuuugaugggugagauuaaacuuucgaagaaacuacuggggcugucaaaguuuaauacagaaagcguuucaggcagcuccuccuucacccgcuugcaaggaacagacgcuucuucguucucauccccugugggcugcacuuucuuuggcauuguucacgaguagggaggaaaugcaaaccuaggagaagaauaagacacugucggguuugcaggaaugcacacgccccaagcaugacugagaccauuacgccucuucgaaaacuccacaucagucaggacugcauccuccaggaugugacacccuuaagccaguguuauguaugccaagaugauucaaccuuaaauacugagugcagucugugcguucaucuaaaggacuacacaacuaucuuauugcuacaagcacuaaguucugaaaaucagucuuaauuuggagacuugaugaucccaaacuaaaccauuucucucagcaauucuuauucaaaggggaagccuauggccacugaaauggcaaaggcaaaacuccugaauuuggcugcaaucagcaccaguaccugaauccaaagggauguacccucugugguacaaccaucugauggagaaucaggaacagguagcugucugcugcccugugcugcucaccacagcacagaaaaccuucccaggcagaagccaaugugcccugggccaguggcgucaccugguggcuggaaugagaugacaaacaaagcuugagaacugucaccaucagggaacucccccucugcccauugaaaaaaaguaauuaaaggcuuuaaaaaggaaaguuaaaaugggcuauauggaagaucuucaaaaagaucuaacuuuuuaacuggaacaagggaucaaucaccaacaucauuagccucuaacacagcacuucuccaauuuaacaugcauagaagacacgggggcaucaaguggaccagauacccauaguaacaacacugcuggucugaggcacacaucuggguagcaagaggaccaacauucccaaacacccacaaacuauaaacccugacacuuauauagguuucccucauguagguucaagaacuguaauucaaaauauacaaauauucacaacagaguuuuuuaauuucuggcauauuggugcucagaagucagauuuuauacauuuggauuagggauguucaaacuguauaacuucucuuuuuucuuucuuauucugagaagagguucuguucuucugauuccuaacaaacacccuguugccaaagaaggcugagaaucacagugcuuauaaaauaucacauuuuugucaaggucaauaacuuaaaaugcuaugacuuucuucuggguugaguuaccaagauugcaagaaagcugucuuuccuuuucaucaaauguggagcauucuggccgcacugugaacugaacccggaugcaaacucaucaaauuaacaagugggaacugaacaaauaauucguugcuuuuuaagggcuguuuuaaauauuaguuguuguagaucauucuaggacuucccagagcagaauacuucuuuuguucagcuuacuuucuuuauagaacucagguccaccagcccagagguggucccacacaucaaacacuaagcaaaugucuuagaguaacuggaucuuaugggggcauuuucucaauugaggcuccccgcucucagguaacucuagcuugugucaacuugacauaagacuagcuagccagaacagguaccuuccaaaguaaggcacacauuucuuacccucuuauauuuaagguacacaucucauacccucacgauugcucaguuugaugagaggaaaacacaagugaaaggcuuguuuccuuaagaauaaccugagagugaaaucguacauucaccagaagguguggcuaaagugccccaaauacuuaagcgagaauaaaaccacuuaaggauuuuccccaccuacaaucaccaacaagucaaccccaagacuacagaacuuaccuugccuacgauuacaccaccuauucuuccccuagguuaacagaauuuaucugagccucaguuaauuggaaacuaacucagauacauucuguuuuccuuacaccacucauuuuuuuauagccuuuggaggguggagcagaguagacacaccaggccuaucuccaaauauaccaaacggcaccaccauuucacaugcccaggacacccaagacauuccuuguauuucaagaaacacaggaaauuaaacaagagacugcuuuauccauaauggugcagcaccugccuguaagccccacggggcucccagauagaaacaagaauauuucuuucuauagaccugggguugcgguaaguugauuuaaaagcacuuaaacaauucuaaaagagacucaguuuauaaacugguaauugcuguaucgcugauaaguucaacccgaaaauaaauguuggcacucuuacuauaguugacaaacuuaagaaucuacauuuuagggcgaccuaauuuucccaugguaaaacuuaaugacaagaagccacagagugucuuaagagauagcuaccucuaccuugcacaaaccuagccaaguauggcacaagacaguuaagucagaauuuuucuucacuuuuucuucuuagcaaauucucaaaagccuuacucacuagcuccccaaacaaacaaaccccccccccccaaaaaaaaccccaugaccaccaccacuugggaaagacaggaggaggaggagguuugcacaauuaggacuauuauucuguacaaguaaccauagauaucaauacucacuagcagcccuggcagggacgucucucuccaugguagcaguauuuuaccagcaaagcgugguacacgcuaaugucuagaugcacacaucaaaccuaguggaguaccacuucugaugcuggaggcagaaaucuacauucacagaaguccuuaaugaacgaauuguaggcccacuaaccuagagaagacuagauugaacuuagcucaauuaaucacaccugacaguaguuauacaccaugggccugagagaugacucaggcgguaaagacaccugcuguccacuuaguuuaauuucugagacccacauacuggaaggaaaggauucccucaaaguguccaccaaccuccaccgguacaucauagccuguguacauccacacauaaaauaaauaaaguggugaaauacuuuuuaauuauauauugcuuguaagaaaaucaccaggcuaacugaaagcaauugucuucagcacccagaaaaguuuucauuaauucagagaugucucacugaauggcaguuauguuuuuuugcagcuuuauauaaacagaauacgaauuauguguauucgggggguccaugaggucacgaaagaugcagcccaaaaguucagaggcauccagguauuaaaaaggagcuggugaaacccaacucccggcgccggaaguucagaucaugaccgcugguagacuuccugaaaccuguuuagucacuuguuggacauccuggaggcaggcaggcagacaggcagucuuccucacguggagauaaaaaggcaaccuacgcuccaagucccgagcugggcgacaguccccgcgccccuccucaguccgcgaccguggucccugccccuccccgucugcgcgcgcagccuggcucuagcucgccggcgugugccgcccgccaccaguccggcggugcacguggccagguccccagcccucagccacccggcucaccaguuaggccccagcccuccagagcugcacuucucagccugacccgcgucccacgcgcugcaccggcacggccuguugcgugucuuccgcaaguugacccagcuaaggcauggaagggcgcgacggcguggucacguccagggcgggcucccgagacgcggccccgcccacg

SEQ ID NO: 8283 - RNA, 693 nt, Mus musculus
uaccuagagcucugcuucauuguuaauaaucacaguuaacuuaccuccacauacggacucagucugccugcaugguccugaacacggaaauacuuggacacugguuccugaagggugccaccaaaucugguccccgucucugaggagugaguccuggaagucugcaaguacugaugauaggcacucuucagagaagaaugcaacuuagaagucauaucggauuuuuggagaaacaacuccuuuucugaccaccggccaugcugcagacuggaggucguugguucacugaacucuacauaagacuugaaaauuccagcguguuccugguugucuucaggguaaaaggggauggaaggaucuggcaaguggaagguaacaugcucccucuuuucaguucuccaaucuuugcccgaagcuacagcuuccuccuccucuuccucggccuccugucugucaucuccaucgaaguuucucuguaagcgcucugacacugacuguaggagggauaagacagaagagggcugguuugcacucucccuugacuuggaagagccauggugaccaggcgagaccucacuggacagaacauccuccugcgaacugucauccucauagauggggcucagggcuaagggauagauuuuguaccucuuggcuuccaccgauaagaacaucucugaauugucuccauca

SEQ ID NO: 8284 - RNA, 1885 nt, Mus musculus
cuuucuuuuuuuuuuuuuuuuuuuuuucaaugaucaacuuguacuuuaauggacuacucaguuaagacacugcugcagucggaacuacauggacaggaagggucugagguacccuuaccugggaauugcacauggucuguuucacuggggcagaaacuuagagucaggcccaaguggccauaugggcaggcugccuaccacugcagaggguaccucagcguggaaggccaacgaacuggcaccccaguggccagacugcucuaaugaaccacacacagucuggggucucucucgucuugaggaaagcaggcaggaggcccaggugcugcuuccacaggcagaguaggugugcagacuauggucugacggucacgggaaugccuuucacauguugguacucaugcgugacuggcuguuggcuggagucagcuccccuuggcucccuucucuaggaggagacuugacauggaucugguugcggagcacagcugcucucagaaucauagcuuuggcacgucguuggaauuccuugcccaucagcagggacuucucaaagguggugcuacgcugauccacaucucgagcauacaguaucuugcugugugagucgaugcgggcauuaauaaggcccuccagaaugaguugugucagcucaucuuccagagcugcaacuguuguguugaaggcugcagccaucuugugcauaucagcugacacauaggggcugaaguauuggauaagagcccgguuacgaaucuggguguacaguguccugacgugaggggccagguacauguccaggagcagguuauccuucaucucguccagcaucuucaagcaugaggcauacuuggauucauagaauuugaagaugaugucucugaccuguggcuccagcuccaggaacagcuugaaggaacugcuggagaugacauuucguugcagcuccugccggucagagguggcuaaggcacacaggccaccauagacagccacauugcugggggacagcagcucugggaagucacagugaucaaaggaagccagaaggaagcacuuggcugcuugcuuauacuuccgugcggccagcucagccaagccugcagcacacuugagcuuggugaggauggcuugcgucuggcugucccgcucuccccgcugcucagcaaucucuggaguagacucggccuugcugacauagcuuaacacaugagaccaauuuugcaaguagacacugaccuugaugacguugaggcacauguugaugacaugcuuagcacuggugcaguagucucgggcucgugaguaacauuugagggcauugcugagguccccacaguccagguagugaucacccaggucaucguggccgcgccugaugcucucuuugauagaauugcccuuauaguucuucaaguccguguccagcuucuccaguuucaacagagccuucuuccgaguggccuccacccaggcuguguccaggggcgggggcuccacuccacucucagggauggcaucaggugcauucugcagcucccugguagccucggagagcuuccgguguaucucuucauacauguccacauugaagguccucugcacgaaggauagagccauuuucaaggccucuacccucaguggagggcaacggucagcaauaaacuguagucgcucaauucgcaucaggccacuguagcuggcugcauacugcuccagauccagggugggauucuccaccacauaguugacaucaggugcguucugcgguucuuccugcggaucgacaucaaucugcauggguuccacggcccccugcaaguuaaacaccugaaccggcagcggcaucuuccacccccggcgccgcggcgacguucgcuucccg

SEQ ID NO: 8285 - RNA, 9673 nt, Mus musculus
ucaauuuguuaguuuugucuucugguugcagagcuagcaguuuuccaauauuauuauaucaacucuuucaaaaauuagguuucucuuucagauaguuuuauuaagaaaaaaacauacugcuuuuacuuuguugaagaguggaaauaaaguauacaaaauauucagcaacugauuaaauauguggugcucagguuggggugauacuaaguaacugaagauauagccauaugacauuauucaucauagcauguguggcaugaacccagguccccaucaacacagaagccacaaaucagaacagaaucaaguuauuuguaagaaaauaaguagcugggcuggugagaugguucagcgguuaagagcacugacugcucuuccagagguccugaguucaaaucccagcaaccacauggugccucacaaccaucuguaaugggaucugaugcccucuucuggugugugugaagacaguguacuuagauacaauaauaaauaaaucuuuagacuagagugagcaaccuccauucccagcaaccacaugauggcuuauaaccaucaguacuguaguguacucauauacauaaaauaaauaaauaaauauuuuuuaaaaaagaaaauaaguaggugucagcagguuaagugacuuauccagagacagaaggcaaauauauuuuuuuuucuugaauauagaaucuagauucuuaaggugggagcugggugugggagggugggcagugggaaagaccaccugagaguaguuaagcagccauuagagaaaggugagagagacaugaacguagauauacuuaagcacaaaacugcauguguggaaguguccguguggagcccaucaauauguauagcauauuaauaugaugaaaagaaagugugacagugaaaucuggugaucucgccuguggaagacugcuuaggccucuucuuuaauuuacacguuuguuucuauagugcuugcuuuaucauaaaguggugucacauauccaagagcacaauugccuuagucuuugacuuucucaagcuuuuucuggucuguauguaauucaguuucucgcuggaauccaaguucacaaaaaccacugacuuaccucaccuuaggucuuacgcuugacugucaccagucaccaguuagauugcuaaccagauuuauggcugagcguccccaagccccagugaucaccaaguuuacuccccuaucuggguauaaagacuuaagaggcauucucgucucccugugaugcacuguggcaucuuuugaggucuuauuuuauacaacucuuaauuaccaaaauauugucaaauacgccaggugaauaaaguaguuaucacuuaguugaauauucaucuuaagaguauagaagugcccaauagaaaucaauauuuuuccagagauacaagauuuuucacuuuuaccagauaaccaguacuuuuaaguagauuccugccuugugucacuggcuucagcaguuucuguaauguuaguguguaaauguuagugugaggugcaaaaugaccauuuagcgaugauuaaacauaugugguuaacucaugaaaugcagacaaccaagucaagacucugaaauguggacagcguaucccuaaaugcugagaacguuucuaaaguagcaucuuuauuuggagccacagcgugggcaacagcaacagcacagggcccggcagggguuucuuuuuuuguauuuuacagccaguccaaauuucucuuugguguuguuaacauaaucuuuugugcuguucaccaucaccucaaugcuguugaugcucucucccuguuccucuaccagaagagauaucugaaugaaaaggucccggagguccuucacuugguucuccaaauucacaaguuccuugugucucuguucaauuuccgagagcugugcuuuagugauacugguuucuguaaguaagcuuucguugaaaacuucccauuuuccauggugaagcaugucauucacuucuucuucagaaacuucuuuuccggccacuucaagcugacgaacaauaaacguuuugcauuuuucuugcuuuaaagcuauugugucauuguauagaaacaugguuugcuggaagcggcggaacaucgcagcauacugagacuucaguauccuugugaccacugaugauggaccauuuucaaccucugacuuuuucacuucuuugacuacgucacccagugcccuguuuauguguucugcuuggauuuuuaucuccuuugcaaugguagagucucuuuuaaguagacuaaaccuucucauggaagccacuagacuuuucuguugcuguccaaaucguugaacaucauccacaaaacuguuaauauucuccugcaguuuuuggaucucauguaggugccucucagcuacaggcucucuuucauaaaugacagcuugcuggacgagcaccccuuguuccucuuccacaaacaccugaccgucccgagagaguucuauuuccuugguuuucuguuuuaauucuugaagucggucuuucaucuuccuuuacccccuaagaaacagaaacaguggaauugaacaaaggaguugcuguuuuuccccauuggcaguugaggugagauagcuaugugucucuuagcaaaaguuguucuaguuuucuaacaaguuuuaaaaauugagaauaauaccaagauaagauggcuaaggcaaggcuaaagcaaauuguaggcuauccuaggcuacaugggaaauucaaagcuauccugagcuguauaguaagaacguggaaaaaaaaaaaagaaaagaaaagaaagaaaggaaggaaggaaggaaggaaggaaggaaggaaaauugaaaggaauuuucuggacccauggcuucagcagaggauggucuuguagggcaucagugggaggagaggcccuugguccugugaaggcucuaugccccaguuuuggggaaugacagaguagggagaugggagugggugagugggugggggaacacccucauagaagcagggggaggggggaguggaugggggcuuuuggaggaaggggugaaccaacaaacgggauaacauuugaaauguaaauaaagaaaauauccaaugaaagaguaauuuccucauagagauuaccaaaauagggaaaauaauuuaagauaauuuaggaauuaguuugaaugguugcuccugcugugcaucucauguguuuuagaguaguaguuauaaaaagccauggugaggguacaguuuucccuccaguaaguccauccaugucaucacacugucuguaauauuagaguugcuuuggcuguacuuuuuugaguuuuaggagugaccuuuaaccuccuaaaauuaccauuguuaaagauaccuuucccacauaauuuaguguaagucauguuugaaauagaugcauuuuucggggacugggaauaugguucaacaguugggaacacaugcugcacuugcagggaccuggaccagguuacuccuuucccagcaagcauacggcagcucgcaaccauauguaacuucacuuccagggaaucggugcccucuacuugucuuuguggggacaggguauguaugcaugugguacacauacauacauuuagacaaaacacacaucaacuauauauauauaaugagguuuuugaauuagcauauuuuauauagcuuuguuuucuauuucuauauauucuauuucuauugcauguauaaaaucuauuuuugauuugauuaagccuacuucucauuccugcaguuguuuccaaggaucucaaaaguccuagagcaaaauguguaggaauuccuaucaugauauauuuuuagauacuugagaacauguuuauauauuauauuauuggcaaaugcugguaauaguuacauuuucaccuagugcuccuaauuguccauagcaucaaaucaaauggauaucuuauauauaaugauagauuaaaaauaaauacacacacauauuuaaaugaaucaaagcuauuguuauuuauaaaccacuaaauuauuuucuuaguccuagaguuuagaaaggcacuuaaugcuucuauaguuuugaaaagacugaguggguauauaagcagcucucugaucucuauguguuuucuuaauauugagcagauaaagcucucauaggcugugguacugugagacucaauuucuuauauaguuuuuuuuuuaaaucaacaauuuggaccuuuucccaugcacauaugguuaucagauauauucaugauccuuagcgugguauuauuuuuagucucugaaauugagauucagggauuaaaguaauaccaagcauauacuaaauauaaauauauauacacacacacacacacacacacacacacacacacacacaccacauacguacuuaagaggaaaggauuugaaauacgaagcacuuuagcaagcaucuucacaucuacagaacugaccuggcuucccagcagugaccuaugacaaaauguauuucaauacauguuuuaaucagggcugucagcauaguaaguacaaguguaauaagcuaagaagcauauuuguucuacguaauuuaugcuauuuguggcacuuagaguguaggaugcugugcgaugaaaacacauaaauuaggaauucccgaaggcacauagaggguaaaacuagagaaccauacaaagaagaaaaucauugaaauagauuuaaaccacugacccauguaagagaagaucucuuuauaguaagcauauuuauaauuuuuaucuuaagccacacaauuaacagagucucuaguauuauaaauuauagaaauuaacauauacuuuguuuacauacaguugcaauaaaacaaaauucagugugauaggcauaacaauguucuccaucaaauuugacuuauuacuguuguuauuucuuucuguguuugugucuaccuggcugccugccucucucucucugucucucucugucucucucucucucuuucucuguguguauuauguaugacacaguguauguguagaggucagaagacaauguacaagauugacauucuguccccaggauuuaggucucagggagugaacucaggucaugaaucuuggcaggugucuaauuuacugucugaaacaucucaucagcuccuccaucaguuuuggaauuuaacaauaagcagaaaagucuuauuaggaccuaaauauaaagaaaacaaaagaaauuccucaagaaggaaguguuuuuggacagcaaggcucagcagagagaggcauuuccaaccaggccagagaaucuguguucaacccuggaauuccacguugaaagucuguccuuacaacaugguuagacauagcaccauuccaaaggucuugagugggaauuauaugggagcaguguuaauaccugguacauguccugaacaaauuggguaaaagcugaggagauagcucagugagagcacuugccauagaagcaugaaacccagcucugcguccacagcacccacauaagaaguaggaguggccacauaugccugcauccagugcuggggaggaggugaggacuggaagcucccuggaguuggucagcuggccagccuagacacaaaccaggcaauucuuguuuagugagagagcgagacccugucucaguaagguguagagugauggaagaagacaccuguuaccuuccuuuggucucuguaagugcaaaggggugugcgcacgcacacauacauacagacauaugccaaguauacacauuaagaugcaaauaaauauuagaacauuucuuucucuuuuuaaaggauuuauuuauuuuaugcauaugaguacaugcuguagcugcacagauaguugugagccgucaucugguuguugggaauugaauuuaggacuucugcucacuccggucagccccgcuugcucaaucccugguugcuuuggcccaaagauuuauuuauuauuauaaauaaguacacuguagcugucuucagacacaccagaagagggugucagcucauuacaggugguugugagccaccguguggcugcugggauuugaacucaggaccaucagaugaacagccagugcucuuaccugcugagccaucucagcagcccagaacauuucuuucuuuaugccacuauguuauugaugugaaaaugcaagcauguaaaaagaauuagguuucuuuauucugcucuauaccaggacaugaaaauauaaaguagaauauuuucuuuggaauauugaacauguguguuaaagcuucuuuauauuauuagguuaucuugguaauaauuuuuuucuuucagguggccauuaacuucuaucuauauucuugaaggugggcaaguguauuuauuguguccuuuggaguauuauauuaugugggaaugccuuaagugcccuauuauggauucauuuuaauguuguuugguuaucauuuagagcucaugggauuuguccacuauuguccagguaguggaagaacaggcccagagacugcagccaucucucugugcuagaaaguuugcucaggcauuccaugaagcucuauuuauagcaucacaaaagacacauuaacacguguuauguuuguguagagauaaguaagcagguagauagaugauugacagauggauuauagauauaguagaugggagauauguagauauguagauagauuagacuagauuagauuagauagaucagaagagagaaagagacggcucaguuuucugugauuuuuauaguucaaauggauacuucauguucugcuguaauccugggcaacuuaaaauugauauuucuauguuuguacagaauaugcucuguuuucucuaguacaucuagggaauucaguuuuauuuucuguaauaucugaacccuaagucucagccucaaagauagacuauuuucuucuaaucuaguguaguuguguuuaauuucuucuuguaauguuauggucccuucucauuucuagaacugcuacuuugugcuauuuuuaaauugauuuuuguuuguuuguuuguuuauuugagacccaauuucucuguuuaccauugauuucuggcaccaacucuguagaccuggcaggccauggacucaagauccaacugccucuggccccacgccccuagugcugggauuaaaggcauucgccaccaacugccauaaauugauaguuucaacuugaaggauauagcaaacguuucucuauauuucagacagaaggaagcaguucuaagauggcugucucccuugaugaggcauaggugaugaccuuggcagugguagcacacucagcauucuguuccaguccuugugugucugaguaaaacucacuuaguguaugugcucgggugcacuucugugcuaucuguaugcauuucuggcggguggugcucauaacucuaugcacugcaguguccuguuucauuuuacgucaacaaauuagaaucuaagcauacuugaauuuaaauguugaauguaguucaugaaaguauaaaguaugaaacucauaagaaauuauauaauugguuaggcuaauugaaauucaugagauuauuucauggaauuuucuuagugugguaguagucuguccauagaagguaagaucaucucucaguacauuuaauuuacuacuauaugauuuugaacuugcuguaugguuugaauuagauccacuguaucugagaacuuaaugauaauauucaagaaagaaaaaaacaggaugaugguugguauauaugguaauaacuuguaauaguuccuugugauaaagagaaaagcaaaugggagugacucagaggaaacuuucuccacccugcuacagagaaugcagauuccuaaagccauacaugaacacgcaguaccuagagucuuuagaaauauacuauuggcugcugguggugguauaugccuuuaaucccagcauguaggguagggggagcugcaggcucucugugaguuccaggucagccuagucuucagaguaaguuccaggauagucagggcuauacagugaaacucugccugccuugaaagccagagaagaaagagagaaagaaggagacagagacagagagagagacagagacagagacacagagacagucagagagagacagacagacagauagagacacagacagagagacagagaggaaauacaccacaggauaucuguuuaauaugcuuauggaauaauuaaaaguaaauuauucuuucuguaguuacuauguugauaagcacuucaggaaaugcauuuuauuucagucuauaaaggcagcauuuagcaguucucuaguucaaugguaaaauggggaauuuuaccauauauauucucuaggcuugaauuaacugacauuuucagcaauauauucucuuaguaaucuucagauucaguguagaucuauugucuuauugaacuaaccuguuuuguaaaagucauuucucuuuuuauugaguuuuaaaauaaaacaauuuuugcuuuucugauucagguagguugaauguauaugaaguagucuucauauuaaauuuccaaggacaaagccuugaagcgagauccuuguauauuacauguggcccacuucauauuuacuuuuaaaauaguuauaaaaguuauguugauuugaaugaguauuuauuaaauuugaauaugguaacaauuacaacuuaggaaauacauuucauuuaaauuguucauaauuaaauguugaucuaauagcuugaagaaucuaugauaaguuuuauaauuucaguacuuuaacaaacuaucuaaaacauuaaauguuugaguacuuuuuauauuuuacaguaguucuaacaaaacuauuucagaauuucuucaaauuaguuuuagcagaaccugagaaauaaugaagaaauuaauauuuuucugucaaauuugggcauaaagcuuuguucaauuuuaagugugaaagucugucuaaaauaaguauagcaucauuaauuuauugucuauaaacauagaauuucagauuuguuuucaugggaaauguuuucuaauuucucuaaaacaaguugcuuuuauagauuuaaaguagugauuucuuuuaucuaugguugguaacuacaccuuacuccuuuucaguuccucauagcaagaacaggucagcugcuuguagcuguguucugaucuaaauaagaaaggaacucuaaaggaccugcagagacauccuuuacugucacagugugccuggauuucaguuucuggauauuucacuauuucucuuuauacagcgugugugcacaggugcacacacacacacacacacacagacacacagacacacacacacacacagagagagagagagagagagagagagagagagagagagagagagagagagagagagagaagaaaauauaauucacuuaccugggugucuuguucuuguuuucccaccuggggugugagaguccuuaguccgagagaaaauccaagugccauggaguguaaugccuggcccaaugcuaaaucagucuaagccacaggcucccuuuaugguucucauacaguuaauugaaagccaaacagugaagucaaauaagucggcgauaaaguuguccauuugcuguaacuaugaagugagaggcacagacugcuuaccucacaccuggagaaucagguucugccugcuccucaccuguuccu

SEQ ID NO: 8286 - RNA, 75042 nt, Mus musculus
cgcucgggcugggccgcggcagagcugggagagcagagcccgggcucgcagcuucccucggccgcccuagcgcaggcacgguccccgcugcgccagcccugacccccggccauccucucagcaaugaggguccugagcgcacgcuuucgggugcuacuggccugccucgcccuggugaucccugucucagagacaaacuguaaguaauccauaucuucaggcuucucuggucccuacaugcccuggcugguaggauugucuccuggacagcuuguugcuuccuaaauuuccaguaagucccccagcgucucagagaguggcggcagccuggaucuggcggacugaguaaacgugggacgagaucaaagcuugccuugcuuugggagucauuguccacaggauugaugcaagaagcugggugauaccaagugucauaggaauuggaugagcauaguucuaaacauugguaggaaaacuaagucaacccucggugcccuccgaucccagccugcacccucucuuacaguuaaccuuccuuuugcaauuucuggacuuuguacuugauuggcucgucucacauugacaaacuguuugaggaucacugcgaguuuacuuaucauucccuaaccuuggcguaagaaguugcuguuggauauuaucuuggagcgaggaucguuuuguacugaggauuuugauugcuacugaucugcggugguggcacggauucuuugcaccuuauugucguguuucuugauuuuuuucccccuucuuccauucccagauuccagggagcauauugaguuuucucuuagggauauauaaagagcaacacagguuugguacguuguaacugucaacaaaauuguuuucaaaacuuuaaauguguucauaauuaacagugcuuucuucugcucuguuggauucccagaaacaggcaugggagaaauaacugcauaacauuuaggcgacuaagaguaucaaagaaaucuuucaaggaugguuaauuaaauaggcguuugcuagaauuucaauuuuuuauuaaguaauaagaagaugcagguauucuuaaaauuauaacuaacuuaaagaccagacuauaacugauuuguuuuauauugaagauaaacaaguuacaauuacaaaacuucaacggccaagcccccauaacaaagccgcaugugacuguaugcuugcacaugaucuaucuuguacauuaggacaaucaaauguuuuccgacagcagcagggcgguggccggcacgugccucugauccagccacuugcucuccaggcagaggucagcaaaucucugaguucaaggccagccugaucuacaguuccagaacagcccagcugcccagagaaaccuugucucaaaacaaagcaaagcaaaacaaacaaauaaaaacaaaacaaaacaacaacaaaagacaaagcaagaguugguguuuggggaaagagcaagggacaacaguggcugacuugccacccagagacuagacaaguucuuucuacaaggacaucacagaaagaauauucaguacugugauggcaacauccugucuuguugccuggaugaaaaaccaucucugguuuauggaugaagaaacagacaccuaugugcuguuucucuucccuaaaauuuugacuuuguguuuuggggucuugcuggucgugccuuucauuguggugcugagaauuggaucugggaguugguacaagguaggccagugagcuacauccccaaacucgaagguccaggagaauugaaaugugagauacaauuagaauguuaaacacgucauguauaaucaauuauaugguccucaaaauaugcuauaauaagugaaaccuuuccagagcaguuauuucuugagagaaugaaugaacaaaaauagacaacaccucacaaccaaaaccagaguccugcuuuguaguucugacuugccuuuaggcuaccuucugccuugaccuucuaagugaugggaucgcuugccugugcuaccguccaggcuucauuuaacaaugaaguauucaguuaucaacugacuuuccaaauguauuugcauaaauaaaaaccacaaaaauuaacaagaaauauacacacaacuaacuuguauuuguugcuaaucacucaugagagcuuguggugaaaggggaaaugggaagaggaggauaucuauuuugaguaggcucauuuggccuuaucuagacuucccuuuugaguggagcagucuucucuguguguuacugacccaucuucucuauaugguuuuguacucugcucuguucuuucuuaacucuccccuuuguuaugauuuuauuccugucuuucuuaaguuucuuuucuuuacauauauauauauauauauauauagauagauagauauacauauauauauauagauagauauagauauagauauaauccacacuaauggauuaacuuaaaaugcuacacuaauggagugauuuuuucaaaagguuagcuuacauuucaaaagguuagcugcaagaguuaguuucuuaugguuuggugaagaauguugcugccuuuugcccuuuucugaagagucugccugagacuaagguaaagaaacuuagauuaauugcaucgacaaaggaagucuuagaaaugcccaacacagaccuuguccucugguuuacuuucaugaacaccguuuugaucaagcauagcaagcuuagaaagaaaaaguagaaaaugugugauucaaguauuaaaagggcaccagaaaguacaaugaagcugaauucuguguucaagaauauuaaauggaaauaaggaaguggugaccuuggggcaagaucccacucagcuaagcuuauuguuuauguguuugucacugaauaagggauaguuauauaauauuggguguuauuauuacuuaauuauuguuuucauuuguacuuuuaaucuggaaugacuauaauccugaaauggaggauacaggcuuauguccagaucuugaggaauaguggccaccaaaagcuuagguccagguaugauacaggccuuuaaucccaggagaaagaggcaagcugaccucuuuguucaaggccauccugguaaagagcaagucccaaguagacaaaaacuuaaguccaggcaugguagaacaugccuacaaucccaacauucaggagacagagccaugaagauuccugaguucaaggucaaucuauggagcauguuccacgacagccaagcuuacucaaacuaccacaccaguuuagucauuaugacaaauuacaugagaaagucaaauagaagaaaaggaagguuuuauuuucagccauguuauguagguuuccacucaugggcacuuagggaggcacauguuaaggcagagcaauguggcaauagauacgauaucaaggaagugaaaagaaagcucauuuuuaugaggaagucccucucuccagaccuaugaagcugugaauuuaaagccuugggcaaauguuucauggccuagagacuucccaaaggcccacuucagauccuuucuuccuuagggcccaaguacucaaugcaugagcuuuuuaaaggauauuuaacaucuaaaauauaucugccuccuugggccucaaagacccaagcccaccucgcaaugcagaauucaucagaauucgcuagcccauauuuaugucugggucuuuguaucuuaccaguucuaucagugcucaaaagccaaggucccaaaguauuuucagacuuuggcaaauuuuuauauaugaacuguaaaauguaaaaacaaauugcacacauccaauaugcaaaugcccaugggagucacuccuauuucaaaugagaauugugaaacaguaaggcagaauucauuuaaagcaaaacugaaaacuugaagggcaaacaucaagugcuuuguagucccaagucugccaucuaggggcacauccuauccugcaccauggcuacaauggauucuucagugguuucaugacuaaacaggugaaauauugcggaaauaauuucuuagcucugggacuagaauacccagggacucucaagugaacauuuuguauuuaccaaccuuucagcccaugaaagauggaucuuccuaauucaugaaaucaccucaaugacagucuuuccaacugucuagguagaaaguucuuguauuguuuuuaauggugcuaauuucuuuagugucuccaugggcaccaaccuauccuuucagacauuuuuauuuauuuauuuauuuugcuggcaaaacaguaaauuucucaagucuuucugcucugaauuuuuucuuccugauucuuacucuaaaucucgcuaagaucaaacaguaauacugaggccacaucugggugcuguaaugccuugaaauuuggcuaccucgugugucuuuuuuuuuaagccuccccucacauuauaguuauaaaacaugaagaaaauguagacaaguccuuugucaaauguagcauaaauggcuguuagugcaguucccaaagcagucuuuacuuucauuugaaacuucuccaguuuugucuuuacauuagaccaacacuccgauauucugagguucuuccagaagagcccuuuaagcuccacuuauaguguuauacaccuucucuagccugcuuccccaaacgacuucagaccauucuaaacugcaucauuuaaaaucacgacagcccaaucccaaugucaaauuucuugucaucuugauauugcuguggaaaaauuauccaagaaaaucaaccaagucaagauuuaguugggcucauaguuucaggcguuuuagugucuggucauuggccugguuucugugccuacagucaugaaaggaugcuaugguacagaagcauugguccccucaccucacugagguuaggaagcagaggggagugcuuguuucauucugugcauccucccucccaauccaccuuuuggugaauccacugaugaagccagaacacucucucaccaaauugcauaccaaagacuccacccugaacauugcugcuuuggguuucaacauuugaguuuucucugguauacuuacaggcuaauccccaacaaagaugaaauuagagaaagguuggaaaauuucuauaaauugcucugaaggcugcagaauggucuaugaucagccaugcauaggggaagcaaagccaugagcauuuagguaaucuauaugguggaucucaugugccucuacugcagagaaggaauuaagaugacuaaauuuaugugucuucuaguucuaugugaggacuagacgucucaugacuucuagucauaucaggucacauaacuugaagcacuuuaguuauaacaauccugggaaauucauacagggauuuaguuuuuauuacacuuuugccuuguuguccuacugcuagcuuuuacucacacagcaauauugagacuuagaaggaaugcauucagaagaaacuacuauccuuuuaccuuauuaaaaucuaggacuaauguacaguuguuugauguucauaugaugguaguuggcucaugugcuaaaagccuauucccaacucaguaaauauucacggaaacuaaaagagauuggacuuugauagucacuaaaaaucaccaucucacaaaugcuuuuuuucuccuuaauucuuuuuuuuaaaaaacuuauuuauuuaauauacagucauauacuauagcugccuucagauacgcuagaagaggccaucagauuccauuucauuauagugguugugagcuacuaugugguugcugggaauugagcucaggaccuuuguaagaacagucagugcccuuacccgcugagccaucucuccagcccuucuccuuaauucuugaccugagucuuuuagcuguagcaaaggagcaauaccuagucuuaugccuuaaauaucugggagaccucaaucaauucuuggcuuagcuuggcucuaaagcccuggguuugacagcuugcauagagucucacagagcaccagaaggaugguuuccacagggaaacacuaccaaggcagaaagcagaugggagaaaaguuuacauuguaguuauucuuggagcauacacagccuucuuuccaaagaaaggcacacaacggaguauaggcagugacuuugaagcuuguuugagcuucucuugcuuagcaggagcuugguugcuaaugaugccaucaugacacauuuucuaucauucuuguugucaggaaaauuuuccaguguuucuuuucaguaagagcaauucuacgcuuacauacugagucugugccuccuuaccugugggugaugcauccauuuauuccaagaguucugcuucuugaaauccugauuuuuauguugcaaaaacacuaguuuuuuuucuuguuuacugucaugacuucggcauaauaauguuuuucucucacaaguaacaaagacuaucagaugaccauauauuagaccuagauuucauaagguagaaaauaauaguagggucucuugcgaaugccuuccuucacggcuccaaauuucuuuguaaguaaaaccuagcuguaggaaaacagagccaaaaacauaagaacaaguucuucugugaguuucccaggauugacauaacuaaagugccucaagucaucuaacauaaacaaaagacacuuagagucuuaagaaccuggaguauaaguuaaaaucaagccauuaguaggcauucuuccuucuucacaguagugagaagauguguuccauguuuuuuacuuuguaacaggugguccaaccuguguaucacuuucuucuaagguuuuaacaucuucauagugaccucuguguacuugcaucucuuccuccacauucuuuuuuagaaauauuauuacuggugaugaguuacagccuccauggccuuauuuuaauuugaucaucugcuaacacccuguuuccaaacuaguaaauacucaugggagcugagagagugcgcuuuaguagucacuaaaaaucaccaccacaucacuguuucucuuucuccuuaauucuucaccugaaccuuuuagcaguagcaaagcagcaauacauacuaacgguucuugauacaaaguguagcaccuuuuuuuuuucaucauugaaaugccauuuuauugcaagucagugacaaugggaaguagacauuuuaauuuggugauauuacagagucaagcaaauauuacguuuccugcacaaaaagaccucuacaauaaaauagacuggagacauuuuagaaucuccuaauaauuacaauauccauuucaauaaaagugaaaaagaaaagcucugauuagagguugaguagacuugucugaacauguuccuuaaaguuccccccaggccauuuccaguccuuucugaacacguaaagcaccuuaucugcucaucaggagucucaauugugcugcuccuacuugucagcgaggucuccacugcacaaucguugccauggaacacguauuuuuuguugcuguuauugcugcuuucuuuugucucuuucuaaauugaaacuagauuuuucugucuuggaugaaaacacccgcagcacagaccacaguuuccccucccucugcucauccuggcuuuccuaucgccccucuuuuccagaucugcuucccuucugcuccuuuucacaaaagaccuggcuuccaagagacaauaaccaacccugacaaaacaagagacaaucugacaagguagaagcucucauaaaggggcugacaaggcaacccaacagaagggaaagaguuccaaaaacagucaaaagaaccagagccauaccuacuccuacauguaugagucgucguccccccccucccaaaaaacaaaagaaacaaaaaaccaaaaaauaaaaaacaaaaacaaaaaaugccaagauuacaagcauaacauauaugcagaugaucuggugcagugcuacccacuucggucucugugagcucaugugaacccugcuuaguugauuugaugagccauguucuccugguguccucuauccccucuggcuccuauaaguuuuccucuccuucuuccacagggcaggagucccugaguucugaccugacaaagacuccaaucugucuauaugaugucuggcuguggguuucuguaucuguuccuguuugcugccggaggaaguaauaucuaguaauaauuauugaugcaaacaguauauuaccuuuaaaacauuccacacacacuuaaaauuucuugagaauuuaaacugugguuugaaaauaauuguuaugaggccagguuugguggcacacucuuuuagucccagcacucaggaagcagagacugucggauuucuaaguuggaggccagccuggucugcauaacaaguuccagaacuguuggggcuauauguaaaaggauacugucucaaacacacacacuaaaaaugauuuuguuaguucuuugagaauuucauacucuggauauuagucauuaacauucuacaacagaagagccucccuuuauccacuuacgaauaaucugcugauugaaauaugucuaauuuucaaaaacuucaagaauacuaagccucguugguaacaucaguguuuuuauuucugugugagccuugaugugcaaaagcuuaccuggcaguguuccuauguaaccuucauuauauuugugacugucuucugucuucaacguuauuuuuuauauaguaguaguauuuguauguguguguguguuuauaugacaagugccucuaaccuacuaaaacauugucaucggcaugccuuuugauggacuuugccagggucuguguugauguccuuggccuguguuaccacugaaggccaugcagauauccauggucugugcuucagcaugaagccauguaaauguccaugagccuugcuguugcugcucugccaugugaugccagggcugucucugaggacuggucuagguucacgguucuacuguagccaggggcuguguucauagucugugcuguuguuagaaaccauguggaagcuuacgguccaugcucccucugaguauaaaggguaaaaaaaaaucuacuuuugccgugaugccaaugauuuuagauccacaguugagaaaaaagggacauggaaggcuucugugacaacuucacccaccaccccaacccccaaaaguagcaaccuacccucacaggaagccauugaagagaauucuuaaaaauugugaaaaggaugcugaaguuagcucuccacaacugauggcuucugaugagggaacaacucaguucuguuuaaggagcaggcuguggagagucugaccauucuccagugaguauagugauaagacaaauuguacuuguuuuuuucuuuucuuuuaauuuuaauuauaauuuuuugggaggggcugagggagguggaggcagacauggaagcacagggaaaugacuguaaugguguugaaugaugugaaauucccaaagaaucaauaaaauuauuauguagaaaacaaacaaacaaacaaacaaacauacuaaaacacuuagaauuggauauuugaagauuaucuggagguuuuggaaugacugucuugugauuccauagccuucuuauuccaagaaaaggcuauaaaacuuuaaaguaaugccuuuaagagauucagcaaugaaaauucaaggauucugauuaaagaaaauguacauagagaaucacauaaagucugguguguuuuauauaacucucuuccaucuuaucccaucugguucacauaaaguccaacauaacuugcaugaggagaacaacagagccgguaaacugccuuaguggggaaguaacaagacgugaguuuucuuaauguucaaauaguucugcuccaaggauguucaaggcauuuuucaugaacuuuuucgacucugucuaucagauccauuuuuccucuaagguuaaaauuaaugucucuucaccuaaguaugaacacccauuacuuacuuaaccuuuaucaauuuuucauauagagugugaaacuauuuaacuaucugcguacuaguuugugauagacagaauaauuaacuauguccagaacauauaccagauggggacuuagaguuauuacacccaguugguguuaauguaggagaaugaauuaaugcauagcugacuuugaagucuuguaaugaggacccuguccucucuucuugcccccccccccauugguaauacuaauugaugugguuuaugaagacccauugcuaaucauaauuacuugucauacuuuaaaaauaaaauacuuguugguacuuucuccacuguuaucuuuuuaaaaugguuucuucaguugaacacuaugugucauaccuguuauuuccagcacucagggaacccgaggcgggaggauuguugagacuuccacggacgauuccacuauacugugagacuuugucaagacaagaggaaauaaugaaacauaacaaaauagaauaaaauucucucuuggcuaagcauuuauucccaccuugggaucaagccagcucagucagucaauagggucucaagggaaagagugaggauugaaaagaaaaagacaauuagacaacacgaguacaugaccccagccaguucugaaguugaagcugguuaacuuuuuuccagucugcuuuuguaucauucuaggaacauacaaagcauauggucgguccuaaggcauaaacagaguauucagcaucuuaacaagucccaucaagauacaaggaacacauuccucagcuguauuuaucuugagccuacuuccuuguccuaucccaaugucaaauuccugccaaauuccuagaagauggccccaaaagcucuccacacgccuaugucugucaguacagagacacauguacucaugguucaguuuuugcugccgaguguauauaugcucagcaauugggcuucuguguuuuaagaccuucucuuuaucuuacgugguagacuuggccaaggugucuguuuuguuuuguuuuguuuuguuuuguuuuuuuacauuggcaaucauauuuauuuggaaagcacaauguuuuccaaugcaugcauacucaaaugaccaaaucuuggugauuagcccauaaguugcuuuauguacuguucuuaucauuucauuguggugagaacauuuaaauuucuucuuuaacuguuuugaaaagccucaguaugccauuaauaacaugggguuucccuuaacuugauagcuuauuugcuuaaacuucuuuuuagaaauuucaaggguuuuuuuuuuuguuuguuuuguuuuuuguuuguuuguuuuuauacuguccuuauuugagagggugcacagguacauacgugugaguguguccuaugguacagauguggagguuagaggacaacuuggcagaguugauucuauucaccaugugaguccuagagaaagaacucagauccuuagucuuccauucaguaccuucagaggcuaaaccgucucucuacucugaagcaauccaaguauauucuaauuaagaacauaucuaacucaacaauaauguaacauuuauucuauacuucuugcaauguggauucacauacucuuagauaugaaaaacauaaauaauccuuauuucauggggcuggagagaugcuggguagucaggagcagguacuagucauacagauaacgaaaguuuaguucccagcacccaugucacauggcuaacaccuaucuguaacaccagacucaaacuaucugacaucuuugguauuucacggacacacagacacacaugcauauaaauaacaaaauaaaaacaaaauuuuuaaauguuacuugucuuagauacaaugaacuccuucauacacuauacuuuaaaauguuuuuuuuuuuuuuuuguuuguguucauuguaauuaucuaaccagaagaguauuugagaauacuuagcaugcuuccaaccauuuggccaucucaaugauauuaagagccacauguucauagcauuucuuuggauaugaccauauuaauuucacuggcuugauuuccuaggaccagaagaacugcagacugaaggucuaagcagugugucuguuuggaagcuuucagauacaaauugugagauuucuccuuggaaaucugcuugaaaugguugauauugccuucauauuugccaacauugaaccuuaacguaagaaaaaaucuuuggaaaugcaguaacugaaaaauaggugaugauuuuggggggugugaaggaguagaaucguaauccuagccugacuuuaaacguuuuuuguuuguuuugauuuguuuuguuuuaaucacaauucagcuauguuugcuaauguaaccuuuugguaaauccucuuccugggaggcuucaggaacucugauagcauuugcauucaacuucauguuuguguugcuccaguguuaucuauuuuaaaaugccuauugguguuucaguuuauucuuuuucuucugaauuuauaaguucuaugcauauguuaaaacguucaagccccuuuucugcuuuuucucgcuugcaucuuggcguucugugaacguuuauucuaucuguauauaaagcauucugaugucccccccacaugccccaacaucacccuagcuuaucauuaugccuugccaaccucccuucauuccuggaaggccuguccccacaucccuugagcuuguuuaguuuuguuuuacugaaacaacuuauauguuuuggugaacagacauucuaguauuugcaagccaaaucuauguuuauaugguuuuccaguuuugguuuggauuugagcuauaaaaggacagccccacuccaauaaaauauaaacaugggauaacccugccaaacccuguuguaaaacaguagaaacccaugauuuuaaguagcaucaauuggcagaugauugaaugacaggagugaacuuaugguugauucagugaacuuaguuugauccagaacaacacagacaccaccuuaccacacacauacaacacgcacaacuuacauaacacucgcacaaacaacacacgcaaugcagaacacacacacauagacacacaccaucauaaaacguuuuguucuacugaaacagauuauguguuuuggugaacaaacauuuuaguaugaaugacacggugaacuuguguuugauccagugaacauaccuuuauccagagcaagacacacagcauaccacaccucauacacacaacacacaaacucagcaaauacucuuuagcuuuaaacccaccagugcagcaagauuucaauuguuauauucuggggccacuuagucugagugucugcccaacuuauauauugguaagaaucacucuuagcccuggugcuagcuaggaguuuaaagaugaugaccagcaauucuagaggcccugcuuugcuuuuccacacugguccauaaaacagcggucauggcgcauaccucuaaucucugauuccaggacuugaggugugguggaggacugggagggggugagggccuuaaaaccaucuguuuuuguuuguuugucucacuauguagcucugauugucuuggaacacauuuuauagcccaugcuagcuucaaaugcuuauagauccaccugucucugucuccugauugcugggauuaaaggcaugugccacuagugauccagguacuggaagacgauuucuaacuacauaaugaguuugaguuuggccuggacugcaugugacuuuguaaaguagacuuuaggagcaauguauaaaaaucuaggucaggguuuucagugaaauuacaccaagauuacagauuaauuuggggguauaucuuugaaaauacuugguuuucuuauuaggaauuacugcauaacauauuacuaaaucuccuuagaacuauuuauggugguguguguguguaugugugugggguguguguguucuguccugugugugugauuuguauguguguggugcucuggaucauacuaaggaucacuugaguacucagcaaauccucuaucaccaagucauagauaucuucaacccuaccaugucuuugucauaaugaccuccaauguuccucacuaaauuuauuauuuaauauuaauauuucugcugauauucuguugccauuccauucauaguugugucugauuuuuauuuguguuaguaaagcugcuguuuuuauuuuuauuugaaaaaguuauguauuuuaauuauguuuuaucuucuaccaacuccucccagaaccacauacuuccacacccaccgaacuuuauguucucugggucucaaaacacacacacacacacacacacaaaucagaacaaauaagcaaaaacccaacaaagugaaaaauguacaaacaaaacaaaaaguacacauacacacacacacagaaacacacaaaauaaacaaaaacaaacacaauaaaaaaagaaacaagcauggaacucauuuuguguuggccuucuacuccugggcacagggccuguucuggcaaguauuugauauauuuauucagugacacuccacuggagaaaacugauuuucccuuugccagcugauaucaauuguagacagcaucuucuggaugggaccccauguguaccuccuucucucucagcccuggaaccagacuaaccugaacuacugagcucacugccauaguaucugugaguucaugagaaccacaguccagcuaugucuguaagacacuguuucuuggagucauccauuaccucuggcccuaccaaaauguuuaccuccucuucugcauagauccuucauccuugaggggagggauuugaugaacaccuuucauuuaggauucuuuuaaagaauuaugucuugucuagaauuuuuagacuauucuaauuagcacuaauuggcuuuaagucuucuuuggagaucccugguaaacacucauguuauugcaaagcuauuuuguuuguguucaugcaauacuucuuuuauuguguuauaauauacagacauaggacuggggacauggucaucuucaggacacuugacugaaagaggaaagguagaacucaaccgguuuguuauucuggggagaaucaucucaauaacuuaaugguuaugguuucuuuuuugaggaaaugagguuuuacuauguggccuaggcuggccuuaaauuccuggguccucugucucagucucuccagugcuuaggaggaauuuacuguccuuucugacuuuaaugcuuacuuuuauuaucucuuuaugagauuaucauauaaugucucuaccuuguuuuuucugucuuuguaugaaucauaguguuucuccucauuucuagaaauguuucaacuuuuacauauugugagcccugcagcugaguuauuacccagugccucuuugugaacuuagacgauaacuucuguccuuccauccucucuccucucuuccuggaauuuuuuuuaaaaaaacuuuauuuauuuauuuuauggaugaguacacuguagcugaacagacgguugugagccaccaugugguuguugggauuugaacucgggaccuucggaagaggagucagugcucuuaccugcugagccaucucuccagccagaaucaaauauuucuaucaauauauguuauacauucugacauauucuaguuuaaaagaagaugcacagcuggauagaguggcgcaugucugacauuuaauuuuagggccagugugaguuacacagaguucuaggagccuggacuguauauaaaaucuauauuuaaaaacaagcaugaagaaccagaaauagugauucuugccuacauuacaggacuugggaagcugaggcagaaggauugcugugaguuggaggccagccugggcuacagagugaaacauacuucaaaauaucaaaacacacacacacacacacacacacacacacacaaaagaccaaaacagacuaaaagaaaaagguggagcggguucuguuguuaggagacacugauugcugcauugaaggagugcaucucauagucagcagugaaaacaaaguuugaacagcacacucucagagcuaagcagauacuacuagacacugugaaaaacauacuggacucaguaaauguggaaguagccaagaaaaguguuuauucaauggaagagagggagaucaaaucgauagacuggacuuuauuuguagccuuuucuucaauauuuguuugagguauggaaaacagaacaauugcuuucuuuaggcucaggacaugagagcaguuccuuuaguccacagcuuguaaugauggcccaagcguuccccgauccaguuagcugugcuuuuccucauaaaucucuccuaagcaucacucacucucacucagcuuccucugacaaguacgugguccugguccuguucugugagucuaaagcaaggacucucucuggacacgcccuucauuagaaccucucaucagcuuuaagccacugacuuauaagcuacugauuuuuaaaugacuaagcucagcuuugauucuacucuaaguaacugcuuguaaaugcgccaaaccaaacuccacaaaauuauaaccaaagcauacaagugauuuuaagagaaaaaacgaacagaaauguuccucgaugaaguccaucuagaugccagcaaugaagacccagcgcacagaagacaguacaguguuagagcuggacuugauggagugaagaggccugcaauugccaggccuugacucaggucacacaacggagagcaaguacaaacaaggaaaggagcccccucuucggaucugaaggagcaucgggagaaguccuaacgcacuccugaauggacaaguuuucacuagaagugcacaaguacacuuugcaagagguuaacaaucacugaccaacuucucgauuccaucuuguuagaauagccuacaaacuuucaaauuaaaaaaacugggaaccaaaugggaagcacagaucaauguguuuccugauuucuuaugaacaucuaaagaagucaguuaauuaauaauauacaauuacaaacacccaggaaugcuaguuaaguguguuuuaaacugaaagugcaaaagagaggaugaauuuaauuaaacucuuaccuagauguaccauacggguagauaugcacuauuuuuauacacacaugcacacacccaguuuguuuguuuaaagaaacauucucacugugccucacuaaauugucuaggacagcagcccugaaacccuggguucaaugaaucuucugacuuaguugccccaguagcucagacuacagccaugaacuuagcuuucuucuuguauauuaaaggucaaaucuccaggaugucacuaccaaacagcaggcucagagucacaccugugucuucaguacuuuacaggcuuugaugggaggguuauucagaucuaggaguuaaaggcuuaacacagagaccuugacccaaaguaaaaaucaacaccaacacuuguuuucuuaaauagggggacauucaaggcuagccuggucuacauaauaaguuccaggucagccagggcuacauaggaaacccugucugaaaacaaaagaaaagaaaagaaaagaaaagaaaagaaaagaaaagaaaagaaaagaaaagaagaaagggaagggaggggaggggaggaggggaggggaggaggggaggggaggggaggggggaggcaaggcaaagaggggaggggaggggagaggaggggaggaggggaggggaggggagggggaggaggggagacacacuuccuccccugccucuauuuucaagaagugcugggauaauaauggcuugcacaggacuuucucugauuuuuuuuggggggggggggcuuaggugguuuuugcucuuguuguaguuguuuuuuuuuuuuuuuuaagauuuauuuauuuauuauauguaaguacacuguagcugucuucagacaucccagagaggcaucagcucucauuagggaugguugugagcuaccaugugguuguugguacuugaacucagggccuuuggaagagcagucagugcucuuaacugcugagccaucucucuagccucucucugaauuuuuaacccaaucuucuccccuucuuucucugguaaguuuucauuugauuuuauuguuauuuauauuagacuuuggccaucccauaaagaauucugagaggcugauacaaauuauacagaauuguaagcaucuagcugacgaccaaucaguauucuguaaacuugucuugcauauacaccuuuaagacggccaaguacauauugagucagugaggaacccacugaacauuggaguucuuuguuuuauaaucuguuuuuguguauauacuuuggucagucacagagcucauagauugcacauuaaguuggaguucuuuuucacuggcuggucugaggaaagaacucaggaggacuugccacugagagacccaugcagcaccccuggcagcuccacaggccagugcgagccucuaagcacaccucaucuuuguugauuucagaggucugggggaggcuucgaggaagggaacauuacugaaugaggccagcuagucaguguugacuuugauguccccagacugucagccaguuauuuuuccagacauaagcacagacacaggccagcgaacuauuagugcugaugccaucuuaacaaaauaggucaaagugaacaaagacaaaauauuuucuuuugcauucaugccuugguacaugacgucaaaaucaggucaugguuugguguucccaaugggcggauuagaaugacugcuaagcugacuguguaaauaucuuacucuagccaugaaaggggcccccuguuguaacuccauggaguuauaacauagcaacugggagaacagcaaggccuagagaaccuuucugucauaccuugccaaauaucgaacuucaagucucaucaaacaaagaaucuucauuugugucuggacaaagcaaacaaagaaacaggaugacauaagcuguuuuuguuuuuguuuucccccggggugaugcguuugucucuuuggagugaauaacuaaccuuuacugcuucuucucucccugacuaaaucaaaggcuccaacccaagaagacaacaacggugauuuauucuguuucccucuagaauaggggcuguaaauuaaaguuguaauuagaucccggagucaggagaggcccaccucacuucuguaggagaaaaacaggccagacaguugcuuuucugcucagucacugaguuguuccagagugaaggucauuggugaaauuauucaaugacagcaguagcuccuuuacuucuaaauaaaccccauugucacuccacucaaaugcuucagugucaccuuugcauaugucacagauaauuacuuccccuuugcauuucuccaucacaucccagauucaaauccuaacccaaacccaucuuaugauccuuacuuaauucguuaaaaauauuucucaucagcuuguuuauggcuuaguucuuuggaagcccuuguuuauaguuuacauuuccaaaauucucuuuaaccuuuagcaccauggcauaagaaauguuuucccagcagcauaaugcaaaauauuaaacaaguuauaaaauuuagacaaaaagcaaguacaauaccccucaggcaaagaaaauacuaucauugagaagauuaaagcauaaaauacauacagaccuagcauuguacuguggaaguggcacaagucauccugaaguuugguaagacuuuaaagggauggaaaacccacuuaagaaugucuaucuuuggauuuuguuuuuuuuuaguucccacaaaagccacagguucaaaacacucuucacacugccaaauauuuacaguucaaaaucuaauuauuuuaagugaaaaauuccacauccagucaucauuauucaagauuguugugggcuaaugcaguguuuguuuucauaagcuuucgggaaagcgagcgggcuauuucagccauugaaccacgaaaagaacaaugucaaagcgccucauggcuguucuguuuguacagugaaaggcauuugccuccugcaugagacaccgaaucacaaacacagacaucaacacugccaagauucuccucuuacacacauuccuccacaagcaguuuuuaauucuugggaugcccaauaaaaauggcucagggagagggacagaaaacaaaucuaaaagagaagcaggcuuggaagaagaaaugggcagccaucuuggacacagacaaggugucaaggugggaaagcuguagaagaugagcuguucuagaauuuggaugcucucccuccugucugucaccuccuccugacuauugaguagguuugggguaggaagacuuugaggaucuuuaaauauuaacaucaaagucuucacagcugaacuuaauauuuuugaguucauuuauucuuucugaguuucauacauauacauaagacauuugguuacacuugucccucaccaucucuuaacccauuccuacucccccaacccccucucuccuuccacccagcauuucuccauucugcuuuccugucuuuccuuucucuuuaucccuggcuggguuuauccagggugugccccuugugagaaccggugaggagcaacguacugagccaccaccaguggcgucagcauaggagacaaugacuuccuuucccuauuggcugccaaaagcuccccuggucagcgugguccaaaggagcccucuuuccaucucucacagaguaagggcucagucuuguuuagaaccauugcaaaaauuccuuauuucuggaagauauaaacaguagucuagucauccuccuccuaaggauaaacugaggcauggucccaccaacguucaguggggaaagcaaugaauuuaucagccuuucugacagagcacacuaccuauaguacuguagaugcucuuccuaaaauguuuuuacccaacuuggauaauggcuuuccucuagccucauagguggagccccaaucccuuccccagugugugugaccuguauacucuagcucuuccccaaggccaagggcaauucagaauuauauacagcauuuaugagaauaccucaagcuccucuacagucaacaaacgcagcugugaccauuuuugcaagagggcacaggugaagcuggcaguugcuccucuggauugucacguagaacaaaauccuagguaggcuacuacuaccucugauuggucacucuucaugggugccucugucaugccuugcuccugagucagcauuuuccagcccuucuccccaagguuauucuuguacauuuguucugcccuucucuucugagagauucccaagaucaguauucuucuaaaaaguuauaauacuuguguguguauaugugggugucuaugauauguauguggaggcugaaguauagcuuuuuggagguuuuucucuccuacuaccuucauguagauucugggggcaaucaaaucgcauacucaaacuuccauauaaggugcuuuuacccucugagucaucuugcugcauggcccacaaguuuaguauucuuuuuaaaaaauuguauuuauuacuauuuuuauuauuaauuuacuuauucacuuuacauaccacucacugccccccucucagucgcucuaucccacaaucuuuccccucauccccuucuccugugagcgggcaguggcucccuuguauguugggagccgcgcccacauucgccguuacaagauggcgcugacagcuguguucuaagugguaaacaaauaaucugcgcaugugccgagggugguucuucacuccaugugcucugccuuccccgugacgucaacucggccgaugggcugcagccaaucagggagugacacguccuaggcgaaggagaauucuccuuaagagggacgggguuucguuuucucucucucuuguuucuuacacucuggcuccugaagauguaagcaauaaagcuuugccgcagaagauucuggucugugguguucuuccuggccgggcgugagaacgcgucuaauaacaauuggugccgaaacccgggacgagaaaaaacucgggacugguacaaggaagaucccucauuccagaaccagaacugcgggucgcgguaauaaagguucccguaaagcagacuguuaagaaggauucaacuguaugaauucagaacuuuucagcuggggaacgagaguaccagugaguauagcuuuacgagguaagccuggucuugaacuuucuaaggaaauucaagacagucuaucagaaguaaaguggaaaauguuuggccuugaauuuuuucuaguguuagaagcccuuuuguuccuuuucacauguuaucaagugguuaaggcagggaggauucuagaugaaauucaggacaagcuaucagaaguaaaguggggagagagaguaggaacaaagaggaaauaugguacacaaaauaaguauacaggccuuuccaagggucuugaacccgaggaaaaguuaagguuagguaggaauaccuggagagagauuagaagaaaaagaggaaaaagggaaaagaagaaagaucaauuagcggaggucucuaggaaaaggagccugugcucaucgcuggaugggcucggggagccagcucuugguagcucugaaucagaugaugaauucuccucugaagaaacagacugggaggaagaagcagcucauuaugagaaaaaaggguaccagccagguaaagugcuagcuaaucaguuaaggaagccaaaagcggcuggcgaaggccaguuugcugauuggccucagggcagucgguuucaagguccgcccuaugcggagcccccgcccugcguagugcgucagcaaugcgcagagaggcagugcgcagagaggcagugcgcagacucauucauucccagagaggaacaaaggaaaauacaacaggcauuuccggucuuugaaggagccgagggugggcguguccacgcuccgguagaauacuuacaaauuaaagaacucgccgagucgguccguaaauauggaaccaaugcuaauuuuaccuuggugcaguuagacaggcucgccggcauggcacuaacuccugcugacuggcaaacgguuguaaaagccgcucucccuaguaugggcaaauauauggaauggagagcucuuuggcaugaaacugcacaagcgcaggcccgagcaaacgcagcugcuuugacuccagagcagagagauuggacuuuugacuuguuaacgggucagggagcuuauucugcugaucagacaaacuaccauuggggagcuuaugcccagauuucuuccacggcuauuagggccuggaaggcgcucucucgagcaggugaaaccacugggcaguuaacaaaguuguccagggaccucaggaauccuucucagauuuuguggccagaaugacagaggcagcagagcauauuuuuggagauucagagcaagccgcgccucugauagaacagcuaaucuaugagcaagccacaaaggagugccgagcggccauagccccaagaaagaacaaaggcuuacaagacuggcucagggucugucgagagcuugggggaccucucaccaaugcaggcuuagcggccgccauccuccaaucucagaaccgcuccaugagcagaaauaaucagaggacauguuuuaacugcggaaagccugggcauuuuaagaaagauugcagagcuccagauaaacagggagggacucucacucuuugcucuaaguguggcaaggguuaucauagagcugaccagugucgcucugugagggauauaaagggcagaguccuucccccaccugauagucaaucagcuuaugugccaaaaaacgggucaucgggcccucggucccagggcccucaaagauaugggaaccgguuugucaggacccaggaagcagucagagaggcgacccaggaagacccacaaggguggaccugcgugccgccuccgacuuccuauuaaugccucaaaugaguauucagccggugccaguggagccuauaccauccuugcccccgggaaccaugggccuuauucucggccgggguucacucaccuugcagggcuuaguaguccacccuggaguuauggauugucaacauuccccugaaauacagguccugugcucaagcccuaaaggcguuuuuucuauuaguaaaggagauaggauagcucagcugcugcuccucccugauaauaccagggaaaaaucugcaggaccugagauaaagaagaugggcuccucaggaaaugauucugccuauuugguuguaucuuuaaaugauagaccuaagcucugccuuaagaucaacggaaaagaguuugaaggcauccuugauaccggagcagauaaaaguauaauuucuacacauugguggcccaaagcauggcccaccacagagucaucucauucauuacagggccuaggauaucaaucaugucccacuauaagcuccguugccuugacgugggaauccucugaaggacagcaagggaaauucauaccuuaugugcucccacucccgguuaaccucuggggaagggauauuaugcagcauuugggccuuauuuuguccaaugagagagcagcguugggggauaaugucgauauuuccacucccaaugacggugauguauaaugcucaaguauucuccugcuuuuuuaccacuaacuaggaacuggguuuagccuugauucagacagccuuggcucugucuggacagguccagaugacugacaccauuaacacuuugucagccucagugacuacagucauagauaaacaggccucagcuaaugucaagauacagagaggucucaugcugguuaaucaacucauagaucuuguccagauacaacuagauguauuaugacaaauaacucagcugggaugugaacaaaaguuuccgggauuguguguuauuuccauucaguauguuaaauuuacuagggcagcuaauuugucaaaaagucuuuuucaguauauguuacagaauuggacggcugaauuugaacagauccuucgggaauugagacuucaggucaacuccacgcgcuuggaccugucccugaccaaaggauuacccaauuggaucuccucagcauuuuccuucuuuaaaaaauugggugggauuaauauuauuuggagauacacuuugcuguggauuaguguugcuucuuugauuggucuguaagcuuaaggcccaaacuaggagagacaaggugguuauugcccaggcgcuugcaggacuagaacauggagcuuccccugauauaucuaugcuuaggcaauaggucgcuggccacucagcucuuauaucccaugaggcuagucucauugcacgggauagagugagugugcuucagcagcccgagagaguugcacggcuaagcacugcaauggagaggcucugcggcauauaugagccuauucuagggagacaugucaucuuucaugaagguucaguguccuaguucccuucccccaggcaaaacgacacgggagcaggucaggguugcucuggguaaaagccugugagccuaagagcuaauccuguacauggcuccuuuaccuacacacuggggauuugaccucuaucuccacucucauuaauauggguggccuauuugcucuuauuaaaaggaaagggggagauguugggagccgcgcccacauucgccguuacaagauggcgcugacagcuguguucuaagugguaaacaaauaaucugcgcaugugccgagggugguucuucacuccaugugcucugccuuccccgugacgucaacucggccgaugggcugcagccaaucagggagugacacguccuaggcgaaggagaauucuccuuaagagggacgggguuucguuuucucucucucuuguuucuuacacucuggcuccugaagauguaagcaauaaagcuuugccgcagaagauucuggucugugguguucuuccuggccgggcgugagaacgcgucuaauaacacuuguauauccccugacccugguacaucaaguuucugcaaugcuagagguuucucccacugaggccagacaaggcagcccagcuagaagaauauauccucuuacaugcguucacgcgaccggccaggaaagacgcaacaaaccagaaucuucugcggcaaaacuuuauugcuuacaucuucaggagcaagagugcaagagugcaagagccagagcaagagagagccagaggaagagugcaagagcucuauugcuuacaucuuuaggagccagagcgcaagagcgcaagagcgcaagagugcaagagcaaaagcaagagagagcaagaaugagaaaacaagagaaagaaaaagcaagaacaagaaagcgagagaaagaacaagaacaagaaagcaagagaagagagaaagcaagaacaagagagagagagaaaaagcaagaacaagagagagaaaaagcaagaacaagagagagaaaaaaagaauggcaaaaccccgucccuuuuaaggagaauuauccuccgccuaggacauauuacucccugauuggcugcagcccaucggcccaguugucaucacaggaaaggcagaacacauggcgggaaaacugccccugcacgugugcagauuauguuuaccacuuagaacacagcugucagcgccaucuuauaauggcaaaugugagggcggcucccaacaauaucccacauacaggcaacagcuuuugggauagccccugcuccaguuguuugggacccacauggagaccaugggguacaucugcuacauaugagugggaaugccuaggucuagcucauguauguucuuugguugguucuucucuucagucucugagagucccaaggguccagguuaguugagucuguugauauuccuguggaguuccuguccccuuauagacagcaauccuuccuccuauucuuccauaagaguccccaagcuccauccacuauuaggcuguggguaucugucugagucagcugcuggguggagccucucagaagacuccuuucugcaagcauaauaaguuuaguauuuuuaauggaagaacugcugggaagugacugugccauuuaaaaauguauuugguuuuuguuguuguugugauugagacaauauuuuuguuguuuugguuaccauuucccucagacagaauuacauauuugcuuugaaguucagaaauucgacguuuuugcuauauguauuacaaaauugcauuguuaaacacuuccaaguagugaaauggcugcucuuguaggacagguauuacuggcacugcugccauuuaucaaucaguaauccacuuggcagguagcauguuccucguuauccuguaugcacucagagccuugagccuuugagucuuuaucuuuuaacgaacagugaugaaauggccagagauaagaguuauaaauacaaccccaacuauuuacuuaaucaucucauuuacauuucagaaaauaggagaucuaaagcaguauuacuuuauuuuaguuauuugcaacauuuccuuuuuggugagauuauaauauaauaaaaugauuuccccuuguuuccucccuccaaacucucccauauacccuucuuuuuaaaauuuaugaccccaggcuggggagauggcucagcgguuaagagcacugacuccucuuccagagguccuggguucaauucccagcaaccacaugguggcucacaaccaucuguaauaagaucuggugccuucuucuggugugucugaagacaacuagaguguacucauauacauaaaauaaauaaaucauuaaaaaauucaugacccuuuuuuauuaaauauuguuaaauguauguaucuauauauuccuaaguacaaacaguuuggucuguauaauguuaccuguauauauguuuucagugcugacaacauuggauaaccaauuagagugcucuuugaggaaggagucuuuuuuaucagucucuaccuucuuuaggugacaguaguucuuuauagaggguugaggucucuugggcuuuuccccugucuacuuuggcuuggcucuuauuguccuuguuagguuccuguuuagacagucgugagacuuuaucaauguauuuucugacauggcuaggagacacaaucucacaaaaaacuaucugauccucuggcuuuuacaaccuuuccugccaucuuucuuuuauuuuuuauuuuuuauuuuuuuuuauuuuuauuuuuuuuauuauuuuuuuaauuuuuaaauuuuuucuuuuccauuuuuauuagguauuuagcucauuuacauuuccaaugcuauaccaaaagucccccauagccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccucaguguuccgugagccuuggguguugaaguuauuuguuuaguguauccauugggaccagguuccgcaugucuccauuuugauuacuugugguuuccuguaauagucucuauguguugcaaugaggaguuucuaugaugaggggugaagacuaucuugcaugcauaaggacaaauauuuagaauguacuuauggacuaugcugguuuaguugaguggugguuguaggcucucuuccaagauccaugacuuugcuagcccugaguaacgggcuagguuuccagaaccagguuuuguuucugucuuguugaagaagucuaguaagagagauauugguuagugcaaagguauguuugucacuaguccucucuuagggaauauccugccauggugguuguuguggugguuuauagacaucauaguuggguagggcuguugguugcuucccuccuuugaagauugcauggcaccuucugguaucauaaaagugaguugucggagaggaggaauucaugucaguuccaauucaggagucuuugagcccugugugucaaucauggugucuucagcaguagagacuuccaccucuggggaccaaccaaagggcauaccaauagcugcuaauguuauugggguuucauggauaacccugaccaacaauuuaaaggagggcuucucaugccuggugucauauaguuuuuuuuauuuguuauaugacuuuauguacuauacuauuuguagguauauaguaaauaauaugauuacuuaugacugcuucagauauccuuacuguuuauuucucccucaggauuugucucacuccccaauccuuaaucagaaaucccccucuuuuuaccuucccccaaucagauuguauauuugcugauaguccucugaucuauuucaccuuugagagaguuucagugguucaaguagacucuuuaugaauucacccuuuccuuuuuaucuucuucuuuugucaagcuuuugaguauaugucauuuauuauaauuaugacacacagacaugaaauaaacccauauguuuauagacuuacuuuucuucauaguaaacagaauuauuaaugcauaaaaccuaaaaaaaauguagguuucauuuaugcuuuaaauuuuuuugacuaaaacuauuguccaguauauauauuaauauuauauagcaguucacauuuucauuauuuuuuucaaguauaauugguauugguaguuuaagaauauuuucaauuuauuucuagauauuugucugcauaauaguuacaauuugggcugguguguguguguauguguguguauaaauaaacuuuaugcugagggaauagcauucuaaaauuugcauuuuaauuuuuauguuugagguaguuacccaagaguauguauguauguauguauuuauuuauuuuggcuuuucgagacaugguuucucuguguagcccuggcuguccuggaacucacucuguagacuaggcuggccucaaacucagaaaucugccugccucugucucccaagugcugggauuaaaggcguguaccaccacugccuggcgaguauuucuuucaaugcuauuccucauuauuuuauuuuuaaaucuauuccuccucauauuuccauaguguuccuacuuuuuaacucuuuuuuucuaaggauuuauuuauuuauuuuauguaugugaguagcugucuucagacacaccagaagaggguaucagaucccauuagagaugguuuugagccaccaugugguugcugggaauugaacucaggaccucuggaagagcaaucagugcucuuaaucgcugaaccaucucuccagcccccacuuuuuuauucuuauaaacauguuuauguuauuuucucuguguuguuuauauuaagugauuugugugugugugugugaacaaccuuguaaacauuccuuucuuauuggcuuuuuugauuugcaaacaugacccuaaaacuacgguuacaauuuguuuccuccaaacauaauauugaaguugguuauauuuuuuuuguuguuguuguuauucaccuguuuaaaacuauuguguaaccaaaguuacuuuucauuuuucuuugccuucuauagugcaggcuuagcaaacuuccuuuccucuauauuuuucuucucccugucaucucucacaugguugauuggcauucacaucugucuuucuuuaucuccacagagauuccagauguuuuccgcuaaaauugagaaaguuuguuacucuuguugucauagauuuuugacaacucauuuuaccaugggauggccacaguuaaggagaacauugacuaucaucuagugucuuuggucucuagaaugacugaauaauuuuauagaucauauaaaacagcuguagugagcugcauaaacugucaugagcugaaccugcugcuugaguuguuaaccaaaggguuuauguaucuacaucucuuucugagauccugccuaccaauuuuaaauaucaugcauuuuucauaggcagaacauuauuucaccuuguauuguuuaauaagaugagauaucuuaaggggaaaaugaaauucuuuuuauuuauauaaguuuguguuucuacagucuuguccaaagagcgugcuucacaaguccuggugaggaagcgccgugcaaauaccuuguucgaagaaacuaugaagggcaaccuugaacgagagugcauugaagaacucugcaauaaggaggaagccagggaggucuuugaaaauaaucccgagacgguaagaagucguggagacuguagaguccacccacguacauauacaguuacagacugaacauugccagcuuguguuuccuugccuccauuugaaagcuaaugacuguagaccacuuucuaugugucacccugucacuucaggaagacugccaaugauaggugcucuggccuaacuagauuucucuuaagucucauggucaacaacuaggguugacuuugugauuuguaucgauuuuauccuaacgcaaauuugauagcaucgaggcuuccagagaagaugugugugaaguguaagugaccguggguauuucuaucaccacugugcuucuuguuuauuuugauuaggaugguugcuuguauuugagauagucucuuacguguagucccagcuaaccugaaacucacacuccuccugccucugcuucagccucccaaauacugggauuauagguuggugugcaccacuguguacaaugucaccauuuuauauuuaggagggucuagaaauggggccaucuaaacugacuacuuauuacagugucauguaugcugaguauacuuuauaaccuuuggaaaguuucccuagccuaauaauaugagcaguaaacuucaguguauggaaauuuacaaguuauccaacccccaaauguaaccauaaagauuuaaacaucacacagcagcaugggacuuauuucccauucuguuuuaguagaggguacucuguagcaugccuguagcuagcaggcauagcauuaauaccuccaaaaaaagcuucaccuuuagaguuuaaagcucauacccugaaggguuuccuuggauauuuuucucugagacuaauuacacaaucuggagaaaagagggagaugacauguacaagggucccccugugcuucccugacagcucccagcauccugagaauagcugagugauaacaagcaagaacacuuuguccacaguuagaaaaucugucccagacuguagccacucauguccucuguggcuguucuuguagcucuuuuuaucucuccauguucugauagguuugaagaagacauuuuuugcaaauacccaacaauuagguuucaaucuacuuacaauugggaccaaggugugagaaaaacaccaagagcagaagcaauguggagauuaaaggguuuauuuggcuuacauauccugauuaagguucauugagggaagcugaagcaggaauccaaaccaggugggagccuagaggaaggagcuggagcuaaugccaaggcacugaggagugcugcuuacuggccugcuccucauggcuugcuuaacuagcuuuguuauagaauccaggaccaccaucccaaggauaccaucaccuaaaaugggcugggcccuccaucaucagucacgaauuaagaaaaugcccuacaggucugcuuacaagucucucuuauagaagcauuuuuuucucaauugagguucccucuuugauguuucuagcuugugucauaaaauuagccagcacaaacaguaguaauacaaaauuuucuauccaacacaauauaguaagcuuaguuacuguauagcauacacacacacacacacacacacacacacacacacacacacguuuuacauuuucauacuaaaaaagaauguguauguacuuuuacagagacugugguauauguuaaauagauacauauauuccuuucuacuaugaaaacauuuuaaaaaguagaaagaauacuauaaagcccaacauaccaccucuuaccaauaaugaucaaguccguccauuuuauuuugccugucuaccacguuuacucaauggcuuugauagaaugcuuugagcauucaugucguaugauuauauuauccgucaauacuuggcuguauauuucugcauugaacauauguucagagaacagacuucaaugaguagcuggaaagggaggcacaacaaagggaagaagcgggaagaagacagagaaagaagacucauucgugguucaucaucaacacugauuuugucgacagacuccacccacucccuuuccacaucccuuauacccuuaguccguauuucagguguuuacccucuugcucaccuccucaguguuucuaauguauucuugucauuagcauaucacaaauucuugaacccuauuuguugcuacuuaugguuugccuuugcuucugccauaaacaacagcauuguccuaaugauucagugucagacccuuucucauaaguuaguagaaaccuguugugcagguuuauguguaauaguaggaaaaaccaaggacuuugagauggaaaaagccauguuccaccuugacugagccagaacuuugaauauuauugugugcagaaauguugguugugcaggaaauauucuuauguuauuuaugcuacaugugagauacauucugagaaauguauaacaugguccaccuucauaaauacauuccuuuaauuuguguguguguguguguuuuuuuuuuuguuguuguuguuguuguuguuuugagacaggguuucucuguguagcccuggguguccuggaacucacucugaagaccaggcuggcuucguacucagaaaucugccugccucuauaaaauacauugcuuuguccaccucgugauaacuacuuuugguacccaccaguuuauaaguaagguguuacaugugcauuaguugcaaauaagguaaguguucaauuuaguucccuucaaaguauuucauugugaccuuaguguagauaaucaugauauaaaaauauaucaaaugaagggcagacgugguggcauacaccuuuaaucucaggacucaggaagaaggggcauguguaucucuguagucugcacuggaccugagcuacguagugaguuccaggauacgcagggcuauguagagagacccccgucaacacaaaaaaguguauaagcuggaugcuuaaugcuuaaucaccauuaaaaaauugcuuauaaaagagggcacauauauaucaccuuaaguacaaccuuuguaaaucagaggcuuuaaaaauuauuuaauugcucagugguguuuuaagccuagguauauauauauauauauauauauauauauauauauauauacauauauguauaucaagcugguguguugagcuuuauuguuuuauucuuucuacuuuuuaaacuuuuuucauaguagaaaggacuauacguaucuaucuaauauauaucacaaucucuguaagacuacauacacauuccuuaucaaguauuggcuauuuaucuuuucuugaaauaguuucauacagaaaaauuagaaugugaaaacacacaacauguaauuuauucccauguuaguauaaaaaguacuaaagcaugaaucuuuagcucuguggugaaauuucacuuugcuaauauaucuauuuuuuuauuuuuuucuaggauuauuuuuauccaaaauauuuagguaaguuuaagcaucugaagcauaaaaucuuggaaauugaagggaacuuagauauggucaagcaucaccuucuggccauagcccauccaauacuaacuuaucauccuugagaagaugcaagagcuaugaugcucuuguauauaaagucaugcugacugauuuggaaugacgcuuuacuauguugaacugucacuguuaguuuuacaugucuuucugcuaaaauaucuuuaggcugaugccaaugauauucagacacccagacacuauuugcaaauauauucucauaggcugucuuucacaaaaugaaagauaucuaagaucauccaaacguguguuauacagguaucccucacccauuuguagaagucuuucacaacuccucucucugugauaucaucucaucacuuccuacagccucucauucaugauguuuuggauucugggcucucagugggguaauauuuggacacuaauauauguuacaugacuucaauuaaaguaacaaagccuguuuucuuaaagcaaauguauuaauauuaauauuauuuggaaaugucauuucugcuuccaaauauuaggguuucuaauuuccacaucuguuucucauguaauucucuguguuuacaacagcuuuauguucuucuucccagcuuuccuuucagaauuccucuuuccuaugcuugguuucaccccauuaccucuagccaacuagaaauagaaaggaagucauugggaaaauauaggaaugaauucugauauuauuguuaauauagucuuguaaaugauuaagccauuaaacccaauacucuuggaauuugaaugcaguacuuuauauguuuucuuuauuuuuauauauuacucuguguacccuuggugcaauuuuggagacauuuugugaagaauauuuauacuuuggaucuuaugagaaaauuacaaaaaauuguaugcauuuguauuuauguuauaggaugacuaauacacuaaaaguccaagaccacuggguacacgaucgcuuugaaacaugauugcucuucagaguuuuuaguguacacaauggucaggauucuuuauuuaugccaccugcugagcuugggugacuugacuguacuguacaaugcuguauguaguucauccuuuugccaacuguaagacaucaaucaauucuauugguagcucucuguugagcacagcaagaucuuagcuuuccaaagucuaugagcccauuugucaccucuguagguggguuuuuagcaagauuccaaagcacuuaauaaaauguacuucuuuuugcucucuucauuuuucuccucugaugugcaauuucuguuuuugcuucuuucucuucuuuucauccuuccaaguuuugcccaagcuggauccuucuuaacuuccauggucagaugugauggaauacauucagggugguaaggcucaguccuuucuuuccuucucuagcuaugaauaccaguguugaauaucuuuuuucuuucuuucuuucuuucuuucuuucuuucuuucuuucuuucuuucuuucuuucuuucuuucuuucuuucuuucuuucuuaagauucauuuguuuauuauauguaaguacacuguagcuaucuucagaugcaccagaagagggcauccaaucucauuacagaugguugugagccaccauaugguugcuggguuuugaacucaggaccuucgggaaagcagucaguguucuuaaccgcugagccaucucuccagccccgaauaucuuuuuucaauagcacacaccaagaacaguaauugggagguccuguuauuuguguccacaaauaugaaguucaacaagguuuuguuaaacccuuugcuuuuacauuuuaaaggguagagaauggauaaaagcauucaaccaggaaaauaauuuauuuuuguauacauuaugaguaaucaauuucuaaaacagaagccaagaauuuacauuguggaaguagcugagaaaggauaaguuaucaagacucucauauuuagaagggaauuuaaauguuuaauaauaaaaugaaauacuacuaagcuacuuaaaauuauaagguuauaguaaccuugcuucuugaggccagguaaugaggugguauguuuguaggagcaaccaucugaaauauacauucuuugaucacaguacauuugaaaaaauauuaauaauguuuuaauauagaacuauguauuuuugagagauuccugaaauaacaauuuucucuccuuuuaucucuuuaauauuuucuggauccauccaaccuucucuuuucuuuccaugaguauuuggcagcaugacaggagauuaaaauacaagcaaauaagaaccuaaaaucugagaugugcuuuccaguuucagaauaauccuuagcuggcaucaugguuucauuuuugcuauuguuguuauuuuuaacuauuagaagagguuuauauuuauuauaugcagaauaucacuaggcuuccuaacuuuagguuucuuggacuguuaaggagacagguaauaaauuuauugucaauuuuucuucuauugggagguguuauuauuaucuaauccauuagguggaaaaauguucuugauugauauuuuauauuuuguuuuuuauggcaaacuggugccuuucacuguugaaagagaaaaagaauauuccuuauuaaauuaguuagcuguccugucauugcacgugcagaggggccaugguccuuguuagaaaaaugcaauaugguuuuuguuuuguuuuuuguuaguuuguuuguuuuuggcaugaaccuaggaccuagaccaucaggauaagaauuaucacuuuguucuuuaucagaacaauaaaaguuuuguguucuacagaaaaaaaaaagaaaaagaaaaauacaauauauacuuccuuucacaaugaacauaauagugauuuaaucauucacaauuuaugcugaguuauccuuacaaggaggaaagguuauucagcacauuagaccacagaugucaauaccuuuucuacagugucuagacuuaaaaugucagggccauauaaagcccuucaugcagauacccucgccaucuguugcccuuagaacaugcaauuuagaauagaaauacccuggacuuacugacauuuauacauagauggaaauaauugaugucauuaguucauuucaagaaaugaaaaaagauaaugguuucuaagaacuuuucaaaugaaguuuuaaaaugauacaaacacccgggcagugguggcccuugccuuugaucccagcacuugggaggcagaggcagguggguuucugaguucgaggccagccuggucuacaaauugaauuccaggacagccagggauacacagagaaacccugucucgaaaaaaacccaaccaaccaaccaaacaacaacaacaaaaaugacccaaacauauguuuauauauagacuuauaaaaucaaguuuauagacaucuuaugaacugguagagcuugaacucaguccuuguacaugcuaggugccacucugccacugaguuauaacccuggacuaucuuuauagcuuaaauucucucucucucucucuuuuuuuaaagcauucuuuguauuuucccugaggaaaugggauaaauaagcuuaccaucuauaugggcauuggaaaauaucuccugguaaaugaaaugacuuuguucauagagaauaaauucucuggagaaugguaaacugugagccuaaauguaaauauuaaaaaucauucuuuagggcuggagaugcagcucaucaguagaaugcuuuccugacaugcauaggaccuuagguuuaguuccuaaaaccacacacacacacacacacacacacacacacacacacacacaaaccaaacaaacagguaaacaaagcaaagcacuuuagcuugcagguccugccgagcuagugaauucauccaaacuucuuucuucaucuuuucaagucaucucuggagaagcguuagaaaucucagcaauaauguuaagaagaaccuaaagcaagaaguagccugaagucugguaagagacagggcuguagucaauaauguagcggugagaacacaaacagcaaagcuugaaaaaggcccauguguccagaugaaaaaaccaaaaaagugcaauagaguaagcuccaaauagcaagacauaaaauaugaauagaaguagaugaaauggaaaacagcaaagaagacggauaaaagcaaaauuuauacuuugaaaaggcuuguaacucaccaguaguaacgggaacuuugaagccuacagugacuuccagugagcuuuuccaucuuucugugaugaacuguauuuuccaaagaugagacagaagugucuccugcuccccacacucucugauguguaauucccacuccguuaucauucccugcccacacacccuuggguggauccuggaguugcuuacaucauaauaaaggguagcagcaguacaguaucccuuacaaggcauuucugcuuccuccuuggaugcuagcugcuaugggaaaagaggcauguuaagaccagcauggugaaagaaacucagccacaugaauaaacucugacauauaauauuuuauauacaaguagaagugggguaucagacagugugagcugacauggcucaccuuagaauggcuuuccucggaauccaaugcucuggcugacuucacaugccacagacaucuuuuguuuggugaauuaauugcuucucagauauuggaccccccaaaucaaauccaaauagcuauuaguuaaacuaguaauuuuggggauggcuugcuauucugcaaaagguaacuagguauugaauaucugagcaaagaaguaauacacgccauuucuuuuaugucaauaaguuuggagaacuguaaacaacauuaaagucucuuaucucuuaugucauauuauuucuuagucugcuugccauuuaagccauuacuuucauagauuuguagucaggaacaaaaggaaugggucaacuauuccauaauauuaaggaauuacgcaaauauuauuguguuagucucuaugcaacacuagaagacguggaaauugccugcagcaaccagaacuagugacugcuagugacuuaauuauugacuuaauuauucaugcucauuaacucaggcucucaucuguucugcagacuugaaaguuucuuugcuacagcaaacaaacaaacagauuuuaugggacgguagauuucccuucuaaucccaugucuuuuguuguuguuguuuucagauaaagauucuuauccacaaaaagaagaacuuauaaacuuauuuuucaugacuguuauuuauugcaaacugacucguagauuuucaacuuuucagggagauaaauguguuacaaccaaaagccagcugugagagaugcuaauguuaaugagacagaaaggaagugcggggcaaaggaagacuugacaaagaaucggaucauaacccagacaguucauugcuuuuaggauggauaguguagaaaaugauuuugauccacaaaccaguacagcaaaugcauguauucucuugguaacuuaucagaaauggaaaguuuagcuuuagaacagguguggugauugcaugccugggaucccucaguauugaugaggcuaaggcaggaggaucaugaguucaaagccaaacuacacuacauaggauaauaaguagaggguuggagagaugagucagaagcuaagagcauaaaucacccuugcaacggaccugaguucaguucagguuuuagggaaacugauaccuauaaucccucaacagacaccuauacauucccacacaaagauacacacacacauacauacauacauacauacauacauacacacacacacacacacaccauuuaaaaagugaaaguaaguaaaauaaauaaagcuuaucuacggcacauccuguaacaucucagggaagaauuccuuuuuaauccagaguuucaguauguauaugguuugaagaugugcccaguaacaacagcaacuccgacaaucaccuccgugaucuugacacaguuacagcuacacacucuuguucaaagugcaguacacacuuaugcuuucugcaaggcauaguacaaaaaccggaugucuccaggaaaacagaaaagcucacaacaaauagaaguugaacacugaccaaaacauagggagccaaucuguaaauuuauucuacaaagacugcacagcagaaguaaaacgaauagagacuauugugugguccuuuaacacagcaguucucaaccuguguggcucaaccccuuuggaaguggaaugguucuuucacagggguugucuaagaugauuggaaaacauagauauuugcauuaugauugauaaauagcaaaauuauggcucugaaguaguaauaagagcaauuuuacgguugagagucagcacaacaugaggaacuguauuaaagggucucagcauuaggaagguugagaacccacugcuugaacauuuuggcgugaagaacuggccguaagucaaaaccaaacugcugcuaagaaauuccgauggccuuccaauaacagaaguuccauccugugaacuaaaggaaggucagauggcuuuacuacagaaugauguucuucaugucagaaauaucuauucggagcugaaagguuaacuuacguuacugugagggagacaggaagcuagaauugggugguccaggugauggcaaaggcuuuauccacacagcaguuguucuaaccucacaaaggaaaggcugagcaauuucgauggcugcugaauaauugcaaaggaagcuacuuuagaaaccuggaugaauuuuggaacaggguuagcucucagacagggaguagaagcugaaguuucaauagucugagcagaccucagaggcacucuguugagguaaaacagugagugaaucaacaaaugaugucaagaaagcaaaaccucucagaaaaagaucuguuucagauguaggaaguaaacucaagcagaccacaaacugcaggauugaagcuagaaaccacauagcugccacuagauguagagauaggaggaugcaaagguggcacucucugugaggccugagcgaccugauaaaagaaugguugguacuggaguucucagaguugaaaguucuguuacguucugcucuguucuuucgguguguguucuaaaagucuuugacaaagacucagaggauuuguuccccagggugaagcaugugccuggugcacaugcauccagugaggagcccauuguuggagaacucacccucccuaggagugagcauacugccauuccgaugaagugacauagugucaaacugcccucugaguucaucucuuugaauucauugcucucuacccguagucucuggcaacucucagaccuaagcagagaaguuucugugugcaguggauggugaugaacgcagaaacaugacugcucagaguacagggaauaaguggaggucucagccagccagaagugggagguuuuuaaaucacagcccuucucugaggauccaggcccacgcccaaagaggagugggaagauuguuaaagucagaggcaggggaguccuggagcaaaacagcaucccaugcauaggacagaacugaugcacauacacauucacagcagcuguggaugucugcacaagaucaaguugacauucucaaaauucuaguguccagugagaagggggccaugagcucccaccuguagcuggggagcuauggacagaugauggucucagagagagagagagagacagagagagagagagagacagagagacagagagacagagagacagagacagagagagacagacagacagaaagacagagacggauagagagagagauuagccuuacacuaagacauauaugggcagaauacuuugaaguuagagaauuuucauacccguaccucagcagaauggcugugugcagaagaccugaagacauaaaacauuaguagacauacuaacauagaagagggcaaucucaauucccuccccccccccguagacaaagaaccaaaggcaacugacagauguggagaaggggaaagauaguccucuacagugaugaaauccaugguugauuacccaauaccaaguggucaucccugaaaucauguacaucuaagccacauuacauaggcugagcaggcuguauuuauauauuuaggccauaauguggagagggagcaaaugggaaggggugagguacauagaagggauuggaggaaggagggggaaaaagaaaugauguaaugauauguucauuuaagauuuuuacaaaauuaauuuauaaaagaggauaugaugucgcugagacagaaagaugagguggauauggguuuggggagagugagaggagaauguauucaagacacaucaugaaauucucaaagauuaauauauauaucaaauaagacucagaauaacuguauauuagaaaggcuguggcuuagagcugccucaaagggcuuuuaaagccaaacuaugaaaagguguugauucucagaguaucaaaaggugaacauguuaaacaaaacuuauaaaauaaaaauaaaaaguuaaaauguuaagugagcuuauucuuaguuuuuacugaaaacagagccagcauaguagauccuaagacuuaaucaaaucacaauaauaaaccaugauacaaaugagaucaauuuuuagauggguuguuuaccauagcagcagaaugaacuugccuauccuaguuuuagcagauuauauuaauacaauacuaacaaguaauauguuucagaugucguugaaggaacauucuggaacuaaauuauucaauugcacuagaguauuuucauaacuaucucuacaaauauguaccagcacaaaggccaucacacaagaagagaagaaaaaaacaaacaccccugaacuuuaaaagucaagcuccaaaguucuccuucuuuugauucagccuaaacagcaguaaucccuucucucaagaggagaggaucaauaacaaacaugccagguccauauccuguguggccacaggucaccguuuucaccuguguggucacaggucacugguuuuaccuguaugguuccucaauggagaccaaccagaacuuuuuuuuucuuucagggcgucucugagucaguugaauagcugguuaggagaaagaccuuguaugcuacucgcugaugaccugaguguagugcccagaacgcagggagacauucugggucaugucugcaaucccagcucuccuagagggaaaugggaggcagagauaggacuggcagaagcucaggaauuagcacagcagcagaaauuacaagauuucuugccucaaaacaaggaggaaagaacugacuccuaaaaaguugugcucuccucucgggaugucuuauuacaagagcauguaugcgugagcacgugcgcacacacacuaaauaaauaucuuuaaacaacauauuuauuccucacacuaccaaugcuguauuuuguucacaucugucaauccauuuauauauaacauuuacaacucaauauucaucaaggcauguuuuagauaaaaugcuguuuuucaagggaaaagaaaacauggacucuaaccauaaaaagacugucuucuccaucuuguuagaaaugcgucagguuacagcugcuuugcuaccagguaggcaucaucaguuuaacugaggaguucucuugaacuuugacagaacaaaagcagagguggcaacuuuuaggguggucuguuaguacuaacucuugugaagcaacagggaugguaauaucccagcuuucggauaauuucugcuguuaguucagaucaagccugcugugaugcgauuacaucucuucuaucucacagguugucugggggcauuccguguuggcucauuccaugcugcgaggcagucagcuaaugcuuauccugaccucagaagcugugucaaagguaagcugauguuugaaaacaucauagaaguccugugaguaaaaaccccugugcuaauauaaaccgauguuugaaagccaguaagugagcuccugaagugggcuaugucaagcaguaaugcaauuuugaacuucauauagaagcguaauuuuccauuguaaaugcaucuguuacauuuaaaaugaaaauuuccccaaacauuucagcugagcgguggucagugauaguaggcuucaaguuaccagcugucagaaauuuuauuucuagcaucuuuauuuuguccugaauuguauagucacauaguaugaccacauguuauaguuaacugguaggucagaggagagcuaugcacauucuuuaaacuuuugggcacuaacaauauaaaauaugaaaacguguguaugauaacauccuuuauucucugaaguuuguucagggccuacagugaccaccauuugauaguugggcucauuuucuuuccuuuuucugcaacucauucuccaguguuugaaaacuauucuuuuauguauuuuaauaagaauuuuacauauuuaaggcaagaaguucccuuucauuucaucuugauucaaguuggaauugagaaauucuauuguugcacuauuauaguuugcuuggucugucuuccucauagaauugucuuaagguuuaaaucaagugaaauauuuuucuggcccauugguacauacauguaaucccagcacuugggaggcagaggcaggcagaucucugugaguucaagaccagccugcucuacauaguaaguuucaggacagucagagccuugucucacuuuuucauuucuuccauacuuaaauuccuuccuuccuuccuuccuuccuuccuuccuuccuuccuuccuuccuuccucccucccucccucccucccuccuucccucccuucuuccccuccccuccaccccccauuuacuuacuuucuuucucucucucucucucucucucucucucucucuuucuuucuuuuugagauugugucuuauguauccuagucuggccuugaacugguuguacaaccaaagaugaccuucaauuaguguucucuccaccuccugagugcugggaucacaggcaugagcccaccccaucaaguauaugcagugguugcuaucaaaucuaguaauuagcacaugcuagauaauaacuccaccaacugagcugcacauccaggcuacauuccauuuuuaaugagcaagcacuguuugaaaaaaugaggaagaauccaucauagcccuguugguuguaagcaugcaauggcacguuuccaagucuucuauuugcuuuccuuccccgagauaaaaauuuaaaagagaucuguuuccuuuagccaucucagaccaaugugacccuauaccaugcaaugaagauggguaucuggccugccaagauggccaagcugcuuuuacuugcuucuguaagcccggcuggcaaggagacaggugucaguaugguauguauaaaaaaauccacgcccuuuggcuuuccugggaugguugcauuacaaaucaucugaauaugauauuuaauuaaaaauaacuuauuuuuuuauugcagauguaaaugaauguaaagaucccucaaaugucaauggaggcugcagccagauuugugacaacacuccuggaaguuaccacugcuccuguaaaagaggcuuugcuaugcucccaaauaagaaagacugcaaagguuagagcccagaaacggaauacaaauguauucacugugugaggccgguagaggaauuucccugggaaaguucugcggaaaguggucagaaaguacuuacaggaaaugugccucuauguccacgaggaaccuugugaugcugugcgauucuuaguuuaugauaccacugucaagacuauuucauguucuucuugggugugcauaugcccgagaacauauuucaagaauucauuuaguuacauauaaagguaauuuaagcacuucauaggaagagaggcuccggugcuaccgacuuugcaaagccauuguucuguguucagaauuggcuacuauacuccugugguuccguaagaggaacagcagcuaugcaaggaaaucugcagcucuuaauauuauaucuuaucuuugcuuuucagaaauaucuuuaugauuuccaaaauaaauccauuauuuugcacugcauuuccagccaugguuaugagaaagauggagaaucugguuuucauucucuuuacaccuaacucuuccaucauugcuccucacucuuuuuuuucuuuggauguaaauaaucucucagguuagcuuuuuguguguggcuaguauauugcuuuuggcuuucucuaugaaucuucaucucccaaaguuuuccuuuuuucuccuuucauauucugugucauuggacugcuuggauuacuauaagacaccuacaaauaauuauccuaggugaagguauagcucaaaccagaauucugauccagcugugaaaucuuucuaugaagcagaaacucuuaaaaaagauuucuuucuuccuccuuuguuuaauuaagagguuaaaaauucaguagauuaaguaugaaguuuuguuguauaagccuuuauuuuuuucuuagaaaaugccccccccccggaauucauauuuaaggcacuuuccauugacuugguaguauucaguauuguauaguucacgacaguguaauuuaaagugccguggaguggaaugaagcugaaaugaaaugcauuuacuaacagucucuuccaagccauuaucuaauucaggacuguacaacucucuugccugacuauuuaaagauuuuaguuuggcuguuagaguaggugcaucauuagaaaagcaguuacaaaaagcuauuauaacucagaauaccauguacauuauacagauaguacccauuccuacucgaauauccuuuaauauuccuacuuuaauaauauccuuauucaaauuuugugauuuuuuucauauucacaucaaguuaauacaugcauguaaaauuauuaaaaauaaguuuuuguuuuguuuguuuguuuguuugcugggaauacaguucauuggugaagugcauaccuggcauguggaagucuugggagccuuucucagugcugccaaacaaccaauagaauguuucugcaaaucagaacuuaggcaauuagcucuuucuuuacguagugauguaugugagauaugcagcagaacacagaauuuauagaaaaauauguagaaaacuauaaaaguaggaccuugaccguguuguggaaagacaugaaauugggguggcaguuauuaacuaaauaugaaugucuaaaaccccggcagauaauuagauguggauacagagucaccauaucaaugagcugcaccuaauucguaugcgcuauguauuucccuacaaaucuaccuaaagccgaguagucuaaguacugcguuuuuauuuucuucuaaaccuguggacuuuuaaaaggcuuuuugauccuuagcuuuucuuuaauuaacugaggauucauaugaaguuuuaaggaauaguagagaucauauguauuaagugguuucccuaauuaguaauauuuaccuaauuuuuguauaaguccauccacauuuagaacauuggcauuggcauacuuaagauguagaaacauuuccuuacuacggggauuaauuuuauuauuucgaagcgaguuauuuggaacagagugaugucuacauuuucaucuguuccuaugcccagauaaacaugccaguuuucaaagcuggaaauacacuucccguucgacuuugucugugcccauuguccugcguacacaaagcugaggaauaauugcgucuauguagagcuuucucucccuuguuugccuuuguuuggaauggcuacccucugcccucuugcaaccugucuuuugcuucucacuaccuugucuaacacaacaaaugcaccugaaauuucuagaauaauuaaaagcuacuagaggauucuagaauuaaugaaguuuuagaaauucuuuuacacuuuauucugguccaccuuaaauguuaauuauugauuacuguaggcaagguggauuaaaaaaauuagguauuuguuuacauccagguaaaaagaaaacagaugaguugacauuuguuaaauauuuguagugacgcaucaaaugaaucuacauugacaaccaauuucauaaauuuaaauauagauuuagaagcaugaauauaaauuuggaaguauauuuauagaauauuaagaauguaauugagucucuucuuucauguguuuuuauacuucucccugguagauaagaaaaucacuaaaaaaaauucuuuuuuuuccauuccuauaaaggcacauuaggcaaacuucccaugaauucaugcaaaagucauauuuauggaacuaaaacauggugaaaaaauuuauuacugugcucuuccaagacuguugauauaaacaucaaauaugauuuagaaaccaaauaagcauuuauuugauauuggaaaauguuaacguugauuuuauucauagauuuggaugaaugcgcucuaaagccaagugucuguggcacagcugugugcaagaacauuccaggagacuucgaaugugaaugucccgacggcuaccgauaugaucccucaucaaaaucuuguaaagguagaucgaugacgcuguaacugccuguggcagagaugguggguuugaaccccgaguuaauagcagacaaagcaauacuuuugcuaaccccugaugcagcuugguugauuuggugguugcaggcuuucuuaacaaauagaaguaccaaguaagacucauggucuuuggggguuuaauauuacucaccccauuuaauccaugaaccuucauuuaaaaaaaaagcuagagucuccguuguuauaaaagcaaagugaacacauuuuuauagccuguagacaacuuuaaaagaaaauuuuaauuugaaagaaaauauccauauacacaaggagagauaacacaagcuuuaauugugggacugaaaccgugaaccuucuuagcaccucagauuuuauuccauauuguuuuccgucauuuuuuucugugcauguauagguuauuuuauaauagaaacggggcuggagagguggcucagcaguuaagaacauugcagagacuuuuaaaaaauauuuuuauuagguauuuuccucauuuacauuuccaaugcuaucccaaaagucccccauacccuccccccccacuccccuacccacccacucccacuuucuggcccuggcguuccccuguacuggggcauauaaaguuugcaaguccaaugggccucucuuuccagugauggccgacuaggccaucuuuugauaccuaugcagcuagaguccaguugcagagacuuuugcagagggucuggauucaguucccagagccugagacauguggcucccaaccaccugucacuucaguuccagugggucugacucccucuucuggccuucuccgagaccuguauguacauggugcacauauaugcacucaggugcacacacaugcauacacaauaaaauaagguaaauaauaaugagaagguuaagaugagacauucauuaucucgacugaugugauaagggagaucuacagacuugaggauugcugguugugaugcuaagaccuauaguuugaccagccccuuguggaugcugcucucucuuuguaagguugccauggugucaguguggaugccuugggaagcuuaaaugcguuaugucugcuuuugcuuuagacuguuuaugaauuaucucaccuauuucuuuaaauguuauaaaauuucaaaucagauuaacaucaugccugaaacuaaucaccucaaugaaaauagaacccacuguaugcuuguaaugauuuuaaaguggaaagcucaguaacaccgaucaaucacgugccucuguagccuccacgugacacuugucuguuuucaucaccccagauacaaacugugaagcagacaugagcucucucuuaaugguuuucuuccuagagaaaaucuguuacucuacuaagcuugucuuagaauuuauauaaguggauagugauuuuguaguaugcguuuaucuucuaauuguuuauagugcuguuguaguauagacauuuuacuucccucugcaugcacacucauacauuucugcuuuccacuauuccucgugggaaucucugugggaaacuuaggaguucugcuucacugaagcugaacuaagcaggguccugauuacaacagagacuuccuaaauucagaugggcuuagugaaggagucagggugcuaguuuauagacacagaaccuccacaagucagguccuugucuuguuaauuaacccuaacucuaacucuaacccuaacccuaacccuggcccuagcccuggcccuaggaaagaugaaucucauggaccucagggaaguuaaguuuuagaaaggaacuuaugaugaagucauagguaguguuuaagaggaugcaaaugagcagagcuucuguggguagcagccaccccagaacugggguaccacugagcugcuccuuuaggggcuuacgggaggacuucuggcagaaacuguugaggaaugggaggguugguccagucaccugccucaaugucuauuucagguaucagagguacaguuuuggucacacccucagauauagcuucuaggcagcugugcaaaaggagaggcaagauaacaggaaaucaggcuggaaacuaaaacucccaaacacuguuggcauuuguggcgccuccaaggaugacaagaucacgaacauucccagccucuggacaaggauaaggaucaaagacuuugcugcuaaacugccuggccagcuucuauuaucuacucucauccuuauuauuagguguuuuaaucaccuaaaucauaguuucauuugcuaaagggcagauuucuaaauguuuuauaaaugaguacauauaugucuuauuuuaauauuacaucauauaauuuuaaugcauuuaaaguaugauuaacucuggaaauguaucuuaaaguauuuaaaagagcauauauuacaugauaaccuuaauaagaauuucauaaauuuauaauaggguauaucaaauguaauuucaaugacuuucuauagcccuggaauagucuuuagcuuagacauguuauugcaaagugaagagucggggacagaucaguuaaaauauuucaaauuaucgagagcaauagaacagugaaguuugaaaaacacaaagaacauuaauauaggucauuaaauuuauggccacaagcucuuaauaucacccaacguggccgugacaaauauucacuacuuauggucauacucuacaguggaaacaaaaugaugagucaaauauccacacucucuccacuuagaaauaccaacugaugaugcaugauuaaauaaaucaacacauauuaauaugugauaugaucugaguugaugagagcaugaaauacaguugcucuaaaacauaaagcaaaagauauuagcuuguugugagaugaaggacuucucagagagaaagggguggcuuugucaaaaucucagagaugaagagaaaugaauuugggaaaggcuggcuuugagagcaugaucaccaggggugaggaaaugagcuccugaguccccaugcguugaucgguuaugcagaaggacacugaacccgaaagucagaggucaauugcaaaggucaugagggugaccuaauagcaauugaauggguagagaauucugucuagguauuaugguggauaguccugugggucugaaguauuagaaagaagcugcaacuaugaaggguguuagaugguuaaaacugcaauuucugaagauuucucauuguugcacuuccagagucuaccuacaauuuaccuugggugaguucucuaaauagccaccucuguguuagacuaaacaucccgugacuaacagauaaacacucuugggaauuuauuaacuuaaugaaacaaaacaaaauaaaagauaacaucugaugccuaucuacuuacuuuaucaacuuaauguuuucacuagugugugugucuuuguucucuuacuguaaaaauuucauuaaauugcuuccauguuggaacuugggauuuaugcucacaucagcaugugcccugggacacuauuacuccuacuggauuagaaaauaaacuaucccuuaucucuuuugaauaaaaaacaauauggccaguauuaauuguugccuuauuauacuauuagaaggagucuugugcuuuugauauuguaaguuuauccacuaaucuuucaguccauuaaggucagcuuuccuucccuucacuuucucuccuuccauguccucaccuuuaucccccugauuucuucuguuuuacaguuaucccuuauuuucaaaacaaagaaucagaagaugauuuuuaaugaaauucuuauaaucacaaaugacaaugaaaacccuaaguugaaaaucagaaaauuagcauaauuacuacacuauuacuaauuauugaaaaugauuuaaaaaaaaguuuggaauguauucauuaaaaauggcauuuggagcuccaagaaauuucuaggucaaauguuuagauaugcugucauggcuacucuguuuucuaagaaacuucaccuauaucaauuggauugaacauuuagaagcuaugaaggguucuucucuuuucaucccagauguugaugagugcucugagaacaugugugcucaacugugugucaauuucccuggaggcuacucuuguuacugugaugggaagaaaggauucaaacuugcccaagaucagaagaguugugagguaagcuuuguaaauccgaaacuucuuaccaaguuggggaugguggugcauguuuuaaugcaagcaccugggagacugaggcaggaggaucucugagguuagccuggucuacagauugaguuucaggucagccagggcuaacacagagaagugagaagaaaacaaccccaaacaaacuucugcucuguuuuuggaaaugagagauccagguguuaccaagaucccugguccuuggccuaaggaucuuuguugaaggaauucaguugaaguauagaacacaauguggaagauaggugaguucauuauagaauagggagacauauucacagagguuaagaguguugaguagccagagaaaacauuacagagcugauggcuuucaagggauaagaauuaagaacauucucacaaggugagagugacaauuacuagauaguacauugugcccuuauguaguuuagucuucuuccuccuccucuuccuccuccucuucuucuguaucuuuuuaaagauguauaaaaucucuagaacagacaacucuccugagugccauuuuccugcccacaugauugacaggccuaucugauugacucucauuugagagagcaaugguaugccuuugauccuugucagaaagccagguaguuauccauuaugaaguguuaggguccuggaauccuaccacuuacacuuuagauaguuauccuguaaugaccucccugcaucucaguguggcaugucucuucccagucccagagauaggacucaggacucauuucucugaccaguaauuaaagccuggcaguucaacucugguuuuacaaggggcugauuauaaagacggcauccaucuccaguguccccuagucccacuaaaagaauaugacauagaaauuaguaagaauauuuuauggcauccuuuuguaucacauucuggccagcaugcccauugcuucucuguguucauaaguguucacaaacuuccugguggaaacaaacuugucacaagaagauuuaaugacaauaaauguaucacaacuaagagacagcaauuguguucaccagagugucucaaacuuuucaacacucacauuaaaugcauaauugacccaagaaaucaauuggcaggaaguuuuaauguuucccuuauugaauaaauaaguuaacauuugaucccccucacccccuccuuuuuauuucuuuuagaaauaauaaggcacacaugcuaguaauucuuucuauucuugcauuuuaaauauguaaauguaaaauuauauaugauuaugaggcggacuguuuaaaauaccuaaauaaugacuucacagugcauaacuauaaccaacuauaacuuugugucuacacacacacacacacacacacacacacacacacaccacauauacauacaaccaagaugagucacuauauucucagaaagaaaauuuaaaaaaaaucacacuacccacaugaagaaagauugggaaagaucaggagguucauggauauaaguaguaauucugaggccacucgagaggccaugugguaggauuuauuuuauagcuuaaucucuuauuauuuccguauguccuguagaacauaccacuauucacauuggaauggguauaaauuccccuggggagagcuucguuuaauaacuaugcagaauuaguuguaaaagcccuucuuuguagccaaaaaucucaucucuugguaauuuucuacuuuaauauuccuguugagcuuuaagaaacaaaugcuugauaaaagaucacaugacuucaagucauuuucauguaaauuucuuagacaaugagaugcuaacuuaguuuuauucccuccuggcuuggcacuauucucuugaguaucuagauagcacauuuucccucacaauaguuuuuuuuuaauaaccaaaugaauaauuuguagauauaauuaaugcaagcaauuauacgguuuauugaauuauacacuugcuggaacaugaugaaaagguuuguguuuagcacugaggcaugugaaagaaauacuaaagauaaucuaaagccacauacauguauuuuuagagguguuuugcaggaguuuuacaaggaaauggaagacaguuauuguuguuugcaaagacauuguauugugcaagaauuucagaggcuguuuugagaacuaaagaaagaagacaaccagcacacauugauccaccccuuuugcuuucucuaggguaucccagugugccuuuccuuggaccuugacaaaaacuaugaauuauuauacuuggccgagcaguuugcaggaguugucuuauaucugaaauuucgauugccagauaucacgaggugaggaaccaauguuagugggaauuccuacagguuaaacagucaaguauaaaagaaaggcggaagauggagagcuguaggucugcccucaaugugaugacucagguuacacggguagcuuucacacaagaaccuuuccacaucugcagagacugacucugccaaugcaaacuuacuuucucccccacauuuuccauuuuccagugguuucauauuuacuaagaagcugagaguggggaccuaacccacuugugaaauguucauucaucuuuuauacauuacaagugaaaagucagugaacggauggaguaucauuccauucaaaaguaauaagaaacauuaccaagguggcuugaguaauagacuaaagaaauaguuacucaguuuggcaauccaaaugccucaacuuuuguucuuguaguuagauugacauuccagagaguguuuuugugugugcuucuuacucaugauucuaacuugucaaauacacacauguuagcuucucaaugcauacauauucaagcuagaagcaauaaauuagaauuuuguuguuauaaagagaagagaaaauuauuuaauauugaguuuagagcuuaaguuucaaaguauacuaauuauauaaucaugcguguuuaaguuucauuaaacauugauugcucucuaaucaguuuaacugaauguguagaagucuuacaagaauaagcauuaaauuuuauucuaagagucagguaaguggguguguuucauuuuccuggauauuuggcuucaccacaaacauuuccaaauaaauauuauuuuuagugauugagauucuuggaaauucuacuuugcuauaagaacaaggaaaguaaaggagaaaaguguuaaaaauauuucuguauuuacuuugagauuauuuauuucuucaugacaacucauucugacuugauaucuaacauuggaucagaauuaggaaaacaauuuuuccuuaguuuugucauugauuuauuuacuuugcacuuucagaaguguaauaucuuuuauacauuacauauuaaaggcacagcuugaugaauauuuauaaacuugcuuuaagcaaaucucuucaccucuguuuuccauaaccaacugcuuccucuugcccugccaaauguugacaaauucugucuuuuuucaacuguacaauacuuuugaaacagaauaaaucgauccccaaaguaaugagucaggaugcagugauguauuccaggaagaacauaugcagaacaugacucuuugaaauaccauuuagcuuuauuuuucaaagaaaaggaaauuaucuucauaauaggaucaacuucuggaagaucgugaccaaacacagauuuaauuuuuggcaagaucauucauuuucaacaucagccaaaugcucagacaauugugaggaaggacauaguccuuaugccaaaggaaaaaaaaauuuuuuuaaauauaaacaggccagugcauuccuguuacaguguuaugcauccaacacaguucacauucuaucucuuucagauauuuucuuggaaauuuaagcuacagggauauuuguucugucuucuuuucuuuguuuccuuugaggauggucuguccuuauuacaaauauugccuuugugacuauugauaugugaugauggaauaucuauuuuuuuuguugacuugcuaugcaugaacaaugagucuuuaacacaaauuuuuuuuuuuuuuuuuauuuauuuauuuauuuugguuuuucuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguuaacacaaauuauuuuacguaguuuacauaauaaauaguuauacaacucuuuuuccuuuuuccuauuuguuuuuguuuuaaaaacaaucuuuauuagcuagugccuuggagaucuucaggcugauucucaggaacacauucugagggcaggcaggcagucaacacacagauuccuuaagauuguccuucccuguaauagcuguccuggacacaugcccagagucuugauaauagcaagcguuguuagaguacacugucccccagcaacuagcuaggauguauuuuuucagcuuaauucuuaggcauccuaccucagugguuuaugcuauuacaacauuuggaaagcuuuggaaagccuuucucuuuuucuuuucuuccuuucugccuucauuuucccuccuuuccuacuucaauuccuucgugucuugccugugaaacuuuucgugcaccugaaaggagggggcccccgauuuuccuggcagccauuuuccucaauguggcuaagcccuuacuuaguucuucuagcuucuuguuugacaccaccauauauuccugcccucuucuuccucauaaacuuguggccuuuuuuaugucuggaaaucucaugaaacacagcaacauacuucaaagaaggaacaaaggcacagugcauucugaucauuucucguacacacuugguguguuauguaaacugucagggaacuauaaagaugaucuguugucaugacuuuauuuguuuguuuauugguugguuggucagaacuugaggcucacaguacuguuuugagauaaggcagagccauggugcuccuuuuuaaugauuacaggaaagguuacuuauacuuuuaauaaucuaagggcuagagagauggcucagugguuaagagcgccgacugcucuucugaaggucgugaguucaaaucccagcuaccacaugauggcucacaaccaucaguaaugagaucugaugcuuucuucuggggugucugaagaaaaagcuaucuuauggagcacugugggugauucuuuucuggcauaugugaaaucaggaggcauaugauuuuuucuuuuuuuuuuugcuagauaaaccaagauugucauuguaacaucuuucacuagucauucauggaugcaguacagucacacacaugcacaagcacauauguacacacacauauacauacacaugaaaacauacauacaccuacaaacauacauguagaguguauaaauauuccuguauuaauucuaccauccaacacaaaauacauaccuucaaaagacaaaccaugaaugaaaaaaaaauacuagcaauauauugacucacugaggaaaagacuacaagaguaaucaagaaaacaaaauaaccagguuuugaaauacauauggaaccggaaacaaccugugaacaauuuaaugcugcuuuuuugaaaacucuuuuuaaaucucagggaauuuuuuuuuuuucucuugucguauaguaccguuugccaguccaaggugugaguguugggggagccauugacccuucugaaucucucacaagaagugugucucuuuguuuagguuuucagcugaauuugauuuucgcacauaugauucagagggcaucauacuguaugcagaaucucucgaccacuccaauuggcuccugauugcgcuucgugaugggaagauugaaguucaguuuaagaaugaguuuucgacccaaaucacaacuggaggcaauguuauuaacaacgguauauggaauaugguauguuugggauuucagaaucaauuuccuuauuuggaugcacuuuuuuguaaaauuauaaucugauugucaagugggagcaaaccaaaauacauugggucaaccaaugcauuccacacaugauuagucuugguagugauuugagaaauuccauguuauauauuugaacugcucuguuuuuaaauuuuuuacucuuuuuuuaguagcuguuuuuugggugaauuauggggucuccccuuuaggucaggaaucauuagcagguauaguuaauauaaagacaugcauaaucaaagaaaacccccaguugucaugagaauuuuuaaacuaaagaagugcagauaguacuagcaccaggagguuaagucaguuuuaugucuauguauacaguuaaguagccaguguugaacaaacagcauuauacuuaggagauuuaguaaccagaggacuuuaacauuuccauauaauaucaucaauuucuuuucuauuaacaauugaguuaaucuuuuuaaucaguuuaacuaaaagugggacuuuucuuggagaaaagaucacucccuuuuggcaguggggagaagugcgggagaaccacagcuucuuucgcauucugcugcucuuucaagcgucuccaccuucaauguggggcucuugguggcccgcauauagaagaccggaagcagcuucaguuccauguuuuauauucaguacuuauggucacuguuagacuaguauugagugauauguucaugcuuuacuuuuuuuuuuuuugauuuauuuauuuauucuauguaaguacacuguaacugucuucagacacuccagaagagggagucagaucucguuagggaugguugugagccaccaugugguugcugggauuugaacuccuggccuucggaagagcagucgggugcucuuacccacugagccaucucaccagccccaugcuuuacuuuaaaucucccuagauaagacuuauacaauaugugagugagugagugcgugugugcaugugugugccuguguuugugugugugccuguguuuguguguguguucaugugcaugaauauuagccuaccuguguguaugugcuuaaccccaagucuggugccuucuugcuuuguacuuuauuuuuugagauagggaucucucacuuggaacucacugaucuggcgagacuaacuggucaucaagccccaggcaucugccugucccugccuccucacccuggaaugauuggugaucaucauuguaaccagcaguguuagggaaaccaacccagacccucauguuugugugucaccuuaacugaaaagcauucauuuaaaucagucuauaaaccgaacacuugucccauggcauuugcuuccuuaguuuuaaacuaguucagauuuucaaaauguauuuuaaagacaacacaacccugaauuguuuuaugaagcauauauauauguaguaguacuuaggugguguagagauuaaacaauuaucauggcgaaaacguaaggaaauaauguugauugauaagugauuuugugugcucccaacacugguauuguaacucauucaauggauauuuauugagcccuacauuugcuaauagguaaucuucccaguaagccuacaaggauguaugaagcagucauuguucacaugaagcuuacguuguaacacugagcagcagacuauagauacguuaugucaaguacuuauugauguugugaagaaagaggaaagcaagaugaggcaagggugugacacugagugugcacauaaucagugagcuugugaaauccguggggcugaccugagaaaguuaccgcugggaaguggcuggagagagcaagccaagaaaaauaugagugagauccuaaaaugauucugugcaauguaaaaggcagauucccagucucggggggguggggugggggggggaggauguguucgggaugucugacaaauugcaggaauggaagagaagaagaguuuaaaaaaaaaaaauaaagucaaaacugaggucuauaauaugaccaccugggcaaaggucucuggggagugaagauuugcauuuuaugauaguuuugaauagugacagaaugauucugaucaaaaucugauggcuuuuuggaaacuagucagugcagauuaggguggagguugggagagcauuguagguccccagagcaaagaagacuguggcuuugguuggagugcucgucauggaugggggacaguggacacuuucuggggacauuuuuucuuguacaucuucauuuaaaauucuguuuguguuuuuaauuugcuauucauuucaguaacgugauagaagcagcaucuaacuugaguugcgagugggcccagcuucuguaugcaaauuucuacucacaggggucacgugugcagguccaggaauuagaagcaugugucuugaauaauagcccaacuucuuuuuaaagacauggaaaugcaaaacuacaucuugaaaauauugaggugguuuacacacuucaaaaaccgaauguuucagcuacaggacucaaguggcuagcaauuaauucccaagaaaucaauacaaggcaaagggaaugaggacucguuuacauuuuacugugucuaccugcuaugcuucgcuuucuguuauugauuaguaagccuuugcaucaugagugccguauucuuacgugaagcaaucgcaguggccauccucagacuggaaugauuauucaugcuuacugucacuuccaaccuucuuacaaaucaagcacuugauuuuuuuuaaaaauuauuuuauuuauuuacauucuucauguugcuccccucuacguccucucucucagaguucuucaccuuaucucccgucccuuuuuccucugagacagugcuucccccccaaccacugggcauccaccuucccuggggcaucaagucuuuacaggauuaggcacauccucucccacugagacuagauaacacaguucucugcuacauaugucucaggggccacgguugccagggcccauguaugcuuuuugguuggugguuuagucucugagagcucccagggguuccgguuaguugauacuauuguucuuccuaugggguugucauuuccuuuaguuccuucaauucuuucucugauucucccauagggguccccgaccucaguccaaugguuggcuuuuaaguaucugcaucugucucaaucagcugcuggguagagccucucagaagacagccaugcuaggcuccugacugcaagcacaucauagcaucaguaauagugucaguguuuugugccugcccaugggguagaucccauguuagcccagucacuggaugaccuugccuucagucucuccuccauuuuugucccugcauugcuuuuagacaggaccaguauugggucaaaauauuugaagguggguugcuguucccaucccuccacuggggguccugucuaucuacuggagguggucuccucaggucccccaugcccacaguugggcauuuucaucccccacugucauauucaaggucucugggacuuucuagacaucucccauauaugugugaaaacaggagagaaauccagacagccaggaaaaugaacggaaacaagcauuugauuuuuuuuaaggacuaguuuucuauuuugaaaaaaaauacaauuuguguaugauacucagaaugcuggacauuacugauuucuuaugauuuauauuacaaaauuauucauugauucuguauguacagugcaccaguugcaaaauaaaaguacuuaaaauuuuucuuggguaaagagguucacguuucuuuuugaaauuguuuacuuuauugcauguaauuaagaauguuaguuuuuuaaaaagugagaugugauuuuaauuugagaucaaauucuaucaccuuaaaauguguuuuuaucacagguaucacaauuaugcuguccaagugaguuugaacaaauuagaaauuauauuaaauuaauuguuauauaaaauuacuuaauggaauacuaugauauuucuuuucaguccaguaggucacauggcccugcauugacucuugcuuugccuuucuaauuguaggugucuguggaagaauuagacgacaguguuagcauuaaaauagcuaaggaggccgugaugaauauuaauaaacuuggcagccuuuuuaagccuaccgauggauuucuggacaccaaaauauacuucgcaggcuuaccucggaagguggaaagcgcacucauuaaaccgguaacugugucguuugcuccucucuucuuggguggaucccuuuaccugccauugguucaaagauguguuuucaugacacuugaugcaaagucauuuggcuaagcauaccaagggugacaacuuguauugaaugugguaaagaaccuuagaccacugaaguuauagaaaggaaauaagaaaaugagccuugugguuuuguguccauuuaaauugcugcauugcucauuaagcagcggguauguuaaauucucaaguugucagcucaguguucauuauaauauuguacacucagccauugaggguacaaaaagauacacuuaaucacacacacacacacacacacacacacacacacacacacacacacacacguguagaagccaaacaucuuucuuagguuuauuuuaagacauaaauuuggugguuauggguagcaaacacauaggguggauugaacacauuauaagaaguauuaguuauagcagauaaauacaauguucugaauacaaugcuucuaaaauaaccauugaauagaguucaagaaauuaaucacuaucuuugaagaguuuuaaaaugccacuugcauucacagucaugccagaggaacugguugauauaauuuaaguauuuacuacuuuauaucuaucuacccuucuuucuucacaacuugcagguugcuuuaacuuuuaauggauuucuauguagcacuaaauuggauuagcuaaacuaugccaggaugaauauuccagacuuuugaaauugauagauuacgguacuuuaaugagaaagcaaauuauucaaaaagaaccaaccauuuguaaaauggcuaccacgcaucuugaaccugccuggaugcguuggcgaagccuaaagaacuuuguuccugaagaagauuagaaucuuccugggccacuuuaaccuauauugcaaaugcacacacaaaaagagacaggaagcagcuuagagcccagggccagaaacacagagagaaacuaggguugaaucgggcugaaguugagaagcagauaggaccuuagacuguaaguaucaucaggacccaacugcaggccugcaguggcauagucucaguuuacugacaaguacuaucuaucagaaaggaaagaauuagauccacuuaaaaguauuuuaauaagauaucaaaaaagggguuuccauccaaaugcaaccuauacagagaaucaauuaaagccauuuuccacuucugcacauguauaaaauauacucccugacuucuaucuuguugcguuagauuaauccucgucuggauggauguauacgaggcuggaaucugaugaaacaaggagcuuuaggugccaaggaaauaauugaaggaaaacaaaauaaacacugcuuccucaauguggagaagggcuccuacuacccugguuccggaauugcucaguucagcauagacuacaguaagugaauccugcuguguuucuuuuuucucauugaucauuaaauacaucccuugacaaacugcaaugauuuauucuguuagcauugcccagugacuaguugcuaugacaggccuugucuuacuugugugguuaaauacuuauaaaauuuucagguauuguaggggaaacucuauggacuguuaauaugcuuauuauuauguaacauuuacuggcuuauagccugguucauugagggucgauucaguugaccaguuuuuuuuuuauguuuuuuguuuuguuuuguuuuugcuuuuuuucccccacaggaaaagagcaauuuacuuuauuacauuaaaagguaagauccauaacaugaccucacaaagucacacaacuggaaacgcaaguucaccgcuuuugcaguugguuugaauucacuaaucacggcauagaaggcacugguuuucauuucuaucauuuucauugaucuguguuaaaauuccuggcucugaugaaauugccuauauauuuacauauguuguauagcucacucugagccuuugacauacucauaauuauaaacuuauuucguuuuaaaauuuuuuauccaucugucuaucuaucuaucuaucuaucuauuuuuuuuuuuugcagcaucuguguucaugugagcuuaaucaucuuguuuccuuauuguguuuuguuuucucaugugucuuuguguguccugucauguuuuggauuagagguggcuauuuuacaugcaauaguagagacuuacgugaauacugcuugugucuggaaauaggcacaccugcccuuuguuuauggagggguauugcucaauuuauugagaauuuauugaguuguuagugaauuauuacuggcuuuuauaauagagcagagccuuucaugaaucuguucccuagauucauucccuuccugaggucuuucccuauguaauagaccuuccaucugcuccaagccucacaagagccgccaucaugcuauuuagauguccagccucuucaacucugagccagauaaauugcuuuuuaaaacauaucaccuagcuucgcauauuauuuuucaauagcuuuggaaagugugcuaauacaauuuaaguuuuguuugguuugggagugcuuuacuggagauugauuuuuauuuauuuaugccuuuauuuauugauuuuuauuucuguaaguagagucgaaagucucguuagauugggguccuagugaagucuguguauaucuuuacaaauaaccugcugugagcaucucugagugcacauccggcacuugguuuguaugagagaaucuuagaacuagaucuucucugucaaagaucuugcacauauauuauucaugcaugacuuacugcauuuucuucuaaagauuauuaauugcaaaacuuaccaaaagcagaaagcucgugcuuaaaauaaguuucccaaucugaucaaauuuaaguuuuauaguuuuaaauacuacuuuccuaauuccuacuuaaguugaauucguuuucauguauuaguagugauuaccugugcgaccuaauccgauucuuagguccaaaacaguagaucagagucuggacacuaagagguacaggcacugcuguguugucaggauaucugcuccagcgggaugcaaggugcaguucugaccaucagugagccaggcagcugccccgggaacacagggauaggucuauuggugucgggaagauucuugccuguaaucccuguuuagauccuuuugugcaaauuaggaaucuaaacuuauacagaauaucugaaucagacugggcaguggugaguggauggguugaucagcuuuuacuucggauaaagcagguacgaguugggggguggggguggggguggggguagcggugggggcauauccugugagcaacagacugagaucuuugcucuaccugcguagaaaucaagagugagcaaugaaaagcuccucgggcccugauccugggcagcuuuucguccucuaauguuggauaauaguaaaugauggcagagagagcgaccacggguagcacccuuuggcguugcagcucuucugcaagcuuuaagaacuaggauccuuaguucuguaaucacagcccagcaauuccucaaucccacaaccgguaacagcagcugauguuacaguuccuggcucugggcuaucugagacccugugucccuaaagguguuacaguuuuuauaacuuuuccaagaaaccacagccugcagggcuucuuuucuggcucuuuacaaccuuuaguuuuucauccuuaguucucugccucucugcuucugucauuuccuguuccuccucuggcuacucuaacuguucagcuacuuuucagcugucaagcagcugcuugccuuguggcucuuccagcaaagccugcugucaacucuuccauuguucuuguggccccugcaguucagcaaugucuaccugucagcccugauguuguuuguugugcuucuuuauucauauuaccagcucagcucacgcugguaaaaguagacaagaaaagaucacuucagaaaaaaaagccuuuuguuaguccuuguguuucaaccccagaggaaguagugcagugagccaaacaggcugcguuuacagccacaguaggugccuuccccaccaaucacugcguuuggcucuuuuaauauucgccuucuaaguuuuuccggcuaggcgguccagggucagugccccuucucuggucuaaguggaaaucauuacagggucauccagagggucauucacagagggcuguguagcaaaacaguccuggcaggagaggcuuucuauccagagcugagcaauucccuucaguuguuguguaauuauccuaaaccgugucuauggacuguuugaaaaagcgagugcuggcauaagcuuagucuggcaggccauuggcgugguacaccucuuguucaaggcagggagggcaauaagggagaacucagcaacuuccaacuagacgcugcucacuagaggucaaaucgcccauucuccaaugcuagaaaucuugcuaagaagaauccaauuuauuuuuaaucuuaauagugauguugauugaguuuucuuuguauuauugcaauuugaauagagcguuauccuuccugaugccccggggauagguaggcaguuccucuauuucauuucagacucaccugcaugaguaggacuuuaacugccauuaacuguaacucugaggcuuucugugcguucugacuuccaacuuucuuauuugggcuuccagggaaaaaggaaagcagacaugaucccuggagguccccuucccagaaccagauuugcuaaagaaaauuuuccagaaaaagaaauuuaaauaaguuacauuguagcuaaaaauuacuuucuuaaguuauuuuguggauaauuugaaaccaacuuacuucauaaguaauguuuaauguuauaacuuccacacauuuucacauuuauuucaauauauaauacuuuguuuaauucauuucccaauaauuccauauauucauccugggcaagagucacaaugagaaguguauucucauuauauguagcuaaauggaagaauauuuagccaaaagaaaaucauucccuuguuuauacccuuucgaaguauauggaguauaccuaaguaauauauggaauuuguuauguauuuauuucuucacaguaaaugaggaagacuuaauauuauaaacuaauuuuuuaaaaguacuugagguuaauuuagauaguuauuugugaacuuuaaugugugacuauguccugaaaaaugugucucuccuuguuucacuuccaaaagcaacuuagaggagaaaggguuuucuuucagcuuucagugccaggucauaguagggaagucacagaggcaggaacuugaaacagcucauuccauccauauucaagaguagagagaaaagaacgcaugugugguacuugcuuauuuguuuaugcucagcucaacauauccacugcuauacaguuuagggccaccuggcuagggaaugcugccaccuguaguggacuggaucuuccugcaucaauuaauuuaagacagucuguccuccacagacaugcccaggggccaauccaacauagacauucccucacuaagaauuuuuuccuaguugauuauagguuaugucaaggugaugauuaaagcuaaccaucacaguaucaaugagcaguuucauccuuuggugaacaucacagaacaggcuuauaucuguauccauuauuagccagauuaucacuacaugguacaugacuguacuuugaaaacacaaagucagugaauauuuauugucuucuuugaaaaacaaagccaugcuaaugacacauauguccgauggccugcacuccacuuugguagauaacuagccacgucauucaaaagauuaaaauauuaaaacaagacuaucacagagcuaagguucccaaccuaauuuaaaaacuaacuguggacuucaugguauuucucuaagccuaucuaccucucccuguacauggaacacauuuuuuuguuuccauugcuguagaauuagugauggcggggugcgaagacuucuguaccccuauuuuucucuuagaaagaauacaggaaaucuauucaacuuccuucuaaaucugugcuauaaggucugaccgcucugaggucugaacauuggugaauuugcuugagaugaaaaguuguuaaagagaaaauggcaaguguggaauacucuuuaucacagauuauacuaauuaauaauuauuauugucucaauuguaacugcaacaauuuuuuucugucccacuuuguuuaucauuuugaauagauaauguaacuaaugcagaggguuggcaaaugaaugugaccuugaauauccgcccuuccacuggcacuggagucaugcuggcuuugguuucugggggcacagugcccuuugccuuguccuugguggauucucgcucuggaacgucucagguaaccuuauuuccaaccuagaugaaccucuuuaauuucccuacuuguugacugauuuccaaggaguaggaauauauuggaguacugagaaaccuuggcgucuggagcuucgguuaggcagacucacucauacacaagcugcuuggagacaugacaaaagugcauagaacuaacucugcccauacacagaaccugugaaggaguauggaaauucaugugcacccaaaauaagguuguuagaacacuccacuugcagcugugcaguuguaauugcuuguucuuugcacguguuaaucuuuuacccugugaguacaucagaaaaagaagagaaacugaaacuaucuuacuugauguccuuuuugcuaacuccaguuuggaauuaggaagaaaaggagagucuuugauacaaagaaaaacaaacuuucucgggagaucuaugcuaucucaguuucuaguagugcuaauagcgaauaguuuccugcuugugucuuguauguaugcauugcagcgacuuuuuguaaacagcuuaaauuuaugccaagauuggauuccuuguuuacucuguaaucaacaaaaacaguggauucauuuugaaaauuaaaguguaauuugugaguuucuguugaguaacaaucuccacuagaccccaccccaccagucuuucuauguauuccuggcuaaccuggaacucauuauguagaucaggcuggccacagacucacagaaauccacuuacuuucugccucucaauugcagaaauuguuuaauuuauuccacaauaauuccauauauucucucuggguaagaguuacagugagaaguguauucucauuauagguagcagggauuaaaggaauucaccacaugccugacuuaguuuucucuauuaaugaguuaaggagaugaauauuuguaaaguuaagauuuccuuaaauaaucuguagucagaaaguauagacuuuuccccucacuguaaauaucuuaaccugagaggccauuuuagacuacacuuacuguaugggaagcaucauagcaucucguucuauuuugguuuaauuuucuauuuccucuuuaugacuaugaguuaguagagggggucacuccuaaaaguugaauauuuugaaaauuccagcaaaauaaaacacuucucuuguuugagacucuucagcugccuacuauaaguguugcuuacaaugccggucucuuuugcaggccucuuuccccacauuguccuuggucugugcacuuauauggaugguacaggggagcuuuucugcuuugauauauaugaaagcacucaaaauuuccucaacucagaguucacucuuccuuuuucauauguaacuuuuugaaauuagggagacauggaggcauaaauacaacuuagccacauuguguuucuuucuucuauuuggccacacaacucaguugauguaacucaaucuucagaaaucaguauacauugcaucuuaauuaaaccuggagcuuauaaaacuaaugaauguuugaaaauuaauuguuaaaaauuuaagcaacuuuacauuuaaauguagagacucuaucauuuugugaaguuuagguuugaaugucaaaaguacagagucuuuccuaaguggcuuugcccucaguauuguuuauaugaagucuuugcucuacuguuuaggauauugugguauuuguugaaaauucagugguggcucgauuggaggcgguaucucugugcucggaucagcaaucccaacugaaaugcaauguuaacagaaauggacuggaacuguggaccccacuuagaaaagaugucauuuacucuaaagaucuucaaaggcaacucgccgucuuggacaaagcaaugaaaagaaccguggccacuuaccuggguggcaucccagguacuuuucuucaguucuaccaagauguguugaaucaaauaucuuguauauaggucuggauguccuggaacucacuauguagaccagaucggccuugaagucagagaucuaccuaccugugaguucugggauuaaaggaauauacuacaugccuggucaaauugguaauaucuuaaaaacacagaauuuuaguaauaagcauuaaaagugaagacaugcuucaaauacccuuuacacuuguuuuagaggguuauauuagcaucguaucaauguguguaacuuuaaugguaaugugagacuguugcugcauuuggugaucuauaccaaagaaaaggauaaacacauguugaauuuauuuaucacuaauccaauguuugcuuacuccauauuuaacucaucaauuaagaacauauaccuaaaaguugugcaccaccagugcuugaauaaauugcuuauauacaaauuaaucauguauaaauuccuuuugauaaaugaaaaucaagagaaaauugaguuuaaagauuuuuuuaaaaagcuaauuuuuguuuauaauuaauauuuagcuauuauauauacucugaggguaaauuagugucauaaugaguaauggcauugugguuaaaaugguguauauauaaugucagugacauuagccagacuaaaagaggauuccuaaacuacgcauuagcuccuagauacagauguuugucacuauuuuggaaagcuuaagguagagauuuuuaacuacuuuuggcauaaugugcuuugagaaggaagcacaagagaguguccacuguaauucagauccaugaggaagaaaaugccaaaagagaggaaggugucuuggacucuaguucuuaggagacaaggaagugacauaaacaacaagcacaaaucuuggugacaagaguccaaugcaacaaagcccaaaggcaccgauggucucaaaugacucacugagguacaauccaacaggcgguuuuguagggcaguauugucacauaaaaacagucccuuauuaugauuugcuuuuaugcucagccaggaacuauuucuuaggaaauauaaaaaccaguuuuuauuccagaaaguauacaaagguguguuugucacgacauuuaaaaaggauuucuaagacacuacaauuuccaguagaagaggugaucuaaccacccagaaauguugcucaaguuuaaagagaaaccaacauguauuauuuuauaguaaauguggaauaucauaagcacaugcucuuuucuccucucuaagugugaacauuuuccuucaguuugguuggcaaugaagaacucacgaugugcggagcuccaugcccagcauagccuguuuucugaacagaaccacauuaucaauuuuuccuguaggaauuuguuuggaauugugaugucugaguaagucuucuaaccagaaacaaauaagaugcugaaguauugaacuaauggucagacacuguuuccacagauauuuccuucagugccacaccagugaaugccuuuuacaguggcugcauggaagugaacaucaauggggugcaguuggaccuggaugaagccauuucuaaacauaaggacauuagagcucacucgugcccgucagugaggaagauccagaagaauuuuuagacucuguuuccuguucuucuaauaucucuuuucucguuguaauuaugcucacauuccuaucaccagcuggcagguguuaccugugacgugcaauguuuaaauaugacgugguacuuuguccuucagauuuuuguuauauaaaucacauuuuugaaaagucuugcacucauugcugucuagaaauuaaauaaugaaacacaugaaacacuuaaauuucaauuuauuuccuauaaaugacacugcuuuuuuuguuuuuuuguuuuguuuuguauuguuuuguuuucuuuuaaaaguaagacuuaucaucauggaacuaguauuuaaauguccuguuuuucucagaagacgaaucaguuuaaacccaaacaaaaguccacgugacuaaaugcuaacaguugcagggaaacacuguauuuuuguuguuguuuuuugucugugaaaguggcagagcugauagcauaucacaggugaauugaauggaaggucucgaagcucuauuucaaaguauuuccuuugacugaggcgcguagcuccuuuaggcuucauuuuucuuuuaccuggcuuuccacuugagccaacaccuucacugaaauauagaacaagggcagauuuuccacgggagcagcacaugaauguugucucaaucagguuucuaucagagacaucagguuaugcuguaagaggugugaacauuggguggacagaucacucaaccuaagcugcugagagcacacaaggucagagucagaauggcggccauccuuaauggugggaaggagggugaagccaucaagaaguucauaguugucuuucauauuggguuuuaauuacuauagguggcuugaaugugauuguuaaaguuaaaaaagugauggaaaguagaguagauuuuuaacaaaaugauaauaauaauagagaugcuggauaaaguuacauguucuaucuuuguaaugaaagaaguuacagagguaagauuguccaauauuugaugauagugcauugcaaguggcuggccgcuuugcuguucuuccuggauugaucguuucaggggugcaucagacgcuucguugccauuggagaaauuggauuuuauuuuauuguagauauuuugcaucacaugaaacauaauaaaaugauacauauuuuuaaaauau

SEQ ID NO: 8287 - RNA, 19413 nt, Mus musculus
guuucuagcccagccucgaguggaagguggauagaugcucaggacacuucuuuaaaccgcgaacuguggaacucuacuccaauagaggccggagccccaagucggaaccacauuuccucgcugacuuucugagcuagcacuuccgcccagagaggggcuggaaucuccgagacccuuccggcgcuugcgagggauugaaaaggcacuuccggugucuguugccaaggcgccggccggcccgcgggccgugagggcgacacugguggcgucguccucugccccccauccccgggggcgagaugucggggcucagccacuuagagucggagggcugccgaaaccuacucggccugcuggacaacgacgagaucauggcccuuugcgacaccgucaccaaccgccuggugcagccuguggaccgccaagguaggcgccggcaggggccuugucacccccaggggucggguccggucggguccggucggguccgguugucgccgaagcccagggaaggccuccggguuggcgcugcacagcucugcagccuccccgcccgccggccgagccgggucccggcgcgcuggugagucggaccgugguaccggcugggcaaacuuuugcggacaugcggacccggaugagcaccagaugagcccauucccaugauuuuuaagagcaucccagaguauguuucaguuuucaguuucgaucuccacggagaucagucagcuccugcuguuuucuuucagcccgaagggaaauaauaaacacuauuugucagugucuuagguaaauacccaccgaaacaaauaaaaggcggacaguuuuaauccacguaugucaaggaaugcucagccucuucguccuacauucauuccuaguugggaaguagcaagaccacagcuucuuuuguuuuuguuuuuuaaaucaaaagguuguauaaaagacaaaacggacauauguacguugcauuuauaagacauuaaaaauauccuuacuaaaauacauuagugaaacgaauguuguugaaaagaaagggauagaaaaugacagacaaaacaaaaagaagaacacccucaagccuccaaaacaaaccaccaaauuuaguagcuauucugaaauggauggggaaaaggugauagcgucuuuagggaaguuggaaauaggggcaucaaagauacugugugucuguggaauaagaucuuuggaagguagauguaaugagugcauugucuuuuucuuuuucuuuuuuuuaauucuugcuauuuugcagcaguagucuauuugaaagauauuuggucugugcuuucagcccaacuuuuuaguuuaaaaacaucuugaugcugcuguuuuucagcuucgauuaucuguaaaaucagaaguuugacaacauuccuugguaucauauauugugauuuuaaucauuuuuuucaagguuuauggaucuuagguauuuggggcauagaaauacauuuuuuuucugggucagaaauuuucugggucacuguguaguccuggcugucuuugauucacuuuguagaccaggcuggccucgaacucaagagaucuggcugcuucugcugggucuaaggguguguaccaccacugccuagcaagguaaaggaaguuuaaaauuuaagggauuaaaaaagcagacagaugagccgggcgugguggcgcucgccuuuaaucccagcacuggggaggcagaggcagguggaucucugaguuugaggccagccuggucuacaaagugaguuccaggacagccagggcuauacagagaaacucggucucgaaaaaccaaaaaaagaaaaagaaaaaaaaaagcagacagauggguaaguucuugcuuuucaagccauaggccauguuguauaaaagcaagaaucaggacaagagcuuaaaucauuuucaauaaaaucaaaacuuuugcugaaguugggcaaauuaacaagugccuuguaacugucuguuauuuguuguuacuucuuuuccagaugcuauucaugcaauauuaguguauagccaaaauguagaagaacuucugaggcgcaagaaaguccaccgagaagucauauuuaaguauuuggcaaagcaaggggugguuguaccuccaacugcugaaaaacacaaucuuauucaguaugcaaaagauuacugggcaaaacagucaccaaaacugaaggacacagcagagccaguuacaaagacggaggacauccagcucuuuaagcagguauauuagauuuguacuuacauuccaaaucccuauucugucugaaacugugcacaauccuggcucugaggugcaugguucauaguccuuuuguuuuccagucucugucuccuuuacgugcuucaagaccaugaaaguaacuaagauauagaauauuucucagauuuauauauguguauguaaucuauugaauuggguguuagagugagagucuuuccauaaaugagaaauauuauuauaaaguauacuauaugaauauuuucauuuuaaaugaauuuggaaagcuguuauaaacuauuucauuuuauaagucugcauucgguaacuauguaaaaauuucacuuaaguuaaaaaaaaauuccacuuuccaguuaauccugguugcucucaaguauguguguguguucgauauugaggacuuaauguaaauugacugagcucuggauaauugcugggcuuuuacaguaggcaaagguucuguuugcuuaauaugcuggaaaacaugcucauagcaauuuaauauacuaaaaagaaaaaaaauggucauguuuauugcgaagacauggaaaauauacuuaaagauaucacagaucaugccaaauauauugaauagcagguacuuuguuuaguauagaauaagguaugauaucuuauucuuggugagguacuauauuuugaaauauauagaagcaugagaucuaguuuauaggguuguuuuuauaguaauauucccuuuuaauuaaagaaaagaaaaagaaacaguagcugguuagugguggugcaugccuugaaucccaguacuuggggguggggagaagcagagacaaguagaucucugugaguucuaggacagucuggucuacaaguucaaggacaaccaaggccacacagaaucccuaucucaaaaaucaaaccaaaaauaguauuaauuccacuauagaaaauuacccauuucaguugacuuuggaaguaucuguuuaaagaggguagggaggcaguuuuuacaaacgauucugacacacugguuaggaaaaaaaagucauuuuaugcuagagcagauaccaugaguggcaagagcuuaauuaaguagaauucaugauaauguuagaaaauuguacaaauuucucaugaauuuuauuaauuacgauaguuguguuauuuuuauaauucccuuuauuuacaauccauaagggauccauuugaagcaauuguaaaguuuugagagauguguguaaugggggaaaaucgugcacaaucaugcacauugucauagacuguucaucuuaguacugauauuuuaaagagcuuuguuuauuucuuauuuuuguaaacuuacuucuucuaaggccaaguucauggggauuaaauauaacauuccuauauuacuguuucauaauugguuuugaagagacaggauaucagaauagguggacuguuacaugccuguaaccucaguauacagaggacaagaaaaguggugauugcaagccccagauuaguuuuggauacauaguagguucuuucuuagaagaaggaaaaccugcaaaggucuagaggaccuauuugguuugauaccaaacccaggaaagaaaagugaaugggagguaguugggggugcgggggggggggggggggggggaggagaaugaauggauuagagaauacuuagggcucaacccaacuuuaccucugccuccugaguagcugacacccuagcugguugacacugaauccagcaggggucuucuuguuacauuucacuuggccagaauuuaaauuuaaaagguuuacuuccuuuuuugaaaagaagguucucuggcaggguguggugccuuugcucuaaggcuugccuuggcccuuaggaaucagcuuagguagaacuguggcugugagagguggcucuucacuucacuuucuucuuguuucacagcaggcaaaggaagauaaagaagcugaaaagguugauuuucgucgcuuaggagaagaauucugucacugguucuuugaacuucuuaauucucagaauccuuuuuugggcccaccucaagaugacuggggcccacagcacuucuggcacgacgccaagcuuagguuuuauuauaacaccucagaacaaaacacgacagacuaccaaggagccgaaaucgugagccuucgcuuacugucauuaguuaaagaggaauuucucuuucucagucccaaccuugauucucaaggacuaaaaugugcgucuucuccucauggauuaguuaugguuggaguugcagggacuguccaccgaggaaauucuuguuugggcauauuugagcaaauuuuuggacuuauccguagcccuuuuguggaaaauacuuggaaaaucaaauuuaucaaccugagaaucauuggaggaaguucccuugcuccugaaucaguacugaagccaucuguaacauuugaaccaagugaucuggaggccuuuuauaacguaaucaccuuguguaauagcccugaaguaagaccuaacguaaggcagauaauagauaguggcacuggagaccagguuuuacauaguggagaugaggcauuguugaacaaaagggaaaugaauuugcuaaccccucuaaagcauugagcacuguaccucugcuugaagaagcugcagaaacaacacugaccaucuaucucuaagccacugccgaugugagaauugacauauuuuaguugaaauaccuuuuuggacuacagacuaaugugaauacuugccuauuucuaccugaguuacagcaaauguucugagaacuuauugcgguccaccaaauaaaucccacuugagauauuguagaugccugugugccuuagaaacuuuagguaauguuuucauuuuauuuagugacuagccuacuaaucccugcuuccaaguggcagggguuaauauuauucauguucuuggcuuauuggaucucuuacaagugcaucucacuaaaguguugucaaaagaaaacagcauuuuaaagcauguuuaauauaaaaagucuuaauuauauaagauacaaauaauggacuuguucaaaaaguccaauaauuuagccugggaagaaaaacuuagcugcccuuuugaaacuucuuuuugaaguuaccaguucuaguccaagcgaauaucucaaaauccgcugcucuucugaauuauuuuggguaauaaaugcuguugucaacacagaccuuuuuacugcuuagacuucagccaacaaguuacagaauguuuccuaaaauacuccaaagauggaagguaugcuuugaaauuuuaaagguaugcacgauuccuaacaaauuucugucuuuucuccugauugaucuugacagagguugucucuccacaaaauaaaaauaaaugauagaguuguaaaauaaaaacagauaauaacaaagcccauuuagaacuuauaacauagguaugcacauauguauauguauauccuaacaaaguuuuccaccucuguuacuagauuugagauccacaguaggcuugauagguuaauuagacagcugccuuaguguuuaaauuguucaucaccugguagcuaguugcugauccuggauuugguuaggaauuuccaacuuuauuauuuggaagaaauucuggaaaaucugaugguguauuauacuuguuaaauuuuugcauuuaacucuaguaacuggggagauuagugauaguuauuggaaguaagagguaaaaauucaccaccacuccaccuuugauuuuaguaguaugaagagcacaaaccagcaucuuuuuuuuuuuuuuuuaaagauuuauuuauuuuauuuaugugaguacaacuguaguugucuucaggcacaccagaagugggcauuggaucccguuacggaugauugugagccaccaugugguugcugggauuugaacucaggacguugggaagagcagucaauacucuuaaccacugagccaucucuccaguccuggcaaaucagcaucuuuuaacauaaaggaauuuuuuuuuuuuugucuguauaagaagaauagacuguuuagauucagugcacaguucuuuuuuuuuuuuuuuaagaucuauuuauuauaaauaaguacaccagaagagggugucagaucucauuacaggugguuauacuaccauguggcugcugggauuugaacucaggaccuucagaagagcagucagugcucuuauccacugagccaucucaccagcccaaagugcgcuauucuuaaggagagcuguaggcaauuuaacagcaaccaagccgaaucccuuauuauuuucuguauaguaaguauaauuagguauaaaggaacaauaauuugcaaaaauaauuuucuuguuuauaaggcaaaacaaccagaucacauucuuauccacuuucuaccucuacuuggguuuuggaaauucaguuugauuuuauacuuuauguuuucuuuugaaaaaauuuuccagacaguuucucuguguagcccuggccaucuuggaacuugaucuguagaccaggcuagccuguaggccaggcuagccuguagaccaggcuagccuguaggccaggcuagccuguagaccaggcuagccuugaauucauagagaucugcuuaccucugccuucugagugcuggaauuaaagacauacuccaccauacaucgauauacuuucuuagguuucaaguaucaauauaaaugcccugagaaaagcauaagauuaaaaacaauccaugggcuauuuguguuacugcuauagaaagguuuuuuaaaaagcuaucuuucauauugaauuuuugaauucuuaaaaagccuaggggaggaauagauuucuacacagcuuuaagucaacuugaaaauuuugaaguauuauuaauagauugagaggauuggcuacuuuuuucagguuaauauuucaggugggauauucuuacaauugaagcaaucuaacaaagauauacagagaaauaaugaagaaaauguucagagaaagaaaucuagaauugaaaucuguucaagaaguuuggaaccaaaaguaaagugcaaguguauauguuagggaacagcugaggcaagcucuguuuugcuguauucuaccuagcuaauacuugaaaaaaaucuagcaaguaccacucuuugcauagaauauggagugauugguaugcugacucauuuuauaucaauuugacacaagcuagagucugaggaggagggaaucuagauugagaaaaaugucucaaagguggagcuguagagcauuuucuuagggauugauggggagggcccaacccauugugaagccacccuggucugauguucuugguuucuacaagaaaguaggcugagcaagcagguaaguaacaccccuccauggccucugcaucacuuccugccuucagguucauguccuguuugaguuccugugccgacuuccuucagugaugaacaguguuguggaaguguccugaauaaauucuuuuucaagugacuuugguuaagguguugugucacagcaguaguagcccucacuaacccuaagacaguuaggguuucagauucagggaucuucugggcuuugcugaaaacuauuuugcccauagccuaauagcaggguagguacauggugaaauacuccuguaagacucugguaagucuuagguaccuggaaaccccaagugagccacucggaguuggaaaguuggagaucgaugcaaaagcgagaggaguuuauuguuccagcaugcuagggccguccugcacccaaagaaagagguggcgaugccagggcggccccuucuuccaguuuuuauacaguuuccaguggcagauuagagcaucagcaaugugauuggcagaacagugugacuuuuaagcugauugguccuuacggaacgagguagcuagggcuucccuuaucucauaauuucccuucuaggagaggagggcuuccugguggaauuuuccaaaggucuugagcugaccucuucacucccuuuuguuaaaaugacuaaauaaaacuguucaaaucuugcacuugaguuuuaggguuaaauuuagauauuaguaucuaaaauuauuauuucaugugucuuaaaaacuaaaacgccaaacuacagagaaaagccauguguaauuuauuaaugugaacaauagcagguuuguagauauucugcuuucuucccaggagguguuuuucugugaaaagaaggcugauuaccuaaucuuacuaaaaauuuauauauguaaauguacaugauuauagccagaugugguggugcacgcuuuuaaccccggcaguugagaggcaggaagaucucugacuuccugaucuuaagugaguaucaggacagccaaaacuacauagcaaaaccaaauguugcuagagcuguaauauuuuacuuugcaauccauccucuuccucagguuacuugcacggaaugaacaauagauauuuucacuaauuagaugacaguuaccuuucuuuguacauugacuuacuuauugugacugauugcaguaggaauagcugaugcuacaaccuaguuuuuauuuuuuuuugaggcauggucucagcuuuaccuuggcuguccuagaacucacuguguagaccaugcugaccucaacucacaagagaucugccugccucugccuccucagugcugggauuaaacauaugugccacuauaucugacuaggaucuagauugaaauccaaauaaaagauuaauguuuagcccuuuuugacuaaucauccucagaauaaacauugucauuugcuuauugucaucuuuuaaaagcaaaauugccuuauauuuuaaagaauaugucuauguauuuguguuuuguguguguguguguguguguguguguguguguguguguguguauaccaugguuggcauguggagagaucagacaacuaauggaaauacauucuccacuugugggaaauagagauuggcaggccuggugggagagugccuuuauuugcugagccauuugcaggcucccuauuuuuauguaaauauuucuuacuggaaacucacuuuaggaguuuugaauacauugagacauuguguuuugagcggcugcuucaguuuugucuuugaggacuuggcuagaaugugguuucuccucacugagauucucuguuagcuuucaucggcacauuuuuuuuggcuauuagcagucccuuauguguuaugaguuuaccaaguauucuuaauccuugcuggauguuaaguugggagugcacuuguuucuuuuacauucuauuucuguuauuugagauugaaguuuaagagguguauuguuuuuaaauuccuggcaaugggauugaacccaagguauaggcacuagguaagcauauuagcacugggauuagcacugagguccaccuucugcuccuaccccccuuguaagguuuauuuugagacagggcaaggcuguccaccuugccucagccuccuggggaacugguuuuacauggcuuuaacuauggugccuuuuacaacaaauacuuuuuuguuuuucaccaacaauggauacugaugacuaucugaauguagucauuguuuaaaacuuuaauuuuaauaucugaacuggguguaauggcacauacuuuaaaucccagcgacucaggaggcagaggcacauggaucucugugaguucaaggcuacccuggucaagccaaugcaagucuagugaguuucaggacagccagaaguauauagugagaccuguuucuaaacaaacaaacaaacaaacagauuuaaaauaaaaauaguuaugcugaagagauggcucagugguuaagagcaccaagugcuuuuccagagguccugaguucaauucccagcaaccaccugaugagaucugaugcccucaucuggcaugucugaagagagcaaugguguacucauauacacaauuaaaaaaaaauauguaugcaguugcuagagagauagcuuaguagcuaagagcacuugcugcucucucagaggacuugcauucaauucccagcacccacaugguaacucacagccauauuuaaguacaguuccagggaucugacuccaucuucuggccuguguacgugguacacauacauauaggcaaaacauacagguaaaacaauaaaaauauaucuuuaaaaaaucacacuuuuacauauuuaugucguuaguauuugaaguuuuguuugcagugaguaauacccagaaaaugauaaugaaaaacuuuacuuuauacuagaaccagaaagggaaacauguauugucuuuagcauauuauuuaaucacucuacacucugaaaguguuuugcuaaacuguuuuuugugcuuuuacauauauuuaaauauauuugaguuuuaaacuauaaagugguaggguagaaaccaaaugaaaaacuguugcaggaaauucucuacuucugauggguugaccugagaucuuuugacugacagggaaagccacccaggggagagcauguuuuagucacucugcuggagauucauguacucacagggaggacugcagugugaccuucccuauaaacccuggaacacaaguggugggaaacaacuucagaaaaacaaugugugugcuaugcaagagauccugaaagcaguguuuucaaagaucacagacaaaugaggacagugauggcuaucugaagugauuuuuggcccgaaauccauuuauuaucagucaaaaucauacuacauguuaacuagcuuuaugaugccaucaaaauuucauaugauuguuuuguuuucuuuaaagaaucuuauuuauucuuuggcaauuucauacauugaaauuguguggaagcuugaccauauccacccacucuccuugccuacuucucccagguuccuccaguauaugcucacuguccuaccaugucucccuccccaccguuuguaacucucaguccaguuaaggaugucuguugcagugcccacugaucuguuggcuugcucuuacauaggcagccguaggugcagugaguucaugagcacaccggccaugucaugucccgaugaugacaugucucaucauucuuccacauccuccagcugcuuuauuuuuaaagcacauugacuucacugguaaauuaauuucaacagguaauuauuuucucgggcaccaugccagguagaugaaacaaaauuuagaagcaucuuacagaauuuuaguaagccauaaguuacuugcuagaaguuuauuagggaaagcagaaacuauuggagcuguuuuaucaucaagaaaacagugaaggcaaaagagguagcucgggaguucagagcucuugcugcuacaacaggauauggauucuuagcacucauguuucaggagaccugauguccucuuuuggcuuccaugaccacaggacaggcacaugacacaaauacacacauacacuaguacacauacaaagaagccuuuaggacauagcauuacugagagccaguguggaagagcaguccugacuuguguucuugagguccuucaaaauuuccaacaacauuccugagaugagucauuauuugacaugaguauguuacacaugagaauaaaaagacuuaaauuuccuguuccacuuuucuuugagaacacagaaguauagaaaacaagacuauguaaaaggaaauauguuuuaguguagacuaaaauggcccauggucccguaggaccaugaccuuucucuaaugauacaaugcaggcuucagcaauccugaagaugauagguaaauaaaaccaaccagcacuucccuuucuuaaaaggguggguaacugcggauauagaaggucagcauaguggcucauuguugaagugaauagaaguaaauuugguuuucuugaguuacaaugcuggaggaaaaacuaggcaggaagucauacucccgccccccacuaccuguuuauagagggaaggaucaggguagagacugaacacauuucuuuggggaaauauuuugaguauuacaaauauauuacagaauauuuggggaaaauauuuagugaaggauuuucuccacucuuagauaccuuguguaaguggcacaugaaugaacaaagugcugucuugaagagccgguuauuuuaagacuaugagguuauguggcucuuguacaaacaguucaguucuacagagcugcuuaucucuucaccgucaucucggugguuugccuacugcagaaacuguugggguuuauuuaaaaccacauccaaauacuguggcuguuaagaaagaguacucucuggagcuaacugacaggcagacugagagaccaucuaaggcuaucuauggauagauuuguuucuuuuccuguacauaggugaccauauuauugaaagagacggccuguaguaaaaaauauuuacauagauugauuacuaagaaagccaaacuuuauagaguuaccugagaaaccugacuccagaagacuuccgagaggccagcaguuuguuauuucagggccguuggagcgacugacagaucagccauguugcagcagcuucugcuguccauugacuucuuuuuauuaaauguauugucuggcuaguuagcuaauaauuugacuaccuaucauggcuggaaucuuggauugagugaaaaugagaaaggaggagccagagagguggcucaguaguuaagagcauuugaggcucgugugaaggacuagaguuugguuccuagcuuucaaaauugccuaccacuguagcuccagggaaccugauaucuucuucuggucucuucaccaucaucuugguguuuuguguacugcagaaacuguugggguuuauuuaaaaccacauucucucucucucucucuuuuaaaaccacauccucucucucucucucucucucucucucucucucucacacacacacacacacacacacacacacacacacacacacacacagagugacagagagacagacacauggacacacacacaccacugaacacacaauaguaguuuguuuuggaacguauauugucagcggcaggacggcauucacucuagaagccuucuuugcauuccaggaauaacugccaacucuucaagccuucaaaggcccaugaacuaggcguguuuccacuugcucaagaggccucuggccgcaugcacucagguguggcacaacuaguuaaagggugucacuugauuacaucccuuucugcagcagggcaugcugacugagugagccagaacucuuccugcuuucagacccuggccguccaauaagcugcuccauacagaaaggaggcugucuucgucaggguuuuacugcugugaacagauaccaugaccaaggcaacucuuuugaggacauuuaacugggguuggcuuacagguucagagguucaguccauuaucaucaaggcaugguacaggaagaacugagaguuguacaucuucaucugaaggcuguuaggagaagacuggcauccaggcagcuagacugagggucuuaagucuaugcccacagagacauaccuacucuagaacugccacuccucaacacgguugcccgugacaugagcagaccuguaccucugaccucaaugacugagcgagaaaaaaggguugaagaagcuuuacacccagcccccguguccucuugucuuaguuugcuuuagcucuuuuccaccuugacagucuguggggugucucaggauuguucuccagcaucgcucacugucagacacugggccuucccacagcagucucugaugugaggacugaugaaguggaugucucgaguucugauccuccauccaggaugaggggcgcacagaccgacuuccaccaccaaauuuaagguugccagaacagauguguguguguguguguguucuauuuccuguuacuagacccuccagucugcugucaccaaggccaauuguacuguccugacuuguuucguauuuggggcuucgggguuuucuucccaacaaagacuaagaauugcaguuuuacauuuuuuaaaaaguuuauguuuuguucuuugagccuccccccuacccccgaaaagacaggguuucacuguguaucccuggcuguccuagaacuugcaacucacuuuguagaccaggcuagccucaaacucacagagaugcuccugcuccugccuccugcaugguggguuuaaaguugugugccaccauggccccccucaccucuuucuugauuauugacaucauucccaucauuccucucuuucuuuccuaagaauuuagucuacacucugauaucgugacuuuuguuuuucauggguauugggggaauauauaaucaaccaucugaucgcaguaauacccaauaaaucucauaugccaccaugaguaacugagcuaccucuaauggugacagcauccacguggguaaauaggaaugaaaacugguguagccacuagggaagucgguguagguuccucaaaauacuaaaaauaacgacuacaugacuaagcuauucagcuccuacauauaaauacccaaaagacucuaagucaacguaccacagaaauauugcugguccaugccuauuucugacuauucucauuaccaaagaaauggaacaggauuauauauuaccagcagaugaauggauaaagaaaauacguauacguaugcacaaugaaguuuuaugaagccaugaaaacauuuuagaucaugcaggagauuggcagaaaaacaggugcaacuggagaucauuacauuaaguaaaaugagccagcuucagaaagacaaauaugccauuuuuuucucauauguacaauuucauucucuaucucucucucugccuuccucacugcaugugugucugaaaggggaccaugggaugagaggaagagaucucaaagcuaagcaagagaugaagggggacaaaagagaguaaugugaugcuaaugacagaagagcagaaccucuuagugggaggcaggggaccacuuccucgacaugagaguaggggcacuggaggagagggaucagaacacaguucaaugacauacauguaugaagauucuauaaggaaauaaaugcaugccuuugugugguaacuuaaaaaaauagaggagagaaaauuugccaauguuucagaagacuucagacuuuugagcaaugcugguaccaagucaaggaaaacaauugcagauagacugaagguaucuuguauugugagagguaugcgagccuuuuuaaauugggguggaagauuauggcuuagauugucaauaucuccuaaugucuacuaugaaaaaaauggccaaaguuugggcucuugugaagauucugaucucaugaauggacuaauuuauguuuggacucauggcuuagugaguucuaggaaaaaggccuauaaaagugagcucucucuauguuuucuggucaugaugugauagcuuugaucuguuauuuacuucccaccauagauguucugccucaucacuggccugugcacuagagccauccaaaugcugacuuuugccucugaaacuguaaacaaccccccucccccgaauagguaaaauuuaaagauuaagugaaggguuauaauauaaacaaauuaggguuuucuuagucaauuuugaaugagaagauauauuuuauuuucuaaaguaaauuuguuccaauuaauggauuuguccugcugacacaaguuacugauuuccugaggauuuugauaaaaauucuaguuuuuccacucuugaguauuaacuuuaaaucaucaaauuuuaauuauuuaaacauguagacuagauuccauuuuacuagaaacaaauuuauaaagguccagauagcaugagauauauugcagauggcuucuucuuugcaucugcaucccuucuugguugcucacaguuuuucacuuaguauuaagaagaauuagagcccuuuauccuuuccuugcucagcaccagaugucuaggaugccucuuagcaucaucuggaaggaaagcccccuucgcagcauugcaaagcagaauguggaaauuuacugacaucuuguggccaagucaguucuccgaguguuuucuguccacaucaaaggauuggcuuccuauuggucauccaacaaaaaaauacaucugucugaagguccugaaguuugugauaguuuugaaguccugucucaaagaguugcaaguuagcagcagagcacuugucggucugcauaugcacuccaacuccagcauagcaccacaaaacaagagaccccauguucugcuuuauuaaacaauuuuuauauuaauuaauuaauuaauuaauuaauuauauaaggggcuggugagauaguucagugguuaagagcacugauucaucuuccaaagguccugaguucaaaucccagcaaccacaugguggcucacaaccaucuguaaugagaucugauucccucuucuggugugucugaagacagcuauagugcacuuacauauaacaauaacuaaaucuuuuuuuaaaauuuaaaaauuaauuauguaaaauuuaaaauuguacguguguguguguguaggucagaggacagcuuucaggagugguuucuuucaaagugguaucugagauuacaaucaggucguggauccugacagcagacgucuuuuccugcuaaggcuucuugcuaccucucucccucccucaccuucccaaccccaagucuguuuugaaugauuggcccaugacaaggguugacaauggcugugaugacuuucccauccuggggcagaggagggaggggcugugggauagccacuugaggagacugggugggaggccccaugggaugccuacaaugaauuuuaguagcugagcucaugacuuagaaagcagauuuuaaucaucacuaaggagaagucacaggauucuugugggccaggcaggagaagggcauccaaucaguauguguuuucuauucugguguccagucucccuggcucugugugucuccugugcacccuggaaacuuuguauauugggugaggggauuuguaagugucuggcaauuaaaccuuugucuucuggaaguuagugaccuuuuccccuuuuccucuggaaguacuuuuuacaagauuuguaaguaagagcucuccauagucugcguaccgugaacacauugcagcgaaccuuccauacuucauuccucugcaaggcauaagacuuugccagguugcucagccgccacgaucaauuugccuucauucaucuuuuagacuuaauuugccaguucuaaaaaucuccuagucuuucucaauuuuagucuuuaaucuuucauguucugagcagaaagggucagaaagcuagccugucuucagccauggcugagagccuggcauccuuuucuucauacugcagugcagcuugauauaugguuagacaauagaggguugggcauucuugcaauacuuuagcagugcugaaaucugcagcaugguacgaaggaagcuaaaguuugaauguaaccacuuuauuuaaaggguuuuucuucuuuaauuuaaaugucaccgaacugaaguaaacauaauuuuguugaccauauucaugaauuaugaacauuauuauuauagaauuacuauagaugcaacaugcauugguagacucaugugauggucugaugugauaacuucauuucauacauuuacauauccuggucuguaugcauuugcauaaacaacagcaacaacaaauuccugccuugcucugauugaaggauuuccaggacuguugucugcuccugaaguuuguuuuaaguauguguauccuuuguuuguauuuuguauuaagaaguaaggaaaagaaccccuuauuguugagcauguugauauugucuucuuuauuuuuuuuuuccuucuugggaaccuaugaaacaaguuauucuuuuucuguaggguuuuuuuuuuuuuuuuuuguaaaccuuuugguuuguuuuauuuaaaaauggcuuuauaaaagggcuuuuguaaaaaaaaaaaaagaauugaaacuaaaugcucaugcaguuaggcaagcaagagcucuucuguagcauuguauccccuuucagacugcugcucucugggcuugucucagucccuccccauugauauuauucuggugagggauguugaagccagcgcugaaaugaaggucugcaaugcuacuuuaugucauucaagucugaaaaaaaaaaagccagaauuuugcacaucaaaaauaacuaugcugaauugcagaggaauugcuaacauuuuaaauauaaacuuuauagcccaacaaggauacaguaggguagguaaauuuuugggaugggggcagggaauuuuuaggaacuguaaauguuuaugcuuggcaaauaacuguuuaagaaaccugacuuuuuucgcuuaauggacuccuaaauaaucuuugcauuguuacuuacugaggagagaaaaagagagggagaggaaaagggagggggaaggguauggggagggggagagggagaaagggagagggagagagggaggggguagagggggagggagaggguaagggagagagggggagggggagagggagagggggagagggauagggagggggaagggagagagggagggggagagggagagagggagagagggagaggcacauauugcugaauauauuguuuuugcauaucauuccaagucaguugguauuagaaacagacagagcauccauccauugccccaggucaagaaaucugugcuucaugcaaaguccuuuuguuccauucacagaggccacaggaggcucaggagugcaagaccaucaucacccgcaaaggaaccaugugcuuggguggcaagauuauaauuuguuaauaugaucaauuauuccaguuaauggauuuucuuaugcagugcagaugagauagauccuuucauaguuuguacuguaaguauauuugauacauguuuuuaaaugggugaugacaaguaggguagagaauccuccaugugauuauagugauugcauuccgacuuggcuucagaacuuaaaacugccuggcuaauauaaucauaauauauaaguagacuuuguagguuaaugaugcugcuuguauuuuuuuuuuacacuuauguguaaauagguauuugcuuauauucugcugcaauuucagagaaaauuuaucuuggcaauuuaaguguuuuuaauuaaaauauu

SEQ ID NO: 8288 - RNA, 6030 nt, Mus musculus
agagaguggaccagcagaguguggaagaagaucagagcacuggagagacugauccugaugaugcgucuguagugcaaccuaaaggacagguuaaugugaagagaagccugucugcucuuaacaccuccaaaguggaucauagugucccaagacaucggugcauguuaugcaacaaggaauuucuugguggccacauuguaaggcaugcccaggcucaucagaaaaaaggcaguuuugcaugugugauaugugguaggaaauuuaggaacagaggacuuaugcagaagcauuuaaaaaaucacguuaagaagauucagagacagcagauugcuacugcacaacaggaugauccagaagucaucacuuuggaagaaauaaaugguuccaaaucuuuaauuuccuuugaaaaugggaauucaaauacuaagggcuuggaaauagagacauugacggcuuccagugagagaaacaaagaggucauccgugaacacauggcugaguucauuaaaauucccauugcuauaccagagaaugcuauagaaaacauuauugaaaauggcaaaccagaugcuucuuucaauaauaucucagaaucuuuaccucagugugaugaugacuaugaagaggaagagaaugaagaugauuaugaagaugauuaugauuugaaucaagaaacaucagugcuucacaaaaucaauggaacugugugccauccaaaagauguauaugcuacagaccaagaaggcaacuucaaguguccugcucuuggcuguguaaggauauuuaaaagaauuggguuccuaaauaugcaugcaaggacugugcauccaacugauuuaaaugugcggcaaacuguaaugaaguggaguaaaggaaagugcaaauuuugccaaaggcaguuugaggauucucaacauuuuauagaucaccuuaauagacacagcuauccaaauguguacuucuguuugcauuucaauugcaaugagucauuuaagcugccauuucagcuugcccagcauacaaaaagucacaggauauuucaagcucaguguaguuuuccagaaugccaugagcuuuuugaagaucuuccucuguuauaugaacaugaagcccagcauuacuugagcaaaacaccagaaucaucugcacagcugagugaagugguuccuaaccaucaagaaauagacccauuuaguaaugagaaccaaacuauucaucauccaguuucuacuaguaagucaaggaaauauucuacagaaccaaagacauauauagacacuauggaaaagaaaacagacaguuuaguucauaauggaaaugaacauucugaugauacuguuucaaauauaagcuugauagaccaaaagaugccugccauagagccaaauccugaaaauacucauaguaccacugacuuagucaauggacacagugaaauagagcaaacaccauuaguuacaucagauccuacucugaaaauagauauaaacagaaacaggacagaaaaugguucuauuuuacccaguguugaaucacaagaacacagugcccugucaguaucucaggcaccauccaaaccaaaucuuacaagugaacagacuucauauggcuuaauuguaacaaagccauuugucagaccuuugccccccaguuaccuugaugaacgauaccuuaguaugccaaaacgcagaaaauuucucaccgauauuguagaugccuguucugaucaagauaacauguauaaaaaaccagugaaaagauuacgauguggcaaaugccugaccaccuacuguaaugcagaagcacuugaggcucaccuugcacaaaagaaaugucagacacucuuuggauuugauucagaugaugaaaguaagucuucuguguuuuuauuagcucuuucugcagaaauggaaagauacuaucacuacaucuauaauguauaucugugcaacuaaaaacauuaacauguguaacccacaggauaaagcacuauuuuacacauuuccuuuaaauccacaaccacuaugaagugagauuaauauucuucuuuuagcucaaccaacaaauaaauucacgaguaguuugcacaagcuuaugaacuuugggaagcgaggaaucgagauuuuucauucuuugcuccuacuuuuccuacuauacuauacuauacuauacuauacuuagguagguaggguuuuacugcugugaacagacaccaugaccaaggcaagucuuauaaaaaacaacauuuaauuggggcuggcuuacagguucagagguucaguccauuaccagcaaggugggagcauggcagcauccaggcaggcauggcacaggcagagcugagaguucuaugucuucauucaaaggcugcuaguggaagacugacuuucaggcaacuagggugaggaucuuaugcccacaccuacagugacacaccuacuccaaccagguuacaccuacuccaaccaggucacaccuccaaauggugccacucucugguccaagaauauacaaaccaucauauauacuguacuguacuauacuauacuauacaccauacuauacuauacuuuuucuacuacaaguggcuuuucuucauucaauguuucacauaauagaaauugaagaaauaauacuuuucaucagcaagauagaauaugaaacaaguaaaacuaaguuacugucaaaaauagaaguaaagagccuggggaaguggcucagcagauaaaauacuuccuguguaguggugaggacuggacuucagauccccagcacccauguaaaugcugggccagcauagugccuugucuguaacccgagcaugcaggaccucaguuagaaucccccagcaagcuagcuagcuauacuagcuagcagaaucuccgagcuuuggcuuccuacauaaacaugauuaucaagaaagauaaccaacaucaaccucuggucuccaaauggauuuggacacaugugcccccacucacaagcauucaugcacguguauguacacuacaaaacacauguacacacaugccagaaauguaaggcuugcuuuucuauuauagucuaugaaauuugaauuaagacuauuuuauuuuacaggugccugauaaugucucagaacgauuuguugaucaugcaguaguguuuaaaaaaagcacuacaagaaaaugcaucaucagcuugcuauuucccugauggccuuaauuuuagaguggucucggauuacuaaagaaaagacaaagcacauuuucuggaaugaacuugcagaggagaugugccggcuuagacuccaaaaggguuauaaaacucccaaaguaccaguuauccaugaaaccacacuuuaaaaaaguuuauggugauuaauagcagcauguucaguuuugcuuuaugugaaaacacauuuggguaacuagucagaaauacaaaccagcuauggccuuacugaagaaaggaaaaaguugauucauucuaagaugagauggaggggagcugguuuacaauaaacauguaaaacacucugaaaauggaauuuguuuucuuguccugcauauucauuaugucuucccuucuggucaacauauuuuaaagaaucauucauugcucuuuaguuugugauauaauuuagaagcugauacauagaaauaaaguuugauuuaugaccaugcugucuacuaacaauuguaacuuguuuuaggcaauuaaguagacaggucaaaguucagugaauggcaugccaccauugaaaaauuuaaaacaaaacaaaaacagugcuuggcuaauaagcucuugauaagaaccuucaaugccccacuuuuguaaagucagugauuuaaaggcagcagccuuaaguagacaagaaaagugccaucggauacuuugggggugguggugaaaagaaucuaagaccaucacauucuacauaguugaaggaaaacacugaauugaaaaaucuugaaugugaauaaugguaaaagcacacugggauauuccuaucuguacauauuaggacuuugcuagaugauucauaguaaaauccuuuauacauuaguaugaguuaucuaaguaugguccuaugaaaauaauuggcuuaaaaguaugucaguuaagaguccaagaguucauuuuauucaguuaggagaauuaauucaaaguuaagccauacuaacaugcuuucuucaucagugaugaauuuggccugcauaguaguuuuuauauuuaaggaaguacuuacaucaaaauuugcacaacaggaauacaguaacauauauuaaugcacuguuguucuuggugaccauucgaagaaagauuuuaacuuauuaaguuauuaaaacaaauauuuuaguuuaaaaaaucuuccagauauuucccaccugucuguuaugaaaaggaaaauacauaaagaucuccuuuaccugauaguauauaagucuaaacgagacaaaaacauacaaacacaaaggugaauucuuuaaacacauuaguaugccaauuaagugucccagcuacuccagcaugguuuuguguaaaucagacaaugucaucauacuacaaauuuuaggaacauucuugagguuaggaaaauaggacauuacuuucaggguggcauucagacuuuuaaaaacuauguuuuccaauaaugcucuaucagaauauuuauuuuuuuauuauuuaccaugggcauuugcaacuaugcaaugauggucacuaguccauuccgaucaaauugaaguuuguuuuaguuuuauuauguagccuacauuaggcuguguaauuuacgugaagauaacagauaaguacaacucauauguuuuaaauccuuuaaguucaacucaaaauguuuuccauauuucuugacacuaaaaauguaauaauugacuuuuaguucauauuaaaaguacaucuuguaauaaaaauccuguuuggaaacugguucauuugcacaaugaauuuuugggggaacauaauuucugcuuuguacacuuugcaguuaauaacauuuuaccauuuuuuaacuuuauuuuuuacagguuguaaccacugauauagauacaaauccauaaagcauuacauuuucuuaguuugugugcaaagauguguuaagcaaauuccgccuguuauuuuauuuugucuuuuaagcuuaauuugaagguuuucuuuuggcuuuuguugcuaggagaacauuuuccuauagauaaaauugguucauauauaaucaacacaaaaugucguguaaaauucuguuugaccacauuuuucuaaccucuuuauauacuucucaauuuuaccuguugaaagaauuugugcauucuauuuuguuuuuucuccaaagcauuuugcuuuuguguaaauccagcaguugugauuugugauucagaagggaaggaagcuuucauccacccacaugcuuuuccuucuccuugguuucuacucauguuuugaggauacacgaacuccuuuuaaauguuuguuuuacaauaauuauauguggucaaguaaggucaaggaaagugcagaucugaauccuugcugcucagacacagaagaugcacaggaaagaaucuccguggauaaggacacugguacuuugggcucuagccauauucauuuuuaaaaaaaaacaccaauauauaacaaacuacaauuuauaucauugaucugugauucuuuuccaaucacacugaacauuuagcuguacuuucauguuugguuuaauaguguaugaaugaaaagccuaaaagggaugauaguguuuauuuuuuaauuuauuugguacugucaaacaccuuuucagaaugagcaaaugcugcauuugcauuuugguauuguuaugugaaagauauuacagauucagcaagaaggaaaauuugugcuuccuuguugaacauuaaauuauuuuacuuugcauuuuauaaaaguacaaauuaaaacugagccauugaacugcaauaaaucaacaauagugucucauuucaagaaauuuuuuguauuguacauagauuuguucaauaaaacauuguccuuguugauaau

SEQ ID NO: 8289 - RNA, 44543 nt, Mus musculus
gaugacauggaaugggaaggugcagaggcauuuauuccagcuuccauuuuggaaacguuuagacuuaccacacugagagcucuugaaaguccuucauguuauauaaauaucaaccuaaggagcaaugagucgagcgaggaacuugcuuuauuaagcauccaaaaauguugagguuuaaguuguuugcagauuccaaauggcuuuuaccuuucuagaaucuacuuuuaaauuauuuugguguuuuaaacaauguaacuuuaacuuuagauuuuucuuacaaaauuaggacacuuuuccuuaccuuuccuucaggugcauccauguagaauuaauguuuuuguauaucuguuaaguuuuaucugcauuuuaaauuuaaauuggcaacauuuuucauaguaaugugcuuuuuguuuguuuguuuguuuuuuguuuuuuguuuuuugagacaggguuucucuguauagcccuggcuguccuggaauucacucuguagaccaggcuggccuggaacucagaaauccaccugccccugccucccaagugcugggaucaaaggcgugcgccaccaccacccggcaguaauuugcuuuuaaacucucuucuucaggugguugaagauuacgcuggacguuggcaggucccguugccacagcuucagguucuucagacugcacugugcuguuucacgucagccagcgcgucguucccagacgagugugagcacguacaguauguuuugaguagucuugcuguguaaguacucuuuaguucuuaucaacacauugugggcuuuaggcguuucuucugaggaagaacccuuuccuaauguggucccucaaaaccaaacugccauuucuccaaguggucuuggcaaauucaaaugauacgucucagaauaugcuaauugaggccacgauaguuagcagagauggaccuuaaagccuuccagaaagaggugaggagacucccaguuaaaaaaaaaaaugcuuguagauaacauugaaugaaaauuauaaacugggcauuuguauuuuuccuucuugcucuccuaggaguccauuaaaauaauaguaaaaaaguaaaagaaauacagagaaaagaaaauagguaaggaucaacagugauaacaagacagccagaaaggauauagaauaugcacgagcaaguucaaaccuaucuauuguuugcauuuggccucauuuuacacucucagcacaacacugggcugugaaauuauccacugccaaauuuaacaaaaguaccagguuaagucucuaagauuaacaucucaaguucuuacugauuuaggugugcauauacuuaguuauaaaguggguuuaaaaacaguguacugagccugacgugguggcccacgccuuugaucccagcacuugggaggcagaggcagguggauuucugaguucgaggccagccugguuuacagagugaguuccaggacagccagggcuacacagaggaacccugucuugaaaaaccaaccccccucucccccccaaaaaaaaccccaaaaaaccaaaaccuaccaaaaccaagccaaaccaguguacuguguacugaguaaaccaaguagaaggaagccuguguuccuugccugucuacaaguaggcagagacugugaguaugcaaggugugaauuguccauaggagcugcccuuauuuguuagcauaugggugaaagaguuacuuguagauuugguuuuuugucaggccauucagcaggcuuaaggguccugguuuguuuccuacuucuaaagaaauuaaaugauauuaguguagugaccuuugcauucucuuauugaaagauuccuccuggaauagcuagcuguugacuuaauuacucuaaaagguucauaaaucaaaaaaaacccaugcucauaggauucccaguuuucuauguguagucuuauuuuuaaauuacuaaugguuauuaaagaaucaucuacacauuucaagauugccuuaagugugaaagaauacaauggaaaaaacugaagaaaaaaaaaaguaacagaagaaugguguuaaugugagaaaccaaaacauuacaaccuuaaauuguauuacauuuucaagagagaguugagaaaacagguguaacauucaaaccacaugaugguuuauuaaaggaaauaauaagauaccaaagguaagguuaagauugagaaguaugguuaagggacugaagagauggcucagugguuaagaguacugguuguucuuccagaagacccagguucaauuccuaacauccucaugauggcuuacaacugucuguaacuaauuccaggggaucugacacucugacaccaaugcagauaaaaaacuaaaauuaaauuuuuaaaaaguauccuuaaaauguaaagcuagaaagcuagaccuguaaagguaaagaaauuaacuaggaaguaaaacaaaucaaaacaaaguugagugccuauaaagcuguccaugguggcauauauguguaauccuauuacuuagcagccugacacugaagaagcauaaauuugaagccauccuggacuacauagcaggaacgucuccugaagaaaaugaaaugcagauaugcauguaacauacagagagguuguacuuauguauuuaggaacauauguauauacuacuauacaggugcauauauaaauguauauguaacaauuaaugaaaaaagagacugaucuagaaugagcaaggaagguuaugugggagugaaauuauaacuucaaauauaaaaauaguaucaaaagaaaugcaaagaaaaaaggacauuguauucuuuaaacguuagcuauauaugcucaaaagugggagaaagaaauauaagauaucauguuuuuaaauguaaaaagggaaucuuaaaauuuucauuuuuuuaaaaaauauuuugugaugcuuaauggaaugaaaacuauauuuugacucuguuuauaacuacaaaaauucuuacucaaacuaguuaaguaaaaauaaaguaagagaauagcauuuguaugcguauggauguggauuuauuagguaucucaaccauaagaaagcaaacacuggaacuggaacuaauuccaggaucuucuaaauccaauacagcgaauuggcuuuuucuucccuagccuuaaucuuuuguuuuaauccuucuagaguuucaaagaguacuacauuaagcacagcucauuaacuuaaccagcucccucccuaccaaaaaacguauguuaggcagaugucaagcccaguuuggauauguguccccuacuuagguuaaucacuauggugaggaaaaggugguuaaaccuuuggcuuauucaagugauauucucaugucaucccauugaaccauaaaaauccugaagagauaagcacuucucucaagaaaugugucagguaguugcagaugggucuggcuagguaggaaaaaauuguugcccacaaucaaucagucagccaaucaaucagucagucaaucaaacaauauuuuuauauuuugaagccuuaugaaacauuuucaguauucucuacugauauuugaagaaaauaaaaguuaccuauguauguauguauguauguauguauguauuuauuuauuuaaaacuucagauuuuauuccccucccaguccacucuccaacuuuuccacaucccacaccuccuucccacccccugucuccacgaggauguccccaucccugccccaccugauuucuaaacucccuugggucuccagucucuugaggguuaggugcaucaucucugaaugaacacagacauggcaguucucuacuauauguguguugagcccucauaucagcugguguaugcugccugguuggugguccagugucagagagacuucggggguccauguuaauugagacugcaggguuacccuacuccucagcuucuuccagcuuuccccuaauuaaccacagaggucagcaguuucuguccauugguugggugcaaauaucugcaucugacucuuucaguugcuuguuggguauuucagagggcagucauguuaggucccuuuuugugaguacccuauagucucaguaauagggccuuggggccuccucuugagcuggaucccacuuugggccuguuccuggacuuccuuuuccucaggauccucuccauuuccauuccugcaguucuuucagacaggaacaguuaugggucagagaaugaggacauccuuaguugugcaggcaaauggauagaacuagaaaauauccugagagagguaaagguaacucaaucccaagaggacauacaugguauguauucacuaauaaguggguaucaagaaaaaaaaaaguacagaauacccaagauacaguccacagaacucaaaaaggucaacaagcugaagggcugaagggcccaagugaguaugccucagucccacuugggagggagaagaaagcaaccacaguggggagggagggaucugggagggaaggaucugggaaggaaagggaugggggggagaggagaacaugaucaguucuugggcggggaaaaggacugaagccuugagagucagccgaaagauuggaaacaggcaaccuagggagguaggagguugggggucccuccagaauguaccagagaccugggaggugagucucucaggacugucaccuuagaugaaaugccuuacauuguuggggagagggaaaaguuuuaaauaacuuuaaauauuaacuauauuauauuaaguauaauuacuuuuaaguauaaauauuauuuuuuugcaaagugcuauuauccucccccuacuucuuucuguaacaucauuguuaacuauaguguuguauuauaaaaaaguuuuaaaagcuuugaaaguacaaagcuuuuacaucaucaucaucauuaucaccauuauuaauuaauuaguuuugagacagaggcuuuauaugaagucccugcuguuuuggaacucacuguauagaccagguuggccuugaauccugccucugccucccaaguucugggauuuuauuguugagauuauaauauaguuacaucacuucccccucccuuuccucccuccaaggccucccaugggccucuucuuaaucuucaaauucaugaccuuucuucucauucauuauuguucuauaugugacuuuggcuuuccauugugaauggacacuaugaccaacguaacucuuaugaagggacacauuuaauuggagcuggcuuacaauuucagagguucaguucauugucaucaaucauggagggaagcauggcagcaucuaggcagacaugauacuggaagaacugagaguucuacaucuugaucaccaaagguagccagaagagugauucauucgcucugggaaaaguuugaguacuaggaacccucaaaguucgccuacacggugaacacuuccuccaacaggucacaccgccuaauaguagcacuuccaugggccuagaauagugaaacuaccacuauguauauaccuauguauuacuaaauacaucuuuauaagguacuuuucuguauguuuucagugaugacuauuuaguauuggauaagcaauugaugugcucuucccuggguaagacuauuuccuucccauucucagcauuucuuaguggccagaaguucuggccagcuuauggauuugggagcuagaagaaggguuuacauagugagaucuggugauauuggaaaguauaagguuaauuucaaacaugcaaaaucaaucauuuaaagacauagauacauuuauacaauuauaugaagaaauuaaaaacaaaaaccuucagaaucacauccguaggauagcugaauaagauuuuaagaauugcaggucagguaaccaauggagauuuggauaauaagucuuacucaaaaugauugcaaugaauucacaaacuuauccuguuauuauuuuccugguugccacauacuuagaauuuuccagaauuuccauauuguuucucugauauuuggacugagagcuaauuuguuugucaaugccaaacugaagccacugggguuucuacuaccagagaaaagagugaagcaaaaccaguauuuugaacuguauagauuauaggaacuguagagauuagugucaccagcauggacuugaauuacacaggacuggugguuguucucacaucauuuccuuuuaacucucauauguaucauguucaaaaauuagcaguguuuuggagaaugagaguugacuauccuaaacuuauucaaauacugaauacuauugcagucccuucuugagcauauugaugcaucucuuccuauaugguacugaucuguugagcaagccaaagucuauaaugguacccuuccuuaaugaccaccuagaagcaauuugcauucagcugauaaggccagcauuauaccuguauaguuuaaccuuuauuguucauucauucuccaugcuuuuguugaagauuucauaauccucucucuguucccccaaauaucacacugguccucuauauugaugaugacguuaugaugaguggaaaaagugagcacaagguagaacccacacuguuugggaaaguaaaugcaaaucacaaggugggaaaggacuacagacaacaguuuuuuaaaaaguagugcuguuuuuuuuuuuuuuuuuuuuuaaagaaagguuucuuuguuauuggaaauuaguagaagagagaacuguauuuugauacuaggagaaaaauagggaaagcaaaaugauuguuccauuaaagugguaguaacuuugugaggauaguauuuuacuuuuuaaaauaaccagaaaauucuucuagaaguccauaacuaaguuuauuaauuuauuuccuguaaagcucugugcuuuauucauaaggaaaaguuggaaacaaguaagucuuagucucaaaagucuugcagaguuuagagauacuacaucaccacuuauacuauuauguaauugcaauuuugagauauuugcaguguguaaggagaaggcauagcacaggcuuuaacuagucugggauguuagggaaaaacuaguuaacaauaauuaacacuugcugacuucuaaaagaaugcuaggaauaacuagauaaaacagcagaagagccuucuauagccacauacagguuccuagacaggaaggaagucagaauagucacagauuccauuauauuuaguuucuguuugaagacuucuuuuucguauuuuauaucauguauauauaacuuuuauucagcugaaaaaaacaugcauaugagcuuuguguuuaagauucuuuuuuauaugaauguaauuauauguauauuuuucuauauauaaauauguaagcugcuauguucucugguaguaacuuauauaugcccacauuuauuaaauuuugaaccuccuuuacuacaggaagacaggcuaucucuaggcugggcaauugaauuauggcuuuuaaagggauuuuuacagaaaauaaaaaugaauucuguuuuuauuaaccugaauauuuuucaaauguuuuggaaauuuagagucauguaaaaaaauuuuaaaucagcaaccacaauaugucuggcuuucccuggguuuauccucuuuguaagcuguauuuuauaaaaaaaaaaaaaaaagaaagaaaaaagaaaaacacacacacacacauauauguauguguguguguguguauauauacauauauaauauauauauguauaaucugaauuuaaguauaccuuauauucauuccugguaguuaaggaaacugaggauugagaagcuuggagacuugcaaauuucagguagcuugucaugaccagucuuuuccuuuuuucuuauaaauuuauuugacacuaauuccuuccucccuucccucuuuuuuucuuucuaauugaaaauauagucuuuucuccuacaauacuucccaaccaauuucccuucccucuacacuuuuccucagccucagauccucuccucucucaccccaaaaagaauaggucucuaagagacuacagccuaacaggacaaaacaaaauacaacacgauaaggcuaaagcucucauuauuggggauaaaaaagcaacccaauuggagcaggcaaaagagucagagacaugucugcucccacuguuaggaaccagcaagcuaacagcaauagcauauacucagaggaccuguugcagacccaugaggccagugcuuggcauuucagucucuaugaguccaugugagucuuacuuaguugauuuggugagccauguuuuccuggcaucuuccauuacuucuaacuccucguuuuuccuccucuucucugugguucccaaucuccaagaggagggaccaaauggagaucuucaauuuagacucucuuucugcauaaugucuggcuguggcucucugcauuugcuccuaucugcugcuggaggaagccucccugaugacaacuggacaaagaaccaaucugaguauagccguuauaacuaaaacucaauggccgcguaugacacugagaaugagaggaaaauacagauacuaauguuuuguuuuguuuuguuuuuuaagauuuauuuauuucuuauauguaaguauacuguagcuguccucagauacuccagaagagggcaucagauuucguuauggauuguugugagccaucaugugguugcugcgauuugaacucaggaccuucggaagagcaggcggcccucuuaaccacugagccaucuugccagcccccuaauguuguuuuccuaaccuuuuucuuacaaaaggaaaagcuguucaugaauuauaccauauuuuaucaucagguccuccaagauuaccagaagagugaacugguuaaacuaguagcauucauaugugcaauggcaaaaaauaaaaagcuuagcuucuuauucagaacagcaagacauuugggggcuauaccacagguuuacuaguagauugccaaucauuuuuauuuaucuuacuuuacuucaaacuugauuuuucuacuauauauuugugaugguuuguauauucuuagccuagagaguagcacuauuagguguggccuuguugaaaugggugugucacgguggguguggguuuaagacccucacccuaguguccuggaagucagucuuccacuaggagccuucagaugaagagguagaacucucagcucugccugcaucaugccuaccuagauguugcccuguucccaccuugaugauaauggacugaaccuguaagccagccccaauucaauguuguccuuuauaagacuugccuugcucauggagucugcucacagcaguaaaacccuaacuaagaaaauauuccagucaaguuuuauuugauucacuuaucacacacaguaauguggauaaaaguaucaaccaauuuggaaaucagcgucuauuauuuuauuguuaaauuuguguugguagaugcagaaagugauaagugaugaaauauccuauuccuaccugcugauugauggucaugagagaaaacaaaacucaugcucagcauaacuuagcuuuuaaaaacaaaucuuauuaauuuuaagguuuuuaaaauugguuauuuuauuuauuuacauuucaaauguuauccucguuccugguuuccccucugcaaacccucuaucccaucccccuucccucagcuucuaugagggugcucccuacccacgcacucacuccugccucaccacccugccucauuccccauauucuggggcauugagauuucauacaauauauugugaucauauucauccccacaccucucuuuguuuccugugacauccaccccaccugccuaccucagcuuacauucuaacugguuuaagucaaacgcuccacaauaaaggcacaaugcaagaaaagacaagaauguuuccagguauaaaauacuacagucucuacuguguuauaacaugaaacaaagcuuuacacauuuacacacguuuuaaagugugauuuucuuuuuuuaaauugagucaaaauaaucagucagaucagcuacagaucuauaaugacucuagugggaaaaauggacuugaacagacugcagauuugagcccauaaaugggcaacuuaaauauagaaauauaaaugcuagaaacuaaaaaagcacaguauuauacagaauggcuagugcuuuugauggacaaaaaaaaaaaaaaaaaaaaaaaaaaagacuugggacuguacuuuaagcaagcccgugguuugccuugaacaaaaaaauugaaugaaucuugaauguugacuaguggaaauuauucaauuuaaaaggcaagggagaaaaaagagcuuuaggagcuaugggaaaauauaaaacuauacauuauauauuuauuaaaaucccagaacagugguucacaacauuccuaaugcugugacccuuuaauacaguucuucacguuaugaucccccagaucauagaacuauuuaauugccacuucauaauugauauucugcuacuguaucaauuguaauguaaauauuugauaugcaggcuaucuuauaugugauccacagaggcgucacaaugauccauagguuguccuagaagaaacaucaaaaauaaaccggaagcaauuuugauaaaauucugaacacaaauuuucaaaacuaagaagagaaaugaauacacagauccagaacucagugcaaguaugauuucucaugcacacaugcauacaguuagugccucaacagccugguacucaaacugaaaaccagagaaguguuauuacuucaaaaauaaagaugccaaacauaaaauaaaacgcaucuuguaaguaaaacuauguaaggcagaacacaaugaaaugacaucuuaaaacaaugaaagaaaaggaaaucucgggcuggugagauggcucaguggguaagagcgcugacugcucuuccgaagguccugaguucaaaucccagcaaucacaugguggcucacaaccacucauaaugagaucugaugucuuuuuuuggugugucugaagaagcuacuguguacuuuuuuguaauaauaaaucuuugggccagagugagugggggucuaccagagugagcggaccugacuggagcaagcgggguuuacuagagcgagcagggguccuaaauucaauucccaacaaccagaugaaggcucacaacuaucuguauagcuacaguauguacucacauacauaaaauaaauauuuaaaaaaaagauuuuuaaaggaaaagaaaaagaaaucucugaacugaaauguauuucuaaguuggaagagaaauagucuucagccaaaaaugagaaguuaguaauaguucauuccugagaguccugaguuaggagaagcagggagagaggaagaaaguuaaaaccucuucagggagcaccaaaaugagcaaacauuggauaugcuaguaauaucugaacuauuauugaaauccacauguacuuuuaauuauaauuuugagccauaaagauauuucuauagcuagauuauacagaaucuuuuuugcauauuagcauugauuaauuuuucuguauuugaguuuuaguuugaacauuauccacauuuggaggguagaacaaaucauguguggguuuuuuguucauuuguuuguugguauuuuaaaguauucagcuguacagugauuugauaugcugcuaucuaacacuuggcuacugaguugagaugcuuuuaauauuuaacugauacugcuuuuuauuuaagagcucuuuaucuuuggccucauuaaucuauuuauucuuaugcuaaugugauacugaguuaauuacagaggcauuagagaauauaaaaucagcuaguccuuuacuauuuguuuuuguuuuauagguuccuuuccuuuucuauuucccccuuucaguccccucacccucacuuccccuccucccuucucuucuccccuccccuucugcuugaguuaggguuucuuuugcugcaaugacccaaaagcaaguuggggaggaaaguguuuauuugacuuacacuucuguauugcuguugaugaccaaaggaugucaggacaggaacucaugcagggcaggaaccugauguagaggguaugcaaaggugcugcuuacuggccuacucccguggcuugcucagcuugcuugcuuauagacccuggauccccagccugggguuggaaccacucacaaugcgcugggcccuccuccaucaauuacuaaguaagaaaaugccuuacaauuggaucuuauggaauuuuuauuuuucaaaugagguucccuucuuucagauaacucuaguuugaaugucaaguugacaugacuggcuagcacaccuccuguuaucccuucccuccuuccccucucauccucuccucuccuuucucuuuuccuuuccugagacaggcucucacuauguauccuugguuggccugaaacucaauauguagacuagguugcccuggaacucagaggagauccaucuacuuguuccucuggaaugcugggauuaauaaaaggugugugccaccaugcccaacuuuauaaucuuuuuuuuuucuuuuucuguuucuuuuucuuguuuuagauauuuagcuuuguaaucaaauucucucuaaauuuguaugguuaauguauguagguacauauaaggcccuaacuguuuucaagucucugaaggcucucuguaaaagaaaacauugauguuaaauagagauucauucauuuauuuauucauuuuaauuuuuauuuuaguuuuuaggaagauagcuuucucaauaacacaaaaguacuaaguggaacaggaaugcugauguagaagcugaaguuacccagaagaucuagcuaaguaaauuuauaaaagugguaguuagacagcuuucuuuaucuguaaagaauacuugaaaaggaucaacuuaaaaagaggguagguuuacguauuugcuuguggagcauauguauauuuguguacagagcugcccuuguguauagggcagaauuacccucugccuuaacccagaaguugguguuuuccuagauuggcagccagugagucccagggcuuccccugucuuuauacggggguguaugucauugcccuuggcuuuuauaugaaugcugagguucauaacucaggcucucauacuuggaaaggucacacuuuauucaaggaaccaucuuuucagccaccaaagguagguuuauuuuaguucaaaguuuuggagauucagucuaugguuauuccuauugggccuuuagaaacaccguacaggggcuggugagauggcucaauggguaagagcacccgacugcucuuccgaagguccggaguucaaaucccagcaaccacaugguggcucacaaccaucuguaacaagaucugaugcccucuucuggagugucugaagacagcuacaguguacuuacauauaauaaauaaauccuuuuuaaaaaaaaaaaauaaaagaaacaccguacaucuugucagaaauguucacagaugagaaagcugguuaccuuauggcagcaggaaacagaagacaggaagauaucagagacccuugauccccuucaagguacacaaacagugacuuaagaacuauuucaggauacucccaccaguaacaaaagcuggugaccaaguuuuuaucuauggccuuuggaagacuucaaacauguagccaugcuguuuaguuuaguaguuaagcuaaacagauguuuacuguagauggcacagcuguguauuacaagauaaugcaggauagcuucugaaacuguguugugugaccacacaugguuaauugaaugggaaaguugugaaaaguuagcgaacauaaaagucuguacacaugaaaugaccagaucuuaauucauacucaaguacaugauggguuuaggguguuucugguacuguucauuuguguugcauugcacaacuucagccuugguucuaaacacacaacucacaugccuuguacuuaacuacagugucaugcuacgcaguaccaaugagugcuaucuuaaacaucuuggcucagauucaaagcuauuucuuauaaauuucaauguuuuuacugcacauucaaaauucucuacauagagaaacauaaucaccuaauucuggaaaacacagacuuuuaauaguuuccgaucagugcucuauguaaguaccaaauuaguaguagauccuuguauuguauuguguuagaaugcuugauuguaaaaguugcuguuugagagcugacuugagucuuauaaagaaaugauaaaugaauuugggcuuaggauuaggucaggauugucagcaauuucugaaaggccucaaacaugcuucugucauuuuguacuaugaauuuauaugaagaaacauucucaacauugaugauuauaaaagcaaaauaucaaucaacucugaaaaacacagaacauauucuauguuauacaucguacaacauauaaauuucuauguaacuaaaguaauauauauauauuauauauuuucauuuuuagucagugguaaauuuaaauauauaaugaagaauuaagguaaauuuucuuauaauuauuaucaguaagugauuauaccuuuugugcauaccuauauauccagaaucauguaaaaauuuuucaagugaaaggagcaauaagaaaggaaaaaaaguugaaagaaguaccucuguaacucacagauagccaaagaaguuuguagcaguccagacugacucuuauuaguagaaccuugucuaccauuucugaaagaucuagguagggccuuuaagaauucuaccaaauaucuaucaagcuaguagaauaauggaacaucuguucacaacaggauuugcuggguucagucuuaaaaccuacugcuaaaagagaaaaagagaaagauucaaaauauauauguauggggagagaaagagaagagagagagagagagagagagagagagagagagagagagagagagagcaagcgcaauaaguagugacuuaaaauuucaugucuuauuuuuugacaauuuuauuuuauaaggcgauucuugucuugauccccugauggacccaggaaaauuauauuauaauagcaaugaaaaaacacuuguaaugcauaggaagauucuauaaaaaaagaauauguaugggaauuugaaauagauucuaauaaccgcauggauaacuuugaaaggcucaagacuucaguagaggaauuaacugaagauguauuagaaagauagaauuacgcacagagccuggggauacaaaugaauugcuauaaacaauuuuaaaauaggaaaaguuacaucuuauaaguacagugcuuuuuagauagcccuggguagguaccuaucaugucugcuuaggaaguuaacagguagauuucuugaauccaaauguuugagggcaacauagugggagggagccucuaacgagaagaagaaaaguggucuuugagauagaucucuuggagaagaugcuauuaaauauugcuaaguagucaucaaaaggcaaauacauugucuaaacucaguugauaagaaguuugagaguuucauuccaacuuuuacuaauaccauagauuuucuccucucuggugcuagggauugaaccuagggugguguuugugcuaggcaaggacucuagcacugagcugcaugcugaguucauuucaguuuuguaaaaguucuauuucacuuuggagcaucugaugcugucuggaucacguucaaaagacuggcucagaaaaggagaacccaaacuucauuguugucuuuuucuuuuucauuauuagaauauauucauucuacuaaauaaugggcuuuuccuaugagauuuuuauucacagauaagauuaaacugugacuguaucaucucaccaaucgucacuguucaccccuaguccccuuuccuuuuccagcucaucuuugacuccugacacuuaugcuuuauacuaaagagagauaguugcuuuuauuaguuucugaucucccuggaaaucuaccaaaauauaaauauuguauguuggugaguacacaaaguuucccuugauguaugacauguacacucuaggauuuccuguagauguuuaaaaccccagauagcaaggagcuccacauacaguuuuucuccuacuuauuaucauaugaugccaagcuugaucugacauauuuuagucucuuguugucuauuuugcaucauuacuuuuugugcuuuguaagucguuuuuguauuuucagacauuauuucauguauuccaggcuggcuucaaacuuggcgugugacuaaaaaugauguugaacuucuggucuuuuugucacuugccaggcucugggauuaaaaacauguaccaauauaccucuuucugugcugugcuagagaaugaacucggggcuuugcauaugaaaacugagcuaaauuccuagcccuuuaaugagcuuuuaaaaaucaaguauuuauaaguaaaauauuugauacuaaagagagagauuauaacuugguagucuuuuaaaauagaacaaagccacaaaucaaugaaaauuauauauauauuuuuuuccuuucaggaguuucuuugaguugcuccuauucuuuggaagagaugaguuuuaugaagaacccuuaaaggauauucuuggcucauuccagguaaaauaguucacuauuuuauauuuuauacacgaagaaaucaguuugauucucucucuaaaaauaguuuaucauauuaacuuuuugcuuaaaaguuguuauggccacuacagugacaguuuuaaagauuccccuauauuggcagguaaagaaaaaucaugaagucaauuuuaacugaauucccaagcggcuucuauccuggauucuaaugugguugccuaaagaaccuaagcaugugugggaacauagugccuuucccugucuacagcguccccaggugaagaagcagucuugcccuagaagcaagcuccuugcccuauguuucuuuuuguuuugcuaucugcugauuuucccaucucauggaaccucugcagguuguuguucuuguuaagaaacaaaucuagacaagaaugucaaagacaugagauagcucaguugguaaaaugccugcucucaaaagcauuaggauuugaguuuggcuuccaguacccauaaaacucauuagggguacuuguggagggagaaaaccaacgcccaaggggguuauuuucuuucuuuuuuuuuuuuuuaaaagauuuauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagccccuauuuucuuaaugcuacauguguguuuacauauguacauaaaauaaauuauuguagaaaaagauccagacauagauuuccacuucugcaacugucaugcugaggaggugguaaugggcagaugcuagcagcucacuggcucuaguugagcugcauugagaagcuccagguucaguuaaaagacugucgcaaaaauaagguggagagcaauugaggaagaugcccaccaucaaucucuggcuaccacacucaugaacacacuuccuugugcaccuguauacacuugcacacaugcauguuauacauacaaugcacaaaaaagacugauaacauuucaagaccucuucuauacaucuaaaauaguuugguucuuuuagucauuucuuuaggaacaacacguaguacacuauucacucaugucuucucaguguuaucagcacuucucuggguuggaauaaaacacagcaaaguugggacauuccaggggcugaccugcagccugucauauagaacauuacuauaguauuaaaggcuuauagcuaaucgggaguuuggcuguauuauaaaaauuaugaaauaucuagcauucuacuguguccauucuuaauucaacaaaauagaucaaaaaaaccuguuuucuaauaucagcccuugguaggcagaagcaggcggcucucuaaguuugaaaccagcuuuaucuucuuagugcuuucuguaucagccagagcuauagagugaaacccuuucucaaaaauauguaaauagaaaauaucaccaaaucaaagcaaaacuguuuguaugaaauucauaaucuacuuagauuacauauucaaguuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggauaaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguauaagcuugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggauuccugugugggcccuugcgggugucaggcgacucagcuggcaagguagccggggcucgaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcuggcaagguagcccggggcucgagucucgagucgagcggaagggacuugugccccagaucaggcccggguagccugcuucccuauguaccgcagucucaaguucagcgcgauuggauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacuuugcuggcaagguagcccggggaucgagucucgagucgagcggaagggacuugugccccagaucaggcccggguagccugcuucccuauguaccgcagucucgaguuccgcgcgauuggauuggggcaggcacugugauccacucaccagaggucuuagggucccguggggaguccuguguggacccuugcggguguugggcaagacucugcuggcaagguagcccggggcucgagucacgagucgagcggaagggccauauucaaguuuuuaaacacuuauuuuauguuuaacuuugucuuugacacucguuggcaauguccuugucuuaguuaguguauuagucaggguucucuagagucacagaacuuauggauagucucuauauagucaaggaauuuauugaugacuuacagucugcaguccaauucccaacagugguucaguaguagcugugacugggaguccaaggaucuagcaguuacucagucccacacggcaagcaggcgaaggagugagaguacaacucccuucuuccaguguuuuuauauggucuccagcagaagguguagcccagauuaaaggugugugccaccacaccuuuaaucccagaugaccuugaacccugagaugucccugucuucaagaucuccauaccaagauccaggucagaaacuucuaucucccagccuccagauuagggucacuggugacccuuccaauucuggacuguaguucauuucaaauauagucaaguugacaaccaggaacagcacuacaguuagguuuuaaugcuguaaagagacgccgugauuacaaccacucaaagcaaaacauuucauuggggcuggcuuacaguuucagggauuuaauccguuauugucauggugggaaacauggugggugcaggcacacauggggcuggagaaggaaccgagagaucuaggucuuuauccucaggcugcagaagagaacugagacccagguccuccaucuaggccacaccuaagagcuccugcgacgauuuucuuucuugaaguucuuuacucaggagguguucuuugagugccacacuguuuucaccacuaugcuccaugaaacaacaguaaguagaauagugcgcuccuguaauugugacagaaagacaacaagacuuuaaagugacuguuuuggaaagcaguggcugccuuagagcagauagaagcuagagaaugcugcugcaaggguacuggagaaggacaugucagugauaaaggaaguguuuguugacgauguccuagaggugaaaguugagcacugauaaugggaaccaucuaagugaagacacugaaagauuuuuuaaaauuuguuuuauuaaaguauauuuuuaaaguuuuguauaugguauauaugaguggcuaugucugcaugcauauuuuuccaacuccagcuaagguuaucuuuuugcuuaaaaugcauguaaacauuugugaagagacauaccuguauuucuucucuugugaacagaagugucuuaguuaggguuuuacugcugugaacagacaccaugaccaaggcaagucuuauaaaaagcaacauuuacuucgggcuggcuuacagguucagagguucaguccauuaccaucaaggugggagcauggcagcauccaggcaggcauggcacaggcagagcugagaguucuaugucuucauccaaaggcugcuaguggaagacugacuuccaggcaacuagggcgaggaucuuaagcccacacccacagugauacaccuaccccaaccaggucacaccuccaaauggugccacucccuggcccaagaauauacaaaccaucacaagaaguaaucaguuacugaaaauuccccacaauauacucauguguacaugcacuuucugucuuuaaucccuucaauaucucuaauucuggcugaaauagaaagcccauccucaugaccgccuucucccuaccaguuuaaaaaucucuucugccaggcaggcauggcggcacaugccuuuaaucccagaacuugggaggcagaggcagguggaucucuaugaguucgagcccauccuagucuacagagguaauuacaggacaaccaggccauuaaacagagaaacccuauuuagggaaaaacaaaacaaaaauaaaacaaaagaauaaauaaaaaucucuuuuuccauuucugcaauuuuggcuucuuuguaguuugaacuuauuugaagcuuuguagguuuaguuuugcacuguguaauacuggcuagccuagaauguaccauguaucccaggcugaccuugacuuuggggcaauguaacaccuuugugccagucucccaaauauuagaauuagaggaaugggucauuacacauagcuuauugagccuucuaacucauagaagcuuuaaaaccuuuggguuccauuuuagcuuuacauggugaaugaacuuucauuuucuguucugaguuacugcuguuaguauuccccaggcuucuuaccuuugggaucuagcaaaugucaguaggcauucuuauucuguauaccucuauaaacgcuuguacuugcaaagcccggaaagcuuccaguuuuugacugauuauugguaauaauaguuauaaucuaauguagccuuuaauuauuuuaaauauauuguccuaguaaaaguccuguuucccugaguaucucaccucuguccauauuuuguagugucauacaaaauauguaaauauguagguuuacaguuguguuuuuucucuuccacauuaaaugggacaaauucuguugcuaauaucuuaaugcauauuagauuaucugagagcagaguuaauucagauuaugauuuaggaguuaaaggugggaccugguggucggcuuucuaacaaccuccuagauuauauugaugcuacuaaucccuagaucuguauuugauuacauuuaugucaccuauuacaugacaaaugccaguuuucccuagaugggguacagacuacagaccaaagaaaugauuucaaaucuagcugggugaguuuuggggguuuaaugaaugaugccucaccagaguugcuucacuagaguucacuguacaguguugaggcagcuccaguggaguccccgcuucccaacaaucguuuacugcuaauauagccuccuuccuuugagagggcaaaggguuaccagaggaaagagcuccagucauccagauagaguuucccgugugaaacuacaaauaauccaguuuuauaguucacucuaccucaugcuagacaaacuacauauuuuaguuaauaguuuccucacuugcuggcaaaaugccacugacacuguguucuucagacagguagugacuaaaaccuaguuuuuaaacuuauucuuuucuuucaugaauuucugucuaccuaaaauuggaguuucucaaauauaaguuguaaacuuuguuuaaaauuuccugaauaaauuagagggaaucuuuauuuuuuuauuuuuugaguuuaucauaugaggauaucaguuccauaucuccuccaaguucuucuguguuccugcaauucucuuucaaauucauugacucaccaucaucaucaucauuuuuauauaguagaaacagcccuacagaauauauuuagguuugcugagaugcacauguguuuggggcuaacugcuugguuguaucauaaugcaugucuuguuuaaaucauuacuguugagauauugugguuguagcuucgcugucaugccuaaccaacaguaucuuacagcaggcaucccugcccuggggcucuuagagucuuuccaucucuuuuuuucuacagugcucucugaucauuagguguaggagaugaguuagugguguguaccccacaaucauuuauuuucugccuuuuuaaccaguuguggauuucuguaauauucucuaucugcugcaaaagauguuucuuugaugaguugagagcuaauuuaucugcguguagaaagauaaguauuuagacugcaguuagaaauuauauugguuuaggaaaauaacagucauccauucuccuuuagaaucuuugacuucuccagucacgggauguuuauuugaccaggcauauauuccuuucuauuaaguggaccuuacauuaaacuaagugucuguugauuuccccaagaugaaagugugacuauugaaccacugaggauaucugcuaggccuguugauguugaaggaaccuuuauuuuuuuauggccaaauacagcacauaauaauuucugucuuaguuuugaguuccaguaguuuuucuuuaccuuuacauauuauguauuucucauaggaugcacuuaccucuucaucauacagauuaauaccuaauuaaaugacaaacuguacaaugaugaaaaaaauaauugugcauucuggaugagggccagucuuagaguuuuacugcugugaacagauaccaugacuaaggcaacucuuacaagagacaacauuuaaguggggcuggcuuacagguucagagguucaguccaaugucaucaaggugggagcauggcagcaucuaggcaggcaugaugcaugagaagcugugggaggguucuacaucuucaucugaaggcugccagaagauuggcccccacaugguuaggaggaaggucccauugcccacucccacaguaacacacuuccucuaacaaggccauacuuccuccuaguuaaauaccacuuccugagccaagcauauucaaucagccacagggucuuaagcaaacuacucagacaagaaacuagaugugggugcuugucugggaaggcaguuaacuacaacaaaaaacaaauuacuguaaagaagcaaucccuaaaguuguuuuaaaauucauacuuauacuuaugacuaugcuguucaacuuuucaauuuucagaguuaagaauguugcaaauuaagaacccauguugaacaaacuagauaucacaagggagaaaaaucaggcaggcagugaacuccucuauuguaacaaauuacagaauuaucaaugaccaugguuuauuucaaggguaaauagauuuaguaaggcauuaaccaagcugauagaauaugagaaagggcaacagaaacaaauaauccaaauaccuggaaaaccaacuauaugucuuuuaugcauacugaucaaacaauucacagauauguucauuaaagaauauauaaugacuaaucaaauaagucauagaaaauuuuaaaaauuguuauuauaguuaguguaaauauucuguaaucuccaguuauucuggaaaaaugaaacagaaggugagaggggugcauacagcggugaagaacuaaaagcuuggguuugguuauugaaugcauggggaucaggaagaggaagaaucgcuguuugaggaaucuagguugaagcaacugccguguccuuucuagaagcaguaaugauugagugaagaacagaacguaggaaaauauaacuuuugcucuagauauguugcaucuagaugcuuagagaauauuuauauuucaaguuuuauuuuccuagguauuuuuguuuuuguuuauaauuuaaggucacucuuucucauugguacaucaaguacuuguuucuccuaaaaccagagacuuuccauuaaagccucaaaaaaccuagcuaugguccauagguaguguacuuugaaaaauuauccuaaagauucaauuuggcaaaguucuacugcugguguucaaaacauucuucaugauggugaucauggugguuggaauggcaaaugucccccauaaacucacauaguccccagcuaguggcacuauuuugugggcgaggcuaugggaccauuagaagguguaguguuguuaaaggaaguaccuuucugggggugugguauuggggauguacagccucgcccuacuuccaguuugcucugucuguuuucuacaugugguugaagaugugaucucucagcuuccugcuuagguuguuuguugccaugccucccccacaauuaugaacccucccuccggaaccguaagucaaguaaccuuucuuuuacaaguuacuuuuguccaugguguuuuauugcagcaacaauaacuaguauaguggugucuuagucacgauuucuauuccugcacaaacaucaugaccaagaagcaaguuggggaggaaaggguuuauucagcuuacacuuccauaccaaggaagucaggacuggaacuuaagcaggucaggaagcaggagcugaugcagaggccauggagggauauucuuuacuggcuuuccucaccuggcuugcucagccugcucucuuauagaaccaagacuaccagccagagauggucccacccacaaggggccuuucccccuugaucacuaauugaaaaaaugccuuacagcuggaucucauggaggcauuuccccaacugaagcuccuuucucugugauaacuccagcugugucaaguugacacacaaccagccaguacaagugguuaaaagaauacaacucuauuauauuuauagaagauacuuugugaggagcaguuuucuuucuuuuuuccccucauuuauuuauucacuuuacauccuggcuguugcucccacacacacacaguccuucucccccacagccccucucuucuucuaaggggguggaggcuccccuugggugucuccccaacuguggcacaucaagucucugcagggcuaggugcauccucucccacugaggccagacaaggcagcccagccaggguaacagauuccacagacaggcaacagcuuuaaggauagccccugcucccugcuccaauugcuagggaacccaaaugaagaccaagcuguauacccacuauauauguauguauguauguguauauauauacauacacauacauacacacacacacacacacacacacacacacacgugggauuaagugggacuacccuguauauguucuuugauuggugguucagucucugagagcucccaaagggcucagguuaguucacucuguuggucuuccuuuggaguuccuauccccuucgggcugcaguccuugccccaacccuuccauaagaguccuugagcucuguccaguguuuggaugucugcauguguuucagagaacaggugugcuaggcucuugucugcaugcauaaaagaguaucacuaauagugucagggauugguucuuacccaugggauggauggguuucaacuugguccaguuauugguuggccauucccucugucucugcucuaucuccuggaucuccuuuuguuguuuuauugcuguagcuagaacuucaagcauuauaauagggagaauguggguagccugguguuagcccucauuuccguggaaaugcuuuaaguuucugauuuuguuugauguugaauauuggcuuucugcauauugcuuuuauuaugcugagguuugcacuuguaucccugaucucucccaguuuuaacauugaaaugguauuauauuuuggcaaaggcuuuaucuaaugagauaauuacaugauuuauuuucuuuuucaguuuguugauaugauagauuacauugauuuuguguguguguguguguguguguguguguauugaaccaacccagcaucccugguaugaagcuuacaaggugcaugauguuucugauguguucuuggauucaauuugagguuuuuuuuuuuuuuuuuuuuuuuccaucaauguucauaagagagaucagucugaagaguucuuuuuugguugagauuaaggaauuugcccuguugguggcagguggcacagggggcagcaugaccucuuauucuccagacugcaugugcuuauucugauaaauuggauuuuguguguauuucuuuaugugggaaccuguguucaaguaaaucuuacauacauaucuuaaaacuucagguuuuguauuauauuaggguuagaauaguaagaauaacacauugucugagagcugaauuaauucauugcuuauuuaaaacauacagaaauugugaugcucaguuuaaaauucuuuauaccaauuauacaaagaguuuuccugaaaucuguugauuucaagauuucuguaauuuuuuucccucaaauuuggugguauguuguuuauguaugugguauauauacuucuuagagugaggauguguaugccggccagugaguuucuguccucaacaagguggaaacaggcaugucugauuuuuauguguugguacuuaggauucaaaccaagguccuccuguuuauauagcaaguaguaugacucacugagucaucuccccagaccagaauaaacuccuaauuaucuaaagaaaguaaaauaauaauauucaaaauccucaucuuaaugugauaauuaagaguggauugguauagauuuuaauacugaaaugacauuaaaucuguuguggauugaaguagauaauaaagacuucuugauuagugguaaugugcaaagacaacacauuaauuaacuaauuaauugaucaaccaaucaaucaauuacuugacuuaguggaugguuuuggauaacaccguggaauuuguagaaggaagagugacaugagaaaagggcacagguaaaauacaaggugaauuuaaaguguuucucggacagggauggaaagaaggaugugucacauguaauaguaaugguccagguaggcggggccuuaaauuucuaauuaugaugagcuaacgaaggggucaaacguggauguaaaaagauccaaauacugaaauacagcuuuauagacagauguggacuuuaaaauggcaaccaguuuaggaaugaaaaaaaucuaauuuuagaacaaaacauuaauuccacuuuacaauggauucugaaagaaaagugaguagaguuguuugcuucauacccuuggcaaaggcacaguguugaaaggaauuagcuaaagggaguauaauaagcccacuucaguaagcagcaguacuaagcagugaagguagaggaguguguugauguccauccaugcauuguuucagaaacauucuaaaaacaugccuaaugcuucaggagagaaauucuauagugcaagagguucuaggcuaacuuuggggguguuaguuugaauaucaugcgaaagccauuaauacuaucuaaagaaagcaacuauuuuuauacuuaauuauucucguuuauucuguuuuuuuaaaaaguagcccacacugaaaggauucguuuucauuaccuauauaagaguuauuuuccuuaguaguacucuccaaaaucuaauauauugacaaaagaaacacacacagacauaccagaauaaucauacugauggguuacacauuaaaugagaaagaaauaguuuaaaauguauccuaccaguuggagaguauauauuguaauccuagccaggguagaagaaguacacccucacgugcauguugcaguaaaucuccaucccaaauaugcccggcaaugaaaacaugacucaguuaauaugaauacaugcugugcaccuagauugggcagaucuaccacuacacuaccaucuuccacauccaaucuaggugcacagcauguauucaucuuagaacuugccguuucuccacgccaugugcuucugcuccgcuuuucuucuuccuccuucucugccuccucuccuuuucccauuuuuccuuaucucuucccaccuucugcucuaccuuccgaaucaucagcucuccuuuauuuuacaaauuaaggugcauagcagguuuacaggaaaucaccaagugcugacucauuuccuaauucgcagguacagacaggagaacagaauuaacauuaaauauaauuagccccagggcuagccacaacacguugauauccucacuucccaaacuuucuugaguuugguaguuguuaaagguugucagagcuuucucugagaagcuuucaauggucucaauuagggacuuuagagcccccuguuuucuuuuuaaacuaaauuucuacccuuuuaaagaaaauuuauaggauacacuaacauagacugagucgaguucuaaauaccucagcauaauuggcaauauaacuuguaauucauauguauuuacacauaugauacccccacguacccuuuaauaauaaauguuacagcaugcugauaagaaaaugcacauuuuuuaauacucaggcaucuagguacccuaaaauauauuauuuauacauaccacaugugcacguucuuugaaaauguuaaaauauucuaagaaccgaaagcucaccuuuagugagcacuuacuaugugcaaaguacugucccaagagccuucuaguacuuacuguuauuauuuaaucuucacaacaaucuuaugaagugggcucucgaaauuaacuguuagagcacagagagguuaaguaacuugcccacucuaggauuuauuuuuauacuuaguuguuuuaauuuggagacacccuucaaggccauuuaggagauaacuuauucuaacaguuggacauaaugguugucuucuuugaugaaauaauuaugugugugugaaauaacuauauauguacaaacacagacacacaaacaacuguacaauugugacuucuuuggugugauguacuccuaguuccuguuacuugggagccuaagggaggacugauuaaguccagcaaauugaaaccaaucuuuggaacagggacaccucauuugaaauucuuguuuuucaguuucucccaucuuguucuuuauuaaauaaaccccuuuuuucucuuaagcaauaaguuaaaaaaccaaccaaacaaaacuuagaauuaacuuuuaggucaaaaauauaauguucaaaugauauaaaaacaugauaguuuaauacaaguaaaguaauagccagugugaauuuguuaguugauaauucaucugauaagucaaauauuuuaaugccuuucaaaaugcuuaaacaguauuuauaagauguuacgauaucugucugccuccgguauuauuuuaagcacagaaaaaaaugacauuugugcuuuaauugcaauucagacaauauugaaauauauucagauacugcuaacuucauuaucaucuuuuuuguuaaggauucaaguucauuuuauuuauuuacugagucuuaguuuauuuuucaaaauuuuaacuuuccugaacaauuuuuaaaacucuuaguguauaaugaaccagaaagaagaguccaacagguacacaaauuguauaucuaaagcugguucaucaaacucaggaaauaaaaguaaaucaauuuaauuccuuuauuacuguuacaauauaaugaaauaucauuuaacauaaaauauagaagucagagagugcugauuaauuacuacuuacuuuaugaguacaucuguaucuacaaccugaugcaaacugcuccuguuacagguuugaugucuuuucuccgccuguuguuucuuuaucugcuaaucacaaaucuaauuuccaaacaaagggaagugaauguucaguuuugaaacuuauuacugugugguaaacuguggcauagguugaaggcagagcaggggcaugagucuccugugcuuagaguguacuucuaggcagcaccucccccuccccguaggcucuggccucucuuuguuaacaggaacuuaguuuuaaauuuuuauguaaacuuaacagaucauuuaauuuucagcuuuuuugcaaccuggcucuuucucuacaagugauucaccuguaggcuuuucccuuugguuacauuuuauccccguuuuaauggguuguuuuuuuuuucagugcaaucauguauaucuguguaauauuuaacauuaagacuauuuguuacuaaugggguuuuguuagccuacuuagguugcacugguacccuuuucuccuuuauaauugaauagcuaucauguggccaucagucacuuuauagauacugaugaucaaguaguuuuuaacuccuuuaaauuucacaaagccagaauaauuuuucucuccuaggaaugccagaaccaccuccgcagauauggaaaugugaaucuugaacuggugacucgaaucauuaaagaugguggcccaugggaagacccaguguugcaagcuguucuuaaagcccaaccggcaucucaggagauagguacuucaggagagucaacaccaaaaccauuucuuuuaugauuuggcccaaaguacuucuggauagcagcuuuguuacauuucuuucuaguagugguacuguggcuguugacauauuuacuggguauuacagggaguuuguuuuugacucuacaauuaugguuuuaaaauauguuuaaguaacuauacuuuuguuguuauuguuguuuuaaguucaaacccuaaaccacagaauauucacugcaucagaguucucugaaggcaggaacucugaauuuauuuuacccauuacuauguuaauauauucuugugccuauauucuauaguuaguccaaugcccuguacacaguuauugguuaauacagaugauuacugugugaauuguuguucacacaguacugugacugaaugaucacaugauaaaugaauaagugaauuucaaauaugauagaacagcauuucccaaucuaauacaauuuugugucauugccucauuacuuuaucuccuuugacaucaucuccuaccauacugaacuacacaguggacucuagagccaauauugacucagagccaauauuccuuauugaaguaggaggcuuuguucucuaauccaaccuguuaauauuaacccuuuagcuucccauauuauuaaaaauguccugaguucuaggauauauggauccccaaaacuuagcauauaagcuuaaccauaguauauaagcacaagaauauagaaaagucaaagagaacagacaagcucuccaacuugggaacagcuacuuagcauguguugaacauauaaagauagucccauuugcaacagguuaagacauggaguguguggagaagggacuaucaugcugggcuuaagaccaaaggagcacuauaccaagaguggagaacgcaaggcaaacaaggggaacugcugcuugauguguggauugggaagcacuuagagcaaaucaaaggcugagacaguuggaaaugaggagaaagacuugcuuuuuaaugaaaauuauaaagaguaaauaaauuacaggaaagauaagagccaucgugagaggaaacaaggaaauguggcuagagaaaauaggauggguaguagcaucaagcaagccacagagaagaaggcaggagcaagcaugaugggucagaagguaaaaaaggcacuugcuguacauguugguuaauugaguaauacacacaaagaauaauaacaauuuuuaaaauaauuuuuuuuuuuuuugguuuuucgagacaggguuucucuguagucuuggcuguccuggaacucacuuuguagaccaggcuggccucgaacucagaaauccgccugccucugccucccaagugcugggauuaaaggcgugcgccaccaccgcccggcuaaaauaauuuuuuaagaaggcaggagagaagaaaguuuauuaggcuuuuaaggaaguguuuacgcuuccuuaggcuagaacagagcuggugugaaggcugauggcuccuuaggugccuuuuauaacuacacuagcauuccucacuuuaggcaaaaguucucuagagccucauuaauauagaugccucuucucuggguaguagucguuacgguaaaguccauacugaaauagauucuugcauggacuccaagucacucuuuacucaccauaaaguaaacuguuuaaguccaaauaaaguauagucuaucaacacuucaguagccacuaaugaaauauaaauaauuaaaaauguuuggauuuaaaaagcauaaaauauagauccuacuuuugucguugccacuuacaauaucuuugucauugggcaagucauuuaaucucuaauaaaacaaauaguauaaaauaugucauaagauuguuguuagguuuaaauaaauuuacaguuaaauguguuuguauauuaugaaaaaaaucauaaauuaguaauuauccuuagugauguauaaacacauuagaccccaugacacaauuuugcauuaauuuuauuuaacauuuauuuauucaugauucagguuucucauuaacuuagcuuacauuucucaacaguuaaucugauuuaaugugguuuuaauguacuaguuuagcauucagucucuuauaauaaugaaaauacuggacuaccagaagcaaaaauguguaaucuuagacuagagguacauuuuagauuugcuauuugaaacauucuaauguaccaaugaacuaaaagaauaucuaauucuaauuuuuaaucuccuuuuuaaacuaagaagaaaucaacuagaauuucaugagcacuguuuugaaauuuuauuuucauuuaucagccaucauaaaugacuauucaaauauaaaaguuuuccuguggagcauguuauuuauauaaugaaauaugauguuuuaguuguaaaguuuaaaacaaaguuugaauacuuuuugagaguaauaauguuuucuuuuuaauauagugaacaaauacuuaaguucugaaaauccacuguucuuugaacuacgugccagauaccuaauugccugugaacgcauaccugaagcaauggcucuuauuaaaucuuguauaaaucacccugaaaucagcaaagacuuguacuuccaucaagcacucuucaccugucuguuuaugucaccuguagaagaucagcuauuccgugagguaccauuugcgacuuuuuccuauuaccauuuauccuuacuaaaaacaaaauaaaaccuuacuguuacugaauuguuuugcaguaauaacaaggauuuagagaucacauuaucucaguguauuuacuugucacuauuuuuuuaaguuuaugugacuuagaaucugauaguaacaaaugauugaguuaauauaauuuacuuacuaaacuuuugguaugauacagaaaaaaaccugagaaauauuaugauuuugucucuuaaagugcuaagaaguuaaaugcuuauguuuauuuuguuuuuuuucaauaaaaggacuucuuuccuacucugaauucuacuuacccauaggcauuaauggccuugcaaguacucauugugaaaugcagguguuaugcuguaaaacuauaaaaauauuucaauacaguauauaauuguaaaagaaacuagaaauguaucaguacuugcaaguaacuaaacagaaacugcaacuagaguauuauauguuuuugaugauaggaacugacucuucuuuucuucuuacagcauuuguugaaaacugacuguaagaguggaauugauaucaucuguaacacugaaaaagaaggcaagacuuugcuagccuuacagcucugugaauccuuucuuauuccacagcuccagaauggggacauguacuacauaugguaaguguuucugaugcauaauuugaaaugaaaaaaugguaaacuaaaggaguacugguuaguagaguuuggacuauauauuuuccuuacaguugucugaaaguguucaacuacuuuuuaaaaauagcauaguuuuauuguuuuuuaauuauguguguauguguguguguguguugauuuguuagugugaguguagaugcuauuggaggccagaagaggguaucagauccucuggagcuggaguugaugguguucgugagccauccaacauggauguuagcaacugaaauaggaucuuuuauaauagcaauacaaacucuuagcaacucgaccaucucuccagccccuacaauugcuuuuauguuuuuauuguuauacugaaaaaaauuuugggacagguauauauuuuguuuacuaaguccuacacuuagggggucccuugcaauuuaacaaagagacaagagagaaauuaaacuuuuaucagcuaagaauuaaaaaacaaaacuuuugaguacaaagaauguccauuuuaauaucuuauauuauuuuggaacaaguuaggaaaauaaacauguauacauuuguaauauauucauuuguaaaacauuaauuggauuauguaucuucugguuuccagcuaucauuuuguuuuaaaauguguuguagaguuaggccauauguucuuuaauauaauuggucuauuugcuuuuuuuaacccaucacccuuuuauaaaaucuccuuauuucuaauauucaccaccaucuuuuauguguauacuuuaccuuacuaaauuccucaagaggcuuccauauuuaggaauacaauagcuaugagauugucugaauggggcaauaguuuagcuauagaauaguucccuggcaucuaugaaaaaaacaguaacagaccaaaaauaaaauaaaauaccucagauuuucagcuaacaaaaagguauuaauuaaauguuauuucuugguaucuugaagguuauguagaaucuauguaggaagcuagugacuuauuaaacuugaguacuuaccaaacaguucacuagagaugucuuuaaagauagugaguaaagguaagcacacauuagcuuuuuuuuuuuuuaaaugucaguuacugucuccauaauacauuguguuacugaggagauagauguucgugaacuggaaaaugugauucauaaaauacauaagcaagccuaaccagcaccucaggaaauaggugugucggagacugaaaaccaaaaugacugugugaaguagcaaacacaauguuguuuccuaacuggaacaguuagagucauuuaaaaaaauuaauaauauagaauauuagagucaugaauuuuuaaacugaauaauguuuguuauucugucucgguccagaguacuuuuugauuacagaauuguuacauuucucucaaguggaguuguaucuacaugauguuacauguaaaacgaagaaagcccaauguccugugagcucaacuccacuugcaugucuaggcucucaagacauacauaguaaaucuauuuuggaaaaaacaaaguugccaccaaguaucuuaguaguuccaaauuaugcgcuuuaugugaguuuuagggucuaagggcagauuucuuuaugagauguauccuuaugcuuucaguuuaccugaaaagccacugccuguauuuguccuuguucauccuuggccguguauuaggaaagaaucuaccugugaaggcuuuaagugcucuauaaucugucuucucaaaaguauagcauguucacagaaaagcacaugaucuaaagcuaauagaaaggauacaguuuuaaaaucaguacuguauguuuaaauuuuaaaauuuuuguaccuuaguagaaagaaaauauucuaaaauauugguuucuaaauuugcaaguaguauguuuacuguucuaguuggcaauaggaccuagggaaaugaagccaaaauaaugaggcagacuaaacucuuauacagcuaacagcaaacuuuacucaauagagcaucagacaauuuauacugugaggauuaagaggaaucacaugagcaaaguguagaaucccaaaggcaagccacauguggaacacguggcaagaaaccguguuuuucuguagagguauauaaacaguagccaguugaaggaauaauggaaguaaacucacuccuauccacuacaccugcguaggacaugaaaacacauuucaagaacaauucgauguuucugaagacacugaagucaaaagacucaguuuucuuggcguuuucucaccagcacucagaguucucucuugacuccauucguggaugauauucugauguuauauacuaaagaucaaaguguauguuuuacaguuauaacaucaguacuaguauaugaaauuagaacugauuuaagucaacacuaugaauuucuuagguaugccagcauaucuuuagaaucauuacuaucagugcaagauuauguaggcuuuuuuuuucucuuuuaacuucuauuaaucucaaagguagcacggagagcauacacauuuuuaacuacuuuauguauauagccuugcuaggauaguauagaaccaggcaaaagaaaucaaugucuuuacuuauaucuugauauauguccuuuucucauuauagggaguugauuuuccuauggaguaaacuacagcuuaaaucuaauccuuccaaacaaguguuuguagaucaguguuaccagcuuuuaagaacagcaacuaaugugagagucauauuuccuuuuaugaaaaucauuaaagaugagguaaauauauuuauuuuucaguuuuuagauuuuaaugcugcauccucugugugucacaauccuuucucuucaucuucaaauauucaacauggcucauguagaaggaaaaacaaucuauuguuacuuaauuugggaauaauugcuuccauauauaucuuaugacuaggcaaauuuaucauuauaaauucuguuuuugaauacuaauuuacaaaugauccgauuauacuccuucauugucucagaaaacucuuucuugauaauaaaacuguauguaguuaaguggaaaugacaugcaacauacacagaugccauucugauucuuguucuggucaaauaaguauuaauuauuccaaccaguagaggcauaaaaucgacuucaguagaucaauaaaaaauucugcaguaaaagcuaauuaucauuaacagaaguaaaaaguuacugauuuucauacaauucccagcaagcuuauuauucuuauacuuuauuagauuuguauaaugccucuuucauaucugaguaaauguaaagcacuagcauauguaauaauagcaauaauaacaauaguaucaccaucauuauaaguacuagcuaguauaauagcauuugcacugauuuuaaaacacaauuacuuccuagcaucuguuugaaaugacaugcauuuacucuccgucagagaaugagaaugagcccuuaagggagacuagaguugaaagaaaauucgaaacaaaguuugcaaacauuuuacacuacagguauugggucuugucaaacuugagaauuaaauauaagaguaaaagcaaacauaauuauugaagagacuugauuugaaaauucuucccaaacuucagaauacuguuucaggaaguuuuccuuuuggaguuguauucaaauuuuuuucuuuuuucuuuucuuuuuucuuuuaaauuuauuuuuuacacuccauauuccauucccugcccucccccauccacccuccaacugcuccacaacccacaccuccuccccaacucuccugucuccacauggauguccccauccccccaccccaccugaccucuaaacucccuggggccuuaaguuucuuaagggauagguacauuaucucugaaugaacacagaaccggaaauccucuacuguauguguguugggggucucaaaucagcugguguaugcucucuguuuggugguccaguguuugagagaucucagggguccagaucaauugauacugcuggucuuccuacaggaucgcccuucuccucagcaucuuucagccuucccuaauucaacaacaggggucagcugcuucugucaauugguugggggcaaauaucugcaucugacucuuucagcugcuugcugggucuuucggagggcaguuaugauagaucccuuuuugugagugcuccauagccccaguaauaguguauuaaaaauuuuaaagcagauagcauaauaguuuuuaaguuauauuuaguaggaauauuuuuguuuuuccagguugaagaagaaggccuacaaauuuguguugagaucugugguugugcucuccagcuugaucuccaugaugauccugaaacuaaaugucuaauuuauaaaacaauugcacauuuuuugccaaaugaucua

SEQ ID NO: 8290 - RNA, 1062 nt, Mus musculus
uaauugucuguaguauucugggaagacacuuccugaucugagaaggguuuguuugguuguuugauugauuggugugguuuuuguuuucaugacguuucagcuguuguaucuauuagaacuauacaauuguuacaucuuguucuuucucuuuuggguccggugggggaguaucuagacacugaagagaaaguuugaauuucuuaggucaguugaauggaaauucaacccggaguaagugagauucagcguccucuuauucuacacaggcaauuucaucucagcaucucaguuaucccccuuccgcgcuugauacuauguugagacucgguggaauuuuauguauauuuuaugcuugcuggauuuagauaaaagauguaggggaaucuggaagaguuaaguuuauauauauauugcccuuguuuuaccugaccgaagcuacuuaaaccggguacuaaacugacuuuaaaaaaaaaacaaaaaaaaacaaaaaaaaacaaaaaaaacuacucauguuuaauuuuuaagguuaauuaauguauacauaaaauucacguuccauaaagugaguuagugguaauugugauacuuagcugagacaauuguucauuaggacacguuucuuccugguucaagucucaguuuguuuuucuugcugaacauaucacguuacugagugcccguccuguuucagcuaggcucugagaggauuacacgggcuaaguggcagcuucuguccgguggggcucagaguccucaaaucagauagguaaaaccccauaccggaggcgcugagacauugggcacucaccaugcgagggucacacaaaacauaagucuaggaaaguuacuacaccucauuucagcaggcgaguccgcucacaguguucccgggagacucugauaacaagaccggcauuguuaauuacagcaucguuaauuacggcuuggucgccagcgcaagcaaguaaacacggguuaguuagcaagagccuuugcuagcuggguauguuacaagaggcuugguggaaaacgcuaguucuuuguuaaggaugcaugaaaggg

SEQ ID NO: 8291 - RNA, 4389 nt, Mus musculus
ucucucucucucucuuuguuacugcagcacuuuuauuucuuuacacaaugacguguugcuggggccuaauguucucauugaacaguagaaaaccaaaauuugucauuucuuaaagaauugaguacaaaaaaccuuacaucaauuaaaaggaugaauacauuuacaggugucgaugcaaacguucccaccucaaggcgaguaacaaccgauggcggucaggagggaagaaaccagaacgcaaacuggguccuaaggcucggacuuucccacccuguuagacuggcaagaaggagugguaacugguucaggaacccuugccagccucgggaaauccuggaagucugcuguugguuaauaccuugcacagaucacuccguggugcucacagagauccaccaggcuggggcuuucucguccacagcgugcuuuccccaggccccaagugaccgagccacaugaacuaaggacuaaaucaagauaugcacaggguauuaaacauauaucaagggagcaguuaacuugaauacaaggucaaaacucagcaacaaguucuacguuccagugcugauaucagauacaagcuucaaggacaaauuucuuuucaaaggcuuauuccaguuucaugaggcuagcaugagguguguacauuugccagggcaaaucgauacuucaauaucagcucaugcagcagaugccuggcaccugcucaguccaucuagaagcauuugcgauggacgcugguggggccugacucaucauacuccugcuuguugauccacaucugcuggaagguggacagugaggccagaauggagccaccgauccagacugaguacuugcgcucagggggaguaaugaucuuaaucuucaucgugcugggugcuagggcugugaucuccuucugcauccugucagcaaugccuggguacauggugguaccaccagacagcacuguauuggcauacaggucuuugcggauauccacaucacacuucaugauggaguugaagguggucucauggauaccacaggacuccaugcccaggaaggaaggcuggaagagugccuccggacaccggaaccgcucauugccgauggugaucaccugcccgucgggcagcucauaacucuucuccaaggaggacgaugaugcagcaguagccauuucuugcucaaaauccagggcaacauagcacaacuucuccuuuauguaaugaacaauuucccucucagcaguggugguaaagcuguagccccauucagucaggaucuucaugagguagucugucagguccccgccagccagguccagacgcaaaauggcguggggaagggcguagcccucauagaugggcacugugugugugaccccaucaccagaguccaugacaaugccaguggugcgcccagaugcauacaaggacagcaccgccugaauggccacguacaugccugggguauugaagguuucaaacauuaucugcgucaucuucucucuguuagcuuugggguucaggggggccucggucagaagcaccgggugcuccucaggagccacacgcagcucauuguagaagguguggugccagaucuucuccaugucgucccaguuggugacaaugccguguucgauaggguacuuuagagucaggauaccccucuugcucugggcuucgucacccacguacgagucuuucuggcccaugcccaccaugacgcccggugucgggggcgcccuacgauggaagggaacacggcccuaggggcgucguugccagcaaagccggcuuugcacaugccggagccauugucaaugacgagugaagccggcggcggagugugagcaaaacaagucucuuaaguaacuugaaauuaccauuuuuaguuauugugaaaaccaaaauguucaugaagaaaacuggaguauucaaaguggaugaggaagaaaugaaaagaauguuucaugucacuaaguacaguaggaaguagcuuucgaguagugucauuugaucugugcuuugaagggcacuuuugcaaggaaguggaaguaauuucacaaggaaaacaaaggcugaaaagcaauguucacaaugucagggcuggggagagaggaaccagacgagagccgacaucguccuuuaggaccauggaggauaguaagagaugagauuuucuaaguguucuuuucuuauuaauaccaagacuaaaagccacagcagaguauauauguacuggaaggagccauggagagacuauacuacuuucuucaaaaaauuuauauguuuauauaauuuacuaguguuuuaaccuuuguaaagcuaaaaucuaggcuuccuguuuguuuguuuguuuguuuguuuguuuuugcuuuaaucaucaagauucuccuuucaaaugaaaauuucuuuuuaaccauuuaauagauaaaaccaaaaccauaauccuggaacagaggggaacucaucucugaguucaucgacagugaggauuaauacugggguacacgugguuaugguuuucaaugaugaauaaguuagacgaugccaagauuguagaaguguugagugggagaauguugcaaggaggacgucuggugagagcccacagggguggcuugguaaguaaggcugcugggccuuugugcuuugcuaggcaucgagauuccaggagagugagaggcagcccagugcuguggacucucuucucuccagccgcccaggcucccacugaggaucugcauguucaacguuuucgcucauuccagacuuaccgugcuaaggaguaauagcugugacucaggcuuugcagcccuuuagucucugagugaguuugucuuuucucacuaucacuuauuuccgacuccgacggaaggaaggcugccuaagguuaaagguuaucagaagaauugggacuccaauuuagccucuugagauuuuaauuguucaguguccuauguaaaaagagcuguuuccuaggucauaaguaauuugugguauauucuagagaaauuaaacaacauccucacugagaauagagcguauuuuauuuuauguacuuuuaacuaaauguaugaucauuuacaauguuugugguuuugaucucaacuucugcaguuuugcguuugugauagugguaaggucacuuucugaauucugacaccgucuuuuacuaaaauggugagcuaauuucuguuuugguuccuguagccacagucccacacuuaacuagcuggggucuuuuaaagcucugcuguucagaacugaagccccaggcucaaccuucacuggcgucaucuaagauaaauccugaugcacaggauccggccugaauucacagacugaggcgcccauauuuguagcaagcaugaaaagugauuuuuauucacauagguuuuaaaaacccgaaaucaucauucgcuugaaagaaguucucuuccuacuuccucuucaaacucaaugguguacuuaguuaugaugagucuuuucccuagcucacauagucuuagcaucaccuuacuuuguaaaaagauaagcugauacguauuaguacauuccuguccucuuuucuaggguuacagucgauucauagccaagcccaaccguuuucacucuaacagguauaugcauauagcuauuauauaacaauguuaucauuauuaugucaguauguagagggagggacagagaugauggauacuaugugugcauauagagggagggguaugaauuacuuuuauuaauuguguuaaagugggagagcucaagguagcagccuuaguuauagagcauaacuacguaauaaugauauaccauaucaauuguaaguuugauuuuuggcauacacauugaauguguguauuuuaggaauauuaauccaacaugaagauauuggggacaaauagcccagaaggaugaucuuaauguucuugcagaaguaggacuguccaugggaaaaacuaggacugauauuaagcacagacuuuaauagaaaacuucuuggauaugauguguuguuccuaauaauaauaauaauaaucauaauaaugauaauaauaauaaaauuuccuuuuauucaauucauuuuauguauaugaaugcucuguuuucaugaauaucagaagagaggaucaaauuccauuacagaugguugugaaccaccaugugguugcugggaauugaacucaggaccucuggaagaacagucagugcucuuaacugcugagucaucucuccaccccauauauauuuuucuuaaggaggaguuuuuaugauuucuauuguggccaaagguucuauuacuauuauuauuauguuaaugccacccuuucuagguggauuuuuagauaccucugugcuuuggagaaggucuuccauaucaauagcugacauu

SEQ ID NO: 8292 - RNA, 1030 nt, Mus musculus
cuucuugaagagggaggccauggugagcggccgcgcccgggcggcccagcucggcccgguucgguccggcccgguucugggaacaggaccgguagaaggacggaucccggagaagccuggcagcggcgggaggaggaggacggggucuccaagcucgaccugcggcgggcguggcuccgcgaggcucccgagaacgcguccugggugcucaggugaccgggaacuaagacacuuuuuuggagaagucacuucuaggcggcgcgugcgcagucugcgagcacgccugcgcacugcgccucugaagccgcagcggugcccucacuucaaaggcugcccgcucuucccugcuuuccguugcgacccguccggaccuagguuggcaaggcuggcggcgcgugagucugcaagaugcucgcuugguuucugugcugaccucgggcaagagugaaaccugauccacgccuuccuuguuguuccagguuguuggaauuagggauccuggggaugugugguggacugcggaccugagacugauugacaguaggacucccaagcgaucaaugcaaaggccuuaggggaugcccugcuaggcuugucccaggugaucuucccagacugcccugaugcuaccugacuccuggcugccucuugcgggacccaucuucaccuaccacccgguuucugguguuuccaccagccugcuucugucccuggggaucugggguucagagauuguccaggagaggagugacaagcgaauucuaaugccacacuauuguuuaaugcuccugacuuggaacaagaaaggcugcugauacuuguguucuugcuuagaacccaacuuguuuaggugucacauaaaugcggaggaaaagacacacagucacacaccaaaaaauggcugcacagugaaucuaugaaauugcuacauagcacuugguugauauuuaauaccaaaagucuccauacccuguaaaaaggacagucauuuaaguucuugacuguauaaaauaaauauggaaaucauaau

SEQ ID NO: 8293 - RNA, 1030 nt, Mus musculus
auuaugauuuccauauuuauuuuauacagucaagaacuuaaaugacuguccuuuuuacaggguauggagacuuuugguauuaaauaucaaccaagugcuauguagcaauuucauagauucacugugcagccauuuuuuggugugugacugugugucuuuuccuccgcauuuaugugacaccuaaacaaguuggguucuaagcaagaacacaaguaucagcagccuuucuuguuccaagucaggagcauuaaacaauaguguggcauuagaauucgcuugucacuccucuccuggacaaucucugaaccccagauccccagggacagaagcaggcugguggaaacaccagaaaccgggugguaggugaagaugggucccgcaagaggcagccaggagucagguagcaucagggcagucugggaagaucaccugggacaagccuagcagggcauccccuaaggccuuugcauugaucgcuugggaguccuacugucaaucagucucagguccgcaguccaccacacauccccaggaucccuaauuccaacaaccuggaacaacaaggaaggcguggaucagguuucacucuugcccgaggucagcacagaaaccaagcgagcaucuugcagacucacgcgccgccagccuugccaaccuagguccggacgggucgcaacggaaagcagggaagagcgggcagccuuugaagugagggcaccgcugcggcuucagaggcgcagugcgcaggcgugcucgcagacugcgcacgcgccgccuagaagugacuucuccaaaaaagugucuuaguucccggucaccugagcacccaggacgcguucucgggagccucgcggagccacgcccgccgcaggucgagcuuggagaccccguccuccuccucccgccgcugccaggcuucuccgggauccguccuucuaccgguccuguucccagaaccgggccggaccgaaccgggccgagcugggccgcccgggcgcggccgcucaccauggccucccucuucaagaag

SEQ ID NO: 8294 - RNA, 3930 nt, Mus musculus
uaugucccucaggcacaagagugucucuggcuuucuuggguggguugcuugucuugguggagauagugacugaaagcacagagagaccuacugagggagauuagacauggcucuuuagaggaagaacugcuccauugcuccaacacaguggagccccaaugagaagaggcaguccaugguuuuaagguguuuauuaucaugguagaaaguuguggugagugaaacauuaccccacuuucucaggguaagccugagguuaaauaccuuuugcaagaaggaaugucuuggaaggggagcuaagaggauaauagaggccaagaauagcagagagagggagagaguagagaaguagaggcuugccauggcuacauggagagaauaaagaaggaaaugcagagagagggggagcaagagggcaagagagagacacagaguaagagaguaagagagggaggaaggggcaagcagccccuuuuauaguggguuagguaacuauggggaggagcaaaccuggcuguugccacauaaugggggguggaguccaggcagaguaccaggggcuuggggcauuggacuaagugacugagggccacagaauuauggagagcugaggccuccugucaggugcuuagugucagggagcaugacaaauagccuucugugccuugcaggaacaccugcuggguguccagaguuuaaaacuaccuuggccagaaaacuggcugccuuucacagucccacaacuuuaaauauucuuucuuuguucgguguguuuaguauuuugauuauuaugucacuaaaggauauucuuuucugguccuauuuauuugguguucuauagguuguuccuuaguuucuguuucagaucuguguauuuggagaaggugcuggcuguguguugcuuguuuaccugccugggauguucagacaguauguucacagagaaugcaugcugguuuuggaggguauuuaauugggaugaaguggaagaaaaagguuggaggagaagaucuuugugaaccauuggaguuggggucagagagaaaagaaagaccacagcauguuuuuaacuacagaugcgggggugcuuugggggauugcaucucaggagaaacauggucugccuuuuuccaaguauugccugagaggagcugucuguggguaguaggaguugcaugcuagaguuggggucugggacaaauaaauaagugaguauaaguagguuaggagcaaauauuuuguggaauccacaagagauguguccggggguggggggguggggguggggggaagguuguggcugauguucuucugcuguguaagaaaggagacucaaagauuuugucuaggggagggaacagacagugaugagaaugucuguggguggccuaauuaauuuucuagaaagaugaauuucuauuuuaauuaaaagugucaaaaauaaauuucaaaaaugagaaaacaaauuaauuccaagagcugagaagguggaucccugaaguucuuuagagagucauuuauuaugucucaaacaaugagguccagauucaaugagauauucugcccccaaauaaaagauagagaguaagugaucaagauauuggguaucuuccucuagccccacacuuacgcauagaaauuaaaauugugcguguaccauauacaguacagauaaaugcauauauguagacaaagacuaaaaucacaugagauagcacauauuauagucauuaauauuuugucauguucucauugugauauauagagauagagauagauagauagauagauagauagauagauagauagauagauagauagagguguguguguguuaaaaacauucauacaccuauauuaacauuguuuaucuaacauuuuucauaggcugaggucaauaucacauggaaaucauauuuguuuuugaucauuaguuucaaaaaggagguuuuaaauauauuauugguaggauggaaaccuauacuagaucuucauaugaaagucaagaugagaguguauuuuguuuuauuacuaugaaaguuuggcaacuaacugaucuucaaccuauacagaaaguuaauuuuucaauaauauuuuaugauuuucauguacuuuguuuaguguuuuacaauuuuaaucuuucaauuuaguggaaaaauuuauacuaccaauuaauuuuuuauguuuuuugaugguuuuaauuaauaugaaacagauuuuaugaaaacauuccaaauuuuauuuuauaaauacuacacuggcauguguuucugcuuuuguuuugaaagguagugcaacuuccaucuuuuauuacugaaauuucaaagcuugucauucugcuuuggauaacuuauguguuuuuaaagaauuuaauuacugaguagaauuccuggaacaauccaguugucaaacaaauguuuuaauugaugaggaaaggugguuaugguugagcuguagaaaacagauuuguuaaugaaaguuggaguaagaggacaauaauguugaaugugcuauugcuguuuuaaaggcugugcucuaggcuugugugugugugugugugugugugugugugugugugugugugugugugccaaagugcucauugcuaaaauccuuuuauuauaaggaucauugaccugaguucagauuucuagaauauauguaauuaguuuguuggugugugcuuauaguccuagcacaggaacaugaauaguuuuaaaaacucaaugggcuuccucauuuuguuuacacaucaaaguuugcagauguugaaauacccugucucuauagcaggaaguugacugaaggaagauaucugagauugucuuuugacuucugcgugcacacauguguuuuggugugcacuuaugccaaacauacaaauauacacaguuacuuucuagcuggauuagaaugauaaauaaauagaaaaugagcaguauguuuaugaaaggaauguauuaguguuauuuccuagaauuagguaaaaauauaaaggggggcuaucgauuagaagcagacuaucauuuauaugucccaauauaauucauaaaccugcuguaucauucacagccaaaaauauugcuuacaaaggugccaauuuucaacuuuaugugucacugaauuuacuuuaaagauaugaaacaagaaauuuauuauaugacuuuacuguuuuuccuaaucagacacauucuucuuaauuaacauuaaaugacucauuacauaggauuaagagggauucaagggcuaagacaguauacugcucuuucagaggaccaaguucagguucaagauccauaucaggcaguucaaguuacucuuuguuuauaaaacgucagagauugguaggggccagagccacuuuugcuguuaguuacuauguaugcuggguugccugacuugugaguaccuaugguucuccugucucagacuuuugauuuugccuuaaaagugaugagauugcagauaugcaucaccaugucagauuuguccaugguuacuggugauucaaacucaacccuuccacugguguggcaagcacuugcaaagccuaagccaucuugccagcucugggaggcagauaucuucauaaaaagaacugcauggaagaggcaaaugucugaagcaagaaguagagagccuucagauguuuaauaaauuacuuaguuauuacagaaguacuuuuucaaauauuuuuaauuuuaaauaacucauuguuucagacaggaaaacauggaaacauuagaauaauuuguuuuuauuuugcuugcaucaguuaaaaacaaaacaaaacaaaaacaaaaccaaaaaaacccagcuccuucaaauaccaggauauuaucauccaacuaaugucugugaaagaaaauuaauggugaauaacaaggauuuuuuuuucuuauuauuugaacuccgaaaacuuugacauca

SEQ ID NO: 8295 - RNA, 1266 nt, Mus musculus
uagaacuucaaacgugagaaauuguaugaaaauuacuccucuucucuuucaaccucuugugucuccuaccaaauuaauaauuccuucuuuaaauauuauuacauguuagccauaaugauacaucaaacacacacacacacacacacacacacacauacacacacgugagucuauuucgugucacuguuagguacauguguucaggauucccacuuggaauagauaaggcaaccucugggccaacucaucccuacaggaagcuguuggucuuuucucagaaaccauuaauuuauacaugauuaauugaugaguguagcacuuaauacucuuccaaagucuuccuuuugccaaagguggagacuauuccagagauacaaaacuggucagaauaagugacuguggaguggccaacaccaagugacacauuuccaaaaacaaguuugacaucuaggccugacaagaacccaaggaguugaaggaguuugcagcccaguaggaggaacuucaaacgugaacaaaacaguacccccagaacucccugggacuaaacaaccuaccaaagaaaacacaugguggaacucauggcugcagcuccauauguagcagaggauggucuaguuggucaucaauaagguaugaaggcucuauucccaaguacaggagaaugccagggccaggaagcaggaguggguggguugaugagcagggagaggagggaagcaaugggggguguuucggaggggaaacuaggaaaggggauaacauuugaaauguaaauaaaauuauguaauaauaauaauaaaagaagcauaaaguuuauaacagccagauacucuggauguuugcugccagagauugucugcuggguaagguaugcagccauuuuagaaagaauuuuacugauguggucauauacauccagguguaaucuugguuuaauauauauuguguuauauaugccacugcaugugacacagucuaaaauaaucacccccuguccugcacgugacuuucuguccaaagugugcuaggauaugaguuuccuucuagaauuggccaauucagucagacagaaugaucacuggcuaugauacaugauuacaauaucuuugcauacccagaauaccaaaguuaaaaccugacaguguuuaaucaugcccacauagauuauccacguaauugaaaauaaaauaacggucacacgaaugucgcucacacgagcugucagaaaaggccuauauucucuuuacucaaugauauguuuua

SEQ ID NO: 8296 - RNA, 11802 nt, Mus musculus
cggcgacuagggggcggugccucccaucgguacagucauccuucugccuguucggcgggacugauggccggagagaugacgaucuuaggucaguaucucaggggucccugcaacuauggaagucgacggggaaguucgacgaggucugggugggcaaggguugguugucucacucucugaaucacaggucacgcagccgaagggagccugaaaagggggcuaaggcuguuuggagcuggugggggcggggcgucuggagucgggggucugacuugccggaggccucuuggggucgugccaccagccacaggucugagagacgagggccuaggaaugcuaacgaccucggucuugaauggguagccgaaaucgguucucugugcgagaacccacugugaauaagaaggggaucucgagauugaagacucuuggcuucacucgggaugcggaauugggagggauucaagucccugugcauucuuagauggauucucuuuugaacauaccgauugggaaucaacauucccuugccaaacgcugagaugcuuuugagauuugucuguaggugggaagagacaaguggauagguucuuggucugcuaugaugugccaggcguugauuugaaggagcuagcaauuaccaacagcacuaccgagugacauuauggguuugaguggggacagguguauuacgcagacuagugaaaccaaaucagauauuaauucuaaacucaaagugauguucuuauucgcuuuuguguacaauaugccugauguuucuauaugaucuuuucccuuaaauauuugcugagccucugcucuucaugggccguacuauucaauggugacuagaacuugccuucgggaaguuuacauauuguugcuaucaggguuagcacuugcauacuucuucccuaauaucuauuuugaaaaguauauccuuaaugaaugcuuauauaugcaaaaucucuucuggacucuaugagguaacaguagugccuaagcaguuuucagaucaacauauccaacuuacguauuuuauccuuuugaauggguaaagacgauaaccaaacagguuagacuuacauaccaaagcugucucugugggaauuucauaauggcauuucauuuuaguaauaacagguaaaaacuguuuaugaagcuaucaaucuaaauagcaauaauccaagaaaacuggauuguauuuagcuuuaguuucacauuugugauauuuucauucaacaacagcauaaugguuauuuaaauaucuuuacauuuuauuccuuuauuaucauguaacggauuauacaaaaauacauuugugagggcuuuugguuuuugaggguuuuuuuuuucuccuuuguuuuuaauuguaccccgauggaauguuaaaaacuugauguccaaaagaaguagcuaauaauccuauaaagugaaauauuuuauguuuuguuuuaaaagugcuacuaagaagauguugcuauagguacaguauauggugguagcuucauaaaaacuuaucuuuuuaccuuuugcagguucagcuguuuugacucuccucuuggcgggcuacuuggcacaacaguauuuaccauugccuacgccaaaagugauuggcauugaccuggguaccaccuacuguucgguugguguauuuuuucccgggacaggaaaagugaaggugauuccagaugaaaacgggcauaucagcauccccagcaugguguccuucacggacggugauguguaugugggcuaugagagccuagagcuggcugauucaaauccucaaaacacaaucuaugaugccaaacgguucaucgggaagaucuucaccccggaggagcuggaggcugaaguuggcagauacccauuuaagguaggaaacuaaucuacacucugcguccauuugauuuaacggugcuguuugaauuaugugucagggaauuguauucucucagugagaaaucccacagcagcugcaggguggaucaguucagugacuuccuggugcuaccaggucaggauauggggccuugcugugcacucaucccgccaucaucacaguuccaguuaguucucucaagacauuuuaggaaggaugcugaagccccguggacugugaauagguauucucuauguguguacauuuuguaugcguacaacauuuguacacuugcugucgugcuuucuggcuuauuugaagugugucaguauguuacacacauguagugcauguaccucacuagcuuuaauggcuguggaacugcuauuuuauuacagaguuacucuaucucagcacuaccucuuauacuuugcuagugucacacuaauuuuugaaguucaguauauauauauacauauacauauauaugcguauauguguguguauauauaugugugcauguauguguauauauauguauguguagauauauguauacacacacacacacacacacacacacacacauauauauauauauaucuuugugucuguuagaaauugccugccuuauggaauuuugaguuggauauauauguguggguuuuuuuuuaauaguuauuuuauuuauuuacauuccagaccuuacccccuuccugguccccccucccaacaguuccucaacccauucccucuuccccuugcucaccccacaccaggccucccccuucccuggggccucaagucucuggaggauuaggugcaucuucucccacugaggcgagaccaggcagucuucugcuauguaugugccagggcccucaguccagcccaguauggucuugguugguagcucagucucugggagcucccagggauccgggucaguugagacugcuggucuuccuauggagucgcccuccccuucagcuucuucaacccuuccucugauuccuccauaggggucuccuacuucaguugaaugguuggguguucguuggguguagguaucugugucugucucagucaacugcugguagagccucucagaggacagccaugguaggcuccugucuguaaacacaucauagaaucaguaauaguguuagaccuuggugcacuccaugagauagaucccaaguugggcugcucacuggacagccuuuccuucaguuucuucuccauuuuugucccugcaguucuuuuagauaggaacaauucugggugagaaauuuugacuguggguuaguaauccugucccuccacuugaggcccuucuuucuucuggagguggacucuucgaauuuccucuccccacuguugagcauuuuggauaaggucacccccauuaaguccugagagucucucaccucccaggucucugggacuuucuagagggcccccccaacucccagaugcuucauauuuccauucauugucuuggcccuuaggacuucucuucugccccccgccccccauaccagguccuguucuccuuuucccauccucuucccucucccacucaggucccuccuucccucugccuccugugacuauuuuguugccccuucuaagugggauugaagcauccucgguugggccuuccugcuuguugaacuucuuacgcucuguggguugucuccuagguauucuguacuuuaugacuaauauccacuuaucagugauuacauaacaugcaugcccuauugggucuggcuuacuucgcucuuuucuaguugcauccauuugccugcaaaauucaugauguccucauuuuuaauaguugaauaguauuccauugugaacaugaaccacauuuucuguauccauucugguuuguuuccagcuucucgcuacuguuaauaacacugcuaaugaacauagcggaccacguguccuugugguauggugagcagauacccuggaauggcauagcugggucuccagguagaacuauuuccaauuuucugaggaacugccagguugauuuccagagugguugguuguaccagcuugcaauccagcaucuccugucaccugaguuuuugaucuuugccauucugauuggugugagguggaaucucaacauuuugauuuacuuauuuaggaauuuuacuuauauucccagauuguagaucagaaggucugcaugcucuuaaccuuugcuuuuggaguguccgcaucuucagcaggcagugugacuuucuuuacuuacugagguaggccaugcucuguagcagucacugaacagccucuugagcgggucagccuucgcacccagguccguguuccacaauccacaacugaaaaaauggcauuuuguauuaauugucuuuccuuugcuuuacaggaauuauaucuagugguauuuuuucuuucuucuaaaaauucuauugguugauugauuguuuaauuaauacaggaacuaaauuuguagacuugucugaccuacaacucacaaagaccuuauugccucugcauuucuucuucuuuguccugguuugauaucuuucucuuuuuuuaaugacaauaaaauacccuaucaucucugugaugucuaaguuguuccuuucaaaguauuaggcauacaugaaaucucaaugauagaagagugguuuugauuccuauaguaauuaauuaguaucaacucugacccuuugcacugacuugauuuuuuccccuuuuggauuuccaucuuaaugcucuuauguauuuauuuuucaguguuauuuuuaaacauuugauuucuguggcuuguuucucccgugugcgacuucucuucuaaguuaugaaguggucuaaugacucuacauguguuagacucacuagguaguuguaucaucauggcuucccaaauaaaguguugccuccuuugugauuggaguuucuguaguuuucuuuugugugguuuuaauuaccaguucucaaugagcaugaauaugaaaugcaaacgcccuuaaaugaccaguauguaaauuguuuuggaggaucaugaugaaguccuucacugggcuucccagucuuacccagaguguggaccaucccauuggucacuguauucucugggcugucccagcucggcagccguccuggggauccgguguugcaggcauugcgguguugucauuaagacuaucuuacuaaguaauggccccgaaauuagugauaccggcuggcuacuugugcauauugggcagaacuuuuaaagagcuuugucugagugaaaacaugcccacugagggccaacagcuccaagaaaaggagucuccuggguguuguaacgcauccuuccaaugagaaugcacugagaauacccuaggcuucuguuacaguccugaccuuuguuuggcucuuccugaaaacuguaacacagaauuauuuaguaaguuuuuaaauaucacauucagugaacucuaaucuggaaaaggguguuggauauauuauagugagguuuuucuuaguuuuaaagguuuuuguugaaucaauccaauaugugcaugucaaagcaauuggacuuuuguguauacauacuaacuuuacauccuugcuuuucaaaucuuauuuacagguuuuacacagaaaugggauggcugaguuuucugugacaaguaaugaaaccaucaucguuucuccagaguuugucggcucucgauugcugcugaagcuaaaggagauggccgaggaauaccucggcaugccgguugccaaugcugucauuucugugccugcagaauucgaccuacaacagagaaauucaacaauccaagcugccaaccuugcugguaauagcaccuuugacugaccugacaugcauuuucucagauuguguuaggacuaacaucuucuguaaaucaacuguaggcauccagacuauauggcagaugagauagcugccuguuuuagauauuuuugcaaugauaauuaugaacucugguacaacauuaaauggggagaaaaagcaguguagggcuagggcuguagcuuucugauagauuacuucucuagagagggucaggcccagccuagguucaguccuccaggauacaacuguccucaaaauacguuucuaaaaugaaaagaaaagaagaagcuaagcaaaucaugcauaugacaaacugugggagagagcaugagugcuccuguacuucugauccaagauacgaugucuuccuuguucaggugacguguuuccagacuuugcaaggugaaagugaugccaccuguucuauaaauccugcuuuugugaugcuguauccaaauagaucgaaguguagaguaagcauaauacgcacgcacauugcauguaacauuguaccauggggacuuccuguacuuaucaguaauaguaguugcauggcccuucuaagccaaggguaguguccuuacuacccuuggcuucagggggaucaaucaccucguguucagagcuacugguacaucuuguuuuuaaguuggauauuuuccuuauuuacauuucaaauguuauccccuuuccuggucccccugccccccaggaacccccuauccuuucccucccccucccuccacccucgcuuauaugagagugcuucccuacccacccacuccugcuccccacccuugaauucccuacacugauuggggcauucagccuucacagggccaagggccucuccucccauugaugcccaucaaggccaucuacuucuauacagucuuucccagaaaguagcauggguggaagaauggaggcccggaagguagucagagauagaugguggggcuuauagaaugagcaggcaugccuccccgaaacagugacuccuaagaccuaggaccccacacaugaccagaacagagcgagaagugugauaaccaguagcaucccugggaggaucuuuagaguuugaaaggccgauguggcuccugaccucacaccuuguacaccacuuuaaguggggaaguuacugcaaagcaggaaucuuacucaacguaauguggucuuuuacacgagaucagcugaccauauuuccacaacuauauauuuccaaguagaguaucaauauuagaaaaggcuggaagagguuuuacaauuguuaauaaagugucaagauacuaaacuuaggcuuuucuuuuuuuaugguguauucuuuaagaauaauuuuaauuauaccaguaagaagaacuugcauuuuucauacuauuguauuuuucccacugcuuuugucauugcuggaugaaggucauauuaaagcagaaacagacauguuuuaauuacaaguuaaguggaaacuguuuccucccguggucuuucagggcugaagaucuugagggugauaaaugagccuacagcagcagcgauggccuauggucuccacaagguugacguguucuacguguuggucauagacuuggguggaggaacucuugaugugucguuacugaauaaacaaggagggauguuccuaacacgagcgaugucugguaagaaaagugcagaucuaaggaagugcaggcgugcuuuccucaaucugcccagcauguaggaugucgguuugguuuucagaauauuuugugauuuuucuauauaauguugcuuauaucuauguacagaucaaaguuaacuaucaaaauaaaauggcuggacuuccuguaaguuagauaaguaaguuccuuuagaguuccuugaugacgguuaaagggaagauaacagaaaaaaaugucaaaaugaagacagucgguuauuucaucuguuucaugugugagggugaggauguucugagaaaggcaacuugagugucacugaagaaauaagaucguuuacuuuaaaucucuuuucaagauuuuugcuuugugcuuuuuaggccaaaauguaagagugcuuauuaaccuacauaagcguucuaacauuuauauuucucauucuuuuaacaaaauuccuuagagccaaaauauauacucugaguuuauauuccauuaucuuuuccuauagaacuauuucuauuaagcuuuuaauuauuaacaguaagauacgauuauauuuuugguaccuguuaaucauaaaaauuccaaaaugagacaguguugcaauuuagguagaugcugccuucauucuucuguuuaucaaaaaucacuuuauguuauugaaauacucccuucucguucauuuaggauuucuaacccugcuaggcacugauuaucaauaguagaagauagaaauggaaauaacaauaauagcugagauaaaaccguuucuagaaucugaaaguaaguaacuaucugcccuuaccauuagguuaaaaugguuuuaacauaggucuuuuuuaaucaacguacauuaguaaaaccuuaauauauuauaggacuucuuauccuuagaauaccuuaacauacagaguuuauauuuaugugcauauaaguaugacauaagguuuuuaauucuguguuuaggaaacaacaaacuuggaggacaagacuucaaucagaggcugcuucagcauuuauauaaagagaucuaucaaacguacggcuuucucccuuccaggaaagaggaaauccacagauuaagacaggcgguggagauggucaagcuaaacuugacaauucaucagucugcccagguaucaguuuuacucacuguggaggggaaggacagcaaggaaccucagaauggugacucugaacugccaaaagaccagcucaccccaggagauggucaccaugugaauagaguguuuagaccuggccuuucugaaagcaagaguggaaaaagucagguuuuguuugagacagaaguaucccgcaagcucuuugaugcccucaaugaagaucucuuucagaaaauacucguacccauucagcaaguauuaaaagaaggccucuuagacaagacggaaauugacgaggugguucuaguuggggguucuacucguauuccucggauccgccaaguuauucaggaguucuuuggaaaggacccgaauacaucuguagacccugaccuggcaguggugacaggaguggccauccaagcugggauugauggaggcuccuggccucuccaaguuagugcuuuggaaauucccaauaagcauuuacagaaaaccaacuucaacugaacugagggagugcugguaacugacccugucuuggcguguuaaggauuuccaugugacgccuccuccagaaaaggaguccaugaagucacucaaaaauucccaaaaggacauuuauacaggacaacuuuacauaguguuuuguuuuagaaucgaauaugaccagaugagucuuguuugggugugcaaaaaaaaaaagcucaguauuucuaaaguaacagaguugaguaaaacucuccuggauucuggaaguagguagccauccgcacuuacuagucuggaaacuuuaaauagugccaacuaugaggcccaaguucuuacugaauuuuauuaguaggggcugauaauuucuuuauuugguuuucacauauagcucuuaaggacuugaagaacuguuaugucagguauuuacacuggcugggagauagcaguauuauuaaacugcauagauaguauucaccaacugccauguaauuuguacuuucaaaaauccacuaucuuuuuacauauuacauccuccuaaucuacagauuuuaauauauuugaaagaccaguuuuucuucccaaaauagcuaaagauuuauucagaucucuuucugccagauaguagaacaugcccuguuuaaacuguagucuuuuuaucuucagggcgucauuuucugcuuguauuuucacaccucugcuuuguaagaauaaaaaagacaguagaaaguuaccaguugccuuuucaaagcguugaugucacaauaaagcuguauuacucucuccauuuguuuuugcuauccaagaccauuggguauuuguagcagcuguuugguuuugguuauguuguuuccccuuuucccaggaucaaaccuagaaaugcaagacuauagucaaacuacuuuagacauuuaggcaaggggcucacaaguucaaagccugucugagcuacccaggaaguucuagaccaauauaggcaacuuagugagauccuguugcugucucaaaagcugagagggagauagggaggggagaagagaagaagcaagcaagccagauggccacaagggccagugaagaaaauacucuauguugacuuugcgaugcccauguuauuggaagauauaugucauuauauuugcuuuaaugaaaguauucacauacaagaauuauauccuggcuaucuuguucuuuuaaaguauauccuguuuaucaguguuguaauaacuaaagaagagaacuaaaauuuugaaaaagaucaagcacuucagcuucccaaagaguaaugcuggaaggugguaggauuugguuuuguuuuuuguuuguuugguugguugguuugguauuuuugcagcuuuauaaaaaauuuuuuuugcuuaguagugaaguugcgauuaaauuaacagucauuuccauguaccaaagcgcaugcaauuagguagauagaaaaacauaaaaugccgugcuuugauuuuagaacuaauggagaaaugccaaagaugagcccuucacagcauugugaaaauauucaagacugugaaucuuugauuuucagauugaaaaacaucuaggaacauguuugaggcuacauguacugcagucuccacauguacuuggaauucucacguuagccauuuaggauuauaaacagcaaacuugaauuucucagauguaugacaacucaagacaugaacaaaaucaauuugcagaauggagcagauaaauaauacuaaaaugggaagauaaauguuuuuuuuugaaaaaacaggauggugguguuggagguggggcuauguaguuagcauccucuuccuuaguaguuacaauguuaaaaccaugaaggaaauugucuucaaucaauuguuagagucauguguaccuaauccugacaccaguguaguuuauuuaaaagguacaaaugaauccugaaaggggccauuuguuaaaaucugagaucauuuuucauaaaauuugcuuuuuaguuguacauuuggcuaaauuuuuuuuaaguauguaacuuuaaaaauacuaaguaauauguaauuuauuuuauaucaauguuuugguacuauguuuucacucaaaccacuuaucagauaccacuguguauaauaugaauucaauaugacaguuacuguauagaacagauugugccucuuaaaaauguguguacagguaauucauauuuuguuguaaaucuauagcaguuuugcuuuuaaauuguguacuuuauuuuccacccaugacuagcuuggaguauauuuuugauguauauaaauacaaaaagagagagagccgaugugaugcuuacagacauucacuagcaagugauaaaauuucagaagugucacaucuuacugcauuuacugcaucccgugucuccuggcauuucugcaguuuucugcauaguucucauuuagaagagcuaguucuuaugugaacaguuucuuuagaacuuugauuaacaagcuauggcuuguaaccaguggaguuaaaugcugacuugauccacaaaguuaaugaggcuguguacccccccuccaacuguaaucuuuucaguugacaguacuucauaauuuucuaauaaaaucuguguuauucuuuuggacaaauauuguuuucuaucuuaagaaauccauuuuaugaugucuuaaaaauaagccccuggggccugaguggauagcucuguguuuuagaguacguccucuugcagaagacccugguucaauuccuggcuccacaucguagcucacaaucaucugcaacuguaguuauaucaag

SEQ ID NO: 8297 - RNA, 911 nt, Mus musculus
auaagaacaacauuuaauugggucuggcuuacagguucagagguucaguccauuaucaucaaggugaaagcauggcagcauucaggcaggcauggugcuggaggagcugagaguucuacaucuucaucugaaggcuccuaggugaagacugguuuccaggcaacaaggaugagggucuuaagcccacaguaauagacuuccucuaacaaggccacaccuucaaauagugccacucccugggccaaguauauucaaagcaccacagagggucagcagaacauaugugaaauggagcaagaguagagaauacuugagguuaaaggauuaagcugagauggagaugguggaaagggaggguaguaguaggugggaacugggaacuuggggacagaccaaaguaaggauacuaccuaaguaagggccauagacaagccauagaggugugaucucaaugcucauaauaaacacagaaaucucaggcucacccaaugagaaucugcagguucacaacaaggccagugauugucauauacauaaaacucaagaagugcugcuugaagaucugcccuagggcauucucucuaaugcuuuuaaagucuguuuuuaucccccauccuucucuccauucuugaugaccucaucccaaucuucaauuaagcauccuaaggaacacaaaccuguucguuuguccacgggaucuuucugucuuuacccagcguccgccauuuucaagaagccuuugaacaccuucucugggaaaacaacauaaccaagggcggcuuauagaaaaaagaauuuacuuuggcguaugguugcagagggagagucccggauggcaagauaggaauggcaguggguggcagaagaaggaagcugagagaucguauuucaaauguguucaggaggcugua

SEQ ID NO: 8298 - RNA, 3278 nt, Mus musculus
cggaagggcgucucccaguuucaaagcuugcauuguacaacggugaccugccuaugagauuaacugguucaauaguggcccaaggguuaugggaguaaccaaccacuuuuugauuggauuuaagucccauuccaugagcuggaacccuuaaggacauugcuaaaguagcaaaaaaaaaaaaaaaaaaaaaaagcugagaccaggucucauggguccuaagggcauagucuacuacuaugauccccacaaaugagcauagcaauaaaauuacuccuaaagacuuauugcucuaccaauagaucagagcauuguucaguccucuucagagcaucuucuugcaguagaggguaauuacacagagacccgcaacuagacaagaggcagacaaugagagacuuuggaucauccaucccaaaaugauaucuuaucaaaccccuccccuuaagguuuagucagcuagaaagaggagggagaaagauuuugaaagagccaggggugguggaugaacuccaagaaaacagcaucauucaggucgaagaagacucguggauggaugaauuugcagaggguguagcagcauacacaagaccugcacaaguucaaaccaaacaaggucccagcacugagaagaagaaguggauagaaagucccaccugaccaagaacaaaucuccagcugauaccugcugggaaagaauaaguaacuuuccugcagccgagugucgccggcuaugugugaccaugcuccacaccaggcugccugcccagggggagcugcugaucacaggcaggcagacuccauguuuucuguuucagauuuauuaucgcacuguuuguuuugauuuacauuuuuggugagggagaggaagagagagaggaguuucgguaagggaaagaccaugacugaaauaauauuguacgagaaauaauuuuuaaagaaaaacuuaauuuuauaaacaauccggucuuucagaaacagcauuuucucauauauuucucuccugggaaaaagucuaacgauaugaaauuaagcgccuaacaacuucccucuuugguuauuguucccuauuugcugcaacaaaauugcccaaguuggaggaagcaaggacucaauugucucacaguuugaaguuacaguacauaaucuuggcaacaggagcuugaggcaacuggucacaguguaugcgcaguuguaagacccaaaaagucuuauguccaggaugucccacucacagagacgcagagaaguagauggaugcaaaaagcaagagguuuauuaauccagcaugcuggugucauccugaaaucgggauagaggcgaccacgaguagcuaaagcacacaccuuuuauacauuuuggggcaguuuaucauugguuaaccuugacccgcauuaaggggcagacauugugugggcuuuucuauucaaucagaggacuaucucuuagcacaccuugcagugaggcaaauucugggaaaagaacacauuuacuuaacucuuuacaaccguggucauuuugagcuaccacaaaucugacacagucaggaagcagagugguaaaaccugagguuccuuuugcuuucuccuuucuaugcaguccagaacccggucugaacugcuucugcuccuauauagguggauuuccccacucaccucaacaagaaaacucugaggcacccagauugguuuuagauacugugaaacucacacucaagacuaaucauuacaacuuaacgugccuaaauuccccuaaauauaugcuaaccuagcuaaaggcaucccuggcuggucuguugcuaaauuuagucuguugcuaaaggugcgcccccccccccaccacacacacacaccaccaagucauugaauuuaaaacaaugcaugucaaaaagaaaggaaacagaagcauucugaagacaaagguuucuuuuguaaccacaccucacagcccuagauggagccaaagcuagggagaacagccuagagauggcacuaaagcagauucaucaaccuguggcacuggacagagcccagaagucaaccuguguguucauggucaauugauuucucacaaaggugccaaggacgcaccaagggaaacggauagucucaacaauaaacgagacagggggaaaagaaaugaauaucugugugcggaagaccuuuaucuuaaaaccagaugcaaaaaucaagucaaaagugauuaaggacuuaaauguaagaaaguaugaauuuuacauagaaaucccagagcacgggcaauuacaaccucaagcuaaaaggguugaguuuggccuguuugccugcuugcuuuaucacaagcuugccuccuuaccagucucauuuauugaaagggcagaguaaacaauuaaaagcgacaggcuuccuggaaagcggucacaggcagaccugacgcagaacuuuguagagaacuuaaaccaggcaacggccugggacuugggggcuuuccgguuccuuuucauccccguguccgcgucucucacguuauuucccaagucuccuuuccagaaucaggcugaugcuuuaugcauagucuuguuuuacuuccugcuuuuucaguucucacuuuuguuagugccucgccccuccccgcccacucucucuaaaucccugucugugaucuacucaggaagucgcagagccacuccccugccuggcauuguucaagcugccuauucuaucucuaagaccuacaaacgcuggggaaaaaccauccuucuuaacauccauuuguuccuuuaggaaauauaauauuaauccugcaugcauccuuuaagaaaacuacaugacccguauuaauaucaggaaacgaaucccaguucuaccccuuccaaaacuuguuugacuuugauaauccuugcugggcuaacaucacaguccuugugaugguuuuguuuuguuuuguuuuguuuuccaaaugucuguaaaauguguuuuaucuccguuuacaaugugaaauucccaaugcucuuuagcauccuuaaggucacacuggcuuaauauuauagucauaaauaggagugucagucauucuaguaagugcucugaaaauuaaccagcaugcccacucuucacugacgagaauuuuuaccucaaacuaaaugcuaguuugggaaaggaggaagucagcacaguuggcgaugcagaaucauuaaagggauggauuugagaggaaguagagguaacacggaaggagcugaaaggggaagagccugggauauauacauuuugugcauauaguggucauguaugaaauucuca

SEQ ID NO: 8299 - RNA, 36565 nt, Mus musculus
caugugcgccacgcggaggggagcgagaugcucuccgcggaggcgcaagaggaugcgcacgggggcgcggggcggcgcggggcgggcggagggcggcuacacucccugcgcuaggguggccacguggggcccuggggcugugggcuggcccggccgcucuccccgugggcggcucgggguggcgcaggcggcccgggcggggcggagcgcgcugcugucugcgcugcggcgccggcggaaacaauagugcggaucggaucguggcgcgcggacgguggcccgcggagccggacgguagagguccuucucugagccgcucuggugcucaggaccagugccgggacggacggacagacgagacggaucccacgccgugccggacgcccacgauccucgaguggcguccccgggacccuccgguccguggcugaagagucuccgacgugagccgauccuucccgggugucccaguccccacgugcgucuugccgcggcggagccggggagccggguaaccgaguuagcgggacgccuccagacgcucacccagaaguuggcaaagccgcgucccagcggcuccuucuggccacagcgaccgacccgaaguugguugacaggccgggugucugccggcgcgacccgggaggcgggugucuccugugggcagcccuuuugcuuuuucgcaguaaaacugugauacuguaacuccagguauggcgaugcuugccugacagggcuguugcaaacgccuccuuuuucgguuuuuggggggguuuuuggucgguuacugcaggccauaagcaaguuuuugccguuguguaacuugcuccuuucucuuuccucauaggggcacuaugaacgaagaggagcaguuuguaagcauugacuugaaugaugacaacauuugcaguguuuguaaacugggaacagacaaagacacgcucuccuucugccacauuugcuucgagcuaaaucucgaggguaaggauucugcgguuuuaacugcgugccgcguacuacuuugugcaacuuaggcugagauguuuggagguaacacugcaacugcuugaaagccuagagauuguccuaagugaagaucugcuaaggguuucuggaaaugaagccagaguuaacaauaguuaugagucgagggaaauguuugucuuuauaacagaauguuaagcuccuuuuaacuaauaugaaaugaagugcagguauugucugauaaacauuuaagaaucaacaugaccguacacgugggcagauauaauuuuacuccuuucugccaaacuuagucucuauuuuucccaucauguggugaauuuuaacuaacuuuuauuuuuuuaaguuguuuauaucagauuuuaaauaacuuccuuuaauauuaauaaucuuuuuaaaaaaggacuuuucaauucuuucgaugccaguaccauugugagaauguguaaaagaaaugcuugagaaauuaaaccuuuugcugaagguuguguuggguacacagauaacuggguccuagauguuuccaggaaacaugggcugugagcuuucuauuugcacugucacagugaaaccccaagucuuuugggguaucuaugagucacacugaagaagaaucuuaaaauuucccccaaaauaaaaauuuguguauaacuugaauuuugagguucuaaugugucugucaguagagaaagaucuuacuagauacuaaauauuuugaaauaccuagaugcuuaagggcuugguuucaaaacaacauuucauuuugucuuuaaagacuuucaugauuuuuuuuuugucuuauuaagagggacaauguauccuuauugcuaagcacacuccuguacugagaucauagacuuugccauuccuguuaggacuuguuacucagaaguguuguagcuuccaaauggugucugucuuggcgcaucauggaguuucugugggcuaaguaguaugcuuguuacucuggcuuuaguaaauuguagugauuacaccuaguuuuaaaagcgugacuuagaaaugacgauuuuuuuuuauguguguguggaguuuauauuuauguucucugugccccagugagagggcacacuucugcucuuuggaaacaguuuuuuuuccuguguguucucacaccuccuggaaguuuacauuuuagaagggcagagacaucagacaggaucaacuugcaaucucuguguugucuggaagaaacugaggccuggugggugggugggcugcuccagguugcuggaguggcgucagcaagcuguucuucugugccaggcaaauguuugcugggagcacaucugugccaagccuggcccuaagcgucuuacuggauuaucuucauucaaaauagcucugggaugccugcuaugauuacuuguuugaaugugauggaauggaacaugagagaccuaaggagugcaguuugaaggcacaucgcuaguaauugguagucccaggcuucgaagcccggccaucuaguucuuguggcugugaccucagucccacucaucuacugucaauagguagugaacugugggauagaugcuggaaauccuuccucccgaauccuaauugguuuuugauucagccagcuuucccuaauuggugcuuccugauacguaaaucaucaugccauauaacacuuuacugcagagaccucaguuuucauaauugcuuuccuggcccuucugaagcugccuuuuaacuaacugugagcauuguagcucuugauguguaaacaugaccccggugcuauguuuuuugaaauaauacuugucuauuagucuaaaagacaaaaaaaaaaaaacgguucucaauccggauuagaacuguuuuauccucuguguuaaaggugaaguucaaaaaccgccucgguuugucuugauugucaguuccuugugcucacaaauggauuuccauuguuacugcgcugaugagcuauuuguuaugcacauuaguuuaauauuguccuacugcugugggaagaucaagaaagauuuccaccaaagucaguuuuuauagcaguacccacccaagucguguuuuuaaaaaaaaucaguggagggcuggcaagauggcaggaugcagggaaagacacucgaugcccagcuucaggagcugaguuuaauuccuggaucucacaggguggaagggaagagccaggucccucaagucacccucugaccuccgugugugaguuguggcacucaccacacacaccacacacacaccacacacaccacacacacacacaacacacaacacacaccacacacacacauuucacacguuuuuaaaaccagugggaaaaggugaagacgggguauauucuucaccuuugucagugacuugaguuauuguagucuccuuucuauaacugggauguaagagggaccuuugaaggggacauuuacagguuuaguauaguuuugucuggauuguggugauguugcuguuaacuaagagacuuuacauuuuccucucaaacauuuuuuuuuuucugcaaagagcccacgugaaaugcagugucuggaggaccaccacagcugggcuagguuuuaguucacacauuugaaauaaaacgccauuauauacacuucagaguguuuacaugaaacagcacuagccuccuaauaaugagccucuuguugaagagccaugugcucguguguacuucugcaacaaagacaaaggaugaaaggggauuggccucacacaggcugcucuuacuggagggacucuguauucuaggcauggcucugaguugucuuuuugcugugguuucacacuauuuagaaggaggguggguagugacuaacuuucauguucccaaagcgugguccuguucuucaaaaaccuaaaaaugucuuucaagggacauuagcugcucccagggguaacuuucgagcccauaacucaccuucaggauaaucuaugcacuugggagcuaaggagaugggcgcacaagcagagggcuaggcucggaucuagucauaaggcacuccaagauuuggcauaguguuagugaucaaguacacggagaggcaucuaguuuguugcaguagcuucucuaaccuacguaauaaccaaauugcuucuagucccuaaacagaagccaggucuuaggggccugcaaugaaaaaaccguaauguacagaaggcaguaacaguccagggaguggauccccgaaggcaggagcuacucugcuucccagauaaguaacguaagcuuucuuacagugauagauacaacuguagauaacuaaaccaguuugguuuccaucuaagcuggcuuugcuagcugacaagcaagcaugugucuggcuucucugcguagucuuucgucuguucucccuaaucucuuguucuuucaugaaaacugaaguaaauuagguuccugaaucuuucuagcaggaaaaaaaaaaaucuguauuuucuccgaguaaaucauaaaugagcccagugucugccuuaacuauucauccauccuggguuucuuaccauaacuuuguucaucacugguugguaugacauccuugcuuccaccugaaagccagaagugguuguuuaguguugaaagucuucuguucuuccuccaugcccugcuguaaaugccagcgccuuucugcucaagcagacagauccacugcuugaggccaggaagcaacaaacuucaucugaccacagccucuuccucuuggucccaucccauagaggcaacaccacguauuaagguguauuagucaggguucucuagagucacagaacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcuagagcuagacucccuucuuccaauguccuuauauugucuccagcagaagguguagcccagauuaaagguguguuccaccacaccuuuaaucccagaugaaaggaguagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucgggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggcuaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuacuacuugauuuaguuuucgauaaucaacugucauucuccaugauccaucuguuuucugcacuggccagauaggagaguuaaacggagauguagugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaauguacaguuacccuuguaaaaggccguaggucccucuggggaagaacuggagaaaggguaacagcaaaaccuuugagugucuuaucaagauccuuccucagcggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuaggaucaccuugucuccggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagggguggggcugaggguacuacuuccucagguggggcaaacccuugagaaucugaagauucaaaauucucagcuucaacauggucuucccacacauccccgucccauguuguaggaucccauucuuugccaauuagagcccuuacuuuaacugucgacacacucugaggcugagacuugaauuuucgcuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucucaggagggagagaaucuggagagguuucaauaguugaaagugcugguggaucaacaagccaauuccagaauuuuaaaagauucauccuuguacuucuguuacucuagaaccacuccugguaccaacuucuguauuagucaggguucucuagagucacagaacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcuagagcuagacucccuucuuccaauguccuuauauugucuccagcagaagguguagcccagauuaaagguguguuccaccacaccuuuaaucccagaugaaaggaguagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccgaauuguaguucauuccaaauauugucaaguugacaaccaggaauagccacuacauaagguuaacuaaaaacaggguccggcgagauggcucagguguuaagaguacgugcuguuugcugguuuaguuaucuaccggguguucacucuaggaagaaaguugaaguuauccaacuggaaagccagggagugcagaguuuugauggccuguacccacaagaugccucacaaccaucucacacucuaauucuagaggacccgaugccacguuuuggcuucugugggcaccaggcacauacagugcacauacauacuugcaagcaaaaacccaugcacuuaaaauaaauagauguuuacaagauaaacuuaaaaugccauuuuuaguucaucuaaccguaaagcccauugcuguuccuauauuuucugugaucugucucuuaacugcugggguguuuguuuguuuguuuguuuuaauccccgaauaaauugccucaaaaguagcugauggucucagcagcugaccaucuccgaagagauacacagggagaggggagucauuagucucuccugaacagaggcagaaagaauccagggaaucgucccaagcuuaaaauauaccagcaaauuacuuugguuuaauuucauuuguucuuacccaguaauaaauuucuggggcacuccuccuugggaguuggauuaauuaugguguuuuauggacugagcuaggacaaagaaaaaaauugaaaauccuuacagcuuuuugacaagacccccuuuaaguauggcuacgugcuggccuucacaaugcaaucauuguucaaggagcuuugacugaagcauuucagccccaaggcugaugauugaucugagcacuaaucgaucucaaccaaaauggaaacgguuuugccuucaauaugaugaaaccuuuaauauuggggggggaaaguauuuguauaacccaucuuauuaguugccuccuuaauacacacuguaccuuuacauuguaaaacaucagucuuacauggagcagcaacucuuaaacguaaugaacauaacgucaggaaaucgcuugguggcacucaggcaaggcucccuuuccacacaggagacacuguugacacaacccuuucucuucuauuggggaauaaguaaauaaugguagggguaaccucagccucccucccaggcuugugacacaagccugaaauuggaaacuauguguucagcaaagcaaaacagaaagaaacaaaagcuugggucuuucugcccaaggaguagcgcuaucaaccccagacuucuaacucagcuucuguuuggggcacguguuucuacacguuggguuacacaggugggcagguacaggcuaaggguugaggccaggggcuuuccucagucacucucuaccuuauuuuuggaaacagggccuuucacugaaugucaguuucccugaagcuagucucacguggagcucauggacaagccgcacugacuggccaaugagacaugggguccucgugucuaaccucuccagcucugggucugagggcugugccacgaagccuagcuuuugcgauaggguucaaacauuucucaugcuugcacggcaagcacuuuacugacagagccaugucccuccccccaccacuuguuuuuauacgacaaauacccacuccauaauaguucacuuuccuguuacauagguccaaaccaaauccugacgacgaugaaaccaucaugaccaagcaacauuuguggguaauccagacuuuaaaacuuaaucuagacuuuuaaacugagacuagaaagucaaggagaaaaguuuacguaaugaaaauagguccacuguaaguaggucagggguaagaaugugaaccuagcuccgcccaugugggguucaguucagacaagccuuuaucgugcgcccuucugauuacagcugcuuuucuugggaaacauccuuugauuucagcucacuuuccacucucaucucuaaugagguucagcuaacaaaaccauugcaaaaguacacagggauacacaguccugagccgggccaacagacaggaauccccauugccgugagacugagcccaucugaaguaagcacuccguuacuuacuuauggagagguucacccuccucugcauaggcaacaggaaaugaguaacacuuccucucacucagugauaaacugcagcaagaaaaagaaaagaagaaaaauguggaaauuggaaacccuuaacauuaugaacugaucucaagugaaaucuagcaguuguuauagcaaacauagauuucucccaucuuggccaagcagaaauaauuguauccucaucugugugugacaaaaugaagggacccaaguggaguuguccuccagucucuuagaaaguaaaagacacacuggagcucagacccagguagggcuccguggccagccgcugauacagccgcagccaccggguaaaggacgcuucuuugacuuucuucugcuugcguugcuuuaacuguagaucacacacucagauaguggcacccuaaggccgugaauggcaccuucacuauggcagugacauucucucuauaauuagugccaccuucccuguaauggagauauccuuucugagauagugacuggcacuccuuacagagagucccuccucaucggguuuucccauugucuauaguuaguccuucaggcugcuucccacuguguugcauuuguuuuguuggauaaaacuauauuggcgcauuuuuugcccuagcccgccuagccucaccccuggucuuuugugaccuuguaccugcuaauaucuagcagauugucuucuauuucucuccccucaaaucaucuacauuugcagcuaauuuuaaacaucuucacuuguauaauuugugagcaccugagacugcgaaucugaagguaaauuauucuaugccguaugucauuuuuggacuggaauccuuccuccugucugcuguuggagaugaagcaugggagaugguacagacuuauacaccucauggaaugaugcaggaggguuaccgccacaaaaggacuaugcagucaaaguccuuuaaaagguuacauuucuggucugggcuuuguggcuugcgcagauaauuuccauacacagaagucugaggcaggaagauugugguguguuugagacugaguuuaagagguggcgcacgccuuuaaucccagcacuugggaggcagaggcaggcggauuucugaguucgaggccagccuggucuacaaagugaguuccaggauagccagggcuauacccuaucucgaaaaaccaaaaaaagacacaguuccauacccugucucacagaaacaaaaaagcucccucagaugagcagaccguaugccauccccccccuucuguuuuauucucugcucuuguuucgggacgggauuuugcuguguagguuuggcgggccugucuggccuugaacaugcagagguuuaccugccuguuucccaccuaccaggacuaaaggcguauauaucacugccccugcuucaguaugaaccuuccauuacacccucaucuucguggaaaccuguccacuuuacugcugcagggacuugccgguauguuugucuccugcaccauuuccuuuuccuauguaauuccguaaagaccagcgaauguucagccaguacagaaggacuagcagaauagugcuugagugguuaauuggugaaugaacauggaagaaugcuaaggaccagccucggcuuggagagguucugaggaaggggagcagugaaagaaaggacucacaaucaaaucguggguugaagcuggcgauuugugcucugcuggagauagcgucccugccugccaucucucuguucugcggucuuucucucugaucugcuuucucucuguguucugaugcuucuccaggcaguucucuugcuguucuaaaaaaaaaaaaauucucuggauaucucuucucuugcagaucaugaacucagucuuuuauuuuacauaucaauccggucauuuacuccagguuucccuuugaccauccuaugaaucugcaucccgugcccccagccuccuaauucuuagaagacaggaaacccacauuuucuuuuaacauugcaaaagaagucagagaucugccugccucuguuaagcacgucaguaagcuagcugggugggacccaguccugaaauuaccuuuucuaacacaccuaaauuucuaaauaaauagaauaaauagaccuaaauuuccuccaucccaggcugaccuugaacucaggaaucugccugcauuugcaucugccugucuuuguaucuuucugacaagccggcucauaguguagcugccucuguuucuguagauccguggaacccuuuauucaauucauauugcauccuuauguuuuugcauaguugaaaaguuauauauuuccgaacucauguccuuaagagcuguguuuuccacagccuuaagggcuguccugaaggucccagcauuuaccaucuugcuaaaacauuagccacaccuuagccuccuggacugaugccgucugggauuaucauggccaucauuaaugugaaccggaaggacauuccuugaaggacugugaaaauauguauauuauuacacagacgagcccuaagcccaugucuccuggcauaugacauucuguuccuacuaaggccaugucagaagaacuucagagaauugccuuuaagauuuuucuucuaaagcaacucacaaggaaacuuuggucuauuuaccaaauuaccuaaggacuuucuggagcugugagucuuaauaauauaaccaaagagcuuugucuuccuuugagaauaacaccacaguacagcuagcacuaacaguugugucuaguuauuuuaguugacuagaaguauaaaagcaguguuugagcaggcugucuuggaaugcuuuucuaggcuccuuugacacagacaaacacuacuucuggaugcagcagccgccgcgugggcacucacugcagauaaucuugacugcuuugaaaucggugaucaagacaagcacguggacugcacaacccagagcacucuauuaauaauaauaauuguuauuauuauuaauaacaaaugcauaaaaaagacucucuagcucaaaaucauggucgauucaucccagcagccaggagugaaauguguuacgagacauacaaaaacacugaauccaaacagaaaguacucagaauuaauuccagcagcugacaacaggugucaugguugaaaugaugaacaaguuuccccagaugguagacagaagucaaccacucgagauuaaaaggugauuucuguuaucacaggcacagaaucauggccuuggagaaaaugagggcaggaagugaagaguuagggcugaaauggagucacagcacugcucgcugccuugcaccgcagcaggugauaguucucucauuugcaaaggcaagucagcugcagaccggaagcaggcuucucacuuccgcuuccgcuccuccucugucacggcauuacucccucacggguucuucuucagaagccauuuauuuucucuccucucgcucaccacaacacccgcaccgaggccucuccgucuguacgaccaagaaaggucuuuaaaacacaagccugauccugcauauguuugguuaugacucgucaaugagcccgcccuugccauuucuuccgggucaagcucuuuuagcucccggaugcagagugcuaaguauaacaugauuagcuacuuuugguuuaguuaauucggaguucauagagaguauuuuuuuuaauuagauauuuucuuuauauacauuucaaaugcuaucccgaaaguuccuuauacccuccccacacccugcuccccaacccacccacucccgcuucuuggcccuggcauuccccuguacuggggcauauaaaguuugcaauaccaaggagccucucuucccagugauggcugacucggccaucuucugcuacauaugcagcuagagauaagagcucugggggguacugguuaguucauauuguuguuccaccuauaggguugcagaccccucuuaucauaccccccuuuuacuuuucuuaacuguuaaaauuaaaccuaguaucugacuugcucugucaaugaacuguaucccaccucuuguuuuuuaguuuuuugggguuugcuuuuuuuuuuuuuuuuuuuuuuuuuuuuauuuucaggcgagaucucacuaguuuuccaggcagcccuugaacaugcaguaagacaagcugacauuaaacuugccaaccuccuaaggcaaccucuuccauagcugggauauauauauauauauccuguacuaccaagcccaggauuccaggagcccucuuaacugcucaccccugccuuucauuccuccuccagcguaacucuagacuccauugccuucuuccugucuuaguuuuauuuaugccuuuaguagccucaugaauucccugugcccuaaauacuauguagcucuccuccuugaauguaauugcugagcucuuggaguauguaugaagugagaaagacugaugaauaagaccaugaugggagaggagccaugcuugugcggagaagaauugguggaucuagggguguguccaauuucuccuagguguugcuguuacuggguuacugggccccuuuuccauuaauacgguagcuucauguucuguggauguugaaguuugaauugcugaggaguuggccuuucugucccagguuuuccaccucugcaucugacccccucuuccugcagcagggccaggcaguguugguuguuuuaagccgaaagcagcagacaguguacgcccuguucacuuagcaacuuuuccccggugccccuuuuauuucuuggcucuccaccaaggauugacagguaaacaaaacucuuguuuugguuaugauuuuacuucuagggggaaugggggucgccuguauucucuugggguuaaauguucugcuagacgcaguguuaucagagaaagaacucaacaaaaguuuucguaugauaugcuuugggaacgaauggggcugucccuccagugccuucgccuuucuuggcuuacuuaguuggcugaaacauggcccagaaccuaagccuaaucugucuugaccaaaggaacgccgguguucauucucagaccaaacuguguuucuucucagaaaugucugugguguuuugaauuuuuccuacuuaaaauguaagcggcauuguucuucucaaacaaaauagucaaaauacagaaaggaaagcgaguagagggauucauaaccauccagcauguuuacugaucucaguguuucuggggcaaaggcauguggggagggaaauuguacuuauaaaaggaaaguuggugcccacgccauuaccacccaguaucuucauauacaacauaaggagcauucuucccaggcaguaggucacucuuuacacaucagcguuuuuaaaguauuaguauggccuugagaacugcuugcuuaguuuccaguguagcagugcugagacacugugacacagcucuuucccuugccuggugaaauuccuguugugcugcagcuuaaauucccaggagaagaugugggcagugaagguaggcuuaucgugugcuucaaugucuccccacaccacuaaguugauaccaugcacucugucauuuaaaacccguucuuguuucauugugcaaucaguugccuuccuuuaguuuucucaccuguucauuuaguucaaaguuauuuuuuacccuagaauuaugaugagauaguuaugacaaauagccauacuacuuaaagaugguuaugccacccaagauaaaauauaugucagugggccacugcuccaacauuaauagguuccuguguucaucucuguugagauauguuauaaaaagaaacacuuguaugacugagcaaagaaaagggaagcugcaucgucugcugccaaaauaccacauccguuugguucagguuggucuaaaacacagguuuaguuuuagcuuuccacagcauaauugaaggauguuacagaacacucaaaaaauacuuaccuggaacgugagggucugugguucaaauguaagcaaagauacggaguuguagaacuccuguuuuauaguaauaaucuggggucacuuugucucuccuaccuguuaagaaagucaguuucucaguccaaaccuuggcuggagagacaguaacugagaagaugaaccacaguucaucuuaguuucugucuuagcuaggguuuuacugcugugaucaggcaccaugaccaaggcaacucuuuuuuuuuucuauuacauauuuuccuuaauuacauuuccaaugcuaucccaaaagccccccacacccuccccccacacacaccccuacccacccauucccauuuuuugguccuggcguuccccuguacuggggcauauuaaguuugccuguccaaugggccucucuuuccagugauggccgacuaggucaucuuuugauacauaugcagcuagagucaagagcuccgggguacugguuaguucauaauguugcaccuacaggguugcagaucucuuuagcuccuuggauacuuucucuagcuccuccauugggggcccugugauccauccaauaguugacugugagcauccacuucuguguuugcuaggccccggccuagucucacaagagacaccuauaucacgguccuugcaacaaacgcuugcuagugaaugcaauggugucaucguuuggaggcuaauuaugggauggaucccuggauauggcagucucuagaugguccauccuuuugucucagcuccaaauuuugucucuguaacuccuuccaugggugauuguuuccaauucuaagaaggggcaaaguuuccacacuuuggucuuuguucuucuucaguuucauguguuuugcaaauuguaccuuauaucucgcuauacuaaguuucugggcuaauauccacuuaucagugaguacauaucauuugaguucuuuugugauuguguuaccucacucaggaugaugcccuccagguccaaccauuugccaaggcaacucuuaggaggacaacauuuaauuggggcuggcuuacaggucccuagguucaguccauuuaucaucaaggugggaacauggcagcauccaggcaggcauggugcaggaggagcagagaguacuacaucuucaucugcaggccccuaagagaagacugacuuccagggagcuaggaguaggguauuaaagcccacgcccacagugacacaccuacuccaacaaggccacacauccuaauagugccacucccuggcccaagcauauacaaaccaucacaguuucaaauccacuucugggucuggcuggcuuguccccauucaugguugcuacuaggaagguguauuucaggcuaucuucaauuaacauucaucuuuauaauuuuagcauugagacacugucaaucuucugaaaguuaggaugccuguaugccacaucaggggaugguuaaaauugccaagucuguuguacccagagcuaugcucuguugcuuuauaacuuaauuuugcuuuauaugguaaccucacauacaaaaauagcauaaauguuagaacaaugaaaugaaaccuauuuagugaaaaacuugaauauggaggauuaaaaaaccuggauuguuggcuuaaaacuucauaugguguaauuuuauuuaauuguaccacuuuaaaugaucugaauuuaguguguuucaauguucuugaaaagcaaacccaguccuuuuuauucugugugguuuugaacuuaguauaccccauuagagugacgcuuucaaagagaugguaguggcuuucacccacguucucuuacuaagucucuuuucuuaaucaguugucgguacaugagcuguccuggccaagucagcagccugaccagugcgguuaaauuucaauaagugaaaaugaaauaaauucagagucgagugcccaggucacucuaaccucauuucuaauauuaaauauugauguggcugaugguuacaguauuuaguagcuuaggugggauauaaccaccaucacagaaaguucuguuggcuauuacugguuaaaaaaaaaaauaguaggaauccaaauuagagagucgaauugaauaugagauuuuuuuguacucuuuuaguccuaaacaguuguuauguagguguguuuuccuaacuucccaacuguuaaaugaaaaaguagaccucacugggagagaggauuuuuguuuguuugauugauugauuugguuuugaaaucgucgcccacugucaauacaugaacccacuccuccuuuggcuucccugguacuugauguugcgcuuuguauuuuaacaugacuucucugaacucuuggcuugcugaaguccuuccucauaguuuuauuuauuggaagcaggcugauuugauuaucagcuuaauccucuuagcacauaaaaacuugagccuggcacaaccagcccugagcugaaucuguucccuuauagggccaccuguuguaugucucuccuaagucggugguguucaaagacacuggacgguggcugagcccgucugcgugcugacucaacgugaccgccaagaauuccaucugcuacccagugcagagaugcuggguuaccuugcuuucaaaugucaagaccuugaucacagcaggcuucauuuagucauuuaagugucacuugaauuagcuaaacaugugagagggcaaagaauaggguucuccuuguucauacugcucugcaggcacugcaggcacugcaaaagcuuucuaagggaccuguacugcagaguuuaggaaggaccuauugagauccaggccugccuucucuccuuuaguuccuugauaggauagacaacuggaacacuuuggcaguguucagcaacaauugguaauaucuuuuucaaccauaauuugcccaaugcuugcucaauggaugcaaguaauggauggacuaguaauauagucaaacugggugugucaaacauuuuucuaaccaggccauccagaugaaucgggcuacaguuguaacauauguuaaagagagaaccuuugaggucacacagauauaugugaauccagucaggcacuggcauggacugucuugauuugaagaacauggucucuguucccaugaaauugcccaccuucuauacaagcugguggcugagagaccugauuuaacgacagcaaucaagaauugcaugugaguguaguggguuucuuuucucucuuuuaagauauucagagaccaaacaaaaagugugugugugguauugacccugugagggcgccaccucuacagacugggcuacucuuccguuccauuuaucagaaauaguuaucuucuccucaaaagcaaagaagugcacuuucguucauuuuaaucuguucuaccgcaacuguaugcauauccagucauuuuuauaauuaacaguugcuuaaacaagcaugguauuauuuagcaugugcaaguacuucucucguagcagccaaggugcauuuaucaaaacaaaucucucugauucuggaaauuaucuaaccuccaauauggaccuccauuuaaaaaaaaauggaagcaacacuacugaucauuaccacacgaauaauuguuuuguuugaaggugauaugcuuaaauuauuuuacuuaauauuaacaaccuggaccuuaaaucauaacucucucaucugaguaaggaaaaaaaaaaacccuccacaguccugcuaauaagaaaccccacaaaaucaaaucaggguccaguugauaaguacacuagguagacggauaaugugacugaggaauacaugaggcaaagcuguguggcaugugugaggacaguguguauaagaccaggcuucaugacagcaccagcuggcgcaccuccaagaaaagacugcuuaguugauuucucugugaguuaucauaaauaggaggaucuguaauagguaaggauuaauggauggauggauggauggauggauggauggauggauagauggauggauagauagaacugauagaugaacacauggauggauggauggauggaugguuguacaacuuauuaagaguuuuggcaauuauggcuuuucaaaaaaugacuuugggaguaucgucucucuagaaagaggcauuguauucccacaauaagcagauuaaguaaaagcccaggaaugcccuccauuuuaagugugacaguggcaguuacagguaaauagucacacuugacuaguuuggggcccucuaugggcuuugauauaagcaguuuuauuuuaaagagagaaagaacgugauugcgaggacaaccugccagaugggugaucaggagaguuuuuagaacacagaagaaaggcuuaaguaaaaguucuguguugugguuuguuuucuauugauuugucaacucugucaaguuggcagcugaagcuaugacaacccauuccuugccagcuuuuacacagcacuuuaaacuauaaccuuuccuuucuuguuuguuccccaagaucuuaugauaauaucaugguauaaaauauuguacagccuuaaaagucuuaguuuuuuuuuuugguuuuguuuuguuuuuaaaaagaaauucccaucacugaaaaguucaauuucucuuuaaaguuacaaagucucuggaaugugggcuccuggaaaauaaauccagagucaguucaauacuuccaagaaggaagaacaaggccacaagacacacuuaaggaaaagcaaagucuagcaguggcauuccgucauuggguagcucagugcuuaacucacuuacgaccuuggccccagaggccuuuagcagcuccacuucuccaguuuggcauccauagcauguugaucuuggaggcucaggacagcuccauuccauacuuccggcuguccuugggaaaugcccucuaauccugacaucuccaauaucccggggucuccacugcaaccaagguuagaccuucaccaacagccucaguauccuuucgaagugacgugccucagcuuucucuccaguacaucuucaauccugaggcuugucaugauacaagugcuuacuucuccaaugcuaauuugaaaugguaaauuggaaaaaccauaaucacuuaagaugggcacguugcuauuauauugaggcauuuucuucuauguuaaaaaugaaugauauaaggucgucaugguauuaauuguuuuacuuuuuaauuugcuaucaaauaggauaaaguaugcuuacaaauauuuucaaaucgaauuuuaaaauucaguggccuaaacuguuaaaaagaucaggugucuugaauaagugguagcuucugugaaucagccuuuguuguauauuuauguagauagcuguuuaaaauuauaaugaaguaaaccuuacgauuuucuuggcagacugauagcagaggaaucuauuuguguauucgugccauucaccacuucuuagacugucagcccucuggacugacguauaggaaggacgucacugaaagaugcccuuaauuauccucugaguaagcugcccagacuucccaguacccuuuaaguaagauggguaagaccgcugugaaguagucuauacgugacaauugguaaaauaaggcuuauauaugguuaucauuuguugcucaugguuuuaaauacucuuaacuuucucugaugcauuuaacuacuuuuuauggagugccagaaacuaagacuccggaugccuaucaguaagcuagauaacggccccuuucuauacuguacuuaccuggcaagaaaaaaaagccaacgaagaggcagucguaagaccauguguaagaagcuaaccuagguguauugguuagagaaagcuucuuagaggaacugaggacuagcuagguguggauaaugcccaggggugcagugggugacgcaggguuuaagauguuuacagaugaacacggaggaggaggaggaggaggaggaaaccccuuuaagaugaguagcagaacaucuaaccaugggacaggagcagcucucagaacaaaugcuccaguaucuuuccugaacaaucagggguuuccacacucccagagugagugggguuucaguguugagaauggaagcagaggaguuucaugucgacauaaugaauucagcgacccuacaggaccaucuacagcaaaaguuguagguuauacaaagcauguauccaggguguggggcugaugggcuacccggcgugggauuuggggccagcugaugaaguccugguguugcuagcauuacacuuuuauuccuuccuugauagcacugaaacacaaaucuuccacuaucucguuacucaccagacuuucaacuucaauuaccaaaacuacaacuugagcuuuugaacuuaggagagaauaaggaauauaacauuuuauggucccugaaauguguuuuaaugguuuuuguccuuuaaaccucgcaccucagugggucuccuggcucuauuuucaugcaaauuuagauaaaaauccuucuggcaggcauucauuuaaaacuccacaugcgugacuuaccaucaguauagagggagcacugauugacuugaauacuaugucuugcauuauaaaaaauauaggacuauuuugaaauacccuuugaauuugaaaaauauaugcuauauuuugaaaagcuucaaaaaaaccugauaacuguaaaaagggauucaaaauauuuccauuauucuuagugugucacgaauaccugugaguuaaauuuauacccacuaauguauuuagugcuguaugaguguuaauugugugagauucauuucuucuagaagauaaaauuaccuugaucaguuuuaauaaguauaaaauugaacugcggauaguauagacauuuuaauuucucuuacaaaauaaaugaaggaguucacuauguugguaaggcuuucauucauacacacacacacacacacacacauauauguauguguguguguguguguguguguguguguguguaacuaguagugaaguccuauagacccucagauauuacaggaugaugccauugcuaaagauggcacauacuugaguuguagacuauaguaacaucagucugguacaaaccccgaugcuccaucccugcugacuaucaucauagugcuggaagguacuguguaugcuaccagaggagaaaacuauuaacuacucuuauccaacuguaauggcugcccuggcaaaauaaugcccacuguuacaacagcggcaacaguguuaugagaguaaccaaucuuuuuugcucugcuuuaaggccaguucuguaagacaaaacuuaugccugguaccaaagcucguacauugggccuuuaaaucauaggccuguggcugguagagucuaggucccagaggugaagccucuacugucugauaaauaaacauaguaucaggccaccuuucuuucuaccuauauuauuuaucuuucucccuauagaucaguaaucugucaacccucaucagaaagguuuauuuuugcaauagauggccauuaacccagagacccaaaaccugucagaagacagaggguaagagacugaggacauccuaagcaugacgucugugucacaccucagugaucauuucagaagauggguaggaagagcuagaggcagggggugccuauagugaaaugguguauuuuuuccuuuuuguuguuuguuuguuuuuguuugggaugugagaguucgacacaugaacucacagccgcuaugacagcaugcacaagguuaaaccaaaguccagcugggugggagagcggagagggugucaugauaccuuucauaguugaagaacuauuaacaauagauggcugguggcagaggccauuuucuucacauaaagaaaggcugugcccgugcaucuacuagaaguauuaagugggcuugacaugaguuuuagagaaaaguuagggaagaauaguggacuagugguggaagaaugggggagggauuggaaaugagggaaugguauaagaguguggauuugauaauacacuuucuauaaggaaugcgauuggcguauauccucugcuuugguuuucuuuuuuuaacuuuuuauugguuccuugugaguuucucaucaugcaccccaauuccacuccucucccccuccccuuguacccacccuccacacuugcaaccucccugccaagaggaggaaaaaaaaaucugguuugggaagcuguagugugucuuauaguuggcuugcaaauguucaucgaagugaguuguugguguggaacgaggccucugaguucuguacaccaucaauaccgggaagucacugggacccucagauaagcuguuguugcccugugucgugcaaaugauguccuuuuaaaucugggacuccacacacuccagccauucguugaugggauagaugugggguugggucacuucaaagcccggauuuggaccuuagcucucucugaacagguugucccaccaagcucuuccacaaccacaccacuggggagagcacuccugcccugcccgggcuggcccaucuaaugccaccgccagcaagggacagagccagcucugccaaucucaugcccucggagcuggcucauccucacccacaccagcagggucagcucuauugugcugcccaggcaaguugcagggcuugcucucuggacuguuacagccagugaggaacauggccaguucucuuacucucaugacucuggggccagcucugcagccuggauuagccuauguuuuuguugggagggggggaagcuuggggggggggcggacacgguugagaugaauacaauuguguucauguguucacaugugugcagauuccuaaguguaucacgugggagucugagguugauguucuguauuuccuaagaucacucucuauuuacuaaggccaggucuccugaugagcccagagcucugucagugugcguucuguggaucugaacucggauccucaacgcaggaacaccaagccuguccgccgaagcaucuccccaacccccgagcauucuugucauugaacgugauaaaagaaggcuuuguaaauauguacaaagguuaaugaucgcugggaaccauaguguguguuucuauauuguauguauuaaaaugucaccgggcuaagacuccaauugaaucaguacauuuuucgaaagucuuuucuggucaggcaaacagugcugcugaguugaagauguggcucagucaaguacggggcccugauuccaauuccuggaaugcguggauaagugugugagggcuggggcggacauggaccagaccaacucuccacugaauuccaaguucaguaagacucugacuuaagaaauagauggagagcaauccaagagagacacacuugguugaacuugggccuccacacauacaacauacuaguguaugagaacaugcacacacauguggugcaacuguacaguaacucaauaacaauaucuuuaauauaaagcuaaacggaaacagauuaggcuacauuuaguauuuaucugcuucaaauuugcaaaugaauucuaucaagacuucacuaaaacuccuuuguacuuaaacuaauguuuucuuaagaaaaugugaacauuuuuuugaguuuccauugucuugucauuuuaggagugccaaagucgaaucuuuuacacaccaaaucagugagaggccauaaagacugcuuugaaaaauaccauuuaauagcaaaccaggauuguucucguuccaagcuuuccaaaaguacuuaugaaggaguuaaaaccaucgugaguaagaagauaaacuggauugugcaguaugcccaaaauaaaaaucuggauuuggaguccgaguguuccaaaacuucccagcauccccuguugaauuucaggcauaagccagagaagaaauugcucccacaguuugacucucaggugccaaaguacucggcaaaaggcucagccggaaacgcaggcagcaucucaagcuaugcgcagagaauccuggagcacagagaaaauacagacuuccggcuggguuuauuggaagacgcggaugcauuguggacucacagucacagccaggcacagaaaacagaagagacaagcucugguccggaggggacuauccagacccagaauccacauuacagccgugaagaaugugaguagugugugacgaagaaaggugaagaguuugugguuugaccuuuuugggggacgguugggugguaguugguuugggguuuguuuguuuuucugcgcaugugugugugugucugugugucugugugucuguuguguguauggaauuacaacagcggauuacagauuuggugaacauaauauuuuaagugacauuuugaccucaacaaaagugagauaucuuaaaaccuucuuuggaggguucuugaauuauaucauuacauaccgcauuucauugccacuaucauuuauuuugcccuuauuagugaccaaaucaauggaaucggcaaacugauuggaaauuucaggguuccuucuguuuauguaacuggaacuauuggccgguauacacuggccuguugcuaaccccuuauaagacuaacuggccagggguggucaguuuaaacacagacaucugacaacuuacggaaagccuaaaagguaacacgggcguuuguuuucaauuuuaaaaugacugcuuuugccugcaucuuuucuacaagaucucacuaaggugacuuuaauuggcugaaaugaagugauuuuagauccagaaggguccuugacuaugucuuuagacaacuucuugauucuucaugucaagguuguuuugcuagauagacauuucacaugacuugauuaaugccuaauaaagucgguguggauggacagugacugggaccucagaagauggaaguaggagagaccagaauccaacgggcacacuacccaccuuuauuuuuucaagcuguuuccuguggaagauggagguguuccaguauguguuuccugugaggguuuugugguuacaauuugcuacccuuuuaagaaccaaugaacaaaaccugggguucgguugaauguugaaugagggacuucacugcccguucuuuaccuaagaagcuggcaggcagcuugcucuccgaggcugugugugguaacaguuucuguguuuucauauuucagugaauucgaugacucuugcugaaguaguacaacugagugcgaagcuccaacagcgaauccaagguaaagacucagccucaaugcuuguuauguggaaaaaugucgguaccgacucuccccugugacgggacauuguuagcaucugcagcauugaaauuagggaguuagacauugagaccuguugagguuugggaggcaaacaguaaagguuaaguucuuuggggccuucaggaaaagcaaccuaaguagaauagagacugcagcuaaccucugccuuuggccaucaucgacuucaucgagggccacucacggcaucgggcacucugggauauacguccugauaguuccuuaaggcaguaguacuagcccugguuaucuguauaaacuauguaccauuugaaacccaucaaacguaguaagauaacuuccuauggcuaucugaugcaacuauuacuaaaacauagcuauuuuuuuccuuauucccuguuucugucucucugggcccaccucagcacaccugcguggaauauuugagauucccaacaaaacauguuauuuuguccauaaagacaucaggauuuucuaaaauaauaauaauaauaauaaucugcauuaauugucauuucuuccagcuuccuuccauuuaaaugaagcaguuaguuauacuuugaagaucuuuaagucacuuccagagauuaugcguucagacaguaggagacucaagugcaaagcuuuaagcucacagcuucugaaaagcacuaaaacuugcacugacaaucccaggucacgcaaauaggaccucgucugugggauggccacauuuaucaccgaucuuacccauaauagaaaguucaaguccuaggucuggauuacuugccugacucaggcacaugccuaauaguaagagaccggguuuuaaaaauccagggagucuguuccaagucucugaggaguuucuagaccuggauauuaauggacauuuaugucauagaucauuauguccugauugguuuauugguuaugguggagagagaugacucaagugguggccgcucuuccugcgguauauacuuagaaucuuucuugcacuugguggaguggagagcagacagcaucgcaguuuccucuaugaagugagauagagugaucaacacugauaggcucagaaggaagcauuccuuauuaaaaaugacuugaugcguugucccuguguuuacugaagguggagccuuagcguuggcuuucugugcacuaaaaacgaaauugcuuuucaaaucuucacagagguuuuugaagaguuaacacaccaggugcaagagaaggacucucuggcgucagagcuccauguccgucacguggcuaucgagcaacuccucaagaacugcuccaaguugccaugccuccaagugggacggacagggacgaggucacaccuacccaugaaccacugaagggaccggagcuguccugcuuucauccucuacugcucugcuaagcauauggaccgagaaaacaugggaaggaagucaugguccauuuuuaugguuguugugcuugcaaaaccuaagauaauacucauuaucuuuaucuaauaaagcagaucacucuaguccaggguuacucaaucauuuggcuucaucgggggacuucuuauaauuacuaaaugccccucccuaucuuuuaccauaugugacuacuuaaauauucuguuauaguguuuuuacugaccaauuuuuauuguaacucaguugucaaaaacaauagaagccuaguaaggucuuauguucaccuaaacuacuagagagaauuuuuaagagggaaauagaauucguaauaucaccuuauuuaugagcaauauuuuaauauaaaauuuuauauagagaauugcuauuuuggguauuuuucauugucuuuauaagucuguauuugaauggccauguguauuugcacuuccugugugaauauguucaccucugucaagaucgcugcauuuuggcaauacgguguuuuuauaacuuaucuuucuuuccaaagauacauguguuucggauaguauucggagaagcagucuaccuagcugagcuguuuuaacuacuuaacagaauaugaaaguggaauuaaucguuccuuuaaagcaaauauccaaguaaacaaagcagcagauuauuguuuucuaauggaaacagugcugaauucgcuuaggaagaaaagacuauucuaguuuguaugugucagucuccauaaaaguaguggcccugcccugcuucuuaauucucaacacuuucuuggauguguuaguuuuggacaaaguaggucaacuaucuucagacugcacuggucuuccuuugggggaaaaaauaaaauuauuaugugugccacuucacauggaguucccguaaucuacgaacuguccaaauucugcuauccacaucacugaaauuaguccaaaaaauaauaauaacaaaccauuaaagaaagaaaaggaaaagcauuucaagguacuuuucuaaguuuuaaaacucuaaagggauagacgauuauagcaccaccaccacccaaaaaaaaaacuucaauaaaaaggauaguauaagcuacuuugguuucauauucuuagcuacuaaguuaaugaugacacaaaagcuagugcaaaauuaagaugaacucuuuagcugaugcuuagaauguauuuguguggcugauagguuuugccugcagaaaucuaaggaaagaaaacccauucauucacuuggcagccccucacuuggcagccccucaugcauaaagaugguuucugccuugaagucggcagucuguaccugggcaugggucagacuuuaauauugaacauaaauaauauuugacuaagcaaacagcugccucacuguagaaaaagcaccuuuuccugaugcuaggauguguuaaacuggccuggcugugugcauuagucaaugucccauugguuuugcucuguccugaagaaaacuuaccuuugaagcuuuuuggaaggaguuucuggggaaaaagaaaaaaaaaaaaaaagaauacuuuucaguuucucucaguucuuugagucauccaaaaugaauuuaaaaucuggggagcagaggugaacucauugccuuaguuuuggugagcuuuaaauugaaugugugcaauauggaaggguccacauuuacaagcugggugaagacaacguguccugauuaugccaguaaguguuucagugcuugguuguuaugguuacauuuuccaacgugacugcacuccugccuggcguaacuccuuaaggauggcagcacacuugggcuucugucuggaugauggaaaagcagucgggacagccauaggaguauaagagagucggcuuuuggaaugugcaguacuccguguauuucuauccgaggagacauacccuacggugcaguccuaaguaccaguguuacccaaagaaaaacguuugcuuaucucuuauuggcaaacacuuaguuuacuaaugaguuuggaauaauuggaauuucucccauguacucuuuaaggucuuaacugggaccucugauucauuucuuuuagauauuucacuggaaacaccaaaggaauagugcuccguagucugucucuggugcuggugggagcacucguacccaugcgcguggguuuugcuggagcgcacuacuuuguguaauucaacugccaguuauuuguucaggguucuugguuguggugguggcuugcuugcuugcuuguuuugacacagggucuugcuacauagcuuuugcuagccuagaguucucuuuguggaccaggcuggccugggauucguggcaaaucuccugccucaggaggagaucuagugcugugguucaggucuauaucuuacuccuagcuugauacaugcucuugauugaauaugcaguuauuguauaugcaaaaauaaggaaggggacagaguugagguccaguuuaaggaagcaggaacuuuuacaaguacugguuucuucucuguuuggcucuuucaaaguuguuguguguuuugagaaaguucagaagaaacuucacacgugauuucauuuaaaaacaacaacaacaacaacagaugcacugcuagugagcccguacguagaagcccgagcuucuacgaggagcgaagugaaguuuugucauacuagacuucauaguuaaacaaggugcauauuuuaaaaauuagacuucauaguuaaacaaggugcauauuuuaaaaaucagaagucagaugugauuuuaacacauauuuuucuuuaaagauuaguguuuuuaugugccuagcacauaucaggcccugaguuauuaauuccugucacccuaguacauauacaaagguuugguuucugguuuggguucuauuauguugcccagacccaagcuuaguggccaucuuaccgcuucagccuucugaguggagacaugggggggaggggaggggauugacauacauugccaugcuuggcuuaaauacuccuguuguccauucuuguagcauuucuccagagauuaccgccugauucucgcauuaauuucuaaguuaguucuuuggaacgggcauccacuuggcacgccacgcugaugauccaaacaguccgcuugcuucacugugugcuuccugcguguagcacuggagucaaggaaacccuugcguuuccaagucccauguuugccucucccauucuuauauaacacuuaaugauuauuuuucaaaacgugugcauccuggcaagugauuucaggaacaugguugaagaauacuucguugccaucuugacagguagcuugugguuucuuggacucuugcuguuuccuauggaccauugagaaauggcuuuuaccauuuuguuuguuuauauagaacucaccuugguguuuauucuuuuaaggcuugucagguuuuuguuaauuuucaaagucauccuuuuuaaucaguuuguguacuuaagugagaauguuaaagaucucgcuggccuuuuaaaggguucagaugugugaccaggcaaaauaauuccauggacaugagcuguuauuuaauggcggaguauagcguuccugucaucacguuuuguuuugauuguuugaaggaguuguuuguuuuacuuuuugcaagcucauuuacugacagauauuacuacuguucacgcuacagcaagauguguggaucuuuuaagacuucauacguauaaaaauuauaauauacccucuguuaagcuaugacuuaacgcagagacuugauuuguuuuggguuugauuccgguuuuaccuugaacagaauuuuuuuuuuucugagaaaauuugguuuaaaaaaaaaaacacuaaaggacagagcccuaaauaaaauacuguugccaaguuaagcuuuguggugugggguacagaagaguuuaucugcugaaauaaucggacaccuuggggaaggggaagucacgcuggucuaggaagagugugugugugaccuuugccuuucauuuccccaauuccuuucgguuccccggcugacaucagccuucaccugagcaaccccaggccgugcccaccuugauaggaaccgaucacguggguguagacaguuaagauuuuuagacauuuaauuuguaaauguuuucacugauauuuuuaguuugaagaaaacuccaauuagcaaaguaguuuaauuucaaacuaguuugaaauuucucaguaauuuccccccaauuucaagguuaccaacgagaagcaaagauguccuggagacagacucauuuaaagcugcaccagccacugugcaccaaguguaguggauuuagcuuugaagaucggauugguuugauuucuuguuuuuuuccccugcccuacugccuccagaggagguggcuuuaaaaagugcuucguagugaugugugugugugugugugugugugugugugugugugugugugagacagagacagugacagcgacagcgaaaccuggcugcaucugcagcaguccuugaacuucaaugugugcuuugaaaacuucuuuucagcaauguugcugccauuuagaaagcgaaaaugaaacugccgugaucaaagcuaaguuggucuccaaaagaaacaaaaagauuauuuugucuucguccggguuauaugcaauuuauauauuuguauucugcuuugaaacuguaacuagauaagucugucuacuauuuuuaacuuuacaagaauaaaacaaauauuuugguagcuau

SEQ ID NO: 8300 - RNA, 1173 nt, Mus musculus
cguggauucagaacucuucagcuggggaacgguacugguaagucucccaaauugauccccggguuacagggggauauuucuaagagaaagaagaaagaugaagacugaauaaacugcuguuagaaggacugguggucgugucguucuugcuguucgagagcggacacgacaguuggugcauugguggcccguacagggaaccaacucccccaccaaguucagaacuuucagcagucagugguugcuggcaggguaaguucacagugagugaaacuugugaccccaggaguuugggaaggaccucagauaaaauagaggcaagcauaaaguugccagggagcaggcacaagguaacaaaagguuccuggcuuugggacgaguuaagguucccagcuuugggacaaguuaagguucacgguuucgggauagauuaaggaauuacgauaaucucaguguagugaucaauagauccucgcuguguaguuaugcuuuuuucucccauugacccuuuguggguaggucugauaguuuuggucuuguuuguucugauauauggacuuuguuacuguuugacgcagucaaauugggcaggcuuggugaaggcauaccuuucaccugggcaguauuuagauuggaaagccuuccuuauugaauuugcaaaugaauaggcaguggcuaacucuguugcaggaaauccagcaugggauagagauaugcugcuuggucaaggucgauuugcacaacaacaaacaggauauccacugcagguguuugagcaggugaaucagauugcuauaagggaguggaaagcauugccuaucagaggggaagcuagugaaaacuugacucuuguauugacuccccagauggacacacaggugagugagguuauagucucaucaccacgagguauuguguccaucuccccuggggaucgaguagcuccaguguugacgugggcgagagggucuguuuguguguuuccacaggaccagacggaaccccuuugggugcuggagagacuggugagaugcugcaagaaugaggcuccugauccaguugccccuguggaugugguggauggucccacaagcacaaacgauggagccgagaugggagauccuuuaggugucccagaagccaauaccaguucaacaugauguucaaauuucc

SEQ ID NO: 8301 - RNA, 2627 nt, Mus musculus
gucauuccacuuuuaacaacuccccauuaaacacaagaguggaauaggauggggugauaucugggugccugguagcuccauaaguguagucuggggagauugucaguuugucucucugacccaugggcaucugagcuaccucuucuucccaaucuuggaucaccuccugcuugccuagcauaaacuuaaaaggccuuuuuuuuguuccaagaggagucaaauuucugucuucaaucaucuccagguagugcaccacacaggucuggcugcuauucagaaaagugagcucuccacgagaaauagugucuaccugcacucauauggcaguggcauugacagaggaggagagggaggaggagcaggaggaggagaaggagaaggaggaggaggaggaggagcaggagcaggaggaggaggaggaggagcaggagcaggagcaggagcaggagcaggagcaggagcaggaggagcaggagcaggagacacuggagagugaugauggacagcauggagccagagcagaccagauggcgguuaagcaauucaucuucguuccuuggcgugugacuccuuggauauuauuauuuauguggauuuauuuauccauuuucucucuuuuaauuuaauaucuuuguauuuaauuuuauuuaaacuccguuucuuggaauaucuucucuuaaugucccaucauuuucuuuagauguuucucuugucuacuggucucuggguuccuuaguuggaugauuuacuucuagaaagauaaaagcaaacaacccugcugcaaaucuguguccuuacauugacuuucagaauauauguuuucugggguaaauuuuuuuuuuuuuggcaaagaaaagcauuaccuuucgaauugaaauuauacgcauaccuuauauggauaaacauaccuauauucccauuucuuaauuauaaauuuaauauuaauauauauuuauuuuuaaauuacugaggacauuccuauuuauuauuaaacaaaaaccuacuuauuaucuauaaggaaaaauguaucacuuugaauuuuaggguguuauuuguaagcaguuguaccuauuagcaggguauccuuccccugacuucgucauuuagaccaggcuccucuaaaguuccaagaucugccugucucuguuuccuaggucuucuguguuuuaggucagauucuguguugugucuggccucacccuguuccuuucuuuacacggauagggaguccagccuucugcacaauucuggcuacagcagccaaccuagggcugaauuucuauacaccaugagcacagaguauuuauucccauaggacaggauugaagcaaccagcuguaucaagcuacagacaaccugauguagcuuauacugcagcuguggucucuaagaacacugcauggguuuugccaucugcuauuggauugacuauaaucagcccauguguaaccaggaguugguuccuucccuccagccucuacuguguucugcccuugagugaagccucagcuucuguguucugcuuuuaaauuuaguagauacuucuuuaaaaugucuuucuucuucuucuucuucuucuucuucuucuucuucuucuucuucuucuucuucucucucucucucucucucucucucucucucucucucucucucucucucucucucucucccucccucccucucucucucccucucugcagguuucuacuccuuggcuaggaaaccaccuucccagucccuagucuugaacagacaccauaaccagggugagggcgacucuuauaaaggacaauauuuaguuggagcuugcuuacaaguucagaggcuccauuaucaucaaggcagggaauaagguagcauccaggcaggcauggcacaggaaguggugguaguucuacaucaucguccaaaggaugccaggagcagacucuucucagacaguuaggagaagggucugaaagcccaccccugaagugacauauuuccuccaauaaggccauaccaccuccaacaaggccacuccuccuaauagugccacucccuaggccaagcauauuuaaaccaccacaggaacuuuucuuuugagguaaaaaagaaauacuuggguaaaacuaagggagaaguguaguuaaauaggauauauauauauauacccaagauccaauuuaacuccacauacacacacacacacacacaaacacacacacacacacacacacacacacacacacacacacacacacaguguuguaagcccagaauuaccagagagacuucaguguuguguacagauaguuugccucugccucucccccugcuacauuaaccuucccuucuguuucaguacuguuggagucuaucaaaagacccucacucacaaagaccaaagagauuaccaucacugcaaacugcuaaaggcuaggcucacaaccaaaaauauaagacccucacucacaaagaacacauagauuaccaucacugcaaacugcaagaggauuuuuauuaaaccaacaauuugggaacccccaucucagcacacaagccggaggagagacucagaacaacacacuuuuuauaccuuguaaggggccgguuuaggcaacagggcuagcuggcuuauucucauu

SEQ ID NO: 8302 - RNA, 8041 nt, Mus musculus
auuugauaacugugaaaugaauguuuauuugaauuuuuugauuaguuguacaacuaauucaugacaaauuaccacauggauuuuguauguuccucaggacugggguuugucgaugacuucaaauuugggaucuaaaaagagggaaacauuucaggcuuagucauacugcaauaacaagauuagguaccaugcugaaauuugucaguuuuaagauuuuuuaaaaaaaucuguuuuuaaacaugugcagagaaacacaagaggugauaaacuuucaacaccuucuguaauuggggcucccuauuaaucugcuacacacacgugcugcauaauuagaccaaucaagugagagaggucucauaauucacgaacauugauccacgugcucucucucccugcuauaggaaccucacaugcaauugucauuaacuuccaaacaccccaaaaccucucuaggaugagugacagcauaucauuaacaggagcauagucccagcucuagagaaaaacggacauauucuccaccacaauaauccccaaauuucguuugcgacaaaacuuaccaucaaauuugaagguaggaaauguauccaucucuccuuuaccauacauuuguuuaagcuuauaaagcucucuguccagaucuugcugauacucugggccaauaucaacagguccuccagaugcccugguguauaauugaacaaagaaaacuaauuuaugcacaaguuaaaaugaaaccaacuaaccaaaaaacccuaaaacuacucuuuaucaucaagucuuaauaagguacacagguaaggaaaaagaaaagguuagaaaaaugacuauucucucugcaucucaguucaaauuauuuuagaacaggguuucugagaggagguacuucaaggaagucucuaagccucacgguuuguuagcaucaaagacacuuacuaagcagauuuuucucaggaucugaguugcaguauauggaaaaugaugcaguccagauuuaaaaaggaaaggaaaggaaaggaaagggaaggaaaggaaaggaaaggaaaggaaaggaaaggaaagacaaggugcaaaccaauaagacaaauauuccccaccaaaacccacuggaggccuagaauguuaagcuggggguggggcuguuaaauaauaaaugaucaaggggcuggagacagagauggcucaaugacucggaacacuuagugcacuugcacaggacucaggcucugcucccauuacccacacagugugcucacaacucuccaugaacaccacuuccaggggaaccgaacacuuuccugaccuucagagcuacuaggcauacaugugguaugcugacaugcacacacacagaggccaaacauacacauuaaauaugagguaacaagaguuaauuauuacgaguacaugguuucugaagcuguguauugaauacaugugugaacaccagagguccacgaggauauccacugacuuuaucuuuuccuaccucuccaccucacuuucagagacauugcuuccuacugaacuugagcccaugaacuggcugaccuggcuggccagaaagaccucagggauaaaugaaugucagauuaggcaaaugcugcuguggcuacugcaucuggcuuuuacauugguacuggggagccaagcgcuggucucucuuacguagcaagcacuuuaccaacugaacugucauccagguccucacgccucugaugccugccugguuagcugccuucaucuggcauugacacuucauuccacugccauuugucuuaguuaggguuacuacuguuacgaugaaacuccaugagcacagcaguguggggaggaaaggguugauuuugcuuuaagcuuccauacaucguucaucaucagagaaagugagaccagggacucgggcagcugggaagcugggggcaggagcugaggaagaggacauggaagggcgcuguuacugucuuacuaaaaaggcugccucagacugcuuucucacagacugcuugacuuucaguccagggcaguccccacaguggucugggcccuucuacaucaaucaccgaucuagaaaaugccccacaagcuugccuauugucuuuguuuauggacacauuuucucagcugaggcuaccuccucucugaugacucaaaccugaccucaggugucaggcugacauaaaacaccagcauaacauuuuguuguuguuguucuuuguuuuuuuggagacaggguuucucuguguagcccuggcuguccuggaacucacucuguagaccaggcuggccucgaacucagaaauccaccugccucugccucccgaguacugggauuaaaggcgugagucaccacgcccggcaccagcguaacauuuuaacucagugucaucaucuacagaguuaauacuuaagacugggcagacuccgccuguauccuauaccucagggaccaaaaguguguaauccuccaaacaaauuuugugcuuucuagcuuugauaccuuacgugacaucauuuuucuacccuaaaagauauagcccuucuacucccauuuaccuguccagucuuuaaaacaacuauuuuuaaccugguagagucuccuaggggugucuuccaaaggugauugaaaacaagcaaaaucauuaguaaacuuccuuccuuccuuuaacacuggggagaugauuuauagcugcccaagagacacucaaaagggcagugagccaagcacugcccucaaagcccuaauaugaacuuccugaaacaccuuucacguugucuggauccaguuaggaauauuuauuccuuccaacccuccaaacacucacccugcaccucacaaauuaccuuauauuuacuuguuuauaagcuuccuacuucuaucagauuuuuaagaaucugaacaauauggcccauaucaguaaaccauguucucuguaaaugacagaugaccaaacaaaagaacuauaaacggcuguguauuauuuuccaaagauuucgggguuaaaugaaaugauagcuauacuggacauucaucucaaauauguagcuuguacucuuguuuucccaaguuuuacuucaugcuacuuugagucuuuugcuagaucaccauggaaacagucuuaaagagaaaaaugcuguuauacauaugcuucaaaucacaucccagaagggcugaaaaccaggugaaauccugauuguaugccuugcccaaucauucuuaaaguaaucagugucuaagguacuuaauuuuccuaaauaguuguuaaaugacuucaagauccugcauaguucugugacuuauuucauuguagugacguaauugugccucuacuuuaaugacaacagacuuacuggaauugacuccuggagcccuuauaaagaaaacacaguuaggacuuacauccugaaguuuacaugcucugaacauuuauauucaaaaugggcuucgccaucuacccacuuacugucgcuuugauuuguacucucuuaucuuguccacgaagaguuucuguacaggaucaaguuccuuauuaaaggccacagcuguaacaccaauguuccucuucaaaugcacagagacugcugaccgaaggacagaggagagccugaagauccucugcagaaccauggcugagucucuguacuagagaagcauuaaaaguuaaugugcuuuucauacaacaccugaaauccaucaugugcugagaacccaauucuaugaaucagguuacagcacuaaauuacaucggaacgcaagcuaugucuggccagucauguuacccuugcacaauaaggccuuuccuucuuaccaagaggcccugggaccuaggaguagcugagaguucuguuagagcuaaacggcaagagaaaacuccugacuuggggcagugccguucuuuuucccaugaucuuagucucgggucugaggaaagagugaggugaggcuguuuaagagcacugcuugucaccagcaggaaaagacaaacugccucuacugugccagcuuccaugaccucuugaagggacagagagagucaagacagcugucuuagccaggaguaagaggcuggaaguuuccacuucacaggcucauaggaaggaaaacagcuuugccugcuaacaacgcaugaucccagccacuucacacuggaaccaaucaacuuccaaaagaaacagcaaagaaaaacaacgucaaggccaagugagcccugcaguaacaaaaagauuagaugauacaagcucauccgaguuuacugaggaucuaggucaauaguuuaaacaccaagcuuaaagccucucuccucgucagacccuugaagcuaaaccaaaugauuuucuagcucaaagcagugauagauacacuaaaggagaggauaauucuuguugagaucugaguaaaauaggaauuuaaagaucaaaaucaaauguauuccaaauuacaaaaaaauauauccaagcaggagguccaaaaggaagagagagagaggcugaaacuuagaugaaaaaaugucuucccaucuagacuuagcuuauaaaauggaaggguuccccaaacucuagugagcuaucaacaggagagccauagugcaaugaacagcuucggaccauuucaugagacaguaaguguacccuggaaauaagacgacccucucccaccgcacuucuaugauauccgcugugcuacagugcuuacggggucuuacaggcaaagcuucucaggagggccgugauaaaggccacacaaccccugaggaaauccugccaccaugcuucccaggcucccaccagcuagcuaucugcugccgacgccuuacuucuacuagaugagagagaaccaugguagugagcauacggcuacuacuucacauuauagagaaaguauggacaagaauuuaaaaaucuuuacguuaauuugacaguuauuucucuugaauuuaguaacaucaccaauuacaaaaauggugguggagggguaguguuguuuuguuccguuuugauuuuaaagccaggacuggcaucaagcuuaugaggcuggcacuggggaggcaggcaaaggccaaccuucuggagcucacuuggcaaccuggucuuuuuggcaagauccuggauacggaccgauuaugucucaaaaagcaaugugcacaaccugaagauaaacagcggaggcugauccuggccauuggagaaacacaggcagaaguguccacauacauaugcacacauagauacauagauggauagauggauggauggacagauggauggauggacugacagaaaugcacagaggguuuugagugguaccacuaauaguucaagaaucguuaacuauauggcagcugauuggcauaaugguuauuaaacauaugugaagggagagaguguauaauuuucgcuacaagggcacaauuccugucugaagauaauuuuggcuguccugaauaaguugaaugaagguggccuauaguggguaaaguucgggcacacugcuauacucccuacaacaugaaagauagcaaucuucccuauucucauuuugaagaguuaucuaaagugucaauaguaccaacuucaacaaaccugguauaacauuuaguacugcugaaaaaaaaaucaaauaagcacgaguuuucauucaccgaucccgauaaaaauaaaacauuugaggaaaucaaugccauucauacucuaccagagaauuauacaggcgaaagagcuacaggcaaguagacaagacuuuauaauaagaacaccacacuugauucauccuggaaaucuaggaacacacuuaagacauaauuaguaagguaucaagaauucuuuagcccuaaaaauacuguaaaauacuuccauauuguccacuuaggaaauacucucuaaguguuaggggaaggugcuucuuucagucuugcuuauaggugauuaaaaaaaauaugucuaaagaagguuguuuaccuaacauuccacagucaaccugcucccaaucuaacugccaagacggucauuucuucuacaagacagggaaaauacauuuucacuuucaauaacgcaccaucccaaacaaugauuuccaauccccacgucuaauuuagcguacucucugaaccccaaacauacauguauacucaccuccuaaguccuacucaaucguucuaacagugaccacauucucucuuaccaaaacuacuuguuguuucuccuucacugccuuucacuuuuucagauuaaauagagaaugcgaucuguucaugaucacacggaagacaaauggcauccuaaguguagaacaccauuugggacaaauuccguacugaauuaauauccugcacuagcuugcugcuuguuagaggucugauaguaacaauauuggggaaagcauggugggggugggggugggguaaucaaaguucaaacccagagguguagcuuugggaaggcgcacggcucuccuauuuauagcgguugacugaccagccuagccgaaggcuagucccuuugcugcucgugaguaucuaaucauaaagucaaucgacaaagcaugacuucuagauuggauauaaaacuuuuaggauaucaccaucgcccuuuccugucuuaggaggcucgaucgccgccugcauuauucacaagccuguggcgcgccgugaccuugggcugccccaggcgggcugcaggcucaccaccccgucuuuucugcuuuucgagucggcccgcucugcucccaggagagcauucacggucuuauuuagugagcguaaggcaaaucugaauacccagcagggccgaggucaccugugaccccaggccaggccaggacggugccaaggacacggggcugcgcucuacucccagggcaaaggugacgggcagcccucucuccucgugaagaaacccagaagcucagucccaggaggccgagcuagcccaguuacccucccagucaccuugcacugagucccgagcugccagagucaccgccgccgccaccguucuacuuccggcccuggcuccgccuacacacgccuacccgccaucgcaaggcacuaugggccgcggcuucagucguucgacgcucaccggacaggaagcgccucgaagggagucugcgaccggacgccucuaggugagacagaagccaaacaggaggaggaaguggaggguaagugcuuccgggucccucagcuaagacuccgccaucuuuccuacacuuuaacuucacccccuuuucccucuuggagacacugcacuguacgcaugcguauucuggccuguccccuaguucaagcucccuucggagucagcgucccgauccuugggguuggggagguggauguaggguggggguacaaaggagcgcguaaaaaccaaaaccaaaacaaaacaaaaaaccaaagcggcuggggggcguuugugccucgugagccccgucgucgcgggcguuucgggccgcgcagccugcugggaguuguaguuccaggcccgggggugccugggaggcgggagaggggcugggguuccuuagcgccgauuccacgggaagggccccgggaccuuacccugcuacucgcgggagcggcgcggcucgcccggagaggcgcuguaccuggagcccgcgccgccgccguucccagccggcuguggaagcgcgggcuagggccacgggacgaauuccggagcuggugaguugcggacgcgggcuggcggggagcgcgggcccgcgcgggcggccugguuccggggcuuguccccccccgcggccgccucuguguuuuguuuccgcuggguccccggcgcugcgacucccauuuccguucguggagacuugagggagccugguggggaggggcgggagaggcugugcgggaagccgaggggaggggcgcggggagcggcguggcccgggccgcguugcgggacgcggcggagucgcccgucgcacgggcgcgguccaggcucggcgcgcuggccgagcgcacagccccgggcgcucccgggucucucgggaagaugccagaccugucugucacccgagucagccauc

SEQ ID NO: 8303 - RNA, 28887 nt, Mus musculus
ucgcaaggcacuaugggccgcggcuucagucguucgacgcucaccggacaggaagcgccucgaagggagucugcgaccggacgccucuaggugagacagaagccaaacaggaggaggaaguggaggguaagugcuuccgggucccucagcuaagacuccgccaucuuuccuacacuuuaacuucacccccuuuucccucuuggagacacugcacuguacgcaugcguauucuggccuguccccuaguucaagcucccuucggagucagcgucccgauccuugggguuggggagguggauguaggguggggguacaaaggagcgcguaaaaaccaaaaccaaaacaaaacaaaaaaccaaagcggcuggggggcguuugugccucgugagccccgucgucgcgggcguuucgggccgcgcagccugcugggaguuguaguuccaggcccgggggugccugggaggcgggagaggggcugggguuccuuagcgccgauuccacgggaagggccccgggaccuuacccugcuacucgcgggagcggcgcggcucgcccggagaggcgcuguaccuggagcccgcgccgccgccguucccagccggcuguggaagcgcgggcuagggccacgggacgaauuccggagcuggugaguugcggacgcgggcuggcggggagcgcgggcccgcgcgggcggccugguuccggggcuuguccccccccgcggccgccucuguguuuuguuuccgcuggguccccggcgcugcgacucccauuuccguucguggagacuugagggagccugguggggaggggcgggagaggcugugcgggaagccgaggggaggggcgcggggagcggcguggcccgggccgcguugcgggacgcggcggagucgcccgucgcacgggcgcgguccaggcucggcgcgcuggccgagcgcacagccccgggcgcucccgggucucucgggaagaugccagaccugucugucacccgagucagccauccccgcacuagcaguaccgauugcccuucuggaacuguccuagagucgcaucggugcaaucguucuaaugcauaggaugacuuucugcgucuuucccgaagaugucagugaaaguuacuguaccuugccaacuucccccacuccuccccccgaccuuuuuuggggguugguguagugcagugaacacaacgauggaguuuaggggauuccacccuuaggguccacagcauagagaauggugccagcgcaucguuucacgaugacaaacagucauuugaaacuaaauccuuagguaggccagugagaugguucgacagguaaaggcacuugcugccgagccagacuguucagccucuggaauccagauggaaggaggagagaacugucugcucucugaccuccacaagugcgcaugcgcaccuuauaaguggugucuggguacguguaaguuuguguugggugucacuuucuagccuggcugaccuugaacuugcuauguagauuagaccggccuagaguuuagaggccuaucugccucuauuuucugagcgccggcauuaaaggugugcacuaccuugccuagcaaaauaagugcauuuuuuaauugguuauuuuauuuauuuacauuucaaauguugaccccuuucuuggccuccccaccucaauuuuuuuaaaacagguagauugagcuaaugacaggacugacugcuggcaagaggaaaacauuuauauagaucccccucacauucuuagguaccccaugccacuaaacacuggccauuuuuuuagcacuucuuuuuucuuucuuuuguauuuguauuacuaccuggaugccaacuggauuuacguccauuuuaucuuugcuacaaguacagacgcguaacuuggggauacauagucgugacugagucaguucaguaaguacugagugcgguaguaagguugaggagcccaggggggccaaguacuggauucaucugagucucuggcaacuguacaacaaaccuacaggaccgaaaagaggaaugguaguuuugagaacucucaugcucuuccccagaaggagguuuuuugggggagugaggggauuucagacaggguuuuccuguguuuggcuggccuugaacgcugaugcaccucccacugccucccaaguggugggauuaaaggcauggaccacugccuucuggcucaguuuuuaacuuuuuaaaaaauuaaugaauucauucacuuuauaucccaauugucucccucccuguccucccccucaccccauuacuccuucgaaggggaaggccccccuucaguauccauccuaggacauccagucacaguaggccuaagccugcccucuccacugaggcccaacugguaguccaguuaagggaacgggauccauugccaggcucagagaaagccuccacuccaguuguuagggaccgacgugaagaccaaguugcacaucugcugcaaauguguagguggccuagguccagccccugccugugcuuuggugggugguucaucuuccauggcuccagguuaguugacucuggaggucuuccuuaaccccuccaacucccucauucccauccccaacucguccaugagacucccugagcuccgcugauguuuggcugugcgucucugcaucuguuuccaucagcggcugggaugaagccucucaggcgacagcuaugcuaggcucccaucugcaggcacggcagagcaucaugguuuuaacuucuaaucagauuggguuucuguccuuuccucaugagacauagauggauaugccaaccuuucccgaaugccgacugcauuuccuaggcaaugcaaugccguguggagaguuacguuuacacuucauuuuggaaugauguccauuggugcuuuaccaauaccccgaaguuuuaauuuacuuuaguuggaguuuccuuuuucugugcugugcuuugccaguguugauaguuugucuuagcgccccccccccuuuuuuuucuaucaguuaauugaagauuuaaucuauuccacuuauuagucccuugucacuuucaggcauuguagauagcuuuuguaacuugaauuuuaaucauuauguaaucaaaucagauuucuagcuaagcaguuguaaucgauccccaugcucagcuucagguuugaauccaaguugcuuuaauacaguugauguagcuuuuauuugcuuuuguagugacuugaauuaacuuacugauuuagacuaggccaacauguaauucuccugagguaauuguugucucagaggguuacugccucugucugcuaacuaaccuaggccuagccuuggaggauucuagccucugcacagucuuuaucuaggccuagaauguuuucagccucugagacuuacugcugaauaaacucauccuuucuagcucucucugagcucuggcuggcugguucacucagcuguucugaacagcucaaacuccucaccaugauaacugauucagucugguuucccucucagcuucuccugaggucccugcuuugccucaaaguagcucuagcaaucuguucuggucuucuggcuucuuacucugcagccuguucugucuuugccuaugucuaucuuguuaucucuucaaccuggcuauagcugucuuuguaaaacugucuccugucuucuuuucacucugugcacugccuuuuucaugagcguugggcauguacucugucagaucuuucugauucaucacuuugucugccacuguauuagacaucacuuacaaacaugggugcuucccucuacgaacuaacaacuuuaccuccauuguuuggauuaaagguguguccuaagggcaugccuuuaauccugcuaaaggaauuaaagcucagggcugagccacacuacaacuagauacagccccuccccccaaguaaaugacucacaguaugaucaaauauccugaacaccaacaaguuccaauccauagaguaauggagucaccaucucaggcuaacagaugccacucuaaacaaacuggcuuauaaauguuguaugugagcuuuuacauauagagaguaccucucucccucugauguaauucaguuuuggucucuugcagaucauuuuuguuuguauacaugaaguuuaaaaaacaaaacaaaaacucuuuaacauuuaccucuuccaggacugaacuuuugaacgucuucaaccaugacuaagagagaagcagaagagcugauagaaauugagaucgacgggacugagaaagcagagugcacagaagaaagguugauguuucugaauugaucaauuuuaauauuaucaguaugccacguuacagcugaggaguaggccagugugcuuguuuuuaaccugaccucacaguuuagaggacuacauauuguaguuugguuuuugucguccccaucugacuucguagcucagagaggaaggcauuucugaaauacaggcagcagugagguuaguugauccguaucacaugguuacaguagucugcacccaccccaucuaaggauacucuuuuuuuuuucucccauuuaagugcuggugacuuuuaugacaaagacaguuuaauucaaccugaacuuacuuaacaauaguuauuuauggauaacuguagaggaugacuagaaaggauaggcugcugugcuuauagccaaaaauaugccaauaguccucacuuagucaaaaaaaauuuuuuuuacauuaaccaaguauaauauuauucuaaaauaauauuaucauuaacuuuaaaauaauauuaucauaaacuuuaaauguuuuaagaaaaaaaugugauguauaugugauguguguauguucacuaaacuucauaaguauaucauuauacuuggaaaauauguaaguauaaaaugacauauuuaucuguaugcacacuuacacauuuauauacuuauauguauguguuaaaugugugcaccugcaugccagaacacgcaugcagaggucagaggucagccucaggcauugguccucaucguccaucccguuuagacaggaucuccuguguuugcugcugcauaggcccauccagcugccugugagcuucuggggaguuuccugucuugucucccaucucaccgaaggaacaguggugagaugugagcuaccauaccugacuuuccuugggcucugagcaucugaacucugggccucaacauggacagcaagggcucugcuacucagcuguuucccuagauacgcacucauguuuuauuuuauuaggagauuuaguuuuaauuuuaauuauguguguggauaugacuauaugcaggugaguucaggggccagcagggcagaagcuuuauguagaucgcccuucagguagaagugagccaccugaaaccagcuccugucccuaaggcucugcuccugagcccucguggcacacagacuucuaguacauguucuugauaacuuuagagaggcuuaagucguauuuaaaauaaauaugcugugaaacuuaauuccuuaaauacuacuuguucagucucuuccuugcccuccuguaagcauuuacaaagaaauauguacaauuacuuaucaagcuucaaacauacuugaauucugaaauaacagucuacaagagcucuaaguaaguuuucagagacaauauaauuuucuaagaauaauaccaagcaaggcuaauuauaagugguuaguauuuauauuaaauuggaaguauucaacuuguauuauuauaucuuauuaauugauuaguagaaaugauauauauaugaaauucugguuugguuugguuuggcuugguguugauuuugauaagggcucauguagcccaugcugguuuaugauucuccauggaccugaggaugguggaugaucuugcccuccucaucccccugucugcuucccgagugcugagugccaccaucccaacaaagugugcagacuucuaaggucgcuauauauagccaugcuucugggccuucaauucuugaaaauaacuugggcuaugauauaaaggcagacauuuccccuuaaauagugugucuccaguauuuauuuaugugcuggugcaugcauuuguaugcauaauuaaguguguuuuuuuuuguuuguuuguuuguuuguuuuguuuuguuuuguuucuagagacaggguucucuguagcucuggcuguccugaaacccacuuuguagauaagcauguuuucaagagugcuuuaaguuucaaaucagcuauaugagauuuaggguucauauugagaccgcuaguugggucuaacacagcaucaaagaagaaaugaguucagaauguaguaggaaagaaaacagucucaaagaucaugcaugcuuuugcuguugauuuuauuuugagcaaaguguuaggguagaauguaauuacuaacauuuaucuccauuaacauuuagcauuguggaacaaaccuauaccccagcugaauguguaagccaggccauagacaucaaugaaccaauaggcaauuuaaagaaacuacuagaaccaagacugcaguguucuuuggaugcucaugaaauuugccugcaagauauucagguaaggcugaucucuuacagguagcuauaaauagacuugaucuauguuauaaaauuugagcacuuagaaaugaaaauucuuucaacaaauugcuuguaucuaaaauuuaaaagguugaguaauaaaauuggaaugaaugaacaauaaaccacgcauuccuuuuuacauucaugaguacugaaucaaauuaagauggaaaugaaauuaaagauggagugguaggaagcacauugacccuugagacucagaagugugggcugccugacugaacuuugcuguaugggagcuuccuacccuuuacagugagugagguuccuugacuaaacuguguguuugcuuuauaguuuacugggaguaacauuuaaauacgaguuacuguucguuggcauuaagugcauuaggaucuccuauuguaguaguauaaguugaaagcauccucacagaccaguucuauuuuuuccaggagauacuacuacuagguaguaagauugcuuaaguaguuuucuauaacuuuucuuaaacucacaaauacuaucaucuauauacuuuucucacguuaacaauaugaauguauuuugucaguuuuugaaauuuuugcuuugcuuuauucuuuacugucuguaauccugcugccugucuuuugauaccauuuuuucaauauauuagaaagcuuugaccuguuauuuuaaaaaugcagauccucuucaguuacuuuucacaagauucuauuauaauuaaaauaugguaauggaauuuauacauuaguugccauuuaccauauuugaaucuuuuucuuucuauauauauauauauauauauauauauauauauauauauauauagagagagagagagagagagagagagagagagagagagagagaguaaauguuaauugugauuggcuauugcucucaaaaaauuaaggacuaugauuguauguaccuaaaacaacauguuaaguuuucuucuuuguagugaaagauagcaugguuuuuucaaagcaguugguacuuaguaucuuauuagaaguggaaaaugaccaagaguucuacaucaagauauuguuccuacuuaauucucaccugucaccugugugggcacugguauauuuauaaagauccuaauucauguuuuuccagacaguuaagaacagaucuuuuaaaaccauaauauuuacuacauaaauugagaauugaaaaguagucacuaaaaaugaacuauaucuagaggacagaacauauaggguuaaguucuuacagaacacuucccaaaguaauccaauuuaauuguaucaaucuuuaaaauguaccauuguuuuaguaauauucugcugugauagauagaauaccuggauuagccauaaugaaagaaggccuacaagguacuuaugaucauaguuucucaaugcauggaaguauguguaaauuguuaacuugagagcugccauugggucugcgggcacuucauaucccucuggcaccucugcuccccugaacaaagcaugccagcuuguuacucauguuggugcaaguaugcauuugacaucacagugccugccgcuucuaggaguaccuuuguaucgucagauaaaugccagcuugaaagcuccuccaacaaucacugaguuguacuucuuugaagaauaaauuauauacugaagccuuguccuugucauagugugcugcuguauuuaggaccugagagcuuuucaagauagcuucuaguggauaaugcuaguaucacuacauuguagcuacuaguggauaaugcuaguaucacuacauuauagcuucuagacgagggaaaucuugaggguaagagaauuuuuaagugauaggaaaagauuuacauuaacuaguaaaaucuaccacauuuagucaauauaagguguuacacaauuuguuuuguuccugcucaaauuaaauaugaaguccacuuaacacuguagguuuuauguauaagacauuguaaguaauugaaauugugauuauacuguggcugaauucuuaguaaugagagugauaggagacuugcauguucaacaguauauaugcagacauaucuagacauagguugcaaauguaaaagccuauuccaagcucgugaucaagugucagaagucacaguuauuucuauuccauuaguaagccaagguagaaaaugcauucacuagacggggaucagaguugcagggcuauggaugugacuacaguagauccgggagucagaccauacagccuuuaguuguauuaccuuugugaauagucuuuagaguuaauccuaaguuuuaauaagugacauuaguuacaagggagauaugacaugaguaugucagcaaacuuagauaaauugucagccacuaauuaacauccuuucuuaucauuauaaacauugcauuaucuuguacuuuaaaugcauuuauagaacgaagaaaugccuacuucuguuguuuaaggucccagcagagauugcagagcucccauggaaaguugccacuucaaauagucuuucaguggcagggaauggcuguagaaggugugccugggacaugagcggcucugacuguaguccucaauacaggaaaccagaagaaaugauuuguuaggguuuugcugucuuccauuacguucucaauggagaaacuauuuuuaguuuuagcauauaaguguaugacaacuuugauaauuaaaugcauucuuaugauuuaauuagugugcccugaaaugguacaaugauuuauacaaaaccauagacaguaauuuauuuaaugacugugcuaaaauaauuuuacuuaccuauguuaagcuggauccagaccgaagcuuguuugaucaaggagugaaaacagaugggacuguacagcuuaguguacagguaauuucuuaccaagguaaguuaccuucguugacaaguauugaaaaauuugcucauguuaugccggucuuuuaaaauuugucugcugaagguauuuaagaugagugucagauaaccugugugaccuucacucaugcguuugcuuaguaguucugucugucagggugaagcuggaaguauaggacacugcacgcauggcacagagugcugggcacugacagcagcaguaaagaaggagaaucaccauaaagaccuauuuuuucacauauuuuuauucugcaagaauuucaugguauuuuuaucaucucaccacuauuucugccaugaacaguuuauuauauuuuuaauaaacacuguaucuuacuacaauuauacaccauuguucuuaggguguaauuucuaaauguaauucugauucaugaaauagcuuuaaguuuuugcauaacuacaucuccauucagacucuuuauaguaauaagucacucacuucaguuuucuuuccucucuacagaaagcacaguuuguaauaacagagggcuugagugucuuuaggauugggguuaguugauuggaaguuaacugaacaaagucagcagaguuguacgauaggaaggcaaaggaggagguggcucagucuguuaacugucuaugagugagcuugaagaccugagcucagaugcccagcacccuguaaaaagcugacacaauggugcuuaccuagaacugucguguuggggagcagagaaaggaaauccucgggcuuguugacuguccagucagaugaauugauaagguucagguccagugaaaccgccugacucaaaacgcagggugagaaagacugaggaagaugucccaauaucaacgcugauuuucaugugcacgcauccacccgugugcacacacacaggaccccacacaguuaaagugaaaagaaagcagacagagcucagcacacuuuaauguguuuguaaucuugacacuugagaggcaaaagcaggggauaaaagugugguaugauccuaagcucuguagugggguuguggcuagccugggcuguaugcaguccaguuuauuuguguguuuaugggcagggguaggggagcggcucaucugaauguuuagaaagucuguaaacccuuagacugugaggcuacucacugaugcacccuagugugcuuucuggguuuuuuaauucaugucaauacuuuuuuuuaucucacuauuauaaguggcacuuuucccaugugguaauuguagguaauguuugucaaguuauugcuaaaauucacaacacuaaguuaaagaauuuuuacauauucuuuacauagguguuuaauuucauuauauuugcuuuuaccuuuuuucuucaauacacauuuuuauuuuucaacuauuucaagauaaauugcagacaugauucuguucuaucucuaaacauaucagcacccauguuucguuaaucccagggccuuaggguuagcauacagcucagugcuggaguauucucucauguguguaaggcccuguaugugauccccagcacugcagguaaacaauacguaagcauucuuuuauaaaucacauuauaauuaccaaaaccagaaaauugauuugacacaguauugucucuguugaauuguauuuauuggcaauaaggaucuuuucacauucucacuauuucaagaacgucacuauuggaaaaauaaguuucauuucuuugugacuucagguuuuauuuacguuuguacuuuuguuucuaugugcuguuaggaauggagccaaaguugaacauucuugaaauuguuaagacugcggaaacggucgagguggucaucgauccagaugcccaccacgcggaagcagaagcgcaucucguugaagaagcucaagugauaacucuugacggcaccaagcacauuacgaccauuucagacgagaccucggagcaggugacgagaugggcugcugcacuggaaggcuacagaaaagagcaggagcgccuuggcauccccuaugguaaugagacagcuguugcuuaggugccggaaagguuaaauuagucauacaaaacaccgcugggauaugauagaacauuuuuaacguagacuuuauagaaagaauauugauuuuuauauauuuaauuuguuuugaacuguaacauacucagaacacaugaugaacaaauacucugcugauuucuaggacuacagagaauuauuauaagaaauucuacccuuagcaugcucacaauguaguggaagagaaagaagauaguugaaaagagacgauugucauaaaguuugaauuaauaguaauaaguauaagucaauaacugacacagcaaagcaugucauuugagccuuacagaaaucaagcgggauaguuugaggaaagccaaauggagccgaggcugccguucacagagucagugcaaccuuaggcuuguguagcagaccuuugcucaaagcacggacaggagugucguagggauccuccugccuggucugaagaaaggaggggaggguuuauucugagaacucugcuuccaugaagguuguucaaacagacacucagaacaagcuuaggcugggauggaugcgaggacacugugggaucgagaggucucucugacaccgcagaacuguuguugauuacugaagaaaugacugaguggaaagaagacaagagcauguuuuugucguucgugcuauagcaauacuguccagauuagcauagguggugguuuccuugguaguaaacaggaagagacaggugaaaacagugaugaagacgacacauuguggacaugagagaggauagucggugucuacggcaauaguuuugaaacuaguugguugcagcaucguuauuaaugucauggaacaguacuguaugcuacgcacugugguaaauucugggcuaaugauauagaagaacugagcaagccuuccuuaacccuggccucaacgccuuaugcuugcaaggcaagcccuugacaucuaaaguagauucaucaccauaggcauacauuggaaagucuuugaggaugauugcuuuuuugguaugagaaagacuuuuuaagggaaaguguugauagcacuugacuuugaaguaaagucacaaucaguuuuaggaccacaaaucucaggcuggagauacagauucaguauggaguucauucacauugaaauuauaauuugaagccauaaaagccacagucuuuugagagaagcaacauggagaagaacacaguauuaccaguuucaagacuuaacuagaacaggggaaggaaauaggaaaaccagaugccggguguaguggcacacaucuuuaaucucugcagcccaguggcagaggcagggaaaucuuuuugagcucccagucagucaagacugcauauugagacucuccaaaauaagacccaaaacuaauggcacagcuggagacagaaagaaagaacuuuacaauaucacugcuauagagggagaguuauaggcaguuaagacucuugagaugccucugaggacgucaagaauaugaauagcaucuaguuuggucaucaaagaauuauuguucaacuuugauauaaaauaguguugucuuagauaagcugaauuguagucaaagugagaacauucauuagaacuuuuugaggcaauagagaagaaaagcauuagggaaauaaaugaaucauauggcuuaugcucuuauuauuagucccucaguaauaacuacuuauguauuugcacugcaucaccuauuuuauuuagacauugcuuaaguuguaugcguuuaccagcauccuuuucuaagcaaauacugcacuacuuugaaggagacuuagccuuugaggaauuuaggagcccugaggagugguggccuucuagaaccaauuccccacaaaugccaagggauagcuacaugcaauuccuuauuguaacaaguagaaauuuacuuuaggcuucuggaagcuaguguggguaguuuauuugaccuuugagauagaaaguuaggaaucacccgagaagaagugcugagaagggaagaaagggccaugaaagcuccuaguaauguucugagucuuagcugcauucccacaggccgucuuuaguagcagagcuucagaaaguaauucauacugagcacgggcagcaagagcuuugagacuguggcucaagguccuaccaggaguggcgcuuacuuaaaguacauuuaaaacccuugagaucgucuuugauaauauccugcuuuuucgauaccuacaugcaguuccuugacuaauuaauucauuccaagcaacacugaaauagaauuaaauaguuacagcuacuuaaagucuuugaaauauugaacucaccuugggaaauuccccaaaguucauauuacuaugaaccaguuuucuaucuugacagcagcuuagauacuucuucacucauaugguuuuauguguggguauuuuuaguauugcccauuaaacuaaucugaagaugaaauuaauaauuguaguuagaaauuuacccagagagaagcuguacaauuaaaaauucauguuuuugccagauuccaccaucuaagaacauguagagucuaaaauauaaacauauucacauacaaaaaguauuagagauuguaucuaaggcuauccaauucuacagcucucugucuucuccacauugguccacuccuuuguuuagucuucugucacaagucugauagaaagaaagaaaagccccugagaaggcagcugugcacccguccgugcugccgccguggaucccugcucucuagccacagcuggguucuucuucguggccuuuucucaucacuuuguuaccucaccuuggaaugaaggagacuuagcucgcuucucuggacaacagagcaaggcuuugcucucaugcuggggacuugcugcuguguguggugcgauguguaugguuugguuugcuuuguuguuugacguaaaggcuuccuauggugccaggauggacuugaaacgugucguccagccuaagccucccagugcuggaucgcaggcaucugcuucccucucccguucacagccugauuugucacuuugguuuaaguucgucacuuuagcacugcucauuugugguagaaccaugaguguaguuagacaacuguuaaguuucugagcagagagaguauugacuucauuuuuguuguuugauuaguugucuggcauucuagcccaggguauccuauauagcccagcuugccuuuguccucacagauguccuccugcucagccuccccuaacuguccuguuuuuaguuccauagguuuggguacguaugaagaguuucuuucuccuacaccgaguggucagcuguuggcuuuucucuuucucacuuauaucuggacgcagucuccacgugaccagagcuggccucucgccccuggucucugacaucagcuggcuccuccauuauccauuuuuguagcuuuggccaguucucuaggcaccaugcuuucauuccguuuacagauugucuagaaaggguucugaagaagaugcucuacuuuacccuuccaaacaguauuuguuuuccucugcucugcugaugguacugucugcauagcacgguaaagcucacuuuuacguuuccugaccccgucccauuaguguuguaggaaacacucagaggcaacgcauugugacucuuucaucugcucuuugugccuggucuuucucuuaguuugguuauagugagaaagaauauuuuccuucacuguauuuuaugcauuacuauuuauccauuguaacguguguccuuaaacgaauaaucucgccauauacuaagugugugccccugccugacuugugucuagagucagcacauccugagcaauauaauauaaauuuuggagcaaggaguucucauuuuaaacugggauccuccuguacagauacuuuugaucauaauuucucuuuacugaauaaauugguuguugcccagcuuguugauuuuaagaacuagcugaaaucuccccuccaucucugauuuuauaucugaguuccuguguuugcacaucuuaaaaaacacaaacaaaacaauacugauuuucugguauuucauuauuacuuugagaaaagagacaaaauacacauagccaauucaauauacuaaaccaguuguccugguaguauuuaaggaaaacaaaucagacugauauuuucccaccuuacuugauacuaaaaguuucuuguaaguuuuuuaauguaaaaugaguuugcuuucuuagauauuuuaaagggaggugugguucaugguagcuuggcuagcucagagccaccucuguuguugucagguagcacacuagugcugaguggcuugcuuucucggcucuuguuuacugccuuauucauucucauauauuaccaccccuucaucauccaccauuccgucucucucgcuuucucuccuuccuguaccacugagucauauccucagccgucuuuuccuuuuuuuuuuuuuuuuuuuuuccuuuugugagacauagucucuuuaaaaugcucgggcaggccuugaaccuuugaucuuccugccucaaacucccagguauauaggugugguuuacuuucucuuuuguuguuuccuucccacuuccuuuuugcccaaggcuucucugccauucccugcccgcacaucccugggcuucucaccguuugcguuugcauuccgucccuuuggacccugcauucggccgcugcugcacgaggaagacuguucuuuggcuguguuccgucuuggcuuguugugcuuuagggacggcuguuggcucccgucaggcuugcugaggucacugugcuucugauagguguggaaccuagagcuccuguagauuauuuuccuuucugagaugagagcugacuguuggccaagcugcccucaaaccacuucacucgggguuacagaguauggccacacccaguaucuuauagaagcugcuuugucuucacccgugugugauauggacucugugguagacccugggugugugucuggguuuuguaagcaucuauggguuucuguuuuuacucucaguuacuuuuccuaauuuucuauguacauucagagaaaauaaacuauauucucaucuucuagacauccuuccaucucuguggcuuuucuuuugucuauuuuuuuuuuuugccauaaauuauuccuugacuaguuguuacuuuuacacacauuuucuuacaaaauagcacucauucauuggguaucuggccaauacuacuuauguaaaccaucaucuuaaagcaagaguaccagugccagaauuaaccaagcaauuaagugcccacagguaauaucuucaauuagaugccaggaauauaguuauacaaucuuuaaauaugcuggcagucuuuaauuuucugguugcaaauuugguuagcuuguaaaaauagcagacaaaaugaaauaauuugaguauguuuuauauacauucaacaaaugccuauucaagucacauugguugacuaaagucagguuuaguacacaguccuuagaguuauggacuugaugccacugggggaccguugagugaacaggaagcuagcaugccauaucauaagugccaccaagcgugaguacacagugaccagcuuguuagugggagggauggggaaagagugcauuguacacaaugcgaagagugaggcuagcucccuaguauaccagguaauuuuuuucaaggcaccaacucuacagugcuacaaaauaauauuuugagcuugggcaguguccuccaguaucuccaagguaauaauauacuuuagcugucauuugaugcaccagggaacaauuuuauaguuuguuuuucaugacaaaauuccagacuaagugauguagaaccaagugacuccugguucauucuuggagacgugagauugagaaauggagaaagaauagagggaaaaaggcagcaucagcaugaagcucuucacaaauuagugugcuucacuugggaagucgccugucugggguguauauguguauauauguguguacugagaaauuaacuguaaauguaucuaagauggaaccaggcuaaagguaauauuuuucuuucuagauccuauacacugguccacggaccaaguccugcauugggugguuuggguaaugaaggaguucagcaugacugauauagaccucaccacacucaacauuucgggaagagaauuauguagucucaaccaagaagauuuuuuucagcgggucccucggggagaaauucuuuggagucaucuggagcuucuucgaaaauguauaaaauuagcguuauuaucuauuugcauuguaacuaaagcuuaauuuuauuuuuguaacuuuguuuuuauucuguuaauuguuaauaugcagacacuuaagcuauaguaauuaauguugucauaggcgguaugagguguucuuauguauuaucucagcaccuauaguaaugcccuagacucuuacucuccccccccccuuuuuuuucuuucuuuuuuuuuuuuuuuuuuuuuuuuguuaguuuuuaugugagacugcggcuguaagaucccugcaggugguuagacauagggaggauccaaacuaagauccuaaccuaggcuuaucccacguuccaaggucucucguguuuguguaucuuuuugagacaggucuugcuauauggcuagccucagcucaggauccucuugugagcuuggcuagaacugaagucaugaaagucucccacgagccuccgccuccaccuuuagcccuucucacacauucugaucauugccuugucugucccuaauccuccccugcguuucuaggaacguuaagauccuggaauugcaggggauuucccuccuagucucuuauuuguaggauuaggcauuuuuauauguuuuuccuaguugaauaaauaagguuuuuuuguuuguuuguuuguuuuuuggguuuucgagacaagguuucucuguguagcccuggcuguccuggaacucacuuuguagaccaugcuggccucgaacucagaaauccgccugccucugccucccaagugcugggauuaaaggcgugugccaccaugcccggcaauaaauaagauuuuuaagagaguuauggaggcuguagaacuucagagcaaagcuucucugaggaaaacuuagaaacuaccuggcugaccaaaaaguucaaauuuaaguacacaguuuuaguugaguccacuccauauuuuaacauguuuuaagguaucuacuaagccaucuuaccagcaguccaucccuucauacuguuuuauauguugcaaugcuagccggaccuccgucauuuccuguuuauaagugggcuagagucuauucuuuuugcuaagaguuacguauggaaaugucacggcuuguucuuuguucugcuaugcuccugaugaggaaagaagaccuuagacaguaauuggauauagcauuguuacccaagcuucgccucugcuguugaggacgaggugggcuggaaaggcaugauacugcuuuccucuugaguggacgcucacugguguuuuuugaagugucacuaagagacugguuauauucauuggcugcgugggguuauuaccagcuucaguuguuaaaugugaguaaauugagugucagaguuuuaacugaguuguucuuggaacuacaguaauaauacugagaauagucucuaacgccaugguuuucucagucuuuccuagaucaacucuuuguuguaccugucgcuuucuaauucaccugaucuuucucaaacugugaaaguuacuacgaauuuucuuuccuagucaggaaacaagagucuugcucuccucuuucucuucugugcaguagacuggguuuccucagagaagcuuucuucuagaguuuuccagccuccauuaacagcucauagaauugcuugccuguccagcaugaaucccugcucugccccaguaaggaagugguuugguuuuagaaucuaagguccaguucugcauuuacagaguggacgugaucugcaagguguuuucuaaaagagucucuauuguucccaagucuugucagaagaggguucugugagcagagcgucuguggccuagcucugaagagugcuguuuccuaggacaggucuguuacugagaagccugucugucgccuugccagccgaguaaucucuugugaaccugucuggacagugagaauucuuuuuguaccuugauugauuaucacuuggccuccugcaugcagagccuaaguuaaaauuucugucagcuuuuauuauauuuggggaagauagauaagaaauguuccaggcauacaaauucuugcgcaugcaugcuguugaugugaacgucugucugucagaugugaacaucugucugucugucagcaaggaacaaagucuucagggaaagggacugguucugcuucacaccccgagggcuccaugguccucaggaccuugcuuuuagcauuaucuuccuucucucaugcauggccaagguuugaggcgcuuuagaggaaguuugguauucaggauuccuguauuuucuuacauuacuuauuacuuccuguguucugcuuucagccuugagagucccuaagaaccacaccaaacucaagucucugagaaucaaggguuuggagcugaguuuacagguagccagggucugggcugccuaaugaaugguuccguucuaacuugucuccuuuaagguuaagcugcuuauauucauguaguggcagaauacuuuuaguuguuuuuuuuuuuuuuuaagauuuuauuuauuuauuuuaugcauaugaguacaucaccauugcucccuucagacacaccagaagaaggagucagaccucauuacagaugguugugagccaccaugugguugcugggaauugaacucaggacuucuggaagagcagucagugcucuuaaccgcugagccaucucuccagccccauacuuuuaguuuuaauaacacuuuucuucaaugagacuuuaagaacuugugagaaaaacccaagcuuuuagccagguggugaugaugcccacucuuaaucccagcgcuuggaagguagaagcagguggaucucuuagaacuuugagccagccuggucuauaaagcaaguuccagacagccugggcuacacagagaagcccuaucuugaaaaacaaaacaaaacaaaacaaaaaaaccccagagcucuuaagagaacaguucugaguagaauguucagaacuagaggucuaaauaaaacauaaaaauccucaguuuacugaaaaguuaacuuuguagugugcuucuuaaaagcauuuuucuuugagauucguaauagccuugugaggugugagagaucucauucagaugucaagaauuaauacccaggguuugacauuuugccuaagugguagugauugcuaagcucuaaacccuuaaucucucugaggcuagucucaaauaauuaagcccucaaacuuaagagacccaaagaaauuucuaucugguagguuucagacuucaucuuacuuagucucucacucuucucagcucuugcaacucaaaacugaacccaggcaggacucccuucgagucuucuuggagucccagucuuaugagccacccaguccgagggugaugaccaacagguucaguuucaauagauagacuagaugucugaagugcuggaaacugggauauugaauaugugaaggaguuaacaauggcauuuggucugggaagaccagauagauacuuacugaggcuuuuguagaagauucuuuucaggucuguuagucaggguucucuaaggaacagagcuaacagaaugaacaagucuauggcuguagcaaaagucuuccauugagagcagucuuuuaaagaugacuaaucagucucuuaggacagcugauauuuuaauuuuaggaguauuaucgcacuaaguuucaguuguuaauauauaucuuauuuacuuguuuuacugguuuuguuuuuaaccauggagcuuuuuuuaaaggcugucuuugcuaaauucauuuuuacaguguuggggauuguauuuucaguuucaaaugagaaugaauguuuuguguucuucagauguuuuggccagccaagagcaacagaugaaugagauaguuaccauugaccagcgugaguauucauuccuguagagugcgcccacuuaccaggaagaaauguuuccuuauuagauagcuucaaguucaagcuuucagcagaauuuucugacuacagaggacggaagcagcugaacugaguguguuggcuuugcuugcccuguuccucucucgcuaaacugagaacugauuagccucaacucuucuuucaggguuugauuucuacaaacuaugccaccuuaagugcugcagagccauggccaugcacaugcuugaggcuugcucuaugaauccuugaucacucgauagacuuagcuuugaugcuugcaacucgguuucauucauuuugacugcugaguagcaugucuaaaaaugcugcaaauuucacuagauuuaagaugguauuaacaauuucuauucuacccuuccauuucaaaugagcuaacauaaucgcaggaacgucaguuuuauugauugcauuuauuucuauuuucuguauuagaagaaaaguauauucuucuuuuuuccuuuuagcugugcagauuauuccagccucagugccucccgcuacaccgacuacgauuaaaguuauaaacagcagugcaaaagcagcuaaagugcaacgguccccaaggauuucaggagaagacagaaguucaccggggaacagaacagguacuuuugcaugaacugguguuaguaaacuugucgauuuagauauauucuaaguuggacuaguucucuggcaguguuaagcuaauauuuauaaauugagaaguuuguuuuugcuuugguugagauuggaccagagggcuugugcacugccuuuaccuguguuagcuucuaacaugaccuaugcuuauucugcuuacggauuuaggaaacaauggucagauccaacuauggcaguuuuugcuagaacuucuuacugacaaggaugcucgagacuguauuucuuggguuggugaugaaggugaauuuaagcuaaaucagccugaguugguugcgcaaaaauggggacaacguaagaacaagccuaccaugaacuaugagaaacuuagccgugcauuacgguaagaauuuguuuuuuguuuucuaauaucauacuucucuagaaauguagcuucuuauucuugauauaaaccugguaguuaaugaaaguaaaauacuuuaagauugugugcaucccgcaugcaugugugagcgugugcacgcgugucaguguugguugcugagguggcucagugaacaaagguuuucaccccagagccugcugcccagcugaaucucuucucugaacccacaugguaggagacuagccggcuucagguucacacacacacauauauauacccagagaaaaaacagagaacgugcauuuacaagauuuauuuacaagauuuauuuacaguuauuuaugugaguacacugcagcuguguucagacccaggcccaggagaugccucccauagacaugguucugaugggacuugaacucaggaccucugcgagagccagcagccagugcugcuaaccucugugccaucucuccagccccuuuaaaaauuuuuuuaaguuaaauguuuuaugcauuauguuaaaaauuacuuaagaguuuuucuuacaauuuugaggugcauagaccuuuauaaaaagauuguuauaagauuauuuauuuaaagugauuuaaaaguauaucauuuuuguucaaaaccaaucuucuuauuaaucuuaaauuuuuuuuuuaguuugcauuacaaagaugcuguuuacauauugaauauauauuaaauucaugaauuccuauuuuggcaauuacauuuacaguuuuaucauucuacaucugccuaaaucugaauauccaaaaguugaacuuggaaagauuuccccuaguuccuuuggauaaucuuaaguggaaagaccucuacuccugaguguuggugaggcuaugggagugcuuuugcacuguggccagaggugugccaugcaggauucuguccaggguggauugcaauuucugcccugcuaaguuaccaagcaacuuuucuuaguagaccacaagcagacaugucugaauguccauacacagcauccuaaaucagaaaccaucccuguauccaucagcagacaaacgagugaagcaguugugauguacucaaguaucaaagaggaacugcugccucugaugacaguacagaguccaaaaggggucugcguucaaaggacuguguggucacuguagaacauagcuauagccugaguguauucacuuaggauaggaggggucuggguucaaaggacuguaagguagguaacuguaggauagagcuugugaauguggucacuuacgauaauuugauaaacuaggaaaagcaaacuacagcauuuauguauguuccuuuaaggaaaaaaaauacagagaaaagcaguggaguuacugucuugaagcaagcuuguguuuauacuuuuagauuaaggaugcuugguaaaggacagagugcucaguuauuggcagucuguuguuagacugagugagaacugaauggugaauuggcauuucuaauguuaauguguguguuucuucuaucuauaugguagagcucaaaaugucagagguuuuaaaaacuaguuucacaaagguaagugggggcaucauguaacaacauagggggagaacgaugcggcuccugcuucuguaugguaucaugugaugugugcuccagacugaagaaaggaaguauuagaccuggugaagggagggagugaguguguguguguguguguguguguguguguguguguguguguguauuugugugcgcgcgugcaugcacccuuuuuucuuuuaccaagaaaugacgauuacaccaguccuaauugcauucuagaaauaugaaaccacuuuuuuuccuuuucccaaaugucuauuuaucauaaacuuauauuuuuaaacugcaugacaaguaguuuagugguuagucaauucaaauuuucuguugaugugaagucugauguacaaaguagcuauaaacucggcugcuucugccuccauagagaguguaguaaaguagucuagcguagccuccgaggccgcucugcagugcgggcuagacaguggugcugcuucaugaugccugcccuucgccucuuuuccuggagccuguuucuucugaccuuagaguuauucuuuugggaucccucgugguuuggagaauuucuccaaaauguggcaagccuuuauauaauaaauggaagaugaagauauuucuuuauuguauuaaauauaucauauuagauuuuauauaaaacaaaaguggacuucacaaccaaccaucuguaacuuuuuguuaucuggauuccuguuaacauagcuuauauuuuauagagaguuaacuguggcagucauuguaagcuaagcacuuuauaaagauuaucccucuauucaacaguucuaugaggguaaguacuguuuuaaccucauuuucuagaugaggaauaaaggauuaaaggaacuaggaugguccuguggucacagaggcagcaagugaggccuugcgguguaucucugacuuuccaaggcucuuuuguuuugucuucucuuuaguaauucuguugguuucuaaagcaauguuaucagaguuguuaaaaauguauuuugaaaguuucauauauaagauucuggaguagugaggacugaaguuuuggugaguaauguucuagaguuugauuuguaaugugaaauacugugacgucaauguuaacuguuguaguggauucagaacucugcuagguuucuguuugcagaaaagucuaaaaaguagggaguacaaacuguucaucuuuacgagguccugaugugguuucucuuuuuaaagguauuauuaugauggggacaugauuuguaaaguucaaggcaagagauuuguguacaaauuuguuugugacuugaagacucuuauuggauacagugcagcagaacugaaccgucuggucauagagugugaacagaagaaacuggcacggaugcagcugcaugggauugcccagccagucacggcaguagcacuggcagccaccucucuacaggcagacaaagagauuugagaccuaggaccuccuggggagucuuaagguuuuucuuaaauauuuagagcaagcuuugcucuaaccuuuauuacugaauuugaaucguauuucuagaguguacaaucugaugcaugauuuuuuuuauaaauauuucauacucuugugaauuuggaucuuuuuacguugaacauauauuuuagaauauguuaaaggaucaccacgaugccugcaaugugagagcagguucaucgggguaguuugcuaacagucaggaaagcuaaacuggucaguauuaaugucuagcccuaccaaaaaauagccaguagcgucugaagaugaaaggagggaagcauuuccaggaaacagccugguguagccacugcgggcguggagcuguuuccucuccgcugcuuuacacagagccugaaaaaggacauucucagcuaaagcaugugugccuguuucaucuaaucaagcagagcuaagcaguccuaucaaauacaauuacauugguaauuacuaaacuaucagguuauuaauuuauaauuuacaagaagagaggaaguuaacuggcagaagaaaguguugaaugagacccagauuuaaagcuggcuuaacucaaaccacuauuaaugguuuucuguauagauuauucauuaugucaagccaaggucuuaaauuauuuugagagaggcauuuaauucuaauaaaccagcuauugcaaaaauuccaaaaugauaucauucuuucucucagauuuuaaaaaguauaccucagaaagaaaaaauugguuuaguuuugacuuccuauuuuuuuaaaaauuaaucuguaguaccagauuauuaugcaagaccguuuauauauucccuucuguguuucugauaaaaugaagacuuuagaucaggcgacauguuuaacguuugacguaaguuccuugugaguaguuaugaaaggguuugacugggcucuguaggcgaucuucuuuaaauaaaguuucccacuuguuucauuuuuuuucuuuugaauauugcauauaugacucuuaaaaaauacuguacacaugacuagcuaaccauuucugcauauaugaagacagauauucaaggggagauuaauauuucuaacauuuuuaaauaaaucuuauaugaaaugccuuacugcuugcuaacacuaagaagaaaugccuaaaaaauuuuuuucuucauuuauuuuaaaguauuauccauaaaucaugauaugagagauuagcauauaguuuucauaacagaaaggaauuccucagaacaggauaaaggcuacuuuauauacaccucucucauuuguuuuucuuucaguucauuucccaaauuggcuuuagaagaguuugaggagagaaagugcagccugaugaugcagccaggaccgaguguuagggagaagacagaggguuucuuaccuccuauaucaugacuuccagugcugggcugucagacuucaacaaggguugcuaguuucuuuauauuaaguccuuuaagauuauacaguaaauaguuaaaaagaguaaaauccuauuuuuuuauauuugcucuuuguuuuuauaaacaacaguaggcaggcaaauuauuaguacaguuuggucaccaugaauugaaagaguagaguauaagaauaaucuuuaggcccugacuuucgacagcaaauaggccugggagccguaagucacugcuugagaacagggcauugccgcaguacaucagagcuugagaagcucagacuuacaguguguuggagacauuauguuaaagcuuuagccaagaggacagacuuuguguaucauucggaggaauguguuuuaaggaaaggaacauuuauauuuguucuaggucccuacaaucaaacauuuccaaauccuuaacaaaacaaaacaaaacacacaaaacguguuguauagcuuugcuuccuuuggaagcugguggguuaguugugauuugagcacaguucucagaucuuaggugguuguucucuaccccuccugcauccuccaugcuccccccacacggaaggagacccaagcuuucucacucuggcuccacugagaguucaaagauguguuguucuuauugaggccccaguuugcuaucaucuauuaaaauaacucauguuauaaaagaauguuaauucaugguaauccuugcucaguuuugucgugcauuuuucauagagccuaagauacaguugaacaaaaagaacagaaaacggucugaccaucuuuuguaccuuauaaguugaagaauaaugaaauguuccuguugcuagaaaagcgaguuuuccaugugauguuuacauugacgucauuuuauaucugugcuagccugaagucugagcuagccugaggucugugcuagccugaggucugaguuagccugaggucugagcuagccugaggucugagcuagccuguagucugugcuagccugaagucugagcuagccugaggucugagcuagccuguagucugugcuagccugaagucugagcuagccugaggucugugcuagccugaggucugagcuagccugaggucugagcguuggugcuggcauuggaaggugcagccaguuaggcagaagugcuggcugugacugagcuccucaugaugaguuagccaacugcauucauuuuaguguugauccauguaaauaaaguaggaaaaauuauucaguuuuucuccccagauaaacaguaaugcuggaguaugguuauuucuuuuaaagaguguaccuccaaguauuuuuggcaaguucugucauuuucugcauuugccauuuaugcuacugccuuuuauaaagaacuaguguauccuugaaauagcacaaaaauguuuuaaaauuuauaauugcaaaacaaaccugugacugacuuaaugucuucagaucuaaaggcuauaaaaaaaauguugauauucaauauuucacuuacucccaagaaaaaauacucuugagucuuuuguagaagggaggagaauuuuugcauacauuuuuacucuuuaaauaaagacacuuauacuaucauaauaacaauuauguauuucuuuguuuuuuuguaauuuuacauaaaacaguuauuuucuauuuuuacucagauaaauauuugugcauaaaauguaaaaauaguaaaugagaaaaauuauuauacaauaaauucuuauguugaaaguuuu

SEQ ID NO: 8304 - RNA, 224275 nt, Mus musculus
cgguucaccuucucccgauugcgggguccucucccugacccagaucacuccccaacuugguucccagaccccaucgggagcgcggcuccccuuagcccaagacgccgcaccugugggcucugggucgccucccgcugcgcucgggcgcagcuccccgaggcuccgcuaggggucucugucggguggcgagccgggugggcgggaucagcugacucugccggcugcgagccccgccgccucgcuccagcucugucaguuuccucggcggcgggaggcgagagcaccgggagcagagcgagcgcggggccaccggagacggcggcggcggcgcggacacagccagggcgcggcggaucuuccacucgcacacggagcacucgguggcccacgcaggaucacgaugcugcccagcuuggcacugcuccugcuggccgccuggacgguucgggcucuggaggugggugccgcgccuugggaacgagacuggggaggcgggcgccgggaggacgcgauccuccccaccgaggagcuugaaucucgagacguggggggcugucacggguagaccgcuccucgccgcccccgccugcgggcgcccugcgcuucggcggcucuggcccaacccugcccggggacgcgcugcccgagcgaugaagagggaauggguuagggcgcugggguccccauauccgugccagccuagggcuggaaggcgaggggacgagccugaacgcagacccugacuccucccugcguugagagcuggacuccgggaugcgagagacacccaguucgagggggaagggacacguguggaaaaccgaaagcguagcgucucaggauucagugcccugcgaggaaaucgccgcccuuccccuuccuugggguccuggguuggaaugggggcagcucuggaugcuggggagcgccuggcucacacucccuucccacccccgccugucuugacugcgaagcugggcuuugcuccuggcggccgcgggcggcggcugccugcgcagcgacccucucccgagucggugcggggucgcgcaccgccgccuuccuuuugcaaacuuugugcauuuucgugucucccuuuuguguaaguuccaagugaugggagggaucggaaagugcggccacccggcaccgucccucaaccuggacguccaggacucuucagugcaccuccaguuucucccugagucugagaagguccccgggaacaaaagccgcgacaccccgcccucgccguccagggcgcgguggcggagcccugguaguuggugcgccaccgccguuccuuuccccgagcugcgcgucugcccccgagggccuagaggugcugcuagggccccgcggucucccacccccgcaucaccaccaccuacuggcaauccugugagggacugcaaaguccugagagagagagagagagagagagagagagagagagagagagagagagagagagagagagagagagcgagccgggagugaggcgugcgucugggaagggcagugccuggugguggggaggcugaggcuccagggcaucaaaggaggcguuugucugauuaaggugcggccuccuauggggcagauuugggaacucuagcuuagucacccugggggggacacaggaugcuggggaggguccucaggguuccuuuuuuuuuuaaaaaaaaaaaaaaaggggugcagauaaaaggauugaauagggugaagauuaagacggagaagauggcgccucugcagugcagcaaagaaaagcuguguggaggcugcagccugugaaauccacccaccacuagguguauaacaagucuuccccauucauccaacucuccagcaugcagcacaaggcuuguuuuccuuuuuauccagagaugccuggaaguuguuugcguggcagcugguuuuauuucucuucauuuguacccucuucaccaucuaagcauuugcuaauagcccuuccucgucguccuccucuuuccccucuaccucauaggaauuuucccaaaaagcaauuuccgggcgaguguuuuccugcaauuuuguggggauuggcuaggcuaucacacuaguaugaguuuuuauuuauuuaauuuuuuuuagcucuuaauuuacaaggucauugaacuuuuagccccucugaauuuuuuuuuuuuuuuuaacccacaaguggcuucagaaucuguaagucaccucagacugguuaaaacaggucuucgaagagucuuaagaauuuaguguuccauuuuuuuuuuucaaagccauuuaaucaagggaauucugauuucucugacgaccuaagaauuuaauuguauagucauucgguuuuucuaauuguuuugcugugcagaaacacgacuaaguaauuaaaggaauaacuuuaauuuuuggagcauuuuacuuuucuugagcauuuuuuuuaacuuguauaaaaagagucacaguguaggccaagaugaacuggauuuauguuuuggcuugugcgauugcauauccuuuuucugccgaacauuuggagaugcuccugcaguuaucaucaccuuuaaaggguuacugggagcacuacauucgugccuuuggugagucacuggaaggauagguaauucauccugaugagguuugacacacuuugcaguucugcguccacugaagccacagaauuaugaguuggcugcguuuuguaaaucacagaaaauccgucugcugcagguggcucugcaaaaagaacccgugugauggagggugcugaugauggggccaugaggguacugaugcuggggucucgagggugcugaugcuggggccuccaggguacugaugcuggggccucgucuuccagggcgucggcauuuccugguuugguuuuauuuuccugguauguugaacagaggcaugcguuuagcaaaccgugauggacucaucuuguuugcuuguauagagcugauaacuaucaacuugccucgguagugguggcuccuucacugucugcgacugcugcccgguagugccucucugaugguagaagccuacucauagaacagcgaagcugacauucuuuuuuugacagggauccaucgggagucaccgguuacugcuugucagugggaagccaugauacuggcagacuauaaaugcuucuuucuuaucacccccaagggauagcgucccucauuacacuuguaaggcugcaagcaauuaaaagauggaaccgaggaaaugaaaagguauauacaggaucacaaaacuaaacuggaaaauucaagauuuaagauuaaauaggagaaaaauaggaucaaugggcuacugguuugaaggaaggugaaguuacuuuuacggcuaagguuuuuaaguuuuuaguuuacuguuuaugacacgccaauuuucuauaucucuguguuaaagauuaucugucagucauccugcauauagacgugaagaaggugcuuaauaaaauauuaugcguuauuuuugcagagguguugucgugggauuuacagggcaucuuugacuaauacauuucuuuucuaaucucugccuuuuaugucaagauggaccugcacaaacauacuuuaaauaucaagcucauguuuacuugacuguauauauuuuauugccuucucccacacuggguacagaaguaugcagggugaauaaagcaugcacauaauuauaaaauaggaguguugcguaccaaaaaagaaaguacagauuaggcaaagaaaaaaaagaaaggacacagaaagugggguacucagaaaguguagcaggauaaagaccuagaauuaaaaagaguaaaggaacaagagaacacgauaauccugggauguuuccugggugaaagucuccagccagguuuguguccugggucugugaauggagguuaaguauuugcauggauuguauuugcucacgcacagacacuagagccuacaugcaaggccuuugucuuaucugucuucccugcucucgauuuccagccaggcacagauaagguuuuacauaaugaaggcgagaacaaguguggaguuccauuugauucauggccucgucuguucauuugggacaauuugauugauugauuuuuaggccaaaucgugucucucagcucugaucaccuuuauguaaacccccauaaguggaagcuuauggagcguccacucauccaggcaagacaggaaauaaacagaaacuguggcagguguaggccagacucuggagcugggugaagaacuggaagaaggagaccaaggcugaaagcagccugggaaguaucccuagcaccaucuugaccaggggagguaaggacaaaaagcuucacccaccaugcaaacuuccaggagggaagggagaagcaaauuuucaaagugcuuccauaaggaacguuagccaagaguugucauccuccuuuacacaucagggucacagagugucucugccuuccucccucccucccucccucccucccuuccuuccccccucucucccuuccuuccuguguuuguguaugugauguugggauuucauauggagacuuaggcaugauggacaaaugccugcugcacuacauccccaucccaaggaaucaugaagaugaaaacaaaaccagaagcagaaaaguuccagaguguugucagaguuccacccaguacaucagaaagagaaucccggaagcaaggccuggacauuggcauuaagggaagaaaaaaacaaaaaauucuccgggcaauuuuaaaauagaaacugugauuuuugagggcaguuacagauggaccaauuugaaccacauucaggauucaucaagcuguucugaaaccaaacgagccaaguaauggcauggaagcuaguagcugugcaggaaaacagggaggagggcagaggaaagcucgggucuguuugcagccucgucaucucuccuuaaggcugcuguggcuugacauuaccucucuguagccaggacugcagucacauuccacccccugggcuagaugaccuuguggccuuuugggaaacuugccucacagagcacacaccugcguuugugaaggccuggcaggcagccagcacgcucagcucccaagcccuaaccugguuauuauuuuuuuuuucuuucuguucuuguuuguuucuugaugcaacugugacaucuuuuccuucucauagugggauccuagauacaaaccguggagugcagagugauaaucaauacugucugaugcaagagcuccugagugcuguaaccuccugcaucuuaccuuccgugaccuacccucaugagugcgugggaaagaggacaggcuaaggugggggagugagcaugcucccuggaugaguagcaaggauaagcaacuauacauauuauauuucagucacaguuugcccauggagguauuauuccaggagagauguuacauagcucuuuccuuaacauggauugcuuuugagagagacgaauauuuauuaugaaaaaaaauguugggugaauuuucuuuucuucagauuguucuaccuaggagguuugacugguaccaucuuugggacaggaaaugcucccaagaaugcuggauuagaaugacugcuguaguaauuuauuuaaaaugagguuuuguuuguuuguuuguuuguuuuuuguuuuuuuuugcuacuaguuuuaaagaaagcauucaucaagaaauagcuauaaaagagauuacggggaacuuggguucacauacauucaguccuagcuucaguacuggguaaagaagauauuuuauuuacauuuauuuauauggaaacuguuuuuauuuuuugagauggggaucuguuuugauuacuuuuuguuaacuugacagagacuaaagucaccugggaagagggacccucaagugagaauugccuuuaucagauuggccugcagggguggggcauucucuugauuuaugauuauuguggguuggccuagacaacuaugggcggggccaccccugagcagguaguccuuggauguauaagaaagcaggcugagccaacccuggagacagccagccagcaaacaccccuucuguuuuaguuccugccucuggucccuauuugagcucauauccuuggcuguccuugauggacuguaacguguaagauguaauaaacccuuuccucccagguuacucuuggccauaccuuaaauauuguauuaucauuuuaaaauuaugucuauauguguggcuaugugcacaugaguacaguuaccuguggagaauacaggccuuggaucucccggaaguuagaauuuacaggugucugugaaucaacugaauuggaagaaccaaagugcucuuaguccccucagccccuaagaagacagaacuggagugaacauuuguaauacugauuuugaugucagguguauuguuaggucaguaauuugaaccauugaguguuucucagaugucuagaaaaggccagcauuucacauugcuuucuguugcugugacacaauaccugagacagccaacuuaaaaagaagaaagguuuaucuugguuuauaguuugggagguuuaagucuaugauugguuggccccauaauuaugggccuguugugaggcagcauauuauggccagcuguuccugucaugguggucugccuggaagcaaacaggagaaaagaagagaccaacuugucagauucccacacaauccccaccuuuaacgacaggggccuucagaaggcuaagccuuugacccacuggccuuugggucauacuuaugauuuaagcuauaacaaacauggauccagaaaccaaaugggggcaagguugcuugagcaugugcucaggauaauguguacccugagauacuggccauggguaaauuucugugcuucuguaaaauguagcuaguaguauuuaauguugucaaggauuaauuuaauauauaagguccuuacaaguagauaaaucgauauguauuaauauguacuugauguaugaucguaacuaggugucgcuacuuuuauaggaggguagaaaauuaauauguuuuucucacgcauaguuacagaaaucuaaauaaucuucaugauauuucacuuauuagaauaauugacucacuuagugucuaauuaugaguaagaagaacuuggcaguuuguuuucuguaagguugaaugaauuuacccaagcauggcuuagaccuguaaucccagcacuauaggagacaugaguggaggaucacagguucaaggucagauugggcuaugugaaaaaaaaaaaagauuuaaauacagcacagguaaaagggguuugguuucugguuuuguuuguuuuuuguuuguaaaauaucauuuaugugauuuucuauuucaguuggauuuuuagaaauuuuagaaugauucguguucacugaaaaaaauuaaacaguagagaagugugcaggguuuguacaaauagagaauguucauuuuuuaaugcugugcauaccagcaguuuuccauguguuuaauauuaaaccaguuuaugcgcuggcuugauuauuaacacaauuauuuauuaguuagacaucuucggguuugugugaggaccuggggacaggcuuaguuuugucuucagcuaaaccuuuucaauaaaaaugaauaaucaggcuuugucaucagaacagauauagaagaaucaaaugccagccaaagaauguugguccuaguguagacggcugcaacagcuucacucaagacagggcaugaaggcagccuuccuguaaggaaaucagacucaaaauaaaaugaguuuauauaacuguugugcuaggcucucaggucuuuuaccuacauaucaguuaaaaauacacgcagaaaacaccagcaggguugcucaugugccauuuucucucugugugucaaaauuagucuaaugauaucugaaacuuuuaguaaugauauuuuaaugauauuuaaaacuuaggacucugugauuaaauucugguugcaaacagcacggaaggaucaagaagcaaaggccuuaggguuccaaguggguuuuuguuaaccagccguguauuuauuuaguauuuggauggaggucgguuuuggucuggcugggaguacagaauccauuuuuaggacucacccuacucagggauguuacacggaggaaggccagauggucucagggccccgagugcagggccagugaacccacaugagaaaugaggaaagggaacacauuagagaugcuuuuguagaccguggguccugaaccuaguacagcaaugggcacggaacaggacaggaguccccucauuuucagauggccuggguuuuuuuuccucuccaguucaaaagauauuucagguuaaaaauuucgcucagaaacaauaaaaaauuuacuuuguuuuuggugauuucccaguuaugaagcuguucuuugucugauguuuuucccccucagggaaucaaauuuguacuauguccucgguuucuagagagccacauacugucuuuaucuucaccgaaaacaguggggcuuucuaaaugauagugacaaauuacucuucccgccucucuggacacuuaggagaguaagagauccgucauggaaagucauuuguguuaagugaagaaaugcuuuaucguuccugucgccuugcuaaauuucaaagcuuuaaugacacucauauaucuucgccccacagagacauuuuugcaggacaauaaacaugagguuuaaucuuacccuggagguauguuuguguguuuuaagaugugcccuuucaggccugguuaccaaaaaucucauuuguucagcuuugcuuugucugcacaaucuucuguuugacauuaauuaaauuuaaaauuaauguuuuauaaauacauuccuuaguuauuuaaaaauuauagcuggauaaguuucaauguguauauuuacugugcacaggccucugcugcaugaggacauuuucaugcaaguauaugcuguaugcugaggauacucuccccugcccugcccugcccugcccugcccugcccugcccugcccuccccuccccuccccucccuucccuucccuuccucuucucuccccuucccuuccucuucucuccccuucccucuccuuccuucuuuccccuucucuccccuucccuucuuuccccuucucuccccuccccucccuucccuuccuucuucuucucuccccuucccuucccuucccuucccuucccuccccuccccuucccuucccuucccuccccuccccuccccuccccuucccuucccuucccuucccuccccuccccuccccuccccuccccuccccuccccuccccuccccucccuuccccucccuucccuucccuucccuucccucccuucucuucccaguuucuuccaguuagcuuccuuauuuccccuagagcguuucacuucuacuuucauaucccacauacuuacuuuuuauguaucuacauaagaucugggaaccacaaaugagaaugcauacaaaaaaagaaaaaaauccaucuuucugaaauuggccugauuaguguacggugauuauuuucaguuucuucuucguuuauuauuucaagcaauauaauuucauucuuuacgaugggaaauacuccacugugcauacacacuacauuuucuuuacccacuccucuguuggacccuagauugguuucauaacuuguauuauuaugggcauuucaacauugcuuaguuauuaugaacauaucuaaacaucgauaugucugcauauacuuaauugguauuuuacaguaaaaugaaugaagcaauauacauuuauuuuugugguuguuuucugugcuuuggauuaaacucaggccaugugcauccuagguagguacuguaccacugagccacacacaucucuggcauuaaucuuuuuaaaggaucgaucguuggaguuagaauacaguccauugagucucaucugguguggucauagcugugugccucauuuguuccucuacucaggggaacaaaaccccacugcauuucauuuuuaaaagaaaauagaauguuauuaucucucaagacuuugugguuaauccuaguauguuccaguuauugaaugaaguuucaaaagcauaauuacuuuuuuuuuuuacaaauguaucaauaacuuaaguuguagaguaugauuuauacacaaaaguuaccaugguaaauaagcaccauuucucagcccaauggaguuuuuaaagcauuugaaaauguccaucuuuuuuuuuuuuaaagugauacaacguuuuugaaaucucagcuuagcauuuuggagagugauacuacaauuuaccauaugaaacaucacauuuuauagcaaauauuccccauucugauaguuaaucgcuugucauagcaugcuuguaacaaguauaauuuuaccgccacaauauauuaauuugagaugaaaaguucuucagacacuccaauagaaaugaaaaguucaaauacgaagauuaauuuuaagaauauuuaauucuuagauacuugucuguuaaguaaaccacauuuaauauuaaaaucuaauuucuucagagaaguuacuggcuaauuuuucuuaccuggugcauuaguuacauuuuuguugcugugacaaaauacuggacgaaggcaacuuaagaaaggaagaccccccccccaauucccaccccuccacuucccacccccacccccuagugcuggguauugaacccagggucagggucaugcauauuagacaugaaggcaaaugcucuucaaacugagugucaaacucaguuuuauaucggcucacagguugaggguacaaacaaagccucaugacucauaaagucaggguccuggggacacaagacugcugaucugcuugcacccauagucaggaaagcaggagaugaaggccggugcucaucuggccuuuuuuuuuuccugucaccguggcauggcaaccauucacugcuaccacccacuugagaaugggucuuccuuccucuuuacacucccuggaagcacacacauagacacacccagaguuauacuucccgaucacucuagauccugucaaguagacguggagauuaaccgucacuugcagagaagccuggauucagacugggauauuuagacaaggagaaucagcuuuuuccuuguuccccaggaagcagcagguggucaguugaauaaacguggggguaagagcuaaaggagaauucuacauggaagugugcugugugcuaauauuuuagguaauauauauauauauuaccaauauacucuuguauauauuaccaugcauauauauacauacauaugugugugugugugugugugugugugucagguagugugcaucacuacccugagguaaacugagguaucugaacuauucacaguaacaugaaagaacaacugugaacuggggucugcuuugaggcaguuaaauauuacaaaugaaaguggaacuaggagaauacuaggaauauuaaucuuugugucacuagggacaauaccuugaauccagauuuauccaguacuugauaaauacuuuuggugagcacuguagaaauucuacagugcauugaucaaggguugcaugguuuggugcaugguagacgguuuagcagggagagugauuucuguucaagcuggaucugaguguccaugcccagaacccaugugaaagcauggcacauaacugugacccccaugcuggaaggguaggagaauucuggagauguacuggccagcagaaaugggagcuacggggucagcgagugacccugccucaaaaauaaugaggacaugauagaagaacaucacugccaccugacauugaucucugaucucuacacaagcauacaggguuuguucucucucucucucucucucucucucucucucucucucucucucucucucucucucucucuccacacacacacacacacacacacacacauacuuagagacagagagagacagagagacagagagagagaagaaagaagaaaaaagaggaggaggggggaggaggaggaggaggaggaggaggagaagaggaagaggaagaagaagaagaagaggaggagaagaagaagaagaagaagaauaagaagaagaggaggaggaggaggaggagaagaagaagaagaagaagaagaagaagaagaagaagaagaagaagaagacgaagaagaagaagaagaagaagaagaagaagaagaagaagaagaagaagaagaagaagaagaagaagaagaagaagaagaagaagaagaagaagagaaggaggaggaggaggaagaggaagaagaggaagaagaggaagaaggaagaagaagaggaggaagaggaggaggaggaggaggagaagaaggagaaggagaaggagaaggagaaggagaagaagaagaagaagaagaagaagaagaagaagaagaagaagaagaagaagaagaagaagaagaagaagaagaagaagaagaagaaaagaagaagaagaaagaaaacuguacuuuccaacagcugaaagccagcacuacuuuaugccauuccaaagccagcacuacuuuaugccauucuauugacaggcauuaaaaaucuugcugaggucauuaucuuucuccuguuugcucaggcuugauuuuuaauguuuuaugucaaguguuaaaucauucuacaccaaaggguucaggaaauuuaaguuugcuagaaguaagcugaauuuuaagauaauguaguuguguuggguggggaaguuucuggaacaaccaauaaaaacuuuuuuucucucuuuuuuuuuugagauuguuuuacuauguaguucugacuguucuggauaggacuccuaucuaucuaucuaucuaucuaucuaucuaucuaucuaucuaucuaucuaucuauccauacauacauacauacauauauaccagucugguuucaaaggcacagagaucagccugccuuugccuccugagugcugggauuaaaggcauguuccacuacaacccagccuaauaaaaucucuugaugugaaaguagcuuacaucuugcuguuaguagacgaacugcaaagggcccuacuuacaggacuauauugguaauacuauaguguuauuuagugaaagaugagaggcaggaaucccugagggaagccaaagcaauuucaguauggcuuaaauaguugaagggaagcuugcaggauggacagagaugugccuaccacugaguaguuuauuaacauggcugucagaaacguccaggaccaagauaaugaaggaugaggguuccuagaggguauaugaaguuuauuuauuuacuuugcagaugcuccucuguuuuuaguauauuuuuaccaguuguuggggaauuucauaccugacuacaauguuuuuaguuuuuguuuuuuuuaaucauauucaccaugucuuccucuccuaacuucucccagaucuacacccccuucuuucccaccccucccaacuuuauguccucuuuauagcaauaaaaacaccaaguacacuuugggccagcccuauacucauggauguggggccauccccuggaaugucaucugccugcuaggggccacucccuuaaagaaaacaaacucucccuccuccagaagccaucuacugucaauaacucuucagccaggaauggggaucaccgccccucccccuccaguacuggaaugucgacuggcuugaucaugugcacuucuuuuacaagcauucaugccugcuauguguuaagguugcaccaggccugccauguuuagagggcaccauuuaacuuugguccuucaaaaccccuggcuauuaaaacccuuuugauccccuucuguaguuggucccaagccuuggcaugagugaagaugauagggauauucuauuuguggcagaacacuauucugggauuuuaauauagacugggggaucagauuccucuguuccuuuguauuuguguugcauuguugagcuuuuaugaacugggcucagagguucuuucgugaacuucugagggucauguuggaaggacacagaugacaagaguucaguggguugacaguauuucuccuauguguguguguuuuuaguuguauuuauugacuucauaaauaacugauaagaugaggaaaaugucauuaccaaccuccuuccuggagaagaacagacauucgauaaaauauccaaggguuuauugucacauauuaaaauguuugcaauuuugaaguaauggcguguugacucauugcucauuggcucauucauaucagaguuugaauauauacaauccagucccaagucccugauucuguugucagccauggagcugggguaaaugcugaaauuuuaacgggauuuuaggguuuggggugucacaugguucuauaccuacuucacaaucucuuagggaauuugagcauuucauugaugcugauagugaucggaaguuaugauguuuuuauaacuaauuuacugcacauugcuuuuccuucuuugaucacauuuuuaaaaaguuaauuccugagcauguacaagauggcuuauguuucaacaggagcccauucugucaucucugugaugcuguauauggagagguaguuccugcuguaccuugucaauuucacagucuaauguagaaggaaaaugcaggaaaauaauuacgcauacuaugucaaaggcuacaauaaaagccuauguaaacucuucacagauauggcugagagccuuugggcaggacuucaaggguaaauggaaguuggucagagcagagugggguuccuagagaugaagaacacacagccaggggguaaaggguuaaaaguagaagccuuagcaucugugggaugggaugcggguguguguggagggguaacugggaagggggauauuauuugaaauguagacaaauaaaauaauuaauaaaaaaaguagaagcuguuguuauguggauaugagacucaggguuucagaagcccuugaugaaucugaacuucauuuucugaacaacagugcacuuuuacauguucuagaaacagcaguggucacugauaacuauaauucaucuagauuuaggagcuuuaaugaaagaucuuguuaaugucugcuuaagcuugucauuaagcuugucacaccuagcugcaagggaaucagguaaauguguuuuauuagccaaguauucuguagccaggaaagccauuucaggaucuaucauuaggguuauuauuuguuuugauuugauuuauuuaaaauagggccucccuauguaguauuggcuaccccggaacucauuauguagacuauucucgucuucaacucacagaaauccuuuugccucugcuucccacguucugcacuuaaaggcaugcaccaccaugcccaacaggcucuauucuuaaggacagaggagucaaauacuuggcaacaggcuaacauucuguauuguaaagguaggagaggaaaaugagaugaccaauacauguucuccauuaacgcauuauucuuccugagcaauuagagggcaguuuuggaauguuccucccaccuuucuuaccugcuggcugaccacauggaaaauauuugugggaugauggaagaggagguggggaaugcuucucgucuguaugugaaaucgcccaagagucaagcucauuggacucagaguguguucagaugccuggggaauacuuccaacgaaaauacugagggguugggggggugggggugggggaggaguaauuucagguucuggaaagaaaugacagcaucaguuuccuuuccccauugguaaacuuuuauuucaucuagaaacuuuguuguugaacuuuuacuuugaaaggacuagcaggcgaaaugggcuuugaggcuuuuagaaaggagcacaguauuuaggaccucgucugagccagaucugcccauuauauaaaaucacuuuucugccacgacagagcuuuuucacaucuguuuauacuuagucucucuuacccagaguggaaagauuuauguaaaaggagaaaagaacucugaauguaugucucgcaucagugaaagcggggccuccggcuuaacauccauuugaaguacguagcuacugucuaaucauuucaguuauuguagaaguagccaaaugaagcuaugucccuggaaauuagagaugaagauguggggaaaaccuacaggucuaagaaggcuugacaagaucaucaacauuagggagcgugugaagggucugccauagacauuuggaaugcaggcaaagguuucauuuaaaaugucucaaugauucgugacauacugcaccuggaucuguauaauaauaaaugucuaucaugguuccucaauaguuucucuucguuuuauuuucuaaguuaguugcaguuuuuccuucucuuaagugcagacgaaagccauaggaacccgucuaaagacguauuuagggcacacacacacacacacacacacacacuauaucuagauagauagauagauagauagauagauagauagauagauagauagauagauagauagauagauagauuagauagauauaaaguggaaauagaaguuccaaguccacugugaggagccagggauggcacuguuccauguaaguguucccuggagacauuugaucucuacaguugucuggccuggcccucuuagacugcacuguccaauaaaacuauuguagaacuguuuaaauccaauuugaaauuucaaauagccacauaaaaauguaaaagaagauaaagucagagguagagugcaaguuuagcauuuauaauacucuggguucuaucaccagcacagacuaucagaugauaaaugauagaugauagaugauagauagauagauagauagauagauagauagauagauagauagauauucauuccuuuuuaguaaguucaaauagucuuugaacauguaauccacauaaagcuaauuacaaaauaaauauauuacauggauuuuuauaucaugucuuuaaaguuuuaucuguugugcauauuuuaauucagaucagucauaaguagcugccauauuggacaguggagccuuacaagacugacccuucccgcugccuuccaaaacauguucacauuuagaggauggacucugccaacacugccuaagccccuucauuuuacaggugaagaugaccagaucuagagaugcuggguugcuuagaaucccauagccauucacaucagaagccccacccuuuugucugacuucaauugcuuucaucauucuuucuuuccuuagauuuguguugcugcaacuacucacugugagacuguugcuguugguuaaauauugagccaggagucuuaaaaacauuugguccacucaguaaagccacuguuugauuugguggaaacuguuuugagcagaguagguagaacuaccaggcacauugacaguucuccaugagauaguaauaggaggugauaauggggacaggggugacuuuaugcuuguugguguugcugugggcauuauaggaguaugugacuucaaauuuugaaaugcuagcugccugcuuacaggaagggagaugagcuguucccaugcaaaguuuauugucuaguuguauguauaagccuacacaugaugaauaucuuaaugcuuaacucucucuggaaauggcaggguuaagcuuuuauauuucauauuuuuuucuuguauuaggaacguguguguguguguguguguguguguguguguguguguguguguguguguaugugugugugugugaauguacuccuauuucucacucaguuauacuuaaagugugaugauuuuugacaaguuaaucccaguacacuccuggcauguaaaguauuuucagaauguaagcccauguggaaauucguuggcuugguaugacggguucgggcaggggaggcauagugugaucccguggaguguucggagcugccaaguauuuguucuucggugugaaagcgugcuugacggguggacuuuccuagcuggaaggugcuuuguucauccuuccuaaaacauuuaucagcacggauguuguagaucguguaagagaguccccuuuauucaugugacuuaguucagugaucuuagauuuagaguuaaguuuuuguguuccaggguugggacuaauucccagccauggcccagcuuuacccacaaaggaacuaccgaccuguaaggauauucauuugaugcguuugcuuuuguuccuggugccagucauuggauuuugccuauagugcuuuauguggcuauacuuagaaguuuuauagcuuguagcaaucaggugaaaguacagggauauggcugaguacuguaacuugcgucuguaaucccagccagaggcaggaggaucaccaguccagggcaauuugagcuacagaggcaaacugaaaaaggaaaagaaaaaaaaaaagagauuccuuuauuuccuuuggccuucauacacaaauauuuaaauucuuaauguacgguuuuaagucagcccccuaccucccccaccuugguaguuugcauaguacacauuagcauuugaaacaaaaguuuugagcuauaagaugcucaugggagucauucugaaauauguuuaagguggauugauucggaaaggaugcaaauccaaguuaggcuggcugaggccuccccgcuucuuuagagggugauacggaagguuugaggacccagucugcuucggucggaguguggacagccagugagggcagugcagcaaaaccgugucucagaaucagaaaguuaaaaaaaaaaaaagagggcagagguuauaguggagagacagggcauuugcuuagcauucgugaggccuuccauuuaagaucucuaguacccugggagaauaaaaaauagucguaaguucauugugggaaagugagaaaaaguguauaagugcuuguguucuauccacgauugcuuuuguuguuguuguuguuguuacaucauauuuaaaagcauuuuuguaauuaugccauagauuccauuucauaucugguuuguucuuuuuaugguuaaauuccaucccucauaaauucuuuguaauuauaacauuuaaagggugcauucauuuguuuaaagcaaccagagcuacucacuuguacguguggggcuuugcuuuguuuguuugcuuguuaguuauuuaauauuuuaacagagggggacgucuaugugcuaaguaaguggugauacucauuugucgagugaucuaaacugcugcugcgcucacacuucgcuauaauaugugcuuaaaaaaaugagaugaacagauaucauacagaucaacagggauuuauaaaucccccugccaaccccccaaaaaaagcaagcaaaaaaucuggucugcugauugaaagaagcgauaccccccacuuaacagcucuaucggcacucgugaagguagaaguuugucuguaagaagcuguuagacuugacaggcaaaccuagcugcgccuucggcauacacguuagugauauugugccaucagcuuacuggagcaacucagugggaacaggauuggguuguaugauuucacaaauguaaauagaacauccucuuccucguuuccuugcugcuaaugucucucuugguauuauguggauaaagagaaaauuauaacuauuaauucucgggaguucccaaagguaagacucgaaagccaccaaagaguacuauauuuaucuuuaaauucaacaaugaggugaaaugcucuuuucagaggucaccguguagaaucuggagcccacuuagccagacccacgucagcuuuauuaaggggcugccuacaugcccagcuuuauacuacugcguguuguuguuuacuuauuuauucugcuggauacuguaguuguguucugccacugagcuacacccccagguccauguucauuuuuaauaagauaauacuauaaacauauagugaauaaaugccaguacagcacacgauagauaaauuaauaaaacugaaguuccauaccaucagcagaacaggaauuauaaaagaugacuucaguguaagaggcaaagucauuuguugagccccaacucuacgugaagaagaacucauauucaaccauggggggaaaaaugaaaagacaugaaaugccugaucucuccaaacuucugcacuacugaguagauagcaagccaaacucaccaaucgauauauccugugacacuggggauuagucuguggaggggaggggcgcuacguaagcaagugaagggcucaagagacaagucagagucaguacgaguguucaugggaacagagaccaggcacuuugcuguauggauucuuuugacccgaaggcaacggagaaauagcagacacuugaggcuuuuacccacuccucucugccuacauguggaucaauuuccaucuuugauggugugagcuguaucaggaaggaguuuaucacugaucccguggacauggcacugaccuuagucuacagaagcaaaccccugguuucuuccaucuuuuuuuucuuugccaccaguagcugcucuuagcagcuccaggucucuuagacugugaaucauuagccuucccuuugcaugucaacauuuaggauagugaggaauacuggacuaucuuauagccauuucagagucucuggggggaauaggaaaaggaaagaauuugcauuaaaagucagcugaucugucaugucagaggugugauuuguuaguuuugggaagaccauuauucuuuaugguacaugugaaaauacugacuguguaaagaagccccuuauccguggugagaacaaugguaauuaauagcagauagaccuucuagaagucaguugugcccagaaguguguuucauguaaucccccgcugaaugggaauuuaagauuggaccacaugaacaaucuguccuuggugccuccugagccaccucugcacugccuacgugaaugaugggugggacugagcuaguggguccugucgggccagacauccucuccuugaggaagacagccuuggggugggauggacugauaagaaggcagacugggaguuuguuaagccaucagccaguucucaacugcucuggacccucccugcagcaggagggaugcugaggaguaagaccuccucccaccuccacucacacucgcuccuuggugucuucucugccucucucugcucgcaucaccuuuuuccuagucgucuaagucagcgguucucaaccuguggguugugaccccauugaagguugggcaagagauuuuuuuuuuuuuuuuuuugcagggguugccuaagaacaucggggaaguacagacacuuacguuaugauucauaacauuugcaaaaucauaguuaggaagcggcaaggaaaauaacuugacgguuggcucaccacagcaugaggagcugguuggagucuccuucucuuuaucacagcuccaaauaagggaacccucagaagaucugggggucacucagaacaugggucugcagaucaugcaagauccagauuaugaauuuggguccugacuuggcacagcccaguagaaacgcggcuguagaggaauuauuaacuuucuuaagcuuccauuuccauaucuacagaguauuuguuaauagugcuguuaggagccaugcugaauuaauaagaacuacaaagauaacauguggaagguacugaaugaaggauuaacauggcucuucuugucauuucuuggccccuucguaacagcucuuuucugaccuuucuauacaguccugacuguacaggccagugcugcguccccuuuuuacaaaugcaggggcugagaagagcccauuugcccaagguucuugucuucuguuucagcugcugucaaacagccggaaggcuuccguucuaggcgaauucccucccugacuguaccugagaccagguuguuaagauuuuccgcagggccuuucuuuccuugcuuauccauccuugcaguucuugaccuucuugaacccuacaaaaccagcuuaggaaggaaucuaaagcaugcuggucacaacgaggaccauuucccuguccuucccucugauucuccacaguugaccaggcgccggugacagccuuggcugcuugaaccagcuagagagagccacggaauuccaggcugcuugcuuucaaagggcuccacuaaccccucugaaaacaaaggguuguuuaucacauaucaaagcauaccgggcagggauaauugagagaucuucugauaggucaugugguuuguagucucugcccaggcuucuggagugggugggccgugcuccugccucagguagcagugacuucugucugccaggauuaguucugugugacuguccuguaggugugcauagcauccgcucaccaucaacacuuuauauuucucugccuaggucccuagaaaauagauucacaaagaaaaccgucuuguacuuuguaugguuucaggugacucugauauuucaugaauucacaaaacccgaguugaacacagcaccaccuagucucuggucuaggagagguguuuuguuuuuucuuuucuuuucuuuucuuuucuuuucuuuucuuuucuuuucuuuucuuuucuuuucuuuucuuuucuuuccuuuccuuuccuuuccuuuccuuuccuuuccuuuccuuuucuuuucuuuuuuuuuuuuagaauggaaguaucaaccuggguuggguuaaauguuuucgagacaagccccaggcugcaggaggguuuugcuguuuagacucuagaggaacaagccuucucuucucgccauugcuuugcccugacccugcaugugucaggcccuaucauauguucggcugugugauccugugacacccacauccuguugcuggauccaagcgcuuugaggcuguauuaacgcagauuaauugaacaguugcccugugaaaacagaugcccuucgccgcucguuucuaauaaauugucaagccauuuaaaagacuuccccuugaagaagucauaucuccccgagaagcugaagcaaaaguggaauguuuaugucccaaauuagugugcuauauuuaaaaccaguggccucggccugaccaggacauaauccuucgccgcuuaaugaaacugccauccugucccucuguauuauauagugaaguugguucuacuuucuguauuccaaaccagaaagccguuguaaagaacuagccagaauaagacauuagucuucagcuauuugauguuuucuuuauaaauuaaaauuauaacugacuuugaaauaggaagcuaagccuggccuccccugaaccaaaaacugaaauuuuaguaacauuuugcuuacgggauauuguaauaaaaugcucuuugcuuaagauaaagguauuuguccagugacauucugaguuacagaaaauugagaauguauuauagauaauguacuaugaaaccagaagaacauucucucuaguugacaaagauaugcacaauacaaagauccagguauugaucugaugcuguucagagaucgagaaaggccgagagcaaauccuauuucaaagugcaauucaaguaaaauuagauucagugagacuauaucauuuacccacccuuguaguaaauaauaagguagaggugcgagucuaagcuguuaccuaaaggaagugaaaugacccagagagaugagcaucccaugaccucccaaauggaaucgaagcaguugaacuugcaagaguagacacuagaugccaguggaugggguaaaugggagauguuguucaaaggguaggaauucgcaguuagacauggguacaucauagagagcuggaguauagauauugucacuguaguuaauaauaaguguuauauucuugaaauagguuuuaaguguucacacacauauagaacaguauguguggugauagguaacuucauuaguuaauuguuauuuaauuacuuaaaauuauauauauguguauauauauauguauguauauauauguguguguauauauauauauauauauauauauauauauauauauauauaucaaaacauuaucucgugcauguuggauaagauaacuuuuauuugcuacuucuuuuucacaaacccaccuugcacuucauuuguaaagagaagugaagucccuaaccuggaggguuacaguaagaauaucguguaggcuucaguaagcauuugucauuacugaugcugcuguaagccagugcucaugacuggcuccucuccccuuccucugccagauguucucaguggcucucuguugaugcaugcagcuguguuucugagggacaccauggaauguccuuaacccucugucuucaggaucaguguuuaucccacaguaaaagaaacaaaucaccaucaagguugcuuuguagcaacauacaaacccccaaagcucacauaaugacuaugugacaccauaugaauggacaccauagccaccauguaacggcugaugacagauacuuucuccccguuuuaguaacacucugcugcuuuucugucccaucagaguuccaugucuuuguauuauguguuuauuagauccuaggcaugauguaugcaguacugguugccaucaaaauagauuguagaguuuaaugggaagucuaggaguugacauccguacccuacauaaaaccaaccaaccaaccuuuuaaccuugcugauuagcuaucauugaguaauagauuucccaccuggaccaccacuuauacucuacuaauucuaauccagauucuguagcucuguugucugucuaaaucugaauucuuuucucuugacuccaucuguuuugucagagccuaguguagaagcgguggacuuugagccuuacauggacccaggccaacaguucuucuccccacauccggagaccaggcuuugccuuuuacaagaaggaaacugccucucuguucccaagacaaagcucccucgacuauaguugcugcauguuuggcucagagguuugcacagucuauguguauaggcaggccauggccuugcugggccugcuggaagauggcuagcucucgcuggcuaauaguugacucacucaccgugggauggaagcucuggccuggaccagacucuggucagugucuguugaucucagggaacauuccacagcugcugauguaacucaaaugacuggagccaacucuucuggaccgguuagagggcuugccuggaccaguuagaugacuggcugucacucaguuuaucugggggaauucugugaagugaguguuacuuucaguuccuccaugguaaggggaacuucucuccucuuaucuucuuuuugcaaaguguguuuuuuauaaaaccaaaguagcaucuuugggacugugguggugccccgauucccgauugggaagccuugggaagaggcugcagaaggauccagaguucaaaacagacucagcuacagauguuccaggccaggccaggugacaugaaacggugucucaagaacccucaaaauaaaaucaucaaaaauagagauggaguuuauaaacgauguggcuacuauuucauuugguacccuauucaacaugauccucacagugcuuauaacuccuuuugcuugaacuuuuuuuuuuucuccugagcuggggcucagaccagagccuuguguacuaaguaaaaaguacuguaccagugagagcuaucccaagacugaaauaucuuuuuauugagagauuccucaugaaaugcauacugaggcuuuuguuuguuugcuuguuuuucuaaaugugauugcagaaccagauaauuugugagacugcccaugguaugaaaagauuaguuuuccuagucugggugugggccaagaccuauuguuguuucugaugcaaacccaagaccaaggacugcgguugcaaacuuacuuauaugacugccauguuccuaaaaaagauuuuuagaaacuuaaauuaaaaaagcuucaagcagcccaggcacagugggcacaccugucaccccaguaccuggaaagucaaaaucaggaguuccaggucauccucugcuagguacaaaauuccagagaacccugggcuagcuaccugagacuguuuuaaaaccugcaacaaacaaacacaaacaaacaaacaaacaaaaaacucucacauaaaaauuagaccaauagaauuaggaaaacaggccacuagauaccaacauacauuuuguuacuaauuuuaaaacuaucccuuagaugcacagaaguacuuaucagauaacugcagcuuaggggucgcccgaguuuacuaggaagccaucuguuuaugggacaaacauguaucugcugucaucaggaaggucacugggguagcugugacucagauccacuaagggaagggacagaaauaggacuccuaucuuuuguaucucugggauggugaccagagagguuuauguuguugcuauguaggcccuuuuuaaaaacuccaagcuguaaauacugaauuuuagaagcacaucgucauggcuuuagaaaaacaacggucuaggauuuccgaaggagcuuguggcuccugcagcuauuccugauuugguguuaaguuucuguucuuaccagguauccugaccuccagugugggcuucuuucagaacacuucaauuaaaaauguaauuauuaguguggcauucgugagaacaugcccugguagagcuuuagggaugagaagacaacguuugaaaauugauugucuccuucugacauguuaucccagguuggaacucauguucccaugcagcucagguuacuagggguguugcuaaguacuuucaccugaguuaucuucccugccaccaaucagaacucuuagcagucaaaauaaaagggggaaaaaggguuucauuuaguuuuuaaaagucauuguguuuuuuucaagaaaaauagagauuagauuaaaaaaacacauuauaaaguaaauuuuaaagcccucuuuguuuuuauugaaacuuguaucaauuucuuuauuuggcuuaccuugggacaccaggaaaagagccaagguuuccuagaacacagcuugaaauccaguguuccaaaggcccccuagucugugcuuucauuuuggagcaccauuuuuuaaaaaaauaaacccagauuugaagaugaagagauaagcugacuggccuugaaguuagggccaaggccuaacaauagcuuugaaaccaguuuuauguuuucagaaaccaccaaaccagccaggcauacugacacaugacuuuaauccuagcacucaggagacagaggcagguggaucucuuugaguuugaggccggccuggucuacaaaacaagguccaauacagcuagggcuguuacaaagagaaaucccccuccaaaaaaaaaaaaaaaaucaaaagaaaaagaaagagaaagagaaagagaaaaagaagcaagcaaaaggaaaggaagaaagcaagccaccaagccagccuuagguccagugucguugaucagacaguucaucugcguuugucaccacuuuacuuucugggaaggaaagcagggauuauauauauaugguggauagagauaaaugagcagcuauuuaaaaugccauuuuuuuuguacuuacuuauaagucaaaucuguguagauacuaaagaugaguuauagagaccagacuucuguuuuauacaucaaauuucaauuuuuucaacaguaaccuuauugagaaccuacgugauuuacuuaaaugaaaaacagcuuucccuagauccucauggcuuuaggauggagccuagugguuacacauuucucacugccuuaguuuucuguuccgugaucggugaucccugggagaccuuuugaccuguggcaaggcagcacagcauggugggagcgcauggcucauucaccucauggcuaugacuggguagaaagaagaagcaaagauuggagucuccacgucuucauuaaggacacacgcccaaagacaggaagaccugcaagggaaagaucaccagcguggaacucuuucucaaaaguuaauccagauuucgccaucaaagccucugccuucauggugaggcauaugcgacgugccucugacuugguagagcuaaagacaggaaaggagaaaagcagagggguugcggggggaggggcacuuguacuuuucaugucuuccagccaagcgcuugcacuugcccucuuauggaagacucgccauccggacaaaggaggguaguuacggccaaagaaugaaguugcugaguaaaauggauacccuucucuauuuuuuuuuuccauuuuauccugguaccuggcaaagaaaauggaaaaaugaaaauuugguuggaaaaaagucaaagacgcguguaauuggauuagggcuggggauuguagcaccguucagaucacuuggcuagcggugcccucaguuuauuccucgacauuggugggggcgggggcagggggagcaggaagggcauaaagggcaugugaaggcagaaauggugggggcugaggagauagcuuaacaguuaaggucgcucuucgcauagucaggaggagcagaguuuggaucccaguucauuucacagcccgggcuuacacccauagcuguaacuucaauucuaagggucagaggcaagaagaccagugagcauucuucucuccaccccacccccacccccagcacauaaaaagucucagagccaagaaaggacagugccucaaaggaauaggcagaaugguggaggaggagggaccuacagagcacauggaugcauguacucacacagacagacagacaaacagacacgaauaaaguaugcauguacucacaccaacagucauacaaauaaaguaugcaucuacucacaugcauacauacauacagacagacagacagacagacagacagacggauggacagagagacagaaaaaaauaaagaagucuuuuagcagaaagagaaauuguuguucuugaugcuggaggcagggggaaucacaaguuuaaggcuagccugggcuuagauucugucuuuaaaaggaagagggugagauggcuuagugaauagagguuaucgccucuaauuuaccucuaagucacaaaggucauaaggcauucauauuuaugucugguuuucaacuugaacuuccuaguaguuuggucagauuuuuaauuccugaguaagaaguuggaagccucuacagguaaucguauuagccagcuccaccuucaugagaagcuaggaucucgagguaggcuaaucuuggcuuuaucccuggcuuacuaagugauuauacacagagauuaguucuaauaagggauaucucuuccugacuacaccuuggaagcaugagugcaaaggucuuuaaaacuuuggagcuaagcauugcaguccggucagggaggccugauggaaugcuaagguaggcugauuccuagcaauaaucuuagugaacgaagggcaguccauuuuuacucugaguccacugagugcgucagacuugaaggguuuaugaaaugucgaauuaucuugacucugagaaaaauggucaguuauaguuuuagaggaaucuuuauaaaauccuggguuaaaaaaaauguauucucaguuugcauucugauuuauucacaauagaucugagucacaggagauaaucaccccuguuguguggggacccaacggagacaagugacuguguuccccuggaaucacagagaaacuuaguaugaagagcauauuguuuuauaaaagaaaauaauuaugcuuccuguuauaaugccugaaaaauccauggaagaaagaauccaaggaaggcuacugaggaucggugaugauaguaguaguuguagugaugagguggaggaaaacauugccaaccucaccacgcaggcuggguggacaagcuggaagaugaagcaugauugaaugcuauuggacacuugcccuuaagucugucacacauuguuguucuaaguccacaggguaagcaccuaucuucagcgaguugucaugagaagacaggauuuuauacaguguguaccccuguagauucaaguuucaagugggauuuuuuuucccugccaguuuuauuagaaccuggccaguugccucuuaacugcuaaacacuaauacuuuggaaguuccuaugaaauauagaauaaaacaaaaagcagaagcaaagguauaacaaaacaaaggaugggcagacaccugcucaguccugucuucacugcauuugaaagaucccugccgugugacuccaagucaguggauuagagacagaaacuuccgcuuuucauguucaaagucaaggucaacacuaaguuaaaguucugaugagggacaggaagggaaauuuauuaugaguuaucuauuuaauacauagucaaccagauccuacuggguggugaaagcuuucucuuacuaguuaugguugguuuuucucuuauuuuaaugcuuaauuaguugcuuuaguccaaaauauguguaacaagauggagucucuaaucuguuacugauuagaugagucuacugauacguccccugacuaaucauacauaacaagcaauuagcacacugaaaagcaaucuggaucuagcauuacacaaacaauuacgucaguugcugacaugaaaaucccagcuagagugguaauaauaacugaaugugugaauagguucucucuuucuaggcugccaguaaguuacaaccuuuucuugaguuggguuucagcaaugaaauauagugaacgucuauuguagauuagauugaaguaggaggaccaguuaccuaucuauuuuacuguucuugacgucaggcaauccuuagggucacugcacaaauauuuaaaauuagguagagacacuaaagggagggaucuuuucugagucaccacagcuuauuucucuuagaagugguuugaagauucaaugcaaagaacuuugcgcuguggccuaauuuagugcugcuuucccccuucaaacagaauaggaauaacccaguguuuaugugcucuuuggguaagcacuaagccagaggauuccguacuuauagaaaugaguaaauauggagaugcugaacaagucaggcagaaagcacaauugcauagcaggccugugggaaaugaacaaugggggaccgagucuauaaauguaaggaagaacugauaauaacuuuugaaaagaauauuuuauacauccagauaaucuaauucauuauauuaggacaauguucuuuuuguagguuuuuuuguuuugucuuuuuuuuuuuuugucaugaaugaacgacuugcugcaaugucuaacuaagguauauauuucagccugaacuuuauucagaacaugagcauguggcauugcuaauaacuucucuguucccuuuaaauggaagcuucuuugauguuccuuaaauaucauaugucaagcauaguuuuuuuuuuaugaugauauaaugucuuaucuugaugagauuccuuucuaaaugucccugcuugcaagaagaagccuuccuuuaguggcucgucgcaucagauuuuugauaacccagaccuggaugucguuucaucucaaggucauaauuauagaucguguuuauguugcuucugcuccccuuaggagagcuguuggaucuuuaagaugacuugaauuuggugacaauauuaaguccauggccauugaauugcuuuucgauucagaggggcuugcuuugauuagggcuuuuucucuaguuuaucauuccuuuuggcuuguauaaaauauugucccuucauacuuacaguuguacauaccauaauagguacuuucuuuuuuccauaaugauuuagguacagacaaaacuaauaaugcuaguuugucaauuuucucuuagaaaaaaggagucgacguauuuaaaugccuugcugaacacacugcuuucugcccuggugucuuuaagaaguugauaagaauccccaugaacuggaauacuguuauauuuuugcuaguaagccguggcauugguaaauagugcaguauucuauuucauggacccuuucacuguuuuauugaugacguaaauuuuuauugccccaagauagguguacucaaaggggaaaccagaguuucuuuuugguaguaaauucccaucuaagggaugguuuuagcugcuuaagcagggucccccuuacccccaccccaggcuucagauuuguuguuuccuaugauggugaggaaggaagggagggggacugcuacuaaaaauaagaauugcucaaucaaggugaagucucuguuuggguguuuuaaguucacauacuugugcuguccagacucgaaugaauauggagacaggaauuagccuucagcguagucuuggccaagcagcugagucauuucuguauacauaucuuaauaguuuggaauauuuuagugaagucagaauaccuagaacagauauucggaguucccaguuguauaaaacucagggaggaccuugacuuugauucucagaacuuuccaaguguuaaagaagacauuaugcuggacguaguggucaugucuguaaugccagcacuggggagucugaggcagaaggauuggggguucgguucuagccugggcuauuuacugaacgucuaucuuaaagugaaagaaggguuauuaguuuacguguguuguuauagucagcuccaagacacacuuguguugggcaagcuuuucuaaaggaguggggagugccucccucuucuuuuuucuccccucccuugaucuuccuugugucuccucccucucuggcccccuuuucauucuuccauucucuccuccucggcuccauucccaucacuccccucucucuuuucuuucaaaggcucuugcuauguagcccaugcuagcccuuuccucaucccccugcuuuccuuaaccuccacaguacagugcugugauuccaggaacaugcccagcacugugccagccucuugcuuuuuuuuuuucuacaggaaaaauuccuuuccuaauuuuccucuucguuuccuucuuucccuucagucaccccauuccacacuccgcuggggaucaaaccuagggccuguacuuaaguucuguuaccaagcaacggagggagcagcauccccuugacuuugucaucucaccuguucuguauuuucuuuauuaauuaauuuauuugcuuuacauccuaauuguggcuaccuuccuguccucuccucuccuccccuccccuccccccuucccuccuauccccaugauucuccuguccucccuuucuccucaaaagaggggaggccuccuauggauaucaacccaccuuggcaugucaaguugcaguaagacuagauggaucuucuccuauugagguuagacagggcagcccaguuaggggaaagggauccgaaggcagagaguagagucagagacagccccuguuccugcuguuaagagucccacaugaagaccaagcuguacaucuguuacauacauggagcagggcuaggucaguccaaugcaugcucucuguuuggucagucuuuguaggcccuuauggaccuaggcuaguugauucuauaaguuuucuugugguguccuuuaucucucugguuccuucuauccuucuucuuuguuuuguuuuguuuuguuuuguuuuguuuuguuuuguuuuguuuuguuuuguuuuguugguucuagggcuauggcccaggacugcacacacauaaguguaccaccauugagaguggcucucauuucucaucagagaaguuuuucucugcagacaauuauagaaaaucacacuuggcuaaaaggcagaaaacaagugaucauggagggcucagcucuaauggacccaucuacaacauaauacauaucuugcccccaaggcucaaggaaccucuuggaacaguggcuagaaagacaguaagagccagaggaccaaaagcgugaggugagauugugucuccuagaacuaacagagaagcuacacccaggaaaugucaacaguauggucaccugaacagggauacggccacuagacaugauaagguggaaggcagaaauuucacagaggucccaucuuuagacaaauaacuguagacaacuaagggaugcuaagaaugugagauggagucuucacuagccaugagccucuuaauuagucauuucuugucuuuugcaagucagugccagguaaauggaaagaaacucugugguccucaaauaaugugucugucuuucacaugacuuuuuacaacauuuggcucgauauccuuugugaccauaugaaaugccaccauccccaaucuuuuccaugcauuaaacagcaguguguauccuguguuuuaaacaagacagagaggcgcucugccugcuccuagggguggagauuuccugcauuucacucuguccuucuuucuaaggggaaguuuagccgguuggccuugguaugguauucaccaugucaugugguacccauuagcauagcgguauuuaccaaauaguaagauucuggccauuacgucaucuuuuuacuuagcugcugcaggacaugcguaacacgcaacgcuacuuuguaaagcucucugaagccuucucuuuauaaaaggagccuggcauucaggagucaggcugaccucccuuacacagugugagacaggaggugauuuguguucucuacugugaaaucagaaggaccuagugcucuguguucgggaugcaaagcaccagcucgucccuccccgcaggagugcacuucagcagauucuggcaucugagcuccugcccuuucucuucuuguucucauucacuaauccucuuuccuugaugccauuuuguuaaauuuugcaagugucauuuuggaaccuagagaugggguuugaauauaugcaucuaucaucagucauuuuauauuuauuuuguaaaaugaaaacuuuuuuuuuuuuggagaggggaggcagugucuuucuauacagaccaacccagccucaaauucaacguucuuucugacccucagccuucugagugcugacaucugugugccauccggucucgcuggaacuuuaaacaaacuaucuuuguucauuuuaccuguauugucuaaaaggcaaaacagacccagccaaauaauaaauaaauaaauaaauaaauaaauaaauaucgaggguuuuuuuguuuuguuuuguuuuguuuuuuguccuuguaaguuccugaauuuuauuuacauacacauuugaaauucuugcgauugaccucugaaauaccacaggccuuugcaaccucagauuuucucagccugcuuacuuccugucuccucuccucguuuggcaugguggcucugcaggaguuuuauaauagcacucaccacuucuguucccuggaaggauucuuuugguuuuauauacuuuacuuaaauacuaguuaaguuacgauuggucacccguuucaaacguccuagcacgccguagcccguaaguuacgauuggucacccguuucaaacguccuagcacgucguagcccgauguuugcuuuaaguauggcuauuauuucaacuucuuaaaaacuuguugcucuguaugguagcaagauauauguguacauaaaagauaccuucuaaaacucuuuaaacuugucucuuuauaaaaggaacauguaacggaggggucugggugggcucugcccuacuguguaaauggaccuccuaggcgaaugcauuugagaaagcuugguuaaagugacccaacgcuucuacucuccagacaccuaaugaaggagcuucuccccguguuuguaaacagaaugcguccccacuccuugaaauggcauuuucuagaaaccauuuuuugagaacauucauuuaggaauuaaguaaggucuauagucauacuuuuaaaauuuuccaauaccacuuggcuguucucaguauagauaaccaccuaaugauagauuuagcaauuuagcauuaauaaguuuauacuaaaaaaaaauggguccauaacagaaguucuuuauaagaaacaauuuuucuuuauucuauuauuuucagaaucuugguauguuagccuugaauccaugcccuccugccucaguuucaaaacuacagacaccaguggcuaccgugcccagaccuaggacaaaaauugacugcuguagcuaccuagaugaaccaagacagccuuaacaguuugaacugugcuccuucaucucauuuagaauuagugauucacugcgaauaagcugucaagaaugggaguucaucaaccacguauuagccaccagagcucacuuugccguucaacugugaauuaagggcucggagaugguuuaaaauaccacacggccuuggugagucagcucugccacacacacugcacuugucgcuucguagccgggagugacgacauaugagcugcaguguccuuacucguuugucuccuggagacaacuuggcaggcagacaucuugcagauaaaugaggaaagauugucuauuucaaguggcauaagacauuccuuaaagcagugugucauaucugcuuauacagucagcauuuucuguggagcagaaaaucuccucuccggcucccuggguacacagcaaacaucuuuguguggguagcguccaggaggcuucaguggcucuguugucuguagaugggucaggaaauuucuugugccugcauacacuucuuuuuuuucuucuuccuguugaaugcaagcuuggucaaucuggguagcuuuuuuaaaugcucacuauacaucuccuguguauuacugaauuguaauuuaaggucagguauugagaacuauuuuagagagaggaacuaaggaugaaaaucaaaaggcuugguuggacuggaugauuggcucagagguuaagagcacugacugcucuuccagagguccagaguucaauuccuagcaaccacaugguggcucacaaccaucuguaaugggauccgaugcccucuucuggugugacugaagacaguuacaguguacucauacacauaaaauaaauaaauaauucuuuuuuuuuuuuuuugauccuuaagacuuuuaauaugucaucauuuagucugucauuucucaacaugcuuuaaaacuacaaauuacauauuuuuaagauuuaucuauguaccuauguaccuauuuaucuauguaucuaucuauauaucuauguaucuaugcaucuauguauuuauguaucuauguaucuaucuacaucuaucuaucuaucuaucuaucuaucuguauguauguauauacaugcaugcauacauauguacauacauacauacauuaaauagagaaggaaaauuuaaucaauuuuuaugauuauauuuucaacuuaaauauauauaaauaauucuuuuaagaaagaaagaaagaaagaaagaaagaaagaaagaaagaaggagagagagagaaagagagagaaucaaaaggcucucucuucaaaguuauaaaugcuaaauucuaaauaggaccuuuucucaugauacaaacauacccaucucuucugugauuuguuuuguuuuccagucccuagagcaacucugaaccaauacucugaauuuucuagauauaggcagugauggauuagacuugacuaaagaugcaagacauggggaaguuucuggaaacauuuuuuaauucauaaguguucauaaggguuuugcauuggguaaucaaaugauacaaaugguaugugugcauaugguuguuaucccagaacagucaagacauuauucaaauaguuuccagugacgucgcuucucugaguuggucuaaggcacuuaaagaaacaaugacuauuuggaagucuuuagugacaaagaagacuccagcuggcuguguugaucuuggaaccaggaaggacacuagaaugagaucccguggaugugcucagaagcagagaccagcccaucgccuacaguuauguagggugguuaagaucgccugcaccuguucuugacugauaaauuauaaguugaucuucacagaaugaacacaauaaagggguguguccguuacuguauauaacguaauuauggccuauccugugugaucacacacugaagagauuaccuggcuuuuuaaccugugaauuuggaucauuggagucagaguggggcuucauccuaauauauuuguaauguuuuaucccccuuuguauuguauuguaggauucacgguuauaacgucacauuuugucuuuugauuaauuaauuauuuugguauguaugagaagcagagacucgugggcucaaccucuguuugaguacauguugguauuugguuuucuuguuggaaauugaccaggauuuauuucaugcaugcuuuacacgagccuuaccacucuaccuaagacucaaggccaauuuugauguauucucuuagaaacacagagguaaauaauaaaugaguuuucuccuaaagauuuaaaagcuuaguucagaauuucaacgaacacacuguugagauuuuccagccaaguacuucuuaauucucuauuuggaaggguuuccugggagaagguggccugugggggaucccugacgucuucaugguagguacaagcagggccacccauauugugaugaccaacuaucccaaugaccuuggauuugcacauggaaacaauucuggaagcaaaaugacuucagaaccaugugaguuagccaguggagagccacugcaugguugaacuacacauguggaagcagugguaagccuucacugaaaacuacacuguggguguaaaaccgaguguuugugagaacugaaaagccaucuuccugagggucugagaaggaugcucuugcuaauuacugccuccauuuuuuuuuuacuuagaaugauauagaaucauguagagaauagccccaggaaagaaggagccaucguaauacauggugccaucauuuuaaaaaucacagcuaugugcauuuugauugguuuauucaaacaaaaguggcuguaucaguaucaguguggugugugugugugugugugugugugugugugugugugugugugugugaacacucucuggauagauuguguaguaggacuuaaaucuuccuaucaccucuuauacuccagagaacgauguagcuugagccccauaucacaucuccaucuccauuucaggacuuagccucuauagaucugucagaacaucccuggagaacagggcguacauggugacaguggaguuccuucuccuccucccccccaccccccgccugucauaggauauggcuggcauaccccucccccugaacucuccaguccaaaggcugggcuacccuucuccucuggcucuuuucuguaugauccaaugguccuuuuguggccuccuguccuuuuguuguccugaucuucccucucccuuuauggcucuccucacacugccggccucaucuuuacucugggcugucccagauguuuccaucucuggcuaugcucucccucauauuuacaguaaacuuucuccucuacuauaccuaggagcaguugugucugccaguuuccuuucuuacguuccuucuccugcaauacaauucacuuuuguaggggcugagaaggggcgggcucauccucuuacaccaaugagcguccuucucuucugguuuuuggcuagggcaguaguuccaugugucuucauuuaguauauacucaaggcugccuagcugcucguccugagaugucgugacuccuucccacacucuccugugcuucuuagcugcugcagucaucaccgugccuaauccauacaagugcccccguccugugguguguccaaugagacaccaccauccuaccuuucuuuauucuuucagcacuuucuguucugaggugagccuugucugagccuguaccacuggguuggaucuccccacaguccuuuucuguggcuaugcuuacugccuuggaaauguuuacaugauccuaagucaccaaaccagaacuucccugaaacuucgccuccgaccgaccgagacaauucuguccugucuacuggaaguggcaagggcuccguagccaucagcaccgaguuugaguuuggcuuaucugucagcgguugguuucccgcaucauccugaaaguauuuucuguucacuaguucacuagccuuucuuucacuucaaguguuagguuaggaguggaaaucucuugagaaucccuuugugcagcugaaggcaucucagcugcaagaacuaaaacaaaacaaaguagcugauugggugcuucauucaggaaguauggcuggccacuguguuugugcaauccuggagcccagugggacaagccuauguuacuccucucaggaaugugcuauucgagcaccaggaagugaaccgagcugccuggcucagaaaucccccuugcguuuugagcuguugccuuuagaauguucuaggaagagcccgaggucaggccaaguucagcugcaauugguaauggccuaagagugaauucugugcuuucuuuucuccauuggcucccacugcgaaaaucuuauauaucccuaagucgggguuuauuuuauaucguugcacagcuuuguuaauaucgacaaguucuuugcauuuugauuuuaauguuauuauuuuuuuacgccgggcauucuuuagcucuuguauuuauugugggagggaggcaggcauguuguagagagcaaggaaguugucacaggagguggagucgcguuuaucuuguuuguacuuuacaaacuaaacacaagccuucgcucugcacuuacaaugcuuagcuggaugcuagcuggcaguaaagacuucacugcucuuaucacuuuugacuucaaauugcccccuaacacaaaauagaguguuguuauaucccuuucaaaauuauagcccccaccccacccccccccccccccagcacuguguuucugagagccuuuguugccaaaggaauggcaauuugaaaaagugguuuuuguuuugcuuuuugguuuugguauggcugggggccaugaaaagggaggcaucuuugauagugccugacucuaaguuacuugagaaggauagucucccuguucuuaucaagcacauagcuggaaacagaaaccuuugaguauucuuuacaaccccggagaagaaauaaucuuggcuuacccuaagagagauaagguaacagaaagcgacuggaacaauggacaggaaugcuguuuuuaagugaucaccaauuuucacauggacucccguauucgcucugagucuuucuugugcccacaaggcaguuucugcuacacccagugccccugugguaaaaauacaauaccaugagaguuauaaacgcaggggaacagccgaugagccaauguuaugaagcuuuggaaagaauuaaaccaagggauaaaauguaaauauuuguucugcucauguaaaaaaaaaauguuucacguccucauccugaagcauucccugugacucugguacacauagaaaggugacguccuaaggccacagauuguugcuuaagugaaaacccagauucacuucaguccugucugaguuggucacuggucucuugguaucuuuacaugaauguguacaugcgcuucucagaauaauguguggcaagaacccucacuggguaugccacacccauuugagcauauauugcuuucaccuugggaaccguggccauagugacguguuugcugaugaaaucuguacacaacugaccacaaguaguacaggauuuccuauucauauagcucuagguaaagugugaguagagauauagucuacuugauaaacauuguauccacauuugaaauauuuccuuguaaguauguauuggccaaaauaaaauauauacagcugaaaaaccaucagguggcuaaaucgugucuuugcagaagucucaaagagaaagaaucagaggagggcuauguaauuagucagagcuagaacuugguagcaguugauugacaucucccuauaggcuucagugcugaugcuuagaacaagacugcuucuacuuagguuuuucauccccagaucuguguguaagaaccagcaucauaugguccauacacuaucgcugguccuaaguccugucaugcaucacauacuggacguuuacggcacuucuggcuuagaaggcugcuauucaaugcggcuaguaguugagauuuucacuugccaagggaagguauuuacuguguauagugaggcccaaggucugauagaaaagaugggaagcaaaccugaagguaaauuugcccaacacaagucuucauuguuguuuauuuucaagcaaaagucuauuuauaagcgaggucuguuguaauauuuugacuuuuaguugugacacucauucucccccucccccccccccaggcuuacuuuuaaugaugguucuuaaaugcuuuaaccucccuuuuagcccucuacccaccagauauaguggaaagggauacgggggaaguacaucuguuuagaaaugguucuuuggaacaagucccuuuuguguugucuagcaaucagcaguucaguuuacagguuaacagggcagcuugacucacucacaaacacuucacggauacaccagcaguauaguuuggcaaagucgguauagcaagcacgaaucagcagugguggcacuaccuaucagagacagccaggccuccaccuccacuugagucagcaggagggaccaaggccaacaggaacaccagcaaaaguucucagccucucucagcaaaacaaagaucagugaagacaaaagaccaacaagcauuucacagcuagcucuauaaggaagccuagcucagccuccgucacugucccuugaguccuauuuauaggcuaggugcggcagaaauugagguuccccagcagcaagugucuuaaacaggggugggguucauauagguuuuaucuuagaaggcuugacuuugggggaaaaugcuaaccucauauacguccuaugcaaucagucucuuuugaaguggcuuguuuuuucauauuaacuacucuuauuuucauuauagucuccuaaaaaaaauggcuugccuccagaguuucaauuguuuuugacaaauuaccuucaagaaucaacuucaaaggaggguaagguuuauguugggucuuggaucuggugcuauagacguguugacacaauacaucauggcgacccagacacaaagggguagaaccaagucuuaacuaguugcuauuguaucucuuuucccuuucagaggcauauugaaugacuugacuuuuaguaccuguuaaggguuucccuacuuacuggcagugccacaggcuggcagccaagccuuugacauggacauuuaggggacacuccagacccaaacuaugaccguuacauucucuaacuguaguguuucucugaagugaaugcaucacuguagauucaacuugauaaaguaagacaguguagcugucuucagacacacaccagaagagugcaucagaucccauauccagaugguugugagccaccaugugguugcugggaauugaacucaggaccucugguagagggggucagucagugcucuuaagugcugagccaucuguccuucuugaggcuguccuaaacaacaaccacaaacucaaauccugaaaacagcucagcgagggccagagaacccaucaagaaugcacuaggaauuauagaacaaagagaguuagaaauccaagguauuuaaaaaauauaccaguagaaaaguuaggagagcaguuaaagccagccgaagacucucaacuacaaccucccaguccaaccugauagauagcauucaaagucuuuccauagguggaggauagguuuuuauuagguuaauacauuccaaaagauuugauuugcuacuccaguuccuaggucaacaaagaugggcaagguuuggcuccuuagcugggcuugagauagccugaaaauaauaauuaauugucguguugaaucagcagcguugcaaacugaauggagucacugaaguuuuuaucaguguuaucagccuguguacagaggugcuuuccaggaauguuccugugcaucgagcaguucaaauucuagucuuuuuuuuuaaaggguaguggggaccuaaauaggcauuuguuggauugcaaacuaacuuugaaccuaauccuuggguuaucucacaaauacuucuguuuuuguuuuuuuuuuuuaaauuccaauuucuaauccauuuauaguugguuaagcagcagucugccugccagucuuugcuaggccuuccuauaaugcaagcuuucagcggcaguuauuaaucucguggguguugaaugauaaacgcugcugcuuucaauagaccucuugguuuccugcugggcaucagcagggagcaugcuucaguagccuugagauggggcagaguuuuggggucagcuggagaacaccuguguggcccucauuugcagagcauggcauccacagaggccaggaaaagcuucuaagagcgcugaguuguaauuugaagcuaugucagcaagugacuccaaagaaugacgaguuuccaggugugaaaacuaccuacauuaagucugugagagcgguuauuuccccuccccucccccuucucuacucacuuuuguaacagauccuucuaggcuggaacucaggcuggacauggcuauacuguaaagguacugugacuuacugugaccaccauguggguaauuugaggagcaggguucuaacagccgucgugguucacuuuucuguacguguuuggugggcaauucuauccuuuguccccacacacauaugcaucugccuuugacagacaguggccaacuucucucugccucugacacucuagccauggaugaaaucuuagucuaguccugcuucaaguuggccuaaaugaucuuugcacuuucuuuccuuuccucgauuguaauuuaagcccuaguuuccuguuauugacgaaacgaugcucugcguauguucucuguggaugauggguuagagggacccucccucgcagagucuugucuuuugguuggaguagcaaaauuugcucauagugauuauucauccuuaaaaggagcucacaggcaaacuuccuagauugucauuacggaaaucaguucaugaccuuugaaaggggagaaggcguucaggguugaauuuaaaagaaacuuggaguguacaguguguguguguguguguguguguguguguguguguguguguguguguguguaaguaauguaauugaacugugcucagguuaugagcaagcaaauaguauuuaugcaaggaaaaccaaggauaggauagaaauagaauccgucuguuuuuuuaagagcuuauacaagaaucccaccaaagaagaaaaaaauaccaaauacuacaccauacgagagagaauuauucaggccagugagaagccugcuuggauguagaaaccagauggucuucauuagccagaaaccuuaaaacgacauaaauccacugauggggccaagcgauggauccaugccccgucuugccaagcuggccuuuuuaaccaggaaaacagagagcuccuuguucaagccccucuuagcugggacuggggugaagaaugcugccaaacccguucuauaaggaauucugaucuugauaaugaaaaggagagaaaguuccuggagagaaggagcgcccuguuugaaaggcagaaagagagcuuguuccagacgcugccucuucccuucauuguaaaugguagggguuggagggguagacuuccccauucacccucugcagauggguccaagucaaguccauauguuuaccuuuauuuuagcucugcugauuuaaggccaacaucuagcugcaguaccaugaggaaaguccauggcaugucuuugcucucuguguuguggcucaaggaaaaaaaaaaacaaacuuuuuuguuuucccugauagcaaagguuuguuuccaaaaagguuagccguguuuuuaagaguaauauuuccguggcucuagcucagcguuuuuuuaaguagccucuuugcuuuugaagccauggcugaacaccuacuguuucagcuggcuguuuuguuuguuggcaccgaacacuguuuucccaugggaaaaauaucuccaguuucaggauggcggcagcaauccauacagguuauuuucauacgcagccuccacaaaaccacacgaaccacgcagagccaccuguguacaguauggguucuagcccgcacuguugacuuacauuucugaaaaaaauaaccugguggugcuaaucccacugguggagauuaagaccacugaaagaauuuuuugauccaaauuugaagcaagcuuuuaauuaaauacuggccaggaugaugaacucuggcgggguccauucuuggggucccaggaaacaguaaagaguaaccuucugcagagguuugaaaaggccaccccaacaggccaccauguuucccaucagggccauccagagcaaguguagguccagacguacuuccugcuuguguaccuccuaccuacauccauccaaucugggccaaagguccuacauccugagauaauuccugucugcaugcaucuggugcaguugagucaagcaaacuuguuuaagggaguugcuuccagccucucugcaaggaucuguccuugggcaagggacuuacagguuagaggcauuguuguuuaauggaucucuuaggcacaguaauuagaacauaccuuuggcucucacggcgguucaguggagugguuauuccacugaucauaauucuccacuuacuaagcggcaucuguugcuuuuccaaguagggagauauuuuuuagaagcgaggaguagaucuuccaguugacauugagaggagaagaggaaucugacagcaaauauguucuaggauagaaagacuucaauuauaugaacguucauacugucaggcucugaguagaacauugcaugggauuuauuaagcuuuuucuuagagacuuuguucaggaaaagagguuugaguaaaccuguucggacuggccgugaggcaggaaaaucuuacguucuguguggccccauugucugaugcugcugcucucuucuuggauggauucugaggcuggguugcuuauagcaaccagcauguugacagaugcaggugaggaugcugagaguugucuugugcugguuaacuuaggcgggcuacaggaaggauugaaaggcuucugauucacuuuguguguuugaucuaauugcuucuucaauauccagcugcagcugauuuggaaaagaauuuuccauuagagacaugguuuuuuguuuuuugcuuuuguuuuuccuuuuaaguacacauuuguaaaagguagcaaaauguuaaauaaaaccaauucugcuguuccuaguucaguaaucuauuauaauuuuggagggacuagagcugaaguucccaaacuggcucuacuuuauggaaauauaauauguuguuuaaaaccuucucuaucuauguauuggcuuucauacuuaauauuuguaucagcugcuucucuuguugcugagacagaacaucuggcaaaagcaauuuaaguaaggcaagcuggcucucucucugaggguagcauccaucaugguggggaugucauggaagcaggaggaugaagagcugguugugucagauacauagucaggaagaggagagagaugaauccuagcgaccaauuuguucucuccuuuuuuuacuaugccuguggucccagcccauacgaugaaccuguugguauucagggagggucuuuacucuucaguuaaaccuggguggaacaacccacacagauuguucacaaguugaccacagacacaccccagguucguuuccacggagauucuaaaugcagccaaguugaugaugacgauaaccacuacaacauuaacuccccuugcacagaaaacccgaagggaacauaggcauauauuuucuaguuuaaacucacuuugcugagcucacaacaucaucagaagacuacagggccguagucaguuucuuugaagagauauggaaaagaucaccaccuuuugucagcacauguauucuacaaacagauggcauuaaaauaauuuuaaagguaagagggaggguggcauagagaaguaugaaagacagaaaaacgaaguucaggaaucacacuuaggaaaauaaagcauaauuuauuugauagguuuaauuaaaaaaaaaaaaggucagguaguaugacaguuguggaaaggacuugacugguuuuagcugcuccaccuguacaauacuaggcuugucaccagugucauggaugugaggagccuccugugcugaccuauuguuaaccauuggauugcgugaggugcgaaagagaagaucauuuauugucaucgguugugcaucagacuaugggaccaaugggcuucuacagcuaguuccaagccuguagcuaugcagauggcccgggauagcuuaaaaucaaugaggaauaaagcaaagcaaacugucaugaauguggggaaggggcuuguagagaggaggggaaaggacaggagugggaggagcauuacagagggucucuauugcugugaaaagacacuaucaccauagcaacucuuagaaaggaagacauuaaacaggagcuggcuuccagguucagagguuuaguccacuaucaucauggucagaaguauggugguacacaggcagacccggugcugguaaaggacccaagaguucuacaucugguucgucugacagcaggaagagagagugugucacugggccuggcuugaguaucugaaaccucaaagccuacucccagugacacauuuccuccaacaaggccgcaucuucuaacagagacacuccuggugaccaagcguucaaguguaugcaccuauggggaccauucuuauucaagcugccacaggagaugaaaguaagcaguagacacuucauacacgugugaaugugucaaagaacaaauuuaguccauuaaaaaacaaauccaaggaacaaaaaccucaaauuacucuucugaugguuccauugaauuccuugauccccacaguacaccaccagcuaguguuguucugacguaauuguguaugugcagaaaagggaagggcucuuuaggcggaagggaacaacagcucugucauuaggauguccucagcuguggguggaauuggaggauaggacucagaaagggggugauuagggaacaacugugacauuucauggugacagaagccaaaaggcagagacugcuaaggaagaaggauucacauguugcgaauaaggccaguggggacacagguacuaagggcauccucuuugguuucucacauugcagucauauggaaccuuugagaggcagacaggucagggugagaugaguaaaccagguuacaggggccuuaaggaacaagugaauggaccggcgagauggcugagcagauaaaggcgccaacaagccugacaaccugaguuugauucccugggacccacaugaugggagaaaucguuuucgccuacaaguuguucuuuaacuucaacauauucgccagggcaguuaguuguccaccacccccgccccacacaccucuuauccucacaacauacacaaaauaaauaaaaauuuuaaaaagcaaguggaaaauguuagcggccaguguuuaaaaucacaagaugauuuaaaguuugugaccaguggaaaaaaaauaugcggacggacaggguggaguuggcuaugucggauuuacugccugcuuuguacauacaguucuggaugggggaaagccuucauuccuucgaauguuguuaaaggcccuuucuccuauagcacgagccuuaaauacguacuagccgguccuuucagggagcucucugaccccugacuguagaagcaugggcaaaagugaggaaguguuuguuccucguuugguguguucagcagaagagcucagaggcuguugaagagcagagcaagagcuguuaguguuucuugcugugugacagguugccucaaacuuacuagcuuaaaacgacaagugguuccauuucagcuucugugagugaggaacuuaggaguccuucuaggugcucugccucuggaucucucucaaagccacauucuuuuuuuuuuuuuuuccuguguugguaacuuuuucuuuccauuuuuauuagguauuuagcucauuuacauuuccaaugcuauaccaaaagucccccauacccacccacccccacuccccuacccacccacucccccuuuuuggcccuggcguuccccuguacuggggcauauaaaguuugcauguccaaugggccucucuuuccagugauggccgacuaggccaucuuuugguacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagaaacagcuacaucuggguccuuuugauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguugggacaucuucuagauauaugcccaggagagguauugcuucaaagccacauucuuauggucacccauggcuguagccagaugucauuggugucacugagguguggcuuaugucuaaacuugcugguguggcucugaacgaggucggaccuucuuauucuugggauucagaccuggaacaaacagaugaggugcauauuuaaccaaguggaccugaccuccagauucucccagaaucccucaguccguguuuauuacagggcauggcuggcauacccugccucugugcugaacuuuccagcccaggggaggggcuugcucuccccccagaaggaggucuucccuacacaauccagauauuuuggucagucucuuucccccuccauccuucuuucccucucucccucccuccaucccuuccuccuuuuuucccuccccacucccccccccucucucccucccucucugcaugcacagauucuuucucuuccccccccccccuccucuaucucccuauaaauggugacaucccuggcuucauuccuuggggccagugaacucacccaagagcugcccugccaauacccauuuuuauacuuuaauuuggcuugaacuggcucuuuuugucagcagagauaaccuaucacuuaagauugcccaacaaugagugagccgcaaugucaugaccuuacuuuugaacuugcacauccccauuucugacaagcauugucugcugcauagacagacuaaugcauuaugggaaaggacugcccaaggucgugauuuccaggaagcagacaggaucguggcgucuuucuugggcuuugacuaucccaggagagaacuuguuacuuaaauucucuuugcagaaggaaacagucucuccugcauuugcguucagugagagguggugagcucaccuggccugugggagugaagaggcugugaggcucuuacugagggaaaugguccucaaggugaggaugggauucuuuugaugauagauucaccaacuuccagugaaaguucuguaacuccucuuugguuagggauaagauggcaaggugugcuaaccguggaaaucuuugggacagaguagggcucacaauaagguuugcagugaccacaaacaagcccccccuuagccuccacgccagggauuuccccacagguggcugacuaugauuugacuuucuuuaacuucccugcccuguuacccaccugcuuauuucaguaaaauuggcaagauguacauuuugaucucuaagauccgggcuuugaauuuccuucaaacucucgggugagcggcuaagaucaaguucacagaacauucuguuugggacacaacuuugccucugguggagaaugagacuuccaguuuccuggauuggugggagaugacaggggccuccuguggaagaguugagcggccgcaacaucgaagggaguucuuguuuguuuguauguuuuguuuuauuucaaaaugguuaauucuccaguggaauuuucuaacgaaaacucagauacaagcuggccuaguggcacacgccuguaaucccagcacucaggaggcacaggcaagugaucucugaguuugaagucacgcuggucuauacagugaauuccaggccaggcagggcuacacaguggauucuaggacagcuuaaggcuacauagagagauccuguuucgaaauaaaacaaaacauaaaaacuaacaaaaacucaaugcagccaguggcucagcauugaggcacucugaugacaucaugcugucaccucuagucuaggccuugucaucaagcagggacuggcauugugcugugugugagcagcugcgggauaugagaauguggguucuuccacggggcuuauauuuauguuagaaaccccucuuuauuguuagaacuuuccaacagauacugcaaaaucuucuauggcaaaacuaaagaauuauugaaugagcaaauguccuucaauacucuuagugccuuccuuuaaauacucuguuaaagaacacgcugucuuccguagguuauuuucugagucuguagcauguauauuagcccaacaaugcugaugccggguugcugugugacugaagagcacuaggcaucaccaucauauuuucuguucuucguggagcuguggauucuguuacuaacuaggacuuauucucuuagguacccacugauggcaacgccgggcugcuggcagaaccccagaucgccauguucugugguaaacucaacaugcacaugaaugugcagaauggaaagugggagucagacccgucagggaccaaaaccugcauuggcaccaaggagggcaucuugcaguacugccaagagguaagucccuaguggugcaucaccggcauucacuaaaaguauuuacuuucuuacaucuuauauuuauauuuucucucauaauaaaaauccugguuccuaaugauccacuauaccuuucauacaguuuuucuuuacucugcaguucacacaguuacauacugcucugugcuaugaccaucaauaaacuggguaaaauuuaaguuuucacaguuuacuauguucuacugugccuguguaauaaagggauaaaggaauuaaaagugcuagauuuaauuauuuauuuuuguucaaccucuuugacauauuuuaguacaacuacaacuugauauuuuucuagcuuuuuuucuccuguaauauuguaucuuugaaguaaacauuuaugcugauaacucuagaaaguauacagaaggucacuuccacuucaucccaugcugaugaauauuuuuauucuuuaaaacguacauuuuuauuucuuguauauggaugcuuguuuugccuggguacaugucuguguaccacgagugaggcugaugccuaaggaggcuccagaagagguugucacaucucuugggacuggaauuaccaaaguacaguugugagcuuucauaugggggcuuggagggaggauugaaguuuccuuuucugaaaugcuuguguucagaguauuuuggauuuuauagaauuugaaguauucgaaaggucauguugagcugcuuuguggaugggacccaagugaacaugaaauucuuaucuacuuccuguaucccucacacucacaacuguaaggucauuuucuguggugcuuuucguuugagcuccuuuuggacugcagccugucccaugagaucagguaggaauuucccacauauagauucagagcagcuuuccaaaaagugccugguuuuggaacauuuccaauguccuguguuuggaccagagaugcucaguuuccgucuucuuugccuuucucacuagcccuuuuugaaaguaagccacaguugucaaggacuuuuccugccgcucuaugacaugggaaggaagcugucucuucagguagcuaccugucuguacccuaaguuucccaugauuccaaagugcuagcagugacugacuauuccaguagacuucagcagaggccaguaggaaggcuggacacacgcuuuguccgugauggugccuucugaauuucuaugugaaugguuguuaguaccuguggaucaucccguaagcccguguuuuccacaaaugaccacauguuuuuaagccuaugaauauugauccuacaaagauuauuuuccuugacugggaagagcccucacuuccugcugcccugagcccagucaugccuggguagcuucauuuucuguuuuaguuuguggcuugugcagggaugagccacagacugguucuuuccacuccagacugccugcuugcggguagccaugggggaggagcaggggaaagccuuuuggcagauuucuucuuucugccgcuaauguagcauucaucucuccuugcucaucaccugcaguccauuggacaagaaagggcuaacauaucaaggguuugcgagccauuuucaugaauuugguccgcauccuauaacaaugaaaagccacugaagccauucguuggcuuaauuuuugaagaagaggagagacuacguuggaauuucagagucaacccuauccaguauauaucacuguagaacauuccagacaccuggucccaagcccaugugacggaguuuccagucccuaugcuuuuuguacagcuugagcacuugaaauguggccaguuagaucuguacuguugagauaaaugucauguuucagaaauguaauaccaacaaaggcauacaacauagauuucauuuugaagugacuauauuguguguaguuauuaaggaugucauaaggauguuacagucaaacuauaugggguuaaaguugauuucaccucuuugugguuuuuuuuuguuuuguuuuuuucaugaagcuggaaaaaaacuugaauguccacuggccacuuguuuguauuuccacucagcagugcucucggcuuguccagugucacugugacagggucguaaucaauucauuauccggucaucugaagcauaagagagaaaugagcuggggaguccccacagauugccacucagaagguucuuggaagccuuuaaaucacauuguucaaucugggugugguggcucucuccuguaauccuuacacuggcaaaucugagccuuagcuauagaaugaaaugucucaaaagcacaaaugagggagauagagagauggcagagggagauagagagauggcaaagcagcuuagagcacuuguccgucucucaaaacaugcuggucugauucccagucccacuugguggcucagaaccaaggauagauaacucuaguuccugauguuugcauacccucuuguggauugcaugggcagcaggcacccaugugggugcacauacauacacaugcauacaugugggaaaaacacagaugauauaaaaauaaauaaauauaaauuaguaucuuuaaaagaaagaaaaucaucuuacuagaauguuucaagguguggagaagauauaagagccagugucuuccucuuugagacauuugccucuggaugguaagaucuccguguagacccacuaauuaacauaagaggagcacagcuccagacccaaggucuuagugcuguaaauugacagggcagaggugaugaugucaccacuuguaaucccuuuucauucuuaacaaagccucagccucagggccaagugcuucugucccuuuaacccacuuagugacacuucuggaaaggagccuuggaauagaccuuggggaaaugcaacauuuaaggggaacaaagagaugcuaugaaguggccagagacaggaccagaacuggcaugugucaugugcugggagacaagcuaaguuaauugcuaaacagagaaaaaugaugagacaaguauggucaaaaaugagagcgacugaagugugauuuuuagcaaggucagcgugugccuccaugaaaacugaccacaugccaaaagcaggucuucagugcacuucuuaaggggagaagaguguaagcuuuucagacuggcccagguugacuuggauagggguagauucuuagcacguuucaauugcauggaugugaacagggaucaccagcaauuauuuccauaggcuaggaagcauugacauugcucacagggucugugcccauaagccuauaaaaucaccacucaacucuaaaacaguaucccucaaaucaaaucaucuuucuccgacuagcuuuggguacuggacagccacaucuaucugccuuuuacuggcuggauacugccuuuuauuaggcagaaagguugucuuuucuucuuucuuccuuucuuucuuucuuucuuucuuucuuucuuucuuucuuucuuucuuucuuuccuuucuuccuuccuuccuuccuuccuucucuuccuuuuuguuugagaaaauuaauuuugacaaaggacauuacccuuaauagagacaagccuaauugcuacaaauaugacaugaccaaguggcgaggauaauuaucacucugaggaaaaaaaaaucuagauaaagagcuugaggugaacagaggcaaaggaaaccaucuucgcuuuaguauuuauuuauuuuuuguuuguuuguuugguugguugguugauugguuuuuaaugauggcaacuuaagccaaaggagacugaagccaaaucaagggaagcauaguuguccaucauaaaucucaggugugugcagaggaggaggcuagauauugcauuggacacagcuaugcuguccaguaccugggaggcuaaggcaaaaggauuaaaagucagaggccauacuuggcuacacugugagauucuguguccaaagagagaguagggugagccgaaagaucugaaggugaaaggagacuccgcugaaucuggugaguuuuggaaauggcaaagaaugaccuuuuuccaagaaacgguuaacuagguagguucuguugcccagagacaaaaccaauggaacagcccauguguguggaagaggguuucuccuacauagagaaaaacccugggcugaaggcagcuuucaaagggaggaagcaggacuagguccuguguuggaguguuggagcagagaacuauucccaagugcuacuucuccuguuaaugccguucuuuguucugccuuuacuccucuucuggugcuaagaugggugccccuuggggcucaggaaggucggaagcuggcagccagugcuucugggaguggcaucccaacuuuguuugccauuguguauuguaauuccagggagaagggauucugaguggcuucguguugaccacacaaagauuuggcgccugcaccaggguacuuacccauguggcuguguggucuggcaacccacaaggcauggaagaauggcugcucacagaagagggagagaaaugcacaaggccaaaacggaaugacuguggcccuguguacaguggcgacagagcuggguaguucuuuuggcugaaagugcuggcugggauccacauugggucuugacuuuaacuggcacagagaaaauggcagaguggcuggagaugaccacuuggggccguuaaauguaguuugacauugccuacaagaucuuucauuaguguuuuaguguuuaguguuuaguguuucccugccacuucccacauuguagcuacuccugguauuuuuaauaaauagcucugauuuauagaucugaauuuuuuguauauuuugcuagaauacauuucuuugcuuuuauuccuucuuuaacuauguuuauauauuaagugacauugauugacucauugcaugaaaugaaaaggaaaauaauacucaacaauuuuugcuaaauuauaauauuuuuauauuuuuaagguugaauauuaagguauguucuguugcaggaauucccaugucagauauuucuuuucaacaggacuuguuuagagcuaaugcuuccagccauguucuaauuucuguauuacuuauuaggcuguuauacuguuauuauuauuuugaugacuuuugccuuaauuagucauuugcaauaauuuugcuuaguaccauaaaggugaucuccuuuuugccaucucucauugcacagauuccuuugaagaauucuuugcaacccugagaccagaguucuacccccagaacucauuguagaaaaagcuacaugugaaguacaauuauaacccuaguguuggggagccagagacagacaacuggucaaccuaucuuacuuagcgcauucuaggagaaugagaaacccuuuucaagggggaaaaaaaucaaaagaugaauggcaugugaugaaugacacccaaaguuguccuuuggccaccgcacacaugagcacacacacacacacaccagaaaugaucucuacuuauuaccaguaacaggacuaaacaguuaaugguuuuuugucucccuguaauggugacuuuauuuuaugcauggacucuaaccucccaagacugagacacagauguuuuagaagcaaucugcugagucagagaggcagcuguuagcagucugagccuagggcagacaggaggagcugaacucaugacuauaaccucauuuugaccuuuugcuaaccaacugaauuuuccugcuaaauauaucuguaauagaugccuuuaacuguuugcuggugcuuagcccagggugguaucuuaauauugauccuuuuauggggaauuagguauuaacuaguuuauguccucugaucucucucacucuucuuggcuuaucuucccugcuauugacuugauuuggaagucuauaagaguggcauuuaugucccuuugguuccuuuggagcuauccuuggucaagggaaagaccgaggagaaacaguaauggcugaauauuuuaccucuacuccuagguacacauaaggccuuaugaaguuugauugagaaaauaguuuugauuguaugaccuaauguguauguuuguuuuagccacauguugaccaggucuuccaaauguuugaugucuauauauuuccuucuguccccagucauaguaguuuuucuucuacccagucauuguugaaguacaugucucucucuuuuauuucuaugcuuuuuauuagcuccauguacaguuuuucuucagcuccuuaucaagcacauauugagugcuguuaaccaacugaacaauucugcauucccaaaguucauagguuaggcuaacucucuuuagauagguuuuggagacacagucuuucagagaugacuaguauugaugacgucaugagggcagagcccuccagaugguauugaugcccuuacagaaacugcagagagccagcucucuuuacuuccucauacaaaggggucaugugaggaugcagugugaaaauagaaaaauguccucagcagcacauucggacuugguuuugucacuuuccugaacugugacaaaauagauuuccauuguuagaguugcccagggugugguauuuuacuguagcauguccaccaggaccccauuaugucuccuguagguaaaggcucuagaaacccauggugcuacagagagugacauuuuuagggucaugauucacaaagcauuuuaucugacaacugaagcaugcugguggccauuugguaaugcugguggaugacuuuguuagcaugagacuguaguaggaugggcagaggcauccuugucuauccugagggagaguucccugcaggagcaccugugguuucugccugaggggccauucuguucuacuguuccugguuuuaaaguuguuagacaagagucaugggauugcacagauuuggccucauuuuauauacccaacaaaaagugcaaugagaggaccugcaaccuuagagagaaacacagaguguagcuuuaaaaugcuuuaauauugucugugacucuuugauggaggaaaauagccuuuucuaugaucaauacuagaagcagagugcuaacauggagaaagauacuuaaauguaacuucauaaauuuaacaauauaacaauagccauuugugcuaaugagcuguugggguaccauggcaaauguuauggcugaagaaaugucaaaauagaaaaagccucagagaaacaaauauuauguauuuucuauuugugguuccuaugcauuguauagauucauaaaaucaugucugucuauaugacaugaugguaucaaugagaugucuaagggaacaagaggugacagugggugguauaggguaggguaagguagggaaagcuauggaggagaauauauucauuguacuguuuaaacuuaugugagagcucuuuaugcaucugagugccauguacaauggauggacacacucaaagcuguagaaauauuaaaaauaagagaucaaaaaccauuaaaauuuagggucagaaaaugagacuuauuagguuucauugcauggcuuucaggugaaaugauauuuuuuuaaaaaaaaaauauauuguuucauguacaccaaaggcuucaggguguguuuaguuccacgucucaagacuuuauuucuuuacuuuuaagccaggcaacccuggccagcguagcuaaagacuaccgaggauagggcuuugugucagacaaugccuuuccuggcuuacaaggggugcaaacaugcucuguuccaucagauugagaauaaaaccuagaaaauggagacagugguagguagcaaggagggucuugauggugauguggagacucuggauccagguuuugagagauggaagccaggggauguguuaguaugagugcuuuuagugagacauuucaguaguguguuucaaagguugggcugacuggggagagaauuuauuuuacaaacagaggugggaaaauggaugugaaagaucauccucugaauucugucagugaccccaugguccaguguaugaaguaccaugauucagggcaauccacaaacaaugucucagacuguguccuuccuguguaaccgggacaggcagauguuaugaaagccaguuguuaugagaaaucauauacagccuugauccuccucugucccccucuggucuuaagcacacaggaaggacuuuugcuaggcaaagcuuccugaaggaaggguuggcucuuugagcauccacuuggagccagccuguggaggcuggcugaggaugggaaaaguuucaaguguagguagucagauggacgcacuuggcuuuuugcauuuccucuacucuuagauuauucacacauucuuaaguaaguccuuuauauucaugacaaugucugugauuucuuuauccuuguuccucuauuugagugcuuucuuugggauuaacaggcccucaaaacaaaguaguccugugcagaagcaaacaaacaaacaaaagcuggcuauaugaauugaaaacagcucuuucuuuucccuaacuuucuauucuaaaauuuauuauauaacccaaugugggauucccaggaagaguuauuucucuuucuguugucauucuucauuaauaggaaacaaaauuguuaaaaagacaaaaacaguuuguccucaucaaucuaacugucuuucaggguugcccugugauaaacagcauccccgaaauaaacuugguuuguuucaguucacacguuacaguccaucacugagggaaacuaagguaggaggaacauaaggcaggaaucuagaaguaggaacugaagcagaucugggccauggaaaaguauggguuacuggcuggcuugcuccaggcuccuguucagcuacuuuucuugucuagcccaggcccaccugccuagggaugguacugcccacaguuccagggucccccuguaucauuuaacagugaaaaaaaugcccauagacaugccuacaggccaguguguuggaggcaccucuuuaguggaaguuccuucuuuuccaguuccuagguuuguuacaaauggauagcagaugcuauaggaguguauucuauauacuguuguuucucucuggucacuuuaugugcucaaaauuaacccacagaucauaagcgucauaguccugauacuuaaaagguccaagaauucauauuaaguaaagcaguuuuuugaaucgguggaucauaauuuuugaauaugaguacugguguauauucugcaucgauggucuauuuggauucaaggacuacuuggaacuuagggcuaaaagagaugaagucagucuaaauauuguaacauaagaauuauagugagggugugugucuuaguaagccuucugcugcugugauaaaacccugaccaaauccaacuagggggaagaaagggcauauuugauauuauacucccaggucccacuccaucacugaaggaagauagguagggcaggaacuucaguaggaccugaagcaaaaaccaugcaguaucgcuguuugccggcuugcuuucccuggcuggugcucagccaacuuucuuagacaacccaggaccucuuuccuaccugggguugcaucaaccacaucaaucaacauucaagaugguuccccacagaccagucagucaggcaggccugggcaaucccuccagcgagccucccucuucuccagugauucuugguugugucaaguuagcaauaagaacugacagagagaaaacugaugucugaaugaggccauguguguacgcaugugucuuuguuuucacaucugugacgugccuuacacgcuaggcauccccucuuugcuuuucucaugagugcuuuggaaaggcagcggcauaccagccaaaccaggcuccuccgugccuucccgcaccaagugugaaugugcggcuagaacaacacauuaauaugcagugucacaugcagaauugggccaaaugguugggaaacacacucuugccuugcagcgcuuugccuucugccucgugcaaggcauccuugugagagcagggcccacucugcuccccucucucugacauugcagacguguuucaucagcugccugugccucucagcaccucauuaagucacgagcagccgccacuuuucggcuuccauuucucuuucucaacugaauuagauguucuguuuucuauauccccucucauuagcagaaucgaggcggaaaacaguuuuaagaugcaguuuuuucaucagguucuagaaacuuuaaagugugucacuuaaaucuggaaacagaaauguauucucuuccgcacaccccagucuuggcuuacacacaccaaaguuuaagcagcgaagcgcgugcuguuaauguggucuccgugugcuuagaaaaggcaccugcgauaguugucaauccgcugugacaugcugcccaggagauguuugcagugaugucugccauuggggaaaccuuuauuaugaucugguuuuauuuucuucuugagcauucucuucguaugguucaaccucauggaccacaucaguucuggacgccauaguuugcuaugccuaccugugagcuaaaugucuugaaggaagcaucacagguuacauaugggguucugguguacagacuuaacaguuccugacauuaaaaaaugauagagaaacauccuuuaagauaguacugcauccuuuaagauauuuuauuuuaagaauaaaaacccugacuaccgauaucaucuuuuuggguuguuuugguugauuuuuuuuuuuuuuuugagauagguuuccccuguguagcucugacuguuccagaacucacucuguagaccaggcuggccuugaacucggguauccaccugccucugucuccugagugcugagauuaaagcugugugauaccaccuugcugcuaccacuuuuuauagggaacccaagaugguuucuacaugaccauuuuucuggcuuuugguauuuuggaauuuuuucaauucucuauuuaaaaauaauuuuauagacugauacuuaauccuuuaaugauauggcaugauucuaggaccagguaaaugggccuuuaaaaaaaauuguggauuuaauucuuccaacaguucaucuucagcuguguauuauuguuagcuuauuucaacccaagauacuauuagaaguauaaccuaccaccucuguuuagaagaacaacauugagagaauuauuuuucucaaaaagcauaaaaccaaguagcugucuuauagucauugggccuagcagauaggugugugaugcccagcaagaguguaagacauguaaaccauuuccauauugaauuguaucaggacuuaaccagaaauaacauuaaauauuugucagacauuacugugcuggcauagugggaggggugguggguggggacuccaacugcaccgcauggcucuugccuucaagaaggacauguuccagcaggugucuaggagguaggacacggucaguugccagguguugucagugauaauagccauggcaugaaguggccuuguuccagaaaaagaaggauucguggaggggcauuugugaaaccagcaaauaaagggguccauuucuacucagcugaaaggaacauagcacuagguuuuaauguaucugagggagauauacuguaaagggguguuuccuagaagcugagugcccuuguuuugaguuucggaggcucggugcucuucugcagcuucucucucugcaccucuuccuauuuaccuccccuggauugcccuggcuccugcugggcaccguacaccuauccaccaagcccaauacuauagccagcuacuugcuuuuaugcuuuuugaaaaaaagcauugucauccugaugacuggcuuccccgccuuugcucuggcuuccccgccuuugcucuggcuuccccgaauacccagaacuggaaccacagguguuuuccagcuaccauguugauacuaggaaaggaaccugggucuccuguaagaugcaagugcucuuaacugcugagauaucuuuaucugcacccaucaaguccaugauuuucaucaagaaagcaaccguacacacaaaacguagcaaagaaaggaccacaaacaaggauuuuuuaugucuguuauacuagcguucugguacauacaucauuagugacaguugucccacuaacagcauauuuucgaauguaaaguacuugcaaauuacauguaauuuguaaugcaugugagaauugaggacuaauguccaaaguuuuucuuuaacuucuaacaacuuccugcuguuuaggauggcaaaauauuauucuuuuuggcgauuccagauuaauaauccuucaucucugaguaaaagugacugagucagguugaaguugcugcauccaugucacagaucagggaaaucagacaaacugcaugugacaugacugacauaugccagcagucacauacaggacugcaccuguacacauuauauauauauauauauauauauauauauauauauauacuuaaacacacacauacacaaaacucauggcaucuuugcuuccuuuauuaaaauuuacugugucacaaaaauauuaaauguuguccuguuucuugugauuaaauaugaugaauaauuaaauauuguuacaagguuauuuacacauuauaauucacuuaauuuuuguuuuguuuugcuuuuuugagacaagucuuucuauguauuccugguaguccuaaaaccaggcuagccucaaacucauagacauccucuugccucugcccucaagugcugagauguaagaugugugccaccacacccagauaauucaguuuuuauucuugacuaagacagugcauuaugugaucuaaucuaucaacaaaaaaugcaccauugucucuauagacuucuucuggagcuacuuaaacaagcauucauaaauuuuuuuuuguaauuuuuaaaaauauagguguuucguuguguauguuugucuggcauugcuuuguugggguuuguaccugugcaaagucaucacauuaccuagcuggccauucaguacuucaaaaggaaauuuacuacuuuaauuuuuuuuaaaucaucuuuuuccccuuuaaauaaacuuccugcuauuuagaauggcaaaauauuauucucuuuggcgaucccaaauuaauaauccuucaucucugaguaaaagugacugagucagauugaaguugcugcauccaugucacggaucagggaaauuagacaaacugcaugggcuuuaugcaguucggguuuuauaaucucucaucuuucugcauaugaacacugcugucagagcauggagggagguggagaagcccagggagucacauguguguccuagauucucuggauagaauuggaaauuaauugucuggcugaucgccauucaaagcucugguaaucucaagggagagccacauguucacagguuuggucugucagcuugccaucuucucugcacagacacugggcaccgaaagauuuacugguccgcugcaccagauauuauccuaggagucugaugguggugugugagcaaugggagcaaggaggccccuucuccugcugguccauuuguaaacucaauuccuugguuguaauggaaaggaaggaaauguggugugacuguauuagaggaauuuauagaaaaaugacgucuaagaugcgucucguaggggcagcauuucuaaagugccagcuggguucccuuuagaaagaugcaguaacucacacuucacugcacauaaaguccuaucccccagggcaaacucucaugccaucgaguuuaugacucacaagugcuguuuguuuguggucuaauaaacaagaaaaggugggagaauuauauuucuguacacaacgcuaccugcccuccauuauagagaauaaugcuauggggcucuuaaauuuuuaguggcauuuucaaggggagcauugcccgggccuuaaaugcauguacucacggguuggagauacuuaagcacaaaaccaaauggagcgaagguagcugugcccuuugcagcuaaacugcuggucguguuugaagaacagggcucugccuuacagacgaaacuaauuauuacauuuugauguucucuuguuugugcacgcaugugagugcgucugggugcacaggugccaacaggugauugcugaagauugaacucaggccagccggugccuucaucagcugagccaucucacuguccccgacuuggguacuuacguauuuguuuagccacaugauuccucugauugauaccuuguguuuuauuauuugagaauauaguuccuuuuuuucuuugaaagagaagucauacauuuaccaaaaagcauaaaagacggcagagagaugcaguagauuucucuuaucaugaagauauucuaccagaaugagccagcccugacaaggcaugaacccacacugucaugcuuugucgcucacagucuauaguuggucuuagggcuugcucuugguguuguagcuccuaugggucagauaggcguguguguguguguguguguguguguguguguguguacaggguuauaccuacagggauaugggcaagcauggacaccaacuuugagugucuauucuucaagagccaucuccuuuuuacuuuuuguaagauuuaucuuauuuugucugugagaauguuuugccuguauagauaugcaccauguguggugucuuuuauauacaccguguguguguguccggugcccacagaggucccaagggcugcuagauggcaugacacugauguuaagaaugcuaaccacaaugagggcgcuuguaaucacaaacaauuccucugcaagaacaauaacugcuuuuuguuagccugaguuguccuuccaggcuuaucaccuuguuuuaugagacagggucucuuaggcaaggccaacugcucaacgagucucagggaucuggcugucuccaucuucccagcucuguaauuacacaugagcccccaacaugcacaguuacaggggauucaucucuggcucauaggcgagugcuuuguccagacacugaucguuuugcugccuguguagagaauugucuuuauagacugucaugucuuuauaggaagucauaacaguauggauccuuuauacacugauuucugccacuuaaugguaggcauuuauuucaguucccucuguguauuuucuuagcuagauggaucauuuuggggggagaggauacuaaauauuucuguguccacaauguaauuauguaguuuuuaaauauccauuuucaucguccugucuuucuuccuuuccuuuccuuuccuuuccuuuccuuuccuuuccuccccuccccuccccucccguccccuccccuccccucccguccccuccccuccccuccccucuccucuccucuccuuaucuuuccuuuccuuuccuuuccuuuccuuuccuuuccuuuccuuuccuuucccuucccuucccuucccuucccuucccuuuccuuuccuuuccuuuccucuuuccuuuccuuuucuuuccccuuccuuccucccuuccucccuuccucccuuccucccuuccucccuuccucccuuccucccuuccucccuucuuuuacaaacaucuuuuaccucacaaaguaaggugagguaaucaaggcauaaguaauaucguuuuauaguauuucaauuagaugccccccuccccccauaacugcaauggacaagaugucagcaucuuaaaugaagacagggucacucugacaaucacaaacaaaguaccgcggcguauccacggcucccaggugggcacggugcucuaguucagguuccuagguuuucucagcagugugcgcagaagcuggggaugagucuguuccgcaucuccagcuccacaccccucccccuccccccaaaacccuuaaaccugucuaugaacucuagugcuuucagccuagacugucuuuguugucuauggauggaguugacccugagcccuacuagccugugguacgcaccuucaaucuuugaagucuucugcuucuggcuuccugucauccauuacaacccuuuuguaggcuguaguuaucugggaggagucagugauaccucugguacuuccguuucucaaacccacaucaugaauccuucagggacauuggcuucuuuuuguuuuguuuuaauuaucuacucccuuugauggccauauuuauauuccuugcgauuaccaauaauugggacuuucucagauuccuaauuuuaauucccaaacucucccaagcacuaguccuuccuggcucacuuucuauaauaugucuacaccaaacccuuuagcccauuccagaauucgaauccuguugucuuacaaccuuuugacuguguccaauucccuucauguucucaccuucaccuccuggauucaucaccuccaguuaaacuaucugcuuccuuacagccuuuaguaaacuauuucccugguuauuuaucucgcaaaauggcucacuuuagagccauauuguguauugcuauucuucuuucaaaucucuaacccauuauuauuauuacauagaagugguuugauauuucacaaauacauuuugguugauugaguuugacauuucguuccaagugaucagcaaacagcaugauucaugagcagcagucaucacagacagagauaaguaguuuauuacugaaggaggagaauuccugagugccguccuuuaaauggcucucuugaagaugcacuuaauaaaauauuuuuguguaaacuguuuugaggacagaggcugauuuuuuuguguguguggaaaccaucuaugugccaugcucugugcaugaaguauuuuucagauagcagugaguugaauauaaguagagaugacaaccuuaaguauaucagucccaggguuucuuuagaauacuacaagcuguggucuucccuagcgguuuauuuugcauagaaaaugaccucaugcuuucaagagucugugcuuucccaugguucuaguuuaacucuccuggacagugucugaaaagacagcucgaugcaagucaccuuggaguggaauacuagguacagccgcucaggcauuuuccuuuguaucaguguccgugcuuggccagaagcagagcaacuuggcucuuagagaauaacggaaccuuugaauaacagcgaagguucaacauguacucugugugccagccaggcuuugccaagaguaaucauuuccucuucuccuguguuccccaggucuacccugaacugcagaucacaaacgugguggaagccaaccagccagugaccauccagaacuggugcaagcggggccgcaagcagugcaagacacacacccacaucgugauuccuuaccguugccuaggugagccgguuagccagccacccccacagcucgagcugaggggaggauguuguaauuaggucauauucaugcaugcacauuuuaucagcaugucacugccaacauauuguuggugccauaccuuugaguuucauaucugcagauucauccaaagaugggugggaaaaaaaaaauggaagugcaaacuccaaacaguccugugucuguccuuauguuucauuuaaauugcauuagauauuggaaguaaggagaggcgauguauuuguuucuucauuauuuaguguggugauugagaacaaacauaggacuuuauaaagguuaggugagcauucuauuaauaauguguaucccaagccugggggaggugaguuaaaguuuguaagcacuuguauguaggcuguaggagaauacucauuuucuaugaggcuugagguuuuaguguccacaaugcaugaaagggccucccucccuccccacaaauaccaugggaguguauacuacuauaguuuggauggugcagguacugcccuguguucuuuuaauacaagaccagcauuccuuagcucucugcuucugaauagcuuuccugucucccagccagucccuggucuucugaguggaaagugucugcuggugaaaccccagagacuugcaagggauucucguuuacacuguccaguguuacaaauggcaggccuuguauauuuccucacaggauuucacaggaagacuauaaugugaggucuccacacucuagcuaauuccucagaaagcccuucccuagggcaccccuuguuccuacaguugaaaaugaucaggaaguauguuugcuggauuguuugauuuuauauuuauucagaucgaaccgaaggaaaccauguguucacaaaggccugaaaacucuacuuucauuuuuaucuuaaaaaauggaguccuuuuugucuuuugagaaagccaucuuaaguccauuuucaaucuugucacaccuucuuccuggcauuucaugugaacaagccugccauagcuagcccuguuugaugugauaaaucccacuugaauguuuccauuguuauugauuaauaagaagguuguaagaauggagaucuuuauauggauagugaugacuuugaauaaagucuaaaagaaaucuuuuuuagagagucaccguuccccuuccagguacaaggaggugaguuugcauuccaacacuuuagcuacaagggcuccaaucaaaaccuuguaaauaaagauaaauacugaagacucuaggaacuuguauaguuuuguuuagcuguggauuccauagagcauacuggaagcugguggaacagcucugcaguuaagaguucuugcugcucuucugaagaaccugaauucaguuccugguacucagguuggaugacacacaauugcuuguagcuagcucuagcuccaggagaucugacacccucuucuagacuucaagggcacuugcgcucaaaugcaccucccacuccuauuuuuauauauucuuucaaggacaugcugacgucugcuuauuugcgcauguaauuugagacaucaacagaaaacaugggccauuagaaugaagaucucaccuguguuucauauucaguaaguuaacaaugaagacaauguugaaccagaugcuugaccauuugauagucuguguauucucuuacacucccuuauuccuuuaaucccuuauuagcucuuuaaguaugguugagaagucaagauuucauaagagaauaauaagagccagauuuuacacugugggcacauaggaacuaucaaaaucuuaguuuucauuaugauaaaccucauuauaucauucagggacagccucacuaauuugccuuuuaguccuaguuuauguagcaaacaccaauuagugaccugcccccugcuuuucccucaacuguuagagaacgauuuuucacugguugagguuuguagagauguccauacaggucagacagggguaagagaaaguggagaggugccucaaaauuguccaagagauccugugaggaaaugaggaagaccgaauucccugcugccucugucuucggcaaggaccagauuucucuuuuaucuucuaaauagauucugagcuccuuugauguugaaguacauaauucaaggaggcaggccacuugugacauguuuagaaaauuucccgggucuggggcagcaucugaucuaaaucagcacacugacucuaacuguuccugacugcuaauagacuagaugaucauuagauacucccagcaggcauuuggccuguuugaaucuuuuauuguguuucuccuauaaagucccuggucuuuucccauuggaucugaaacaaagggucaguugacaggcagagcauaccugucucuugcuuugccaaagagcuuagauuagaauuaagcaaugugaacauugucaauuucuuaggcaguggcaaaauuucuacgugucucagauauguuacacaaggcauauaaaaugcgcugauguguaugugugguguaucuucaguuuugagaaaaaggaauuacagaacacauauaacucaugucuauuguuugcaugaacauuguaaguugcaccucuucaccuacugucuucauuccuucccucccucuuccccuggcuuccugaucuguccuucaucuugauguccugucauugguggcaugggucauccauuggaauggcuaucccauaagguugacucuguuggccucccuucgggaguauaaguguucauugcuagagaaguuggauuucuugauauaagucacacagccaugauguguucagaucaggaccagagcccacaauuucuugauuucuuauuaucuguauucuuuauaauuuuuuuaaaagaauuaggccuggcaguggugguguguaccuuuaauaccaggacacagaagcauguggaucucuugaguucaaggccagccuggucuagagagugaguucuaggauagccaaggcuacacagagaaaccuugucucaaugccugccacauagaaaaaaaaaguauuaaaacaacuguccacuugguuuguuaauucaaaucaugcaagaaagguugugaauuugagacaauaaauauuaaaauccacaguagauaucauguugauaaagguggcaauuuggaccuuugguaaggaaugauugggaguucaaauuuuuucugauaauuacagagguagucagugacuuccuucucuauaauuugcuucugaaacaaagaauucuuguuuagcacuaaucuacaaacucucugagacuucccgcuguauccaaauauauauuuuagacaaaggagaguuuuacuggaguuaauucccacaaagacgugaccuaaaaacaagaguaagauugucuuagacauugccauauugaaauucaaaacaaaucuggagagagacgccugccauuccuggcuugugaccuccugaccgcugccugucucagaugaaggaccagaauggcaugagcugaauucccucuauagggguguuugccucgggcucuuagcucugcacuaucucucuuugcuggugagauggggaaguguaucauguuaccuuuggcaccguucucccauggaauggacggcuuccgucccuugggaaggaaggcuagcucuccuuucccuuuuuauuuuucauacuuccagaagcagaguauaggaucugacuugaucaaguaaacaucuuaucaugugccauauguguaauccaaagcacaucguucaucgucccucagggaagcggucgguuuuuguuuuugcuuuuucgaaccuuuuccauuucagugacuucucucuuuaugggauaauggaugcacuauugaaguuggcacacuucugcacuugugucugacuaguagugccacaguauguugccuaagauaaaucacuguugcuuuuacagggccaaagugcaguuaguaguguaauccaaaagaggaauuagaaguugaggaacuacgaggcgacacugcgguaugccccuguugcuaaggaagauaccccaaauuugcagguuguaauggccuugugcagaaugagaaauuaagguuccauucucugcauuuugaauuuuauagguuuaauaacauuauaagacaagucugccuuaguuccuagauggcugcuucucugaagcaucuauagccaucuuggucuucuuuaggucaaauaguguguauuuguuuacuugauagauaacuguacaacagaugugucaacuuaugcucaacagauuuuuguuguuguuguuguuauuguuuguuuuuuuaaacauauuagccaaugguaaaauguuuaagaguaaaaauguuaccaaagugugaaaguaggaaagaggauggaaaaacauuuguuuuagacuuuaaauauccuuuaaauguccagaaaccuaaauguuggacuccagagaauuuauagauuuaacauuuuuuuucaguuuuaauaugauaaauuagaaauuagguaccguuuuuccugauaaugaaucuacaaaguacucauuaaaaccacuuuaguuguuuuaaagguaagaauuuuaucaagauuacugaaauugaauuaaugaagauauuauacuugacugauaaaauacugcuggccaggguaggagaugauaggcuuuuaaaaucauuaucuaaaaaauaaccucaagaauauaagaauuaacaugacauaacagugaaucuaaaguucaaguuaaaagacaguuuaguaucaauaucagcuauggcccagcaugguggcccaggccuuuaacaccaauacucaguaggcaguggcaggaagagcucugugaaauauaggccaaccuggucuacauaaugaagucgaggauagccaggguugcaaagugagacccuuucucaaacaaagaaucaggaaggaaggaaggaaggagggagggagggagggagggagggagggagggagggagggaggggggagggagggagggagggagggagggagggagggagggagggagggagggaggaaggaaggaaggaaggaaggaaggaaggaaggaaggaaggaaggaaggaaggaaggaaggaaggaagauugguugguuuaaacauagguacgugcagaaggcucucauuauuuuucucuacaauggagagaaauucaggucuuuuuuuuuuuaaggucaugguaguugccaaguagcugauuaaacauucuguuuuuuuacauaccccuugaugaauuucauauccccaaugaugugucccaggggccccuucucugucccucuuccuaguucucuuuuccugugagucuucagcuuuggcuuugaucccuaacagagaaggaaagucccaacgcagcagcugggcagcagcagucuggagagcaacgagggaagauugcagaagaguggagggcaucccagaaguggggcucuugaggaagagaugacacugauggaugaccugcuguagagucccagcuuggccccuuguguggcuuuagaguccucucacagaguuugggaaagguauagugccgaggaaacauaggaagugaagcaaauuuuaaagugugggcucuuacuacuuuuggcaaacgaaacacagaacauaaaaauaaauaaauaaauaaauaaauaaauaaauaaauaaauaaauaaauacagcaaaaaguuauuuuauuaaaacacacagacaucagugugaacagcuaugucaucuguguuguugguaggcuuucuguggagcuccgaggacaaggcucuuaguuuagcgcgugcagaguugguuggcccaauuguuuugugccuauggugagguaagguggugauaggaauacauggauuaccucauggccagcaauaaaaaguaaugggagaggaggaagcuaggggcuucucacaccucucuuggagggcaaggccaccaaucacauaaccuccucucaccuccaggcuccaucucucaagcauucuguuaccccuuuuaguaccugucucauuggagagacguugaagaugugaucuucacugccugucuugaggaagguaccacaugaggcuacgcugguaacguuggugugaagagaaggcaggagacuuaagaggugguaucaccucccgcuuuggggagacuuaaaguggagaaaucacuaaagcagguccuuacccaagucaccagcacuaaccuguccccguggacccccauagaucccuuucacugggguugcuugugcgaguauggaucagggcuugaugacgggagucuuaccaguggcuacaucauuaaagaaaaugucucaucuccccguuugaauggcagucaacugugagagcaucgugucaggaaaguauuacaucagugaauuggcgaaucugcuuagggaaaagaauaauugcagggcuauauuaggaauaaauacuucauggggcagaagauuaacaaugcuuccucgccaugcuuuugcauucggagauaauugguuucugugugaaauauaagcucuuuggugauuaggacuuuuguucgcucacugaaaacucccgagagcuuagaacaugucacagccccuuaguucccgcuugucaccauguauugaaagaaugaacugaagguuuaaacgaaugggagggacagggagaaggagggacaucacuugaaaggcagaagacagggaguggaacuucuccugccaaacacuuccuaaggugacagcaggcaucaguguccuuaugucagccuaugcugauagcagcaugacuacagucagccuuccaagaagcucccuuggaguuuaccaguugagugauuugagcuguuuucaucaaccgccauggcucuuauaguaagauuguagucagaauucgaaguugaguuuaaaauguauggguaccaaaugcauccuuguauuuuuugaaaaagaaaaaaagaaucuauuguuuggggcuggagagauuauagcucaguagcuaagagcuguucuuccagaggagcuggguucaggucccaguacccuuuuggcagcuuacugcugucuguaacuccagauguaagguaucugucugacacccucuuugggccucugggcauuccugcacgcaugugcuucacugguacacauacacacacucaggcacagagagagagagagagagacagagagagagagagacagagagagagacagagacagagacagagacagagaggcagagacagagaggcagagacagagagacagagacacagacauacgcacauagauagauagauagauagauagauagauagauagauacuauauauauauauacauauaaacaaauaaauguuuuuugaacuguaagagaaaaaauauuacugugugcgcgcgugcgugcgugcgugcgugcgugugugugugugugugugugugugugugcgcguguguguugugucaugguacaacuguggaggucagagaacaacuuucuggagucaguucuccccuuuuguuuauuaccuagguuucuuggugagaaucgagucgccaggcuugcauggcaaacacuuuaagcucacgagcuaggccuugagcaggccuugcaggccugcgugcauauauuuuccucgagauguucuuuagucuucugucucccuuuugacuugaugaagaccuuugccccacggcccguuugauuuccguuaucacuacuguguaggcuucucgggcuuucuuuguucuucagagaacucuuggcuucgugucagugugcugaucgcaugcauuucuugagcagacaucuuugcugucuguccuucacaguucugccuccugaucuggugguuagaggucauaggagggccuguuagccuucgacucuuuugcagucaggcagcaucaggaguccaugucuccagcuccguuuaucuguggaaucacugaugcucugagcacagauucucuugauuguagucuuugccuugcuguuccuucugugcauuccuucauuguuuuccaucacaggcucuuuuuguagacuucagaaauccuaacuacugguguuuuucuacagccuuucucccuggucguucauuuuguauaacucacaugcuugccagaaaauuccauccaugcugugguuucccuaauagccguccugaguuaucaugcccaaggcaagguuucuucucuaggaagagucucagauuuggugugaccucuggaguacuggcacauagcuuucuuggacauuucaggagauaccgguagaugccaguuccuuaugaagaaaugcugggcaguggucgagcauuugccugccgugagugagguccuggguucgagcuccagcacugccaaaugaaacacuacuaauagaugauaaauuugagauuuuuagauuaaaccgugcuuaaacaguaugcuauuuuuaucacuuaauuuauugcuaaauaccauuugcaaugauuacaauuugucauaagagaggaguauaguuauucucagccuucugaaaacuaugcagauagguauaucugugcacaugcaugaauguauaugugugugugcaugugugugguacauacucacgagagagagagagaagggguaguuaugagagauugagaagggcuggagaaagcaagaagggaggguguuugugcauguacacccccuacgccuguuccuuucuuuuaucaaagucuccaggacucuugguuccuugcuuaagaacuaauuaaguccaugugaacuaggaguccugcugccaauaccuggcaagcauucauggccugauuuuuaauauauuuuaaagugguacuguguaauuaacacauucuuaaauuuugacuucuaaaaagcauuuuggaauacuucgguauaaauauaagauugguugcaaaguauugguuaaaaauauagauguggucucuaguuuagaaugauguuauuuuaugaggagaauuuaggacuguccuaaagcuagggaccaaggauauggcucaguggauagagauguuugugcauaggaugggaaagcugaguucagggcccacaucuuggagagaaaugaccuuugagaguuguccuuugaccucuacauauacuugcuugaauucucucucucucucucucucucucucucucucucucucucucucucucucucucacacacacacacacacacacacacacagagagagagagagagagagagagagagagagagagagagagagagagagagagagaaauuuaaaauuagagcugaaaagacgaaaguuaaaucaucugcaagcaaaugcagaggccgcuugcugagggaaugcuaacuagaguugccuaaugaaucaaaaaaauggcaaaugcuuaaaauucaggaaaauacagauaagaccuauuauuuauuguuguaguugaauauucuguugagaugggacugguuaucaaagauguccuuuguacucuacguggcuuuucgaaugucagcucuauuuucucggagagaugggcuacugugucuaggcuuggagauagccauauagcuugaauagaaccccagacgagcugaucgugcagaugucauguggcauccacugaggucaagaggaaggaguggcuuugccuuuauuuucuuuauuuuccuuucugaugaaugaccucaagggcacacuucauacaacuuuaagcuuagaccagagaacuccuauagucugcuaaaguggaugcuguuggaagggcugccucacucacacuucuuccagaagauucugcuacguauugucaguuugccucaguguuuuuccuacaccacauuccugggguaaaacaacucagaucugaaugauaacuuugcuugaaugcauguucgucaacaagaaaggcagaaaucauaccaucugaaaggggguauccccuuuaauuauuucaagccuuagucacauagguccuccuucugauuguuuaauauaaaaugagagauguaaguucuccaaaaacucugcuuguaucuucuauuuuugagaaaugauuuaagugcauuuaaaagcuuagucucugcuugcccagaaugcuugcucuucaaaauaucugcuccccggagagguaaacucaaguuagucuuuucaugugacucuggaucguugaccuggaagacuucgggguaauggaaugggcuuuggcacugaucgcuguuuucugguugaguacccagccuggaaaggaaggcgugacugagccaugugcaaagggggaggguggguggagucuaacgauguuugaagcaugaguacaccuucauuugaugccucgauuuacugagggagagaacucuaaacugcugcauccauggauggauggaagugccucagcuuguaaggaugcuuauuuaaaugauuuugcauauucaaaugauucuacagccaaucaaacgcauucauucccugccuggugagugaaaacugaaugacacuugugcucccucugaaaggaacagacguuuucauuaucaaauucaaccaagcagaaaaucuggcgaagggagcagaaaucuccauuuauuuacaucuaccaucgacuguuuggugauaggagauuaguagguugaggaagagccuuguucucauuuagcuaugugacccuagacuuuugucuccuugaaaauacuuacuuagguuaugagcaugaagccaaccaaaagucucaaauugugcauauauauuuaauucucuauagauauuucuggugcuugugggcagagagaaguccuagucacauauuaacauucuaugucuuccuuauacuuuaaagccauugcuuaucagcuguaaaagcuuaacugcugccuuuauguucuguuagcagaguguccccaucugacuuccauuuuauuugcaucagccgguguaguucaucauaaaagucugcauuagagaaguggaucagaacccuccaggggaauuugcugccaaagcauaguuagagaucuaccuuuugaauccuccauauaauucuuucuugcccaaaccuuucuccguacaaguccaggaauucaauuauuucagcucucugaggagcaguaagcuccagaaaauugauuugcaauaaugaaacuaagccuuguuuacaaaucugaguggcacuuucgaagacuggacuggcauggugacaggaggaggguacgaauuuaucuaggggcucacccccuuugaaaagaucauguuuguggaaacacggcuggaaaggauauagguaauuucuaaaagaccuugaugggucauguuuuaaucugcuuccuuuuuaauucuauuaucuccuguguugcucaucccuaggugugcugcugagagcgagugcuuuaagagagugagugcugauagcugaccauagugcucugaugcccaguuaaaagcugagccaguuucaagggguauggccucauuucuuugcaguugacuuguuaagugcugugacauuuuuuucccauucucuucuuucuccccauaagauauuugacccagugagaaaugggccauuuuucuuugcguacaugggauuugaaaagcugguuggacaccaugacgucucuaugugucuagccggugacuagaaaugccaaaagagaggucagccuuggaagaguagagaaagugacugaauccuuaggcccgagugguauuccugagugacaguggaaaaugagcagagggcagagcuuugugcaaucaggacuguuaaaaagugggugggggggcggcacugagagugagcuucacacagaaagcggagaacaagagcggucuggcuugcggagaagcgggaggagaggacugaagcuacaagaagacgguggugugauggaguggucagggaacacggggacugagaccaaagcauuugguguugaccuugaacgaacuguugucgaucgucaugugcugagccacguggaaaggaucggaaagauuccggcaagguuuagagaaugacggacggacuagagcucgggcagaaacucucuaagugccucuuccugucuugauuauagccugccucacacagggguuucuggaucuggcacauggaagaccgggcuguguacuuuuucuucccacugugaugucagguuuugcuaaugacuggugguugucgugccucacuguaccucagccugguuggcguuuuguaaguaauuauguggguuuuuuuucuucucuuuccuuuuuuuuaaagcaccgcauauaacucuaauuaauuacaucuuuuuuuuuuaaucuauguggcuuugaaaaaaauuuuuuuaaugaggcagaaaaagaaaagcguuuggggaaagcggccagcgaggauauuuguguuucaggagacaauguaauauaggacggugucucugcaggguccacuuuuuagcuccuaggaaacaagaaugaguuuaaccaaaggaggcugaggccuggugggaaccgacguccuucgguuuccauagcggagcuagucacauauccuauaaauacaaaauauaauaacagcagaacugucgaaaguggaggagggagaaaggcagguaugguaagcacugauuagggugguaacaaagcgaauccuggaggcgcaucucucagcaucuaugccguuuacgcucacacgaugaacaguauacucacauaguaaaaccgugcaguaucaguggacaguugcauucagauccagacuccuguuccucuacuaaccccugucuugggcuucacauguucucccaaaaccccuaccuguccgaauuuagcucauggguccucaaaagaaauucccgaucuuuaaaauccuauggaaggugucuugugcucacugccagccaccagccacuaguggccauacaauacugaagacagcuacuccagacagcuuugcagguauaaaggcaaaccguggagcaaaggaaaauacagcaugcuuuaauaaguauuugugcaaugguuucacguugaaaagacaaaauauaggaugcauaaauaaaauauguucccagagugaauuuaguauauauugaguauggaaaaaugcauacugcuuuuuagaaugugccugaaaccacauaugugagcuacuuuuuauuucuguugggccugacugcucuuggugcacacugcuugcauaugccucauuucucccaucuucuacggauacagcuccaggacagguuagcauuuagugguacccacugauguugaguagccacuuaaaauugcaucacaucauguuagauuucgauguuuauuuucauuacucuuugaauuucucuggccaguaagccuuuuuuagagugucuccacuaugaaaaacugagcauucuuaucauaaaaccugaaauuccaaaagcuucauaauuggggacuuucuagaugccacauccugccauaaauggaaaauccuauacuguaaaaacuuguuucuuguccaaacuaugaaaggaauugcagagggucaguguggccucauguguaagcccagcauucuggaaguagagacaggaggggggaguauucaagauacugaaaaaacaaaaaugugguaaaauugcuggagaaguggccaauuuuaagaaccgggcaguagauaaacaagaagacccuacagcaucuugucagaaucauaaagucugugcagggggguaugcccgaugaguacaggagacaacucccaauagcuaaagguggaccaauuuaggcacacaaacauaauauguacacuguaugugaaauauaacacauauacucacacacacacuuucauuuuuaaagaaagucauuacacggagcccacgacugggauggagaaucacgccccacuuuuccuagguuagaguuuauauguguaaaguauuuagaauucuucugaauaggagauuaucuuuuuuuuucccaguguuucaucacuuagacuaaugaauuuuccuauuauacgucgauauuuaauucuguccugcacaguguguguguguguguguaugugugcacacacaagcacacaugcucacuuuauauaaccccuauaaaaacuuugugauuccaacaagaugcuguaggguuguccuuuaucuucuccacaaaucuaagaaucaaucauuucuccagaguccuguuuccuuuuguuggagaauaauagaaagauccaauaucuaggcuuugugugcucauugcugcugaagugucugcuuuguugcugauggaccgaggaaguccccuugcuacuccucgaucuuauaguauggauuccuguagauauuucuguagcucucugugucucaauuagcaucccuaggagcucacccuguugaucccucuaucacccacuggacuguucuacuucccgugcuugucuguaaacucucaccccacugugagcaucugccuuccacccaccuuccuuugccuccaccauuuaauucagaaugcucugaugacaacaucacaauuacaguacuuuaaauugugaaagcucuuuaaaaaauccuaaaauuguuagccauuguugaucacuauacuuugaaaaaauaucauuauuauuucaaaacaauuauuguuaacagagagguacagguagucuguuucucuugaacacccaucucacgguuaguguguucacgaacgugagcacaucugcgugugguauguaugugaggcagaacucuccucaccugaaugagucugaaagacuuaaaggaaacuuuuagugcucacuucuuggcuugcagcuugcuugaaacauucacucagcuucugccaucugccaaauuguucucugaagaaacccagcugccagcuguuauuguaauaguuacggugacacucggggugacagcacagccacuuuacagaaccgagucauuuacucauguguuccugagaacccagaggugacccucaccaugaagcaaaacucugccucaugccgagccaguugagaggcauuuuggugaaauacacuucugaaaacauucuuuccacacaaaugccucccggagccguuugccagcugguugucagcgugcgccacuuauagggcgucaguccaucuaacgugcugaaacaaaauauauauauauauuuaaauaaauuuuccaaguaaauaugaguaaacauuucuucggucuguagcuaucacuuugguauguacauaugcagugugaacuaaagcgcacauaaaucuagaguggguauuuguacguuugcgaauuuauggggacaugugagacacaucugauccugggcaucuccauccggugugaaguggcuucuaguuugugaggcaggaguaggcaggcuuuguuucuuuccucccggaucuuuucaguuugacuuccauucuaaacucuucauccuagucugagguggugucacuuuucccguggauaaggucaacagcaccagccuagucagcuaugaugcuaaugacaggcgaacaugcccaucucccuguguuccucaaaagugcugaccagauuuguagcugaacacuguguagccugcccucacccacccaugagcucaugcaaauugcucuucucugagaauucacccccuccuguuuuugucuggauucauaggcaugcguuugcuagggacuucuguacccuguugcucuguggcuggaaugucuucugucaacguaggauguuuuucucuucccuuuucucgcuuucuccagcgcauucucaaccuauucgcucucacgacccaguaaaguucuccaccuugucucucagauuagucccuacuccaguuccuccacuuuuucuccaucauauuucucaccagccaacaguuucuuucuuauuaucauguuccucuagagugcuacuuuauugcaucucuugucgguuuccuggauucucagcccuaggagaaauguaaauaacuugcaaugaagacuuguguuagggguggacugagguucuugggagagguguuugaagauacccagacuucucuuaagaaccaccaucaucgugagacuuggaggcucacugcucucauccugggccucugccucccucugcagagcucuaccggagcuguuaucuagcauacgugauguucaaauguacaacgcaccacuucaucugugaggcuccacagagcuccacagaauagcuauaauaaacgugguucucuugcuugcagcuuuuccuuugaaaucauuuuauucaaaaacccauucugacuguccaaaacaguccuaguucugagaaaaaaauuucucaauugucucacacugguuccuucuuauuuuccccuguggggcgaacugguggggguccccucauguuucugauaguggauguuuauacuccuaauacuaccucauugcugggaucuuuuuucuguaaagucacaauauaauaauuagaagugcaucccugcccuugaaugcacgguacugcagaaucuaccuuucacagguuucauagccaccauucccucuccuuuucucaaacguucucuuguguaagggaaccuuauacaguaagcucacuggcaaauacuuucugcucacuuccauugcaacucaauucgagcagcuaagacaguggguaaaaaugcagcccguuggcgggggaucacuuggagggagagucucccucccugguaacaccgggaaacugcagagcaggaaaccgcccauccuugcuccauuccgccgggagcgugaccgugagguuauagguucccauggacagucuaucuugugacuacagagcccggugucacacagucgcacuguguucaagucacuguucgauggguucuaacugaugcagcagaaugcauucccggcccguucauuuggaugacuggacauuuuagucucauucuuuucuaauggccagacugaucagaucauaacauuaaaauauuucacgggcuuaggauaaaucauuuucuuauaucaaagccaagggagauuggccauguaaaccauggugacccgaguuucaaugagucaagguaucucuggaaggccagagagcagggacacgugaaauuucagcucagcucugcugccugcuggcccugugagcgaaccacugaccugcacuucuuccugcccaucuacaaaaugagguaauucagguuagaggucuguucuccccgacaccagagccagcacugcacgccugcaggggcccuguugauuuccacaucuuuguuuucuugccaagacaucagccaagugugcauuuuaucuacuuuaaaaacccucucuccucugaaauuugcauaugugcuuuaaauaugaaauucuuuuuuucuuucacauaaaaacaguuugcauggcuaccaaaaaacaugcccaguguguauuggagaauuuuucuguuuagaguaaacguugccuuauuucccacaauauguagacgcggugagcacagcuucuccuuccgauucucuguuuaauuugaacauuggcugccuucaucugaauucuguuaagaaaugcucgcucuugaagcaugaguccacauaaacagguuuauuuccaaacccaaagcacccauccuuguguauggaaaccccagguuauaccuaucauagacuuuuuaaaaaaaaaaaucaauaaauuuugauuuacauauuacucucagucuauaucaaaacauccaucuuucccguaaaacuaaacuauguucuagcauagacuuuguuaaaaaauuaauuuuuaacaaaauucaauccucucaauucuuaaagaauuuuuuugcuauuuauuuccaucuuuaauuguauuauguggauaauucucaguaggacaaucugugcacgaaugcagauauucacaguugucagaggugucgggucgcaacggagcaggacauacuggaugcuagggacugaacucaacaacaguagcccucuuaacuccugagccaucucuccaggcucucucucucucucucucucucucucucucucucucucugggagagauuuuuauaauuuagccuucuaaccuucuugaugaguggcauucuaauaugcuuucccaacccucaggggacgauaagaaaggcuguccacugguaaauuucacuuuaaugauagggcacagugagcuuccauuuugcccuuuguccugaggccuuuuaaaguagcucguguuaauccuuugcuagagcaauuuuucguuagcuauaggcaauaccagcaacuuacaguuaaguaaaauaauuugcaaauuaaaaauuccaguauccuuuuaaaauagaaugaacaguuguuagacuguaagcaucucucagugacuggcucagcacugucaucgagcccuggacagacgaaaaccgauggauuugauuuuguuucuuggcaccaguuuuucuauuuguacccccaagaacucauuuaggccauggaccagaacaucuuauguuuucuuuugauauucuaaaaauggauucaauauuaacagucagcauuuaauaauaggccagcauuuaaucuguccaauaauuacuuaugaaacaggaaaacaucacagaugcaaauauggcugaccauguuaacuaaggaggguggcuauauuaaggguuguggucacuuuugucuuccuauacccuauuuuccugaaauaccucagugaauaggcauuuccuggccgccaggauugguuaccugacuuccucagacagccugaguaguucaccugggaacgguccuuccucauagaugguaucuguuuagcucuggaacuagguuacaaccuccugugguccacacugccuuaggcagguuucuuugcagagguuucucacuagggaaguggauuuguaggagaugacaucauggcucuguguggaguaagaugcaugaugcagcugcagaagugggaaguuuugaagugcccuuugcccuucccuuccuccaguacaagcaugcuugccagagcugugucagggguagggauggaauagucugauggccagcauuaauccacagaaucuagaaucaccugggagauuggccuaugagcaugccugugguugauuaucuuauuauguuaacuaggauggaacaaguggcccacuguggguggcaccauucccuugccgggauccugugcugcauguguggaacaggggagcagaggagccuguuguauuccacauucucugcuuccugguaguggaugucacagcugugugagagacugucuuucuuucccaccaugauggacccuaugugcccuuggauccuaagacagagucagcucuuucucccuuaggucauauuugucagagaguuuuuauuuuuacagcagggaaaaucagaugauaaaugaggugcuguccauacauugugaaacuuaucuucaugaccuacucuacccauccacuuagacuaaccuuuagugauauuucuaccugaagacauuccccugugcacccggucagauucauucacuguauugaccuaggacuugcuucauucugguaugaaaagaaaucucuucauucuucaacagacauucauugucuaguagaugcagacuuugugcugaagcagaggaaugccacaauggacaaaaccaagagcaacuaauuucacagcuuauguuauuuuucacugucaaucuuuuacccucaugacuauguaugaacaugcaugaacauguauguauguguauacaggaagggugauauguaacauuccuaacccuggaguaccagucaggcuuaggagccuuucucaugagauguaaguucaaagaaaacaagauuccauaauuugaaugaauuacucuuuccagaguguuuuuauauaaacacauauauaauacacauuguguauguacagauuggagcuuaacauuuaaaaaugcugcagucucuaacaauuugcaagcaguuuaaauuuacaaaauacagaaacagacauugguguugacagugcucaaauuaaagcuaucuguuuuuguacuguaauccuuaaugacaacgaaugucaguggcuacuugugcagcugcuauauggaugcagaaacugaaauuaauucaaggagaaggcacugggaauauauagggaacauacagccaucaaggaugcaugcauagggaauguauggacauaaggucuucaugguagcaaggcagucgguuguuuaaagaggcugacccaccaugcuaaagguaguguagccuuugugggguuuuucgugcauugaaaguucuggguaaguucucugaccuccgucgagcccguguguguccauggugaaaucagcugucauacgcgaaugauacagguccacucuccucucuuucaguuggugaguuugugagcgacgcccuucucgugcccgacaagugcaaguuccuacaccaggagcggauggauguuugugagacccaucuucacuggcacaccgucgccaaagagguaccaaucugugcccgcuuuccugcagagcgaucuccuugggggaggggggaauacaaagauguuuuuagaggguuguugaaggcaguaaguucuuggugguuuuuuguuuuuguuuuuguuuuucgagacagggcuucucuguauagcccuggcuguccugguacucacucuguagaccaggcuggccucgaacucagaaauccaccugccucugccuccugagugcugggauuaaaggcgagugcuaccaugcccgguggcagaaaguucuuuauggaagcaauguucaagcauuuuaaaacugaauuuacuuuuuaaaguaauuuuauuuuuuuggcaaggucaccacugaacagaaagucuaaugagcuacccugaaccaugucuguacacguuugugcuucucuauccaugaacagcccucauggucagcaauagcucucauuagauacaucucugggcuacaucuuacagaugaacauaaagcugucauguuuaauaggcauauguaaccuuacauugagcaucuuucucuauuuauuuucuaccaucgcucuugucccaugugguuugcauaauuuaacuagcuacuggugaaugagcugguagaacaaggaagccacauguucaaggccaccugaggccacagucguuaaagucauacccucuccugccaccuuccuuuccacggugagcgcaucugggguagcacgcgcagcccuuugcuagccucugcuuugggcuaagucaguggaauauuaaggacaauagaauguagugaaucgucacccuuagaaccgcacuguacccuccauauaauuauaaugcuuuucuccuaaguaguuaugucaagaugggggagccaguguucuagaauuaggguccuuuaucuagcucaggaguucacuaccagcgucaguuuuguaccccuguuccuuccuaggaacauuuuugcuugucugaccuguagaggcacuaccacuggcagguaacagucaaagaccaacagcuaaaaacccucccaggaacaggguagacuccaccuggcgacguuucuuuuccacauuaaucccauggaggcugagcuauaauagcccucugagcuauauccaaggccuuguuucuaaagugcuucugagauccaaaguagagucuugcuaaggggcucacuuuggucuugauauugcacuauaauucaaucaggccaugaacuugccacagccuuccaaguagccagaauuauagacuagaugcacuaggccuggcuccucagcaaauuaauuuaguccaaaauaucaaauacguugguugacgaauuaaagggagaaaaaggguuuaacuugacuuuuauauuucaugaaagagugugcucugauucacuguaaaaacaaaacuuucuuuaucuaaaaaugauuuuggaaguggaauagcugccugagcuuacaguagacuacauccuuugaagcccagcuucccaaaugauaaccucacuuugcgcuuccucugaguuugcaaaggaagacucccuugcuacuacgaaacaacaaacuggugauuccugugggguuaaaaugcaucuauaauacuuuuacuguuucccuaggcauguugaauuauuaauuuuuuuucucugucacggggaaauaguuucucaguuuuucucuucgugccgauuucugcaaaauuaacagaucccaggcaaucaaaaagauacugaaagagaaaucagggcuguggagggcaguuucuuccuuccugggacugggacucugagauaugagccaagagacaccauuuccagaauaagaugcaacuaacugccuauaaaaaaaaauucuauaucugggguagagaaaagaggggauaggcaaauguagacggagccuucaauuccugaaaagccaucacagcccaaaacguaaaucauuuccugauauuuguccccguguuuagcuuucuggaaccugcuuucuuuucauguuuacuuuguaaacauaauacauuaaaaaauguuuuuagguauauuuauuucauuuuauguauauauuguauauauugccugcauauauguauaugcacaggucuguggcuggugcccauaggccagagucaaaauuggguauuagauccauggaccuggcgguggguacgguucuaaaccaugggucaggggucugcuacaagaacaacaaaugccuuuaaccacuuaggccaucucucaaccccaccuaccaagaaaacaauauaaagauagaauaccaggcagcccuugcugaacaccggguuagaaacgaguucagacagcaagccgcccuuaccuucuggaguaggcuccaaaucuaucuguccaugcugauuuuccuggcugugacggcgguucaauuguuccagcugugguuguguucgauuaucugcgcagugacugcguuugauuguuccagcuguggcaguguucgauugucuggucuguggcuguguucuauuguuccaacuguggcguguucgauugcccgggcuguggcuguguucgauuguguggaccauggcugcuguccgacucuucuagcugugguucgauuguccgggcuguggcuguguucgauuguccgggcuguggcuguguucgauugucugggcuguggcuguaguccgacuguccuugcugcgguuccauuguccuggcugcggcugcgguccgcuugccucugugcccacacugacuccuccuuccuuuuguagacaugcagcgagaagagcacuaacuugcacgacuauggcaugcugcugcccugcggcaucgacaaguuccgagggguagaguuuguaugcugcccguuggccgaggaaagcgacagcguggauucugcggaugcagaggaggaugacucugaugucuggugggguggagcggacacagacuacgcugauggcggguaaggcggcuuuugagaugggucucagauuggcugagccaucucgucucuuacaguuuuuguauucucugagugugucucucugucucacaguggaaagagaccucucacuccaguuauauuugauaauaccagaaaaaucuaacccugaagggcugcucugauucuuguaugccacuuacuguuaguguuacugauaaaccuucaugaagucauuggaccacguuugaaugucaggaauacugaucagacuccacucagagcugcuccucaguaggucuaccaggaagcuaguagauuugagcucagcacucuggcaugccauuuuguccugccauuuggaaauauuuuuuuauuagauaauuucuuuauuuacauuucaaauguuaucuccuuuccugguuuccccuccgaaaacccccuaucccuuccacccucccccugcucaccaacccacccacucccacuucccuguccugucauuccucuacacuggggcauagagccuucacaggaccaagggccucucugcccauugauguccaacaaggccauagucugcuacauaggcagcuggagccaugggucccuccaugugugcucuuugguuggugguuuagucccuggaagcucuggggguauugguuaguucauauuguuguuccuccuauggggcugcaaaccccuucagcucuuuggguccuuucucuagcuccuucauuggggaccuugugcucaguccaaugguuggcugagagcauccaccucuguauuugucaggcacuggcagagccugucacgagacagccccaucagacuccuguuagcaagcacuucuugauauccacaauagugucuggguuuagugacuggccucucucccuaucuauucaauaccguacuuaaaaauacuuuuaaacacucuuucgugaacucaauacaaauuuuugguuaaggaagacaugguuuguguuuguauauuuacucuuaaggauuuccuucuucuuugcuuuugguuugguuuuggauggguggguagaccccuccccucaaccaucuuuuuccuuuguguagugagcaacacuaauaaauguuugcggaaguucuuuaacuaucuccaguugcgugauugcugguugacauuuuuuuuuugccucauuuuccuugggaucuuaaccccuucguuaauuuucugacucuuuucacuugugcacaaauauccauauucaaaucauaagucuaugaagccagaauuuuugaguuagaccuaugacccgguuuguugaugaauccaggcuauccuaucccugaaauguaaggcucgggcuuuccugccaagguccucucagcuguuccucaggguuuucuagcucaaacggaacaccaaccaaaaaucacaaaacuuacuaucaguaagaugaggcuucauuuuaguacuagcugccugaguuuaucaggacgugugugugugugugugugcgcgcgcguguguuacagucuuuuauauccccucuuuaccauuuacuuucauccaucuaucuauuugagucaggauagaggcuacauagagaggauacauacaggauagaggcugcauguagcccuggcuggccaggacuagcuauguagaauaggcuggcccagaacuaagagcucuagcugccacugccuucuggguguuggaauuaaaggcuugcacuacuuacuacauccagguaauugucuugcucccccaccucucaaaauaauuacauuugaucuagcuugacauagagccaaggaaacugaaaaaaagauuuucagauacuucucggugauguaaaaguucaccaccuaugcauaagucucguguuucccaggcaagaagucuccgggaagcagaauuugcuucugagauuucugucaucuaaugaguuagggguuccccauaauggcuugacaacccacccccuauacuucuguucuauguaccacaugugggacaggaauggguuaaacuuaauuaucucucucucuuuuuagaaacgagguggccuaguucucccuuauuaagcccacuccuacccuccuuggccacaucuagauuugaacguuucagaggcuucggaaacaaaucccauccuuaggcgucugaucacagaaccaguacaaccagcauuccuaaaggaaaaucuaguuacuuagccuggacguugucuguuuucauaagcuacuggauauuugauuugcuaauuuccagugaguaaccugacuauggauugagaaaguaugcagaaugguauuuaaacuuggaaacuuccauggcugguguuaaaacucuaaggcacuagauauguauuuguaaccaucuuguuaaccaucaaccuugugcugaugucacagggaacauguguauguguguguguguguguguagaguuuagaguucaacacugaguguuuuucucaacuauccuccaccuaauuuuuuuuauacuuagacaccaaggcucaaacucaggcugucaagcauuuaaucaaaccccuaccucccagccccagcagggacuuuuuaaauuuuaaaaugauuauuuuuauuuucuugaaagccaccagccucugccaagcuucuuccacauguaagacauguucuaugccucguaaaaccuucuuuuuaagauggguccaguuuuccucagguuuugaucuuuucauccuacacuuuuuucugagauacugacaccauugccacgguaucaguggcccuuucuccugcugcuggaaacugaucccggcagauggcuuugcauucugacccaggucucuagucuauucaccacgucacuggguaauuguaccuucuugauacccaucucugagucuaugacuucuuuuaguucucacuguuacaacucccaagcuaggagacauuuguuuuccuccuuugaaugugcuguguuugaaugugcuaugcuaccuccuagagaagggguauaguauguuaucuaaaccagagagaacacucagaccccagccacccccugcguggguaauauggucacccugucaucaucaucaacuugaaaugcaagcuggcuccucuccuaauuaucuuccuuuguauucugucucauguuccaacucccucaucccuuggagacggugcacgcuuaguauucccaaccauuacaucugaaccacucaccgggucuugcugccuuucagacucaucaucacagcagcagcaugcaacccgucgaccuuuccuuucuuuugcccaugaucaauccggacagacugaaccacucacauauaccccacacauccuagacuugcagagauguucacauuucccaaauauauuuuggucaguucucaaugccggggaaaacuuaacuucuuccuguaaccacuuccgaauuuccugagcuaucgaguuguguaacugagccgguugauuccacgucguaacagcagcugaaaccuuaauguuucuggaugcuccugauuacuguccccauuugaggacagaucaucgucuaccaagccaucaauccaaaccaacugccuuggucccuagcaucaccuuucuuccuugcuguaucuaugacccuuucauagcuaaccucuguggaugucuagagcaagguaccuggcauuugguggacacucaugugcaagucuccuuugcuaccuaaauaucuccugucccuuauucuucuagccuggauuccugguuaccccccaccccccaacucccuccauuacccuuuccaucucacuggcuccaccuccuuuaccucuaaaccugcucuuucuggaaugauuauucucugguacucccuuccuuauuuugggagcacaccaaugaaaguggugaucucguacugucccauccuucucggcaggcccaucacugcuccauuuuuagguuucugggguuuauuuggaauaguuagcgaaugacggugacauacuucuugggaugucaaaauaagaaaaugucguaaccuaggaaaacugaggucaggacccugcauguguccuggauguacgauacguuacgguggacuuguaugauaacuguacaauaaaaugaguuuugcuuaauuauuauuauuuuucuccaagaaagaguuaaaguucagaaauacuauuccuucuuagaguuacuuacacugcucagaaagguagcaagugcugggauuccaagaguuaacagcccaucaguuccugagaguuugucacuuggcaaguggaaacaccuggcauaauuguguaaacauuaggugcucaacaaauauuugaguagaauuggaguggcccugacaucaaauccguacagaggcgcagucauugucaccaaaggucagcacauauacacaaagugauugguauaaagaaaaaggaaaacccaaacaaacagcagaggaacaucauucuugguaggcaaugauuacaugaaauugcaucagaaaucccugaagcuagaaauuguauugaaaaauguacugagaccaaaggaaaauuaauccuuucuuaaugaccuuuaauguggagccuacaugaauaccucauucaaaaaagugugauaaaguuagaaauaaagacaagauuacuuuucuuagacccuaggguaaaagucaguuuguguuuguguuugguuugguuuguguguuuggcaggaccaaccauuguaccuaaagcuagggugggggugcuuuaccaccgacguucagcauuugcccuuuuauuacuauuuguuuuuaauuuccgcuggcgacagacucucccucugcaguacagggagccuucggcuuucuguacacuugcaucagcuuccggauuagccaggauuauuggggcugugcaaccacacuggcuccugaaguccauucuuagacaaacuucuuccuuuggaaucaguaaguuccuuuuguuucugucaacuuggagugcuuaaaaaaaaaucaaacaaacaaacaaaaccuguagguaaaaucccaguaaauacaaguuauaugcaugggacuaccagcuguuggcaagcauucugugauuugagaaacaaacuucagugaagagcaguauuucccaauggugaacgauuuucacucaaggggcaucuggaaaugucugccggcaguuugaguugucacaguguggguagugugagagaaaugucauugucaucaagggggcuagggaugaugacacugccaaacaucccacaguguauaggacaucccuaugacauuguggagugugcugggguuaagggcccccaauuuggaggcaagaaagaugcuccaaggccaagaguacauguugcucuugcagaggacuuggguuugguuccgagcauccgcauggcagggcacaggcaucuguaacucuaguuccagggccucugccauccucauuuagcuuccaugggcacuacaugcauacgcugugcacacauacaugcaggcaaaacauuguacacauagaaaaauauauaucaaucuaaauuaaaaccaguuuuuuuuccccaagugucaggguucauaccuauagacccagcgcuugggagacaaacacaggaguuuucugggaguucaagguuaccugggccacagagcuuguucuaggccagccaagacugcauaauaagacuccauccaacaaaacaaaacaaaacaaaacaaaacaaaacaaaacaggggggggaaaaccucuauuugaagguuuguuuaccauuuaacuuuuagggaaccuacucuccauucaaggcucugccucuaauucugcauggacaaagaagcaaccaucuacccaccuugagagucuuccucuaaaguacaguuuggggauuuuuuuaucccucccucucucucuccuucguucucucucucccuuccuucuucccucccuuccuccucucuucuuccucucuccuuccuauucucucccugcuccuucccauucucccucuguuccuccuucccucccucccucccucccucccucccucccucccucccucccucccucccuccuuccuuccuucccuccuucccucccucccucccuuccguccauccaucuaaauaaaccuuccuagccucagcugcagccuuaaaauucugucaucaaaaugugcuuaagugcagggaacuuuuauugagacuucucauuuguaccaaauuauuuuaugaaucuaugaucucaguuuugcuacuguaaacuaccauuauacuuugggaggggguguuguagcuuaagauauucagugaauuuuaaaagcaugagagagggagaaaaaaaaaagcaugagagaaucuuaaugaccauugcauuccauuugaauuuuuuuaaagcugucagaugaggggcaaauuauuaugguuugaucugauuguaaguuuugguccauauagauuuacuuauagcuaaaacaaaaacuuuaauccuaaaguauuaccaucauguacuuugcauucaaagucuuacuguuuacuccuugaguucuguuuauuaugguucaucgucuguuuuuaucccacugugagauguuacacagguggucaaugcagagcacagacuuccaugaacucuuccuuaaucaccccuuguaggcaggauaggaaguucacauuaaggacuuguuuguaaagcagcacucugcuagguauagugacugaaaaaucacugucauuauggccucuguaccccaagauccucucagacauuaauagccacaugacuuuauagaguaaguuuuauuugaccaucuaucuucuccuuuauaucuguggaguccaaguucuuagaauagucuuguucaguuucugccuugggcuuuaagaaaaggcuacucaaggcugacgggagaagaaaacaccacggauguuagacggacaccaagugaaucacacaaaugaugaacgaaggucuggagucuuugucaguggaugagucgagucugaauggaaccgaugaagcagcgcauggcuuugcgaugugacugucacagugcuggcuuggcagcuuccagagcugggcugggcugucugccucuggucugaauaaaggaacuaacuugacaaugaugacgaggagaauugcagagacuuguacuugcccuugaggacacuggccgccacuaccaaggccuuauuagaaaugcugucucuaaaguuaauaaacuuggaucgcauauacauucagaaaaaaaaaaacaaaucacguuaauagucuucaccggauuccagacgaugugaggccaagccagugggguuuguuucgguuucugagcaggagauggcagagagaagagcguuuuuccuguauaggacuuggcugcugguaucugagguacaguugguacugcauugagcacaaggugcccacuaauagaaagucaucugaugacauaacccacacucuuggaaguguuauuuuaagggcuggguuauucagugauggugauuucaggaccgugguccacggucagagaguaagacaagagaagaagauauagauucuuguuguuuugacuggauacagugacucgcacccacaagagcuaauuuccugaugaagcugggaucaagauaaugucaucucuagaguaaaaucccuuguuuguauggaauuuaucaccgucucaugucaaagucaugacauuuaaaaucuuuaauuuacguauuaaguuguuauggcaaaagauauuucucuuacuagaacuacacggcaugaagcggugccaaucgcuuucuguaagaaacucagcaaaaugugaaagcauguaguucgguagaaggaagucagucuuuaggcaagugugaaaccacauccucucacuucccauauuuaugaacuaacauuuuaagggaaccggugaaauuaauugugaaacuagagauggugggcaugcccaauuuuguugaagccaggacaugaguguguccaaguagaugaggaaaggggagcccuguuagcaaauaagaucgucuggcuuugcaaucgaugacccuuagacagagagacucacacggggcgaaucgcagagaagaagagaccguaguguucagccauaaaugacaucugugccaugcucccauggcucagggaucaucacagaacguauaagagccaaagguugcagagcacuacuucaagaaaggguuccuuuggacaucauaggcuucgcugcccaugugaacccauagcagcugugacuacaugcagaagaccuguguaagaucaagccagucagaacucuaauguagggacuggaaggacucaggaagccccacuccuaguugaacagcuauugacaauggaaaacuucacugagagggugugucaguuuucuucaggggugcaggccaggguaggcugcccaugcaccaguggcuggcccuaugcuuaggcacauaccagcagcaccgcaccagcuagacugccugguuaauauguuaauaaauagcaagcacaugaaguugugagguagcuuuggaaggaagagacauaagagggggcagagagguaagauggucugaauuucaucaagacauuauaaacauggaugaaaaucucaaagaauaauuuaaaauauacauuuuuuuaaaacaugcuuuaacccuagcauaucuguuugcgccucuuuccucugacagggguaauguuagauaacuuguaucacagugcuuuuuggucuacugacuaauguacggacacauuuauaacguguagacuggaucccgaagggagguaaaccccuauggagcugaucuguagaccaccccaccccaacccugucucguucugccaaauuauaaaagcacucuucgggguguggagcccaguguccuacaucugcucaauaaucaugaccaguauacuguguucuucucucagucgacucuuaaggcuuugucacuguuguaacugauacugagagaugagcacaucucagaccucuugucuuagaugaggcugagaacaucuuaaagcagcuguugguagcaagcgagugaugauacuccuuuuuuauaugccuguuuuaucucuuaaauauccaagaauuauuuuaaagaugcaaaaaaaggaccaaaauauaagauucccuaugacuggaaauugcccauuaaauuaguugugguugacuuugguucucuuggauauuuuuaaauagaaacuuaaugacuguuuaaacuuucaauuuccacaucugaaaaccuuccauuuuauaucucaguuauauauuuccgaaauagagaagaauugcaaguaagagcagauuaaguuuuuaaucuucugcccccuggaauaugcuguucaucggcuucccauuguagaaccguugauugucauguuaaucggccuucagcagaauuuuauagccaguguuguuagagcuggagcugaguuguacaaguaucagauguaguaaugaaagacuuuggcuuuaugaaaauguguguccaggguauuccugggacagcggcaccucauuuaauugaggaguaugcagguccuaaguccauugacacagcauugccaggcaccuaucccacaaggcuccagacccauccacuacucaugcaauacucaugcaauacucaugcugacacucccuuagcaaugcaggacauagagcaucugaaaccgggaggccuucuaagucccuucagcuugacaguauuguuucuacccaugcaaauugggaauugaccauauagccauuuuagauacacauuuaugacauccauagucucugauuuaacccccuacauugaauggggauuuuuguuguuguugguuuuuuuuuuuuuuuuguuuuuuguuuuuguuuuuuuucucugucaucaacacaagugacaggcuuuuccuuggauucccuggauuuuaaccgucagguaccaguacaugcacacacaggcccaggcaucugugggcacaggaguucgagcaaccauagcagaccacggaaagcuuagaagguccuuggaauccuuuauuuccucuccauaucugacuuaccuauccuacuauuaccagccugcucuucuugugugcucuucagucaaggcauugauugggucuuuuguuuauuggauuauaacuaccugcucucucuuuuugucuuugauuguaaauauuaguuaaggcaaauaguucaagacuuacuucuguagccuggaagaccucguuauuuuacagauaaaugaauuccagugcauacggguguuguuauuggcugcuggcccccagccccaguuggguuccgugauaucuguucuaucuuuagaaacacuccuugaaguauuagagcccagggcucugcacuguuacuucugcaaauucugccagguuugcuucaccuaaucuguuuauccuguccaaauacaaucuuagucuaaaguaccuuaaaagacaaccaaaauuaguacccuccuaaagucuuaucauuaacuuucuccuaugcauucauacuucuucaacauacagauugaaagcuuauagccucuauagagcagcuacaguguggaacacgugaauacauaacccugauguagaacuccccaacaugcuuuggugaguucccaacauacuaaagagccaauaugcagggugaaugcagggaagucuugcuugaagcaauguaaguggauacaguuacagagauuguuuuugugccaagcccucauguaaucuaugauucuguguguguguguuccuguuguauauaugcaggugaauguaugugugcauauguauguggaaaccagagaacaaauuuggcuauuguuccucaagugcugucaaccuuguuuuuagagacaggcuaccacuggcguagagcucaucgaauaagcugagcuggccagucugugagccccagagaucauuugauccuaaccuccccacucugagauuauaaauguggagcaccauucccagccauacauauauauguauguaaacauuacauacauaugcugggauuugaggagggaaauccuucccuugagagggaaacaccuucugggugucagcccucuauuuccuccccaaccccccacuuccccacacauaucaagucucugcaggacuaggcacagccuuucccacugaggccagguaaggcuguccauuuagggaugcaggaucuauaggcaggcaagcagacaacaggcucaggaacagccucugccccaguuguuuaggggucccacaugaauaccaagcugcucaucugcuacauauguaugggggagagaagggggcuagguccagccugugcucaugcuuuaguuggucaaucucugggagcucucaaggauccagguuaguugacuguuggucuuccuguggagucucuguccucuguggcucucccaacauuucucccaacucuuccauaagacuccucaagcuccaucucauguuuggaugugaguuucugcaucucuucccauuggcugcuggguggagccuguuagagaaaguuaugcuaggcuccugucugcaagcauaaugucaguuaguuaguaaugucagggauugguucuugccccugggaugggacucaaguugaggcaguuugguuaccuauucccgcagucucuguuaccuuugucccugcacauccuguaggcaggacauauuuugggucaaaggcuuugugggugaguugcugccccuaucccuccacuggggauaguugccuaguuacaggaaguagcaauaucagaauccauucacagcuagaguugcccccuuagacccucugaggcuucucccaucguaggucucuggcacuuccuagagaucgccccugcccucagcugaucucuguucccucucccuucuucucccuacauaugaccuagccccacuccccucccacaggaacagacaagucucccugccuguaguccucuuccccugacaggcucauggccaguuugguguuuuguuuuguuuuguuuuguuuuguuuuguuuuguuuuguuuuguuuuguuuuugucuuggauaucagcuccuuguuucacagaaaugaaaggagucacccuuuucagaagauccaggcuucacuauuucagucuuggcaucccgucuguguguccugacacugaccccgcgcuucagcauuuuauuugcuccuugucuuuuucuccuccaguggaaugcgcaccaugaggaggggcaacuuacucuccuugucccuuugggaaccucauaucugacucaaguucuagcgcacguuauccaccggcuaacguuauccaucuucuuguguccauugucugugguuuuggcuuccacgaucuaaaaauauuaguuggaaguaucuaaaaauaagauucguaaacuuuucaguugcgugcugcuuugaguagcauggugacauuuggcgccaucugcucccuucugcucaggacaugagccacccuuucccaacagauccacacuguguaugggucuugccuguuaauaguugucucaguucugcaaccgaaaguugugguauuauaaugcuuauggauuuuuaaaagcauuuguuuaauaaugguuguaaagggcaaagaugaugcugacagcuuuuauauuuguuuguuuauugucaagagaagccauaaaauaucaucuuacaccgucacauaagguacuguucaauaacauacuguggaaaagagaccagauucauacaaugucuauuaugggacauuguucuaauugcuuuuuguaguuauuaguuucuuacuaugucugguuuauaaaaguaaauuuuaugagacauagaugugcgcaagggauaaaaucuauaauauguauggaguucagugcucucuacaguuccaggagcccucuggggggccuugggaugucuccucacacauaaugcuguuuaaaacauuguucccaauuaauaaaaugggauauuuacuguugaauaaaaccuauaaggcaucucaaaaucuuucucauagaucucugaauugacagcagucgugaaauacguuccuggguugaucagggacagaaacaagagcuguacaauuagacuucagaaggccagucucuguuucuacuccaggugauaauguaaaugguccauguuagccaugcacaaagugaggggccaucugcuccacuaucaguggucuuucaggaauuguaccucuucauuuuuuuuucaaugcuguguauuuaagagucauaagaaggccaauucaaacagacuguauucguggcccaaauuucuggcccuucauuucuagcugucuguugaugauccuuuuccaauaguaucugucagcaugucaaauccaucaugaucaaagccggauccauuaacgucugcuccuugccacugggccuuccugcuguaucccguugccauuaguaaccaucccuacccuuucuccaucuugaagcacaagauucaucuucccacuaaccccgccccauccagacggccaccaguucuguuauucucugaaaccccucaugguuucucagccuccuuggcugugcuucuccugaaccuucuccacacagccccugucacucugucaccugucugacccccaugccgcuuccagcgcacgaaugucgaugugugaccgcucuuccauccuuugacuuaaaguuuguuuauuacacgcuggguuccugugcauaaggauccagaugagucuucagccggugaaaacaaacucuuucauaguacagccauggccugccuucuguuuucugugaacacucacucguguucugcagccuacagagcucuuggcccucuguuguccccuuucccaugugcucuuuccuguagcuucguacucauauauugcuucccacuuuauuauauuuugauucuguucuuaagucugccuucuccagaucuugucucucucucuauauauaugcaaauauauuuauaaauuguuauauauugcuuauauacuuuauauauguauuguuuuauauauuguuuuuauauguuuauauuuauuauuuauauauagaaacaaaaauguuugauuuauauaguaaacugauaauaaauagggugaacaauaacuaguaguaaaacagggccauuauaucagguuguggcaauaaaagcuagucaaaaugcaugaauuguuucucucagaaacuuuucacaaaauauuuuaaguccgaggccgacccgaaggagaguaacugaagccacaucuaaugaggugacuuacuguguacuuagugucaucugucuuccugauagaacaaagcacucacagaagcagcuguugucagggacuucaccuaaaacacaagauguggccacacugagcgcacuacaugugacucuccaucuacccuugcugcacuguguaaggaacacugguguccugugugcugacucugaguuuuccagauacuucuugagaaaauucuuaucaaggcaagaaacuggccuugcugguaaaggaaaaaaaaaauuacccacaguggaaaagcccuuuuccuaucuaaacacgcauuccucaguuuucuggcuaccgaguccuuucaugaugcaguagugauaggcuuaaauuuauaucaccucuaguuuauauccaauugaaaagacucccuuacucacuucaaacccucagaaacaaaaagaagugggguaugugaggaucccugguguagcuuccuuucuugcuauuuuuuccgggaugagacaacaagacaugucuggucuuuccggaaaggcucuccugagagcauaggugcaaccagcaucccagggguucugcccuuucuuagaagaaggguugcagguuccuauggcuacgucacguaugaaaccaauguggcuuucauacaagcaggaagcuucccuuucuccuucuccuuuccgaggucgugugugugugugugugugugugugugugugugugugagagagagagagagagagagagagagagagaggcuugauuaguuucucacuuuaagacaguccuagaaagcuggauaagcauuuagcucacagaucaccugcaguuuuaugcuuguuaaaagaaagcagaagagaagacugggcacagugucccucagaugcuuguguucauggugucuucuccagcugccuucauucaauacuuuucucacggcugggagcaaacaccaggacaggcuauaaccuaaagcuucccgugaaagacccacuucuuuuuuuuuuuauuagauauuuucuucacuuacauuucaaaugccauccugaaaguccccuauacccucccccacccugcuccccuacccacccucucccacuucuuggcccuggcuuuccccuguacuggggcauauaaaguuugcaagaccaaggggucucucuucccaaugauggcuggcuaggccaucuucugauacauaugcagcuagagauacgagcucuggggguacugguuaguucauauuguuccaccuauaggguugcagaucccuucagcuccuuggguacuuucucuagcuccuccauugggaacccugugauccauccuauaggugacugugagcauccacuucuguauuugccaggcacuggcauaguaucauaagagacagcuauaccaggguccuuucagcaaaaucuugcuggcauaugcaauagugucuggguuugguggcugauuaugggauggacccccagguggggcagucucuagaugguccauccuuucaucuuagcuccaaacuuugucuguacaacuccuuccauggguauuuuguucccuauucuagggaggaauaaaguauccaugcguuggucuuccuucuugauuuucuuguguuuuuggaaauuguaucuuggauauucuagguuucugggcuaauauccacuuaucauugagugcauaucaagugacuucuuuuaugauuguguuaccuuacucaggaugauauccuccggauacauccauuugccuaacaauuucauaaauuuauuguuuuuaauagcugaguaguacuccauuauguaaauguaccacauuuucuguauccauuccucuguugagggacaucuggguucuuuccagcuucuggcuauuauaaacaaggcugcuaugaacauaguggagcauguguucuucuuacugguuggaauaucuucuggguauaugcccaggagagguauugcuggaucuucugguaguacuauguccaguuuucugaggaaccaccagacugauuuccagagugguuguacaagcuugcaaucccaccagcaauggaggaguguuccucuuucuccacauccuagacagcaucugcugucaccugaauuuuuuauccuagccauucugacuggugugagguggaaucuuaaggcuucucggccuccugaaacagugcuaccaccuaggaaccaaggguuccauacacgaguguuugggaaaugccucucacgcaggccauagcacagcuuuggacaguccaaaugcucaucccuuagucaucccugccuguccuagauaguguuccugaguucaguuccccuuuugugcucaucaccuuggacugugccaguagaccaccauuucuucaguucguagucuuuuuuggucuauaggaugugcguaccaggagggcagagacauucucugauuuguuucucgcaaugucccccagauuuugaacaugcccccaaacuuaguaugaagccuauuguccaaauggauagagaucauggauucccugaucuccauuugcaaucugcacacggucggucacccauacucaccaagacccugaucuucaggaauuuguuccuucagagguuucuggcauagccucugaugaaccaggauuuuguuuucucacaucaagaauuuagaaugguucuaggacuuuuuuuucuuucucacugcaggugcuucuacuuaauccugcacggaucauaaagcugucaggacaauguacuuuauauuauauaucacuuuucuuacuuccaagauagccuuggggggaagaaaagcacuuuagucuuuuacuguaauuauaguccagauuuagaagccuugccagaauaucauucuaccacacuuuuuuaugaugcugaaauauuuuaaagaaaaguucaguuaagagcauacuaacuaaauaugucuguacaucucuaaaacugcugcucugcagaacacacugauacccucucacccacaaaauuaauaaaaaaagaaaaauugauaccaggaaguacuaaguucacagauuugucuaaacuguuuuucaugguuuauuuuuuauauaacagauccuuccuaacaacagagguuuuuuuuuucaaaaauauuuuaugguugggguguuuuugguuuuuguauuuuaccugcauguauaucuguacaccacauagaccuacccgacaccccaugcaguguccaaccuuugaacuuccaguccuuccugccuguuguccacuccauuagcaagaucaaacaaguaaaaaacgucucuggguaugugaaguauuaauaugcuaaugagcagguaggauguguguucuggagaccaugagagaauuucaagugcaguguccaugagugacccugagcaagucagaagaugccauaacuacugaauggcaaagaguauagucuaauggaggcauucaagguuggaugaauggcugcauugccuauuuauucauuaauuuacauugaaccugccuagaucucauuuacauccacauuuaaccacuaaggaaaaagcccugguuuccuucugucuuuccucuccauuaaaacucagugucccugugaacuuuuguugggaucaucguuauuugcauauuguucccaauugcauaaugaaugcauauuccugacucaucccaacugcccaguggccucuggccugugccagucacuuucuccuuggaauuucugaagcgaguguuaugcaaguccccuguugcucacugagccauuaguagagacucucucacccagaauaggcauuacuaaaugugugaugacgacucaguccaauuucaaaccaagguugggaccggcagcucacucuuaauugccugagucaugcaguuuugaugucucagucuuuaaguuaaggcuccagcuggguuugagauccuuccucagcaaggaauacuuuagcugcaaaugucaaaaaucgccaggauugguucagagucuuuccagugagcugugcuuaacugaugguccacuuugauaaaucuaaugccauccgcucguagcuggcaggggcuucugccuuucggguggucacagaagcuaggaguaacaaggcaaagaaacaaagacacaggggcuaccuuuucaucuggaugugacuucuccaugaaguacaggcauguagccuggcuucugguuguuuagaaauugccgguugcaaggccuucuagcugcaagggaugcagcaauguggacuaaugggcuauuugguucuuauccaucuccugucaagggaggggaggaaggacuugagaaugaccuuggguaacuuacacaguaucugcuacaaggaguuuaugcuuucuucccaagggaaacauacaucggauuuuguuuuggaaaacuucuaacugaaaauuugauaugccuugcuagcuagcaugugucaccaaggcaacuacuccccuaucugcaggagauacggccuauaggguucugucaucacuacauuguguauauacuuuuuguugcuuuccuucuguagagugugcacucauccacagaaagaggucauugacagauuaucaacagaucaugaaaaagauggagugaucauaacgauaguguacuaagaauuacuuaaagguuaugaauuguuucuggauuuuccacuagauaguuuuuuagacgguguuugaccagguaauucagagugucaucacaguauuguagaauaaaauaggaacuacauuuuaagucuauagucaaaagaagacuuuuuguguauguagaucugaauugaugaaguaaucaguguagaggauaauuugccucguucaaccugauucagugaugccaugacaaaagguacuauagauaugaaaagucauagccguguuuuugcuuucuuuuguuauaauuaccuuuauuguacuuguaauaggguucuuggaagagggaauauguuugcaaauugcaggcccucaaauggcaguuuugcuacugagaguuuuuaugccagaucaacccacaaguauuuauaagaaaaguuguuuguuacauuaggaaaaucuacuucaagucuuuuuuuuuuucugaaaaaggggugugcauuaacaaagaacucauaacacaacucuacagcuuugccuaauuuuuaaaaccaaaaaugaccugauagucuaaaucagaacaccuacccuuaccagccacccucuccugcaauccagguuucuucucaccagauccuacaacuccugaauucaucugcuugaacauuugccuauauucauuguuucuguaagugagugggacaugguucaugucaguaaggacaccauuuaggaggccgaggcaaaagguuccuaaugauaucaaggucaucuuaggcugcugaccggaaccuucucucaaaccaguauaaacaaaugaguaaagaaauaggcuaagagugaccuuguguguuuacuuuuggaaugggaguguucuugacuucaccuuccuugggcuguccuuuguugacgauuuccuggggaccacagaaaacaagcuuaccuucuuccguguuucuucauguucucugcaaguaacaacaaugaucucagacauugcuuuucuuuggaacacacugacuuacucaguuggagaacucugaauccaacgaaggggaaaacaucuguucaucucagguuguuuucuuguguuauuggugcauuggcguuuguuuguuuguuuguuuguuuguuguuucugucuucauggcuguauuuucucugugucucucacuuugauucugggaaucucucacagacgcuucugucuuccucuucuucccguacaucggcaugcauaggucugagccccaucuuuuuucagucaugcuccucuggccucuuauuggucacaacauguugggaacuggcuuuugguuauuuuuaucacugcugaaguggaggccagauaguagaucgcauucucguacccaugaauaucagaacaucucucugccauuucuuuucuccgguuucuaugauagcaggaagaaagaaaaacaaacuaaauguuuacaggcugugaaacaacaaauaaaacuucuaaagguccuuuauucauuuaauugggcaggagguaccaacacauucaauuaucccuuacuucgugacuucaaaccccuaccauugugcccaacagaggaauacauguggcccccacuauccuaucaugcagaauagcuucacagaccaaaggacccucaaugaacugugaguucacuccucccugagccuccaccccacagccacugaucuuuuuacuccagccuuuggccguacauggaaugucagagaaugcaaauggcaaaacacuuugcuugacuuucaaaacaaggaaugaaagcuggugugugaauccugcugccuaaggagacucccagguggcagcaucauaugcaauuaugucagguucagccucgugggaaauggcgauccaccuucaugguagccuuuauccuccagcaaaguacaaccuuucacugugucacuggugacucacugcaccuccucacugcacucagauacucuuaggauggccaggagcuccuguuuccuuaguauuucuuaguauuucucacuuuaaaaccuagagaaagcauugguaauauguaagcugacggccuuugcaguugggggaugggaugagaguguucugccaucuuaucaucuuucugugacuguuucuugcccggcuugugaagaaauggcucugccucacauuuucacagacuucuccccgcccuucuguuuucuguugcugugcucagcuuuacacacccaucucaccuuucuuacaucacagaagaaacuaacuggccuuucagcugguggcagaaaaacaucuuucccgccugcuaaugcuuccuguuagcccuaaaagcuccaauuagaagucguaagagggacacguucaagauucucggagaagaugcagccucauuaaaacacaauugugugcuucugcuuuaaauaguguccaaauagauaagugaauucagguccgccuaaauuuaauuccagaaaucaaagccacagcaauaagaacuggaccugaguucucuuagggcaaguaauuuaauuucucagccaguugaacuauuaugcaucucaguucuuaguuauuaugacaguaaauuaugccgacagaggcggugaggggugaugugcauauaauuucuucuuuuuccuggcuaagcacacaccagaaugcagaugucuuaaacagcuuuucccucagccaaggcuuccguuuggagcuuuaaaagcaguguuuacguaauaacggaagauggauagacaccucagggaauccagcuguguauaugcuucacccuaccugacagcccagggcuaaccaaauccuggacuguauaccagugaugaacacugucacaacagucauggagugagaucauggguaauucaugguuuauagagaauccuggccuggacuuagcuuuucucccugccauugcuuuugcauuaccacugacaguggagaaacaaagggaauugugacugauucgauuggacaaagaggggauuccagacacaaucaauucaggaaucuaccacccuucacuagaaaaacagccuugagauuaaguaaaagaccccaagucaaaucugcgccagcuguagguuuaguuuggaaauacgccaucggugcuagaugugugcacagagaguuuugugcaggcaaucaagaaaucaauuaguuuacccuauuuauaucuaggcagauggaggcuuauccuaucugauuauccauuucucaccuauuucuucauggucuugaugagaaugugaaaaucaguuauagucuccuaccuaucaacacauuaugcauuagcacuucacuaaauuauucaucuuaauaauuucuucuguacauuuuagucaaacguuucagaauauguuguguuuuucaucguauuucaccagaguuggggaaauguccccuugaagagcccaacauaguuuuauaggauuuuuucaaguccugcauccugggcuugcacccaagggccugcuaugcaucauucauuacagaaccuguacaaaguaucccuggaguuggaggaaaccacaccggucccuuggugcuacauccaucuccuuggauuuccuuucccuuucauuuucaggacagcaucucacugcuacgcugucagacacugacugugagagucuuucaaccucuggaagcaugugagaucacagcugggaccauuccagucucuagcucacaugauacagucuaugacacuggacgcacacuccuuuagagcugagcuguguccuuccucaacacauccagagcaucauggugucacagcucauacaaccuccagauuuccauugccuuucccaauggaaaagcacacuccuucuugcuggccacacuccacuucggggugauaguuuccgugugcccuguuuguugguggggacacugaccuggccauggccucuuuuccacucucuuguguagugcuucucauuugacacaacugggccagagagucucagucucagcuguuugucuuguguuggcuuuuugaugugguccagcaugucucuguccuuucccaguaggcaauacaggguaggcucucccugcuuuuaucuucauccgugugcucuuggccaagcuggcauuggcagccaguugcuuuccgcacagguuccuuaguaguuccuuaaauuguguccuagacauguccuuucacgauuuuaucuugccaauugcuaccugaccuguguguguugguacauagauguuuacagccauauuaucucucaacagucuacauaauuuugccuugaccgaagcgucauauaauuggagucagaguaucuucuuucugcaaccauuaaacgaagagcuauguccacuugugaaacauuuuguggaccucagauagaguuccuacuuaacagcauuuugaccuuccuaguguuuuuucaucaaucccauacucccucacgcauuaccaaagucccuugauucuuuuucuucuucacuuuccuaaacuuucauucagccgagucucucacagcuauuuuuuuaucuguucuuccagugaagacaaaguaguagaagucgccgaagaggaggaaguggcugauguugaggaagaggaagcugaugaugaugaggauguggaggauggggacgagguggaggaggaggccgaggagcccuacgaagaggccaccgagagaacaaccagcacugccaccaccaccacaaccaccacugaguccguggaggaggugguccgagguaagccgcuguuggauugcuauuuaacugcccugggauaagagauuucaaucagugcuucccuucuccagcccccugcccucaccucccucccaccacucccccaaaaucacaaggcuucuuccucuugguuuauugcugguguugguuugguugcuauaacaagccguccagcaguccauuuaaacuaaaacaaaucucgcuugcauagucacuucuaugccuuguguaugcuguugaaggaguccuagacuauauuuauauaagaccccaccuagccagaaggcaucaaauuugaaaagugcugaaucaugcccugguggugggccuucauuguucagcacugcccguugcaucuuggaccccugagacugggaacuccuugauuggaagaacuguaguuugggucauucacugugcuggacuuauagacaauuccaaugaaguuugcucgugugaauagcuuuuuauuagauuuuacuaauuuuacuaaaucuauuuucuuuuuguuuacugagucaaacuuuuaauaugauuugguaagaaucacuuuauuucgugcugugaaguucaacaugggcaauuuguguuacuuguuuaaucgggacguaugucggcaccuucuucaaaacagguguaauucccaugccucagcgaaugccccucccgagaauguuguaaaccaaagaaaugaagaagacuuuucaucuccaggaagugaaagcaaauacuuugauuauguuaaacaaaccaaauguuaugccaacuaguguguuuggggguuggggaauuuaaauggguauguguugguuuuuuuuccccacaguaaaaucugccucuagaucuagacugagugaacauggguugacuucauuuuaguguaaugcagaugauguuagcuuucguccacaaauguuaaaaacgcaguaagauuuccuuccuuuuugauuaugguguaaugauuacagcucauuagaguuuaauaugagacacuguccaacccaaggacaucgcuaauuauuauuacuagcccucccucucccuuugcugcauuuuaaagaacuuuauugagguaagauuuuauauaucauaauauuaacucauuuucaauauauaagagagugacuuuaauaaauuuacucaguuguuuaauaucacgguaaucucgcccagggccuuccagcacccuaaugagaucccuucugcccacucacagacuugguccucgcucaugcccauaaauggcugggcuacuuuggccuccauugaguugccuuucucugaauacuuaauccauaacugagguuguacccggcacagcuuaauggcugacuugugucccuuaacaguguuuucuguuuuucacuuggaguuuuugguuagugacgaauugaacacuuagaucuaauggaaguauucuauauuguuuaggaagagaguccaguuucagguagaugguuuaguuuuaucguuucccuacuuaagacagcaugugcaaauagagguauccuugaucugaaugaaaugcucuucuucaaaugcccaaggcaucuuuuuccaaagaaauuuucaaaugucucuggaggccaugacugguagaucuggccuaaugaauuuuuuagcccugauuuuucucagcaaggaaagagguguuuuuuguuuuuuuguuuuguuuuuuuguuuuguuuuguuuuguuuguuuuugguuuuuuuguuuuuguuuuuuuuauuuccccacucuggguuucuuuucuuggagucacaucacagugacugauaaucugcaaugaagugaggucuucagaaguagaggacacuuguuggcugccuguaagucugaauggcacaggugaagaccacacacagccucaugaugaccaugagcgcugagaucuaggaugaaaucaaagccaaagaaaugcaaaaccuucuacucuguaaauuaagaacacagagccuacuucagaacaagcuuccagguuggcuaacaaagguucuuaaguagauggcauuuaagcaaggcaggggaagugucgccagguaaauuuuguuaugacgcacacacaucacagucagucggaaagagcaaacaaacccugugcucugguggaagauaaggggcaugcuugggagacaggacuaguugguacucuguggaaaagaaucuggaaaaacuggguugggacagaugcugagaaugaugggaaauggagugaauuugaccgucaugagucacaggggaacacggaguggugaucuuaggcuuauauucuaaucaagauggaauuuucucgagaucugugaucucguuaacuuucaagucuuguuauuuuucugaauuaguucuucccuuucucaguuucacgaguaccuuugaauuuuagauguuuaguuuuaguauacaguuuuccauguaagguguaauuuuuagaucuucagacagaacauauaaagacaugaacacuauggaauuuuucucuagaaagccucaaguucaagugagaacuacaagagaucucuaagcaagauguuuauaagaaaaaucuaaagcaagcacuaauuuuaaagauaagcaggagcuggggauuggcacaggagauagaguacuugcuacaaagguaggaagagcuuaguucaaacccucagagcccgauguaaaaaggcaagcaugguuaugcaagccugcaacccagagcugaggacacaggaaguuuguugggggauauuguuggauguucuguagaagacucuguguggagaaaauaagacaguguuaaagcaagacauccaacauccuauucuggaaaauacagacgaacauacaacacacacaugcacaaacacacacacacacacaaacacacacacacacacacauuaaugcuauaaaaagguuuuuuuuuaaaugugagcacauucacucuauguaaggcuuauggaguucaccaacgacauaaauucaggcaaaucuuuccgagauguuagaggaugcucauuaaugaugcagauguaggauuaaggcagacgacccuucccuguguauuccuaguguagaaggcgacugcuaauucuucuccuuaguaggagccccagcaauggcagagccgaucgcacacuuuguaaaacccucccugcaaagccggcuuccgugccugggaagcaaacacuaccugcagagaacagauuaguauugcacucuuauuaucaacgucaauguuuucgccucugaaaggacaugaaugugauuuaccaccauucauagaaagaaaaaucauuucaccauuucaagacuccggcaacuaagccgaguccuuacugggcuucuuaagaacucgguccuuucauagcccauuggcuccugagaggacuaagcagagggaaggaagcagaagauauuuuuaccugaucauagaacuucuaaccccagcugccuguucugcauuacugaguucagagagaaggcaauucuuuggagguaagcucguuacugcaaaauccaucugguugcuaagcuuugcuaauuaggaagauguuggauaucagucaaaugccucaaguuguuaccaguuaagggaagcaacagucuuagacucuuguucucauuuuuuucagaucauaaguccgagaugugaggguuuucuuuucugaagugugaauguuguaggaauuggcucagcuuuggcuuuugaacccaauucugccuguccagaaaaacguuuuccuuaugguuauuuauucaguaaauauucuuugugcccugcugcuggcuaaagucuuugcugcuguagaaagcauagcagggcuagcacagacaggcuuccaccugcuagaagcauccacguuggaguucuuuagaacuuagaagugcucuggcucaccguuucccuuguucuuuaaagccaugucuuagucaggguuucuauuccugcacaaacaucaugaccaagaagcaaguuggggaggaaaggguuuauucagcuuacacuuccacauugcuguucaucaccaaaggaagucaggauuggaacucaagcaggucaggaagcaggagcugaugcagaggccauggagggauguuucuuacuggcuugauucccccggcuuacucagccugcucucuuauagaacccaggaccuccagcccagggauggcaccacucacagugggcccucccagccuugaucacuaauugagaaaaugccuuacagcuggaucucauggaggcauuuccucaagggaggcuccuuucucugugauaacuccagcuuaugucaaguugacacacaaaaccagccaguauaggcuguaauucuccuuuuaagccuuauagcuguaguaugcaguagaaaaguuauuuccccuauuugaagucagggcaauuaugacuuagggaaacuuuaaacauacauuagucauauaaguaguaauugaugaagccaggauuuggguccacaugagcuaggcuauuucaguuucguuaaugcccaaaugauauuuucacuuuucuuucuaaauacauacucuucuguuuaacuugcaccuccuguaagugccuguucauuugcuauggacauggaugcaucuuuuauuucugugccguacauuccuggaauuuucuguuuuuaaauuaaacaauaguaaugaucaggugucaaugaucaguaauacaugacuaguggucacaauacuauauauauauuccagggaccacaaguagcauguuaccuauuuuuuaagacaaagguuuuccugggagacacucaaccccacuuauuuagauguugucucuggcuauguucacgcuauaaaagcagaauauagagcugaggagauggauaauuacaaaggagauuauacugucagaaaagaccaagguauauacuguuucuuaaucucagauauuguucaaagaaagaauucuacuuacuaaaaucaaguugauuucaguguguguaugugugugcgugcguguguaugcccauguguaugcagguacauaugcauacauguggauguguguguagaauucauaggacaaccucauucaugcauguagauauguguguagaacucauaggacaaccucauucaugcaugcaaauauguguguaaaaaucauaggacaaccucaaguguuguuccucggguggucccaaccaccuuuucuuguuucuagacuuuaggcagugaugggaggcagggccuuucacuggccaagaacugauccaguagacuaggcuacaugaccaacaagucccacauauguuuggaaugguaagcggucccgccuugccuggcuuuuucuuaaugugaauauugaacucgggucuucauguuugugcagcaaagaguuuauggacuaagccaucccccuccccucagcuccaucuguaguauuuacuggagacauuuaucauuuuauggccuugggccagucgaguaaccugcuuuuuauuugccuaacauaagugcugacguugccuugcauguuuuaagagugacuuuacaugaucuaugauaagcgcuuaccuaggaagacuuagacuuaguugcucaaguacagguugcucagauuugaauccuacuuagcccugcagccugggaacugcaaaauccugcacgaugcagcaaugcaaguaguccugcauccucguaugucucuguaaaacugggguugauaucuagccacucugugagaagcaaguggcuccuaguaaccccugggaaccauugagcccaguuucugacagacaggaaguccucagccuggagcguguggucacugcgguuguagucaucauuccaauaccuugguagauucagaacauuagacaacuaguguuuacuaccagucagacguauuaaagguaaaccaacagauugacauuuuaauugcagugugaugcaucucugaacuguugguacaacagagcugggguuuguagacagcauucuguuaccauuaaaaugcagcaugaacugggucuccugcuuaaaauaguuuugugugugaaucuauucccacauaucaagauauuugcaauuaaacuuuauaucuagcggcaaauugaacaagaugguacugaaugucacguuucaagaucgacuguuuauuccuuccauccauuuuaugccccgugggaggaaauucaucaguaaggggacagagagagagacacggacacaggugacuuuuuaaacacuuguguuugugaagcuaaaaucuccggucuaaacccuggcuggcuuauguuagcuggcugaucuugugaaguuauugcuccucuguggauaauuacugagaagcagcagacaaguaucaggaauugacaugaagacauccccaacagugaugaggcacauuuacacacugggcacagcauuauucucucggggcccagggauaugaacccagguagcucaggucuguccauccagaucugcguagccucuuuucacccuguguggaaaagggcauccguauccuguggacguuuugacccacugacagagcaucagaaguaaugcaucuaacaagcuucauaaauaaagccauguugcucuguaggguauaaaagagacgaagcuuauguuucucccccaucuccauugguauggcucaauaaaggcaugacacaagcagccuggaacucauggguucuugcuuugucugucaugcucagcuuuuucagacuccggagaaacaguaaacauggcuugcugugagugugccaaggagcucaaagcucuaaaguguguuuggggguugaggggguaggaaaaagaacaguaguauguucguucuucaagagccagccauaggcuuuuaccucugcucuaacuaaggcagagaaugcauucacacauucgaaccaagguguggcacccccuuuaaugucgggaaaacuggugucagcacuggccauguaggugacagguggcagccuguuauuuugugcccuguggcauaacagucacugauucuaagccauuccaugcaugcuuugcuugggcugagggguccauguaacuguugcuuaacuguccuaaucuggaaagccuacuguagcaauuagugugcuuaagacacaggacuggggaaugagguuuacagagacagagagagagaguauacauauaugugguuuucuuaguuuuaguaagaacuucauugacauaauuuccuaucgacaaaguuuaguaaauucacaaagaucuguuugccauaagaaaauuuuugugccuuaaguaaugauuaugugucuacuuaacaguuuauaucguaaaaacaaaaaaauaaguuccuuaaaauguaaugcaacaaauuagagagcagguaacaugauuauguauguauacauuuucgccuuuucaauuaaucauuaacuccagcagaguguuguugucucagguaacaaagcucugguucuucguggaaauauuuaguucccuuaauauaaguguccagaacuuuaaaagugggguggauugcaaccaaaauaucuguuucuguugguuuucagcaaucccgcccuucugaagauccgucugugacuuccaggcauguaucagaguagcgugucuaucauuuuguguuuuuauuaggagaauacggagaauuccagaagagaugagacugaauaagucucaauguguguguguguguguguguguguguguguguguguguguguguguguguguguguuuauguaugcugaaacacaaaagacucauuguaugacuuuaaacuugaucucucugugucuugguugcuugugcuaggaucagcagccugcaccaucccugguuugacacuccuacuauguaagcagugacauguggaggaaacucuucucugaucggguguuuccucuuccaaaggaauccauucucccuaauacacugaggugaaaggcaaacccuggucaugggacagacuuuaaguaggaaugaugcuguucucaguuugaaucuuaauucuucucuguuagagacuauggaaggaagccagccacuguggaaaggugggcaugcccugucuuccucagacagaaacguguuuccagaccccagcucacuggaaguguucuuuuguucucaaaaguguugaugccaucucgaaugucuucccaggaaaacgcugugaaaaguuagguuccaaguuugcuuuaguucauuccuugauuuuuuaaaaauuuuuuucagcauuauuuucaaaauaacaaaauaauaauaauauaauaugaaaauaaaagcuguaguguggaagucgaagagggccacuagaggucauauuucugagaagugacguuuuuauagguuuaaauauaagagaacuauuaucucaguauugauuaaggcagaaguguugugguguuuuuaaaaacaguuaauuguauagaguaggaaaaauauguauuggcaaucuguuuaaaaacaguucaucuguuaucuuucuguauuuuuuauucuaagacucuucucauuucccacaugaaccaaacguuuuccaauuuuuaccaguuccuccccucucguccuaaggugcgacugugucucuauauuuuuaauauaacacauuucaacuacauuuaauaaguuaguugggcaugguggcacacaccugcagucuuugaauuugggaaucagacuggaggauugaucauagggguuuacuguguacaugagccacgucaugugaccuugcuucucuaaacacaggcuagaaagccacacccucccacacucgcuacagccuuucaaggugcuuagcauccuuugcaguucuucuccaggcaccuauggcuuucacugagccuacacaggagagaggggcguggcuggucagagagagagagagagagaggcguggcuggucauggagcguacuuugaugaaauuuuagcaccauuucuugccuucuguguuuugaggauuugggcauggagacaggaaauuugaaacuuaaggggaaagcuuucuuuuucugguagcuuuccauucgugccuguguuuuccugguguggcacugucagaucccuacugggcugugaaaacuaauuauuacuguagugaggaauuuugggagucauaaccacuacagcuugaaauaccagucgugggaguuuuaccuagaaaauagccaaaugcuacaauguauuuaucuucccagauacacacaauuuuuuaaagcaaauucuuccaucucauucgguuagaaaagaaaauauuuccccuaugacacaagguacgccuuauccuuacccuguucuagguuuaaacguguugaaaacauguuguguguccaauuaaccacagcugacaggaagucaagguucuugaagcaucauaguggucucugagcucgauugcagcagucucaggggcacugacugguguaaaacccauuuuacagacccaucuccuucaggugcuauuuuauaagaaaccuuucugcauagggaggugugagaaucaggucaaguguaauuacaaugacagagaacugcacaucucaauacaaagcccagccagcuugaggcuaccugcuacacugggucucaaucuggugguugugaccccuuugggguuugaauaacucuuugacagggguugccuaagaugauuggaaaacacagauauuugcauugcgauucauaacaguggcaaagacuacaauaugaaauagcaaugaagauguuaaugguuguaaauuuaaugguaauaauuuuaauaguaauuuuaauguuggggggucaccauaacaugaagaacuaugcuaaagguuguagcuuuccauuaggaaugcagccuuaggaacacugaggaccauugugcuggagacuucuauaaaaaauucacacacaucguccuucugagucuaugacuucaauaaugugcacagcugcucgugugauuugcugauauuucaaccuguauuuggaacaugagauuucaucuccagcuugcuggccuaauuugcaugauuauauuuagcacaacaugauuacuagauaauaaauauuugaucauuuauuuccugguaaagauuaauuuucuuaucguuuuuaugacuacuuguuagcauucacaaugcaugaugaaugugauuucugcuagaaguaugugauuguagcauuggaguuaacacguucuuuaaaaaaggaaccacuugggcuggugagauggcucagugaguaagagcacccgacugcucuuccgaagguccgaaguucaaaucccagcaaccacaugguggcucacaaccaucgguaacaagaucugacucccucuucuggugugucugaagauagcuacaguguacuuacauauaauaauaaauaaaucuuuaaaaaaaaaaaaaaaaggaaccacuuuucuaauguguuguuuuaaauuuugcuucaucuaugaaaaccaaacgaauauuuaccuauagaauauaguuuuuguucagauaaauuaggcucuuggaauguugcuauauugcaauuguuaaauuuguagcaauaacuuaauugggauuuuuaaaaaauaguuuuuucaugcuuauuuuauuaggaauauaauucuuuuguuuguuugcuugcuugcuugcuuguuucuucuucuugucgcugauaguuuagaacuugcucuguagacuagacuagccuugagccugucaauauaguccugucucuguuucccagguacuggaauuggcggguauucaccgccacaucuugaucaugguuguuuuaaaggacacugacaucagaguuuuccauuauuaugguugaauguagaccacaauuuauuugaaugaaguauugaugaucaacacacuguaguacaacuugaaugucuuuaccuuuuaagcuuuauuucacuguuaaguuagauagcaaagcuguauuugucuuuguucucuacaauuagagacuaaaauuacaaaaacgggguuuuaaaagagguacauuuauauuauguaugucucuguauuguguuuaauuuagcauguuucacagaacauggagaaaaucaugcuuugggaauguuuuucuccgcauucugagaaucugcaucuccuaauuuuauccaucaaacccuaguaucggaaggcgcuccauccaguggcugucugccggaugcuaaagggaggggcucacuuuuguccaguucuuccaggcucacacagacccaucccauccccucucccacacauuaugcauuugccacuguuuaauuccauuaccucaccugugcccgaguucuggcucuguuauucagugagugggagagacucugaggacacgccccuuguaccagagccgacaaggauggauuuugcugacagucucuguugacugaagguggugccaguggauccaaaacuucuguuccucuuguggccacacuacaaacccagugcaggacacugcuguccaaucuuggcauugauaaaaccgaagaagagacuacugaaaaguaauaucacguuaggaacaaacgagggugcuauaaagcauguacagucccagcccucaaaaggaacaggaggaggcccacaguaggaauaccaguggggaaugcuggaaucacgugauuccuccuagaaacuggaaaagucagaauuguuucagaugcuugucacauggaguggauucccauggaguucuguuugaggcucuccaggguuagaaacccccaaauaagagauggagcuauuguucuccuugcaacaaaaacagacauguggaaagucuauagagcucuaccuucuaauagggaggaaccuuuaaaaugcaagugaguggguugcugcuuuuuaaaccaauggggauauggaacugauuuggggagacaggggcaagauagacugacaaguaagguguguuuuaauguaagauaaugugugguauauauuaauaaauuugaauguguuagcuguauauguuacuguuuggagcaugacgggcuaagggucagaaaaaaauacacgaauagauaauuucuuagaguuaccaugguugacugucagucacucuugcagauguuacguacguuuucagguuuaguccguggacaggcuggaaacauuaaacauaaaugugauuacuuaugcaugagucuaggcgaucauuuacuaagaaaaacagucagaaguuggagagaacguaaauuuuggcaucacaucccgagaaauccuuuuuuuuuuuuuuuuuuuuuaaacaucagaguugacucaagguuguuuuagaagaugccuuuuuuuuuuaagagaaauuuuugaugugcagagagagagacuuuuuaucuuuaaauugagaaaacaaccuuuucacuucuagcccaaauccuguagcugcuacugcauccuacacauuaaacaagccgagaaugucuuguuuuguggaagaggugacucugaagucugagugggucaauucagucccucaaggaagacuuaaaguagcugcuuccuccguucagcccaggucaccacugggaggaucagggcuuaaguugaguaaguauguaugugaacagccagaagaugucuuuucucgcuaaaugugguuccccucugauuagaggugugcucugaacaagccgagaccgggccaugccgcgcaaugaucucccgcugguacuuugaugucacugaagggaagugugucccauucuuuuacggcggauguggcggcaacaggaacaacuuugacacggaagaguacugcauggcgguguguggcagcguguguaaguggauccuuccuccagccuggccaccucuugucuuucucgccacuggcucugcucuuuguaacagaucgaguuucccucuuguucuugggaaugggcccacuguugcuaccacuaaccacaugccugucaauuucucuaauuaccagaagccuccuccaccacgguauguccagucaugagcguaucucuccgucuaucucuaauaaagcauggccuuggauguauucuguaguagucaucauagagucuucuuucaacuccuaggaacuucugacugcuucucuuuacacaagggcuagaguggcuuuugucuucuucaguccuuccugcagaugcauagacaucugugucugucuauguucuuacaugucuucguguuucugcaugugcacaugggcaguagccucucacugguagcuggcuuauggcacugucuugauaagauugcuauagagaauuccucuuauuucaucaugguuuuuuuuuuuuuuaacuucauucugauaaugacauuuaauugaauugagcucaugucaccucaggugcuaucaugguguuucauugcugugaagagacaccauggccacagcaacucuuauaaaggacaacauguaauuggggauggauuauaguucagagguuuagcccuuaucaucauggugggaaccaugggacacauaguuagacauggugcuggacaggcagcugagaguucuucacccggaucggcaggcaacaagaagaagagagguacugggccuggcuugagcaucugaaaccucaaagcccacccccagugacagacuucuccaacaaggacacaccuacuccaauaaggucauacuuucuaauaaugccauucuguaggggccuauguggcccauuuucauucaaaccauuauacuaugggugcccaugcuguucccugaaugaaccucgagcacauauucuugccaaguuuuucuuuuuuucucaugcaauuagguagacgagaaauagggaucgggaccauuuaauaaaaacucuugccaugcaacugugaggaccugaguucaaguccccagaaugcacauaaaacaaaugugcagucugugccuaucuaaugcuagcacuugcaaagggggaugggaggcaguggcuggagaagcaccugaagacugggaccagcuagccuggccuauguaguugaaguagacuguuccaaacaagguagaaagcuugugaccugugacuaucacaugggcuccguggcgugucacacaugaauguguacauucaugugcacacaaagaaaagaauaaugcuagcaacuuucaguggcacaaggcugaaggaaauaacuuacagugucucucaggaaacauccaacugucucuacugugggagauaaugaugugaaguccugaugacuucaguguaaaaugaaguauuccccgcagagagucaguccccaagaagccaugucucagauauauggaauaucugcuucuauuaguagccuuucaagcaaaguccuuaguuguauuuguuuauucuugaucacaaguuggcuauaugaauuauucaagggucuuagugacagugcaugccuuucuugagagauucuugcauuuuaauucuugaauuugcagggagacauaucccuucccuuucccuggauaucugggaacauucuggcaauuuuccaaccaaaucccagaaccaagcaaaacaaagacuugcucucuuaagaccucacacugugagguagcuaauaucuguuugggaccuagaaaggucuuauuggucuccuaggagauaacuccacuuaaguacucugaggaaacuaguaguggagaggcucugacuucaauuggaugauuguagcuccuaguugaagauacccaagcucauuuucaccuagagguuaauuggguuagauaacugaaacacaauaaaggagucuggugccuggagccuuuggaacaaagggccuuuguuaccucggcucuaaaggguuuagcugcuaggucaggauuuccuggcaaaguucucagguuucccccccuuucccuaagguaggguuaguuucuggaauaucauauucuagcgaucaggaaguuugcuuuauauuauuagcagagaacaauucaacucaaguuuuggacacugucuucuuacccacccuaguguaaaccccccucaucucccuuccacuugauuacucugugcagggaguauaaaacauuauauaccuucaccagggguuggagcaugcauacacuuuauagauggauuuguaaaaauccagugccuucaacagggucuuaugagagaaggucuguaguccugauuucauuuuuacagagucggguuacaagguaucaaggaagcaaaggcacagcuggguaccagacucuggucugauucucagaaccuuuggaggaauaaggcaggggaugggaaggcuggagagaugcuucagucuucuuuuaaaaaaaaagaaagagaaaauuucaauaaaagcaagagaaccagcguucaggucuccagcaccuguugagcgugguauuguuagcacuuagaaggcagggacaggagcaucccuggggcuugcuaggcagccacuguagccaaccagcaagcuccauguucacugagaaacuuugucucaaacaauauggcgagcaaugguuggaaaagaucuaucugcucuccacacgcaugaauguguaacccugugcacauaagcauuacaaacacauacacuacgcacaguaauacaacuuuuaaaagaaggaaagggaagaauaggguugaaggucagguuagacggguggauagugaagaauggaagccucaucacauaucugagccagaccucagaagcguccccgugaacaagugacauaugcggagcuacugcugaggaaggcgcagagagaaaugagggucauuggugcuaaugagggaaaagagaccccuaaguccuccuguagauuucccaguguccugucaguggcagaaugggcagcaauuucacaauacugaucuuuacugguaacaaaucucaccugcauuuccuugguucuuuguuuagguuuuaauuuuaguuucaugauuucccucccagcccucaauuuuguuugauugcuuuugaguccuguggguguguuucugccaucauucccaccuuucuguuguugggguuuuuuuuuguuuguuuguuuguuuuguuuuguuuuguuuuguuuuuaguuauguucucucguuuucuccauagcaacccaaaguuuacucaagacuaccagugaaccucuuccccaagauccugauaaacguauguugucacugacuugggggaggggcaaggggaagacuauguugcaugacugaauguguccuucccuugcaucaucugcuuggcauggguuuugugugauuauugaccaggaaccuuuugauagauacuauuuucccauugucuugcgugucauuucauccgguuuuuacuaggcaacuucagauguugggcagagagcaucuacuuaaaccauuuacacuucugaacaaauuccuuucugauuuguguuguucugugaaauaccacacauagaguauuucuugauuuggcagaacuuuuuuuuuuaauuucccgaaagcugucaacaugccauaauuuaaugaaaucauauuugauaguacagguaacccccucccuaaaaauguaauauugcuuauucaagacaauuuugugugcacauuucaagguuccuguguuaaaugauaacugugcagcauugggaggugaaaggugagccacauagauuucaggacuccccuccucccccucccagagugcacacugguuggugugcuaucaggucuuccacuuagggaacuuaauggaauuuccuauaaaaagacauugcuucaaccauauaauauacucuuggucuuaacagcgucuugcuuucugguugcccaaucagucuaauuucauuuucaaaugucauaucuaacacauccauauucgcuuuuaaaauucagucuguauuuagaaauggauccccccucuccagggauggucuauauuguugguacuuacugaggcuugaagaggaaacccaauuucaguuggaaaugagaugauuaaaauucgccuuugucacgauuauccuggaggggauggggggauccuaaccucaaaacuaauaagaaaaugauuuuuaaaaaauguaguguagaugauuacaucauccuauacuguuauucuucaggggccuccauaagauauuacuguuaauucaaauaaugggaugauauuugaaagauguggguuuuuuuauugacacaauaagcccauguccugauauugugaaauuguuccucuaaaaccuuaagucuggcaagugggugguagaggacuagggaaagucuccgagcgucacacccaaagacuaggaaaacaucauuugugugugugucgcguuguucccaggguuuucaaagauugcagaucuccuucugacacacuuguguaccuuuuccuugcaucuuuggugccuaugagaaaauccgaggccuaacgcucucugugcguugucugcaggcaucaaacaccagagggccgugucugaaaccuaagggcacucuggcugggcuccacaccaaauggcuccacacuggguucugacauuuucuagguuagacaguuuccaagguucagaaagcacauuuucaaaaaauauaagaaaccacacaaaacuggaaaaugcuaacauaccuccccaacaaggucacacguaugaauaguaggcauuucucauccugucuugaaaacgaugguaauugguucucuuccauuuuauuuccuuucaguauguaaaaggcuguugguuuucacucuucuucauugauuagaauuaaacauuauuugauaauuuauuuuuauaaaguauacauaagguuuuccagacagauccuggaggcgucccuuucuccucccaucugcggugugguacagacccuaacauccuuccaucccggggggaugaggugauuuuugucagcuuuauuucuugucucccuacagagacuauucaaucacagcaagugaaggguuuugcagugcuaguaccaacauacgggagaaagcauauaauuucuaguuauuuauagcugugugguugugcugccugccuuauuuauagcuaagccacacauuugaauugaaaaagucauggucaccuggaggucaaaugcagaucgcagccucgauucugaggaaaugugugcagaaugagaagaggagcaggcagccuguuccacuggaaaacccaggcuuaugcacggcgucuucacccacuuagaguuaauugaauggcaucucuuugcucggaggugauugguucuacagaugcucugucugaagugcugcuagugggagaauaaaugcuaaguaagcuagaaaaggcccuuccacugaacugcuuuaagacuuuacauacagagaacugugcacugggaccgcaucaugaaucauuuccugacaagucuuaaugcucuaaccaggcacugcuagauuuuaacuucucccccacaaacaccaacacugaaaagcaccacaauuuucaggacacuuauuugucgugacugcucucccagagaccucugcaccacagggacagcgagaggccugagacugaagaguggucuuauuccuaaccauggguuccuaucucuuugaaaacccuuuccaucugaggugaagaaccuccugugucucagcagcuucggacgucaguucugcaucuauuugacuuaauacacaggccucaccuccaggcccucaaugcaguucuuguaaaauaguaaaguuauuagguaaagauuugaccagcuuauauuucgaaggugaggagagcguugccugucugugugcuaucuccaucagaccucauuucaaaagcaggcagauaaacuccaugaugaagacaaagaacauuacaccauuuuuuuuucugauuuauuuuuuauuuuauuuuauuuuauuuuuauuauuuaguauagaauaaaguuuauucagggcauggggaggggagacaagaggguaguagaggcagagaaaggcagaaagaguagagaaguagaagaguggaggccggccaugagcacauggagagagggggaagggaauggggagagaggacggaaggggcaaggggaaagagagggaacaagaagaaaagagaacaagagggcaagagcuacuuauuuauuuauguaugugagugcucuaucugcauuuaugccugcaggauagaagaaggcaucagaucccaguaaagguggcugugagucacugcaugcuugcugggaauccaacccagaaccucagugagugagcgcuccagggaucuaccaggcgcucccacuuuuccaccauggugcaguauaccacaguaccaagauguaccucuguuccagucuaguauucucuucaccccugaccugacugagaguggaacuacguucauauauagauuugugggucacagaugggagauccuguuaaaguauaaggaugccugaagccgcagauguuuaugacccuguuagaccaacuuccuagaucccagaugcuguuguucuuugacuacaagaucagaugucucaguguuuuuuucuaauguauuguaagcuacgguggauacagaagguagaccagcaagcucuguuaaucaugguuuacccgcauaccccuccccacuuccccguuuguuucauccugguuuccauuaaccuggcuaucuguagagaugcuggagacccuugcuucuuguuuaccucuaucuuggcauuguguuucuggucuuagguccaugauuacagcauaucagggggagauauggccccauacaugguuaaaacaggggaagagauggcuuuguccacacauugugugauccaguagucccgaaguaguuuuuuguaucagaagguuaugauuugcaaacaguagcugacucaugccaacaugaauagggucuaccaguguuacccucagccauuguccuuggcuaguuuugggcuauuguuuuaaauuauucuucauuuguucuucuagcugugaaauaauagccaucaauuuguuagcacaucauggaauacuaauaauggaacuaugcuauucucuuagacugccaaacuauaguaaaaacaauuauuuggcuaggcaugguuggcgcacuucuuuaaccccagaacucaagaggaagaagcuaauggauuucugcaaggcugaggccaagcugggcuccagaguuacuuccaggcuagucagagcuauauaaugggaccuauuucaaaauaauaauaauaauuauuauuauuguuguuuaaauaauucuugcacagauauguacuccuuccaucagcuacuugauaaaggcauggaagugcauccauuuuauuaaagggauugggcgugcuuuucugucaggccguagagucacuauccuaucuacacacugcugcaaccacagauaguaaauuaguagguagucaugacugugugguugccauggcagccagcguccuaggagaggccucuguuggugauguaccugcuaugcaagcaugaggaccugaauuugaaaauuugaacccccagcauucgaaugcggggacugcaacacaggaggagucuggaacccuggugcuaggguagaauggugaagccagacuagccaaugggcuugcuccaaguuagugaaagaccugccuuuaaaacaaacaaaaacaaaaacaaacaagcagguaaauaaaagagggaguggccgaggaaggcaccuuacaguggcuucuagccuuugcauacaucuacauaaaauggaaagcagcuagcagcaacaugucuacuuuaauacacagagagguuacuuuuauuagcccagagugugagaaugcuaccacuaugccucuugagagacucggcaggauaauguaagcaggccacauucaguaauuuacuuacaggaucagagauguggucggaaggauuaaaucucagcauaugagugaauugggaaagguugcucuggaaggcugugguaaauuuacauucgcuguaucuuuaaggcuuuaagaaguuaaggauccaucagcgcucacuaucagaguuuuugugauacgacugguagugaagacuggcguucugaacucaucuguuaaauauugaguaguuaugacuguucaugucuuugugagccacugcuaaugaagucaaggaagcuuccagcaaacuaagaagaaacaacacccuacggcuaagcgagucugacuuccaguuacuauuacucucauuuuaugucuuucugccuggugguuguucguauucaggcuaaagauagcauuuaagugcagggaauauagcuaugaauaaaaauuaugcuaacauucauucuucuacauucaucgcacauaucugauaaaaaaaaaugucccaugucaguacaaguucauagacauaaaaaagaaauguagcuugacuggugaagaguaaacagagcguagauuacauuuuuauugccuucuguccacguaggacauucauaguguucuccagcaacuguguucgaacuggccguaaaagaagagaggcucaagaacacaccucuuuaaaauccagugugcuguugaaagaucacucgcuucuauuuuccuguucauccaacucagacuugguagggguggccgcuauuuagguuuugaguggaauguacuaagaguuuuagcuaguuugaaauuagagagaugaaggaaacuuuauauuaaaaaaauguuuuaaguggagauggcaguuugaaagccuugucacguggagauuaaaauuuccuauaaaguccuucuuuauagguuuacaguucacucauacauaaauuacucacgcugucauagcccauaacucguagccauuucaagggaccgcauuacuagcucucaaucaaauagaauuuucaaugauaaggcagugaguuacauaagucuucacuguuaucuuugcuugccauuguuguauagauaagcugcauucugccaggggugggggauauaucaaauagaugcuauccguggggaauuuugucuaggaaucacucccuuguguuguaguuuagauggucaagggcauuacaccugacccccaccacacacacacacacacacacacacacacacacacacacacacacacuaacacacauacccagcauacacaaaacaaaauaaguaaaucuaaaacuaauauuaaaagaaauggugucaccuugcaaauugaggagucaaauggauaugaaaacuguagggauuuuuuuuuaauaucuuaauugucggugugaggaucgacuggagcccagucaguccucagucuccuuaucuaugcauucaagcaaccaugagucaaaaaugaaugccucuguacugagcauauacaagcuuuuuuuucucguuucucaaacaauacaggaagaaaaaccacucccuuuaauguuugcauuaucuucaguaauauaaacagucugaaaaaggacaguguagacauuagauacuccaaacuauauacaaauauacaaaagggaggugggcaaacuggaguuugcucucuauagcgaacccuggaaccaaccgccucugcacacacccaggcacaguuagccugcagggagcugaaaucacagugagggaaauugguguaugaagagucgggcucgaucaugccugucugugaacccucugagcugcauagugacuucagccacucccaggaaccucaguggguuucacuuuuuuuucuuuuuuuuuuuaaugauguuuuuuuauuagauauuuucuucauuuacauuucaaaugcuaucccggaaguccccuauacccucccccugcccugcuccccuacccacccacuccuacuuccuggcccuggcauuccccuguacuggggcauaugaucuucacaagaucaaaggccucucuucccagugauggccaacuaggccaucuucugcuacauaugcaguuagagacaugagcucuggggauuacugauuaguucauauuguuguuccuccuauaggguuucauaccccuucagcuccuaggguacuuucucuagcuccuccauuggggguccuguguucccauccaauagcugacugugagcauccaguaaguuccucacguaguaaggccuuucccaggggacagcaacuacagaaaauggugucguguucucaggauaguguuuuuugugagagaccaugcaucaugaagacucagaaauccgaaguaagccuguuccccaccaaccagaaaauagacguccaguggaucuuaagaagaccuaagacuguacagcggguacugugaccagcacuggugaaauggacucucacaugaaacuuacucucauaauauucaucuuccugggcuuuagguuuagguagcguaguuuuauuaugagaaaacagacacacccgugucccuucguguaugugaccagcagaggagggagacugcagaagacguguguguguguguguguguguguguguguguuagcgcucgcaggagcacgcauacacauauacauauacauuuauauaaagaauucuacucugaggaauuuacuucugugauguuuguggauacugguaaguacacgauugacuccaagccaugggaaucagaauguucccuguccaugggcaaagaccagugucucagacaagaauccaaaagcacacauaccuccuuuggccuuuuuguuagguucaagcucuuggagaagcgccugaagagaucuucagauccaguagccaaucuuauacagaaacacccuugcaugccuacaccaaaaugacgauugacucuggcacgcuguaacucauucaaauuggcacaugaaaugagcuagcauagcgcuauaccuucaugaagcagaguaaaugguaauaacaccauguguucauuuccauguuccuguaagaaaucuauuugaaauaacccugauacccguaaacauaccccacuugcucguauccugauuauuauuuuauucuuauuuuugcaggccuacauuuucacuuagcccaaucaaggcagguuuugcuaaggggaaccauaaucagauaguacuuacagcagauucugucugugccugugcguucccaccguauggaacagaaagugcagguugccuggucaccuccgccuguugcuauucuauuuacuaguguuuacuguagcuucucauuuucacucugccaguaagagggaaaaaaugguuagguccaugggaagcaaguuuugauaaggcgguuaggaaacacguguguauugauuugcuugagguugugcaaagcaaauauauuugucuuugguaucuuuucuguuacagacaguacuuaaaauugcagaucauuuuucagucauucaggauaagaaaccauauauuuuauuuacguccauguucuguguggacuauauauaaguugaauuuuucugggguuuguuuguuuguuuguuuguuuguuuucuggaaaauguguugcuuuuccuguaggugacauugcauaguccuguguucuaacuuauuuucagugaauuagaaguaaauauaucugauuuuuccccaagguuagcauaaaagauuucuguaggacauaaugguaggcaauaaaggcaccggcgugcguggaguuacccugugugacuaacacuuaauuguaggaugcaaggcauguuaucaccacuagauaaaaauccugggaugcagagugcucgggucacuugcccuggguaccagcugguguaaaaacauuguucacaccuagcugggccuaauuuccaaguccugaguggaccuuccuucccucucgccauugggcaaguguucccuuuuuuaucagcuagaugaggacaguuguuugagguuccaagaauaagccuuugccucccuccuucugcucgaaagccacaccugggcagacaucucggcugcuguuagguuuuugaaaaguuaugauuaaccagugaccacagaaaaaggaaagacaucagaaugcaugccucucguguuuauugaaacgcacucugguuucuguuaacauggucaaaccuuugauucuaaugccagucauuuucuuaaauauauagacaagguacuaucuccaugugaccuagcugugacuucucaucuauuugccauuggagauacugcaucccaagccucuuuacuccaagaauuugaugaacagugugaagagaauaugcgaaacagugguugauauuguugaaugaacauugaaagugauuugagaaggaugauaucauuuccugauaagggggaaaccuuuuaaaaacugucucuuuccucucugucuuucuugacucgcuuaaauacuuccaauucuugcaaaccacuacucguucgugaguuagaauauucuuguuuuauaguucagucuucgguuuucggagcauccccguugccagguaacaucacagugaguguggcaauucagauacugccuggcaguauugaauugaaagagaaaucacugucuauuugacgaaccuugcgaugaauuacagacuguugccaagugugugaaggcugaauguccuugcgugguuucgaaacugcacuuguugauguuuaugugacuuccugugguguucuagcucucucaugaaagguagcgucguaauuaggcugucuaaaacacaaugugcggaauucccaucucgccgagaugccucgauuuugcgaucgccuucuucucagauuccauuugugucugcgggacuuuacaaugaugcuggugauaccauuagcuauucugcagauuacaaaauagccaagccgagcaugaggauuugaugaaacauggccauauuaagcaguggaugcuggaggaaugccugucugggaaaggcauuuuuaaugcuauagcuuuuaaaugugcuuuucuugcuauguucuacagaggugaaacuugcuccugccaugguaaaaugucucugggugcuucuuucggcugcauuggcaucuacugugugcuccucuuucacacgauuucucuguccugggaaaugacuggcuuucuuacaaagguugggcacccugugucucuucucaacuugccucccaucuccuuucuaguucccacgacagcagccagcacccccgacgccgucgacaaguaccuggagacacccggggacgagaacgagcaugcccauuuccagaaagccaaagagaggcuggaagccaagcaccgagagagaaugucccagguagggaggaaucuuccauccucuguuguuuuguuauauagggaaaucugcgcucgccucugccucagcuggguagacauaaaguuuaauuuaaauguuugcugcaaggccacagauuccccccacaucuaucccugugcacggucacaucaaguaaaggcaaguacaagaggauuuugaagcacagguccaacucucugcgaaagagaggaauucugugaagauggugaggugagggcuguuaauugauacauuguaggaaacuuuaucuugugugugagucucaugauaggcuguguacuuuaaaugugcguuguaagauauacuuaaagaauaaaaaggaguaguucaaaucaguaaacuaguuccuauugcccacuaagcucgaggaccugaguuugauucccagaacacacauuuaaaaagccagaccuuguggccucuguuuuuaauccagggcugugggggcagaagacaggcagccugucuaaucugucuggagagguccagccccaugacguaagccguuucccaggaagugugagguacuagaggaagaacaccgacaccuuuaagcuaugccuuauuccuugggccaaauccuagcuaacuucuuuaucaggcuuuggguuccaggcuccaacccugcaacaggcacuauugcuuugugaaaucuccccaugccauagaacuacugcccagcugagccaaccaaacuaguuauuccuaagcuggcuuaccucaagucuuuacuccugccccuaaauacauucuaagguguugcucaguccucccgucuauccucccgucaguccucccaucaguucucugccugagauuggcccuggcccugugucccuguaaaucauugagucuucuucauagaacucaucuccugggcuguuggcaucccaaacaacaagaaaacccucauuuuaagcagaacuaacgauguaucucaaaaagcaggacaagguugcuauuucuucaaagacgacuagcaauaaaagaugacuagcuauaacacuuggcccuacucugcaguuguaacccugagagaaaagguuuuacaacuacacugaaccacaauaauccuggccaugaacuaucacuuacauccuaccaguuggccaugagcuaucauucgaauccuaccaguugcccauggggaaagccugaaagccaguugagcuagaaagccaacugaauggaacaggcaacuaaaagcaauccucuggaaaacuagaacuuuucacauuuuuuuuucauuagaaaagucauuuaggccaggcagugguagccuuuaaucccagcacuugggaggcagagacaggcagauuucugaguucaaggccaaccuggucuacagagugaguuucaagacagccagggcuacacagagaaacccugucucgaaagaaagaaaaaaaaaaaaaaaagaaacaagaaaagucauuuaggaagguguggaauugggaauuacuacaauuccuuccuuuuuagacucaagacugaucucauuuucugaagcuuucagaggcugcccugggcacauaauggggcagaaggccagaggaaguguaauaaacacugagcgcucccgugauguuuccagccccugccagggcacccugaugccagccuugccuccagcuggaagcuccuccccucuccggcuccucuccucucuggccucacuuugcucuugacauuggcuuacuuuagaagugccuuucuucuucuucuucuucuucuucuucuucuucuucuucuucuucuucuucccacccacaaaucucagcagauccgcugcugcacaucuugcuugacucagggcaagugguuacucgaaccuuuuauuugauucuaaagauuuauauaauaguuuacuuauuggugguuucuauaucauauguucuacuacacucuaauuccuuuuaaaucauacaaaauuauauaaggcauaccaacuuuauauuuccuccuuaaauccaugugaaucauuuuuuaaaauauuuucacuuucuccaagauauuuuuauguaauuaagaaaauuaguuucaaguaguguguuagcuucugacaugauauguuguggaaauaagaacacuggugagcaucuauuuaauccagggcuuaguucauagauuuccgggagacuuucuccaucuucacaucccagaucagggacuacuuagcuguagucauuccuagagcagagaaugcaccugguaguccccaguguuacagcguuagcugccaucucucaccauagucucugcugcucaauucuagggacuuuuugacuuugaacuugucugucucuuaaaucucuacuuaguaaucgucauuuucucugcaugacauagccaggccucuaaagaacuguaaauccugauagaauuggugccucucugcacacagugaaaaacugcuggacagggacccacagugcagcccugaaguucagauucagagaacuucagguuuucaaauucggagccuuccaacuugacuuuuguuguagcuuucaauuaguuuucuggguuagcccccccaaauaauggaccucaucucuuuccacugcaggggcaggggguuagggaagaugauauuuguauugauguugauggccuggugaucugaagaucuugguuacagugugacuggcaugugucagaugcagauaagcacacaugcaaaacccaagcgcuucaucacuguauuagugacuucuugguaugccaagcaaccugagaagagcaaccuaagaaaggaagccuuuguguggguguagaauuccaggguacaguccagagugacacagugagcauggugugaggcaggagcuugaggcagcagcaggucacauggcaccugcagucaggcagcagagugcauggccugcucucuccuuugccuccuguccagaaaccccagccacagcccagugcuucuuaaauuuagggugagucuccccacaucaacuaaccuaauccagaaaaucccugccccugacauuuccagagacuugguucccuaaaucccaucaggcuggcgagcaagaucauuggucacacuuacuucuauaucuaguccauuuagugugcaugcagaaugaaguccuucaaaacaaaaacuugcccgaugcugaguuuuuuaauauauucaguggcaucuuagggacagcuacugguacugacccuugacuugccuguagauagaucugcagcagcacacugggccaggaggauaguaggcucaucaucacuccucguccauugguuacucucacagcuuucuuaaacaggucuguagaguaagauuacugaguacagagccugcuguaaucaggcaucaauuaaaccagacagauuuuguaaagcacuuuacccaguaauauuaucuauuaccagugcacccuaguaaaagccacugguuaaggggguaaaucuucugccuacagcgugucuguaaguaguccuucagugacgacauaggccauggaugugugagaguagaagauguuugcuaaauuauucugaaaagucaacauucaaguucauuuauauaguaaugcauauuuucaauacauuaccuagguaaaucuuaauuauuucauggaucugcaauuccaagagggugauccagguuccgaaugucuaagauaagaugauagcaaagauacauaaugcaggggaaucgguuuucaugccccaguaagacauuuaguuucuaucucaaacuaauuuugagaugucuugccugaggaauucuccuuagaacaucgccacucgggaacguucccuuccauacaggaaauugaaacauuuuucuucccaggcucaucuauaaagcgaagcaucucuucaauaucuuuucguccaacgcugcccuuuauuagcuaauagaaauacucaaguaccuggaacaguuuguacauuuuccauguaucuuguucucaagaaacuaauuuaaaaaaaaaaaauccaacucacgugcugaucggauaagaccuuauaagccugguuuuccucacagauucgggagauggauuaaaaaguccacgaggaccuacucuguaaucaacuuuguauauugcuucaucuuccuccauuaggcuuacauuacagcaggcuggccugcuuccucaacuagugucuuaccuuucaccacauucaggagauuauaaugcauacuuucuggggcuuucuggguggauuuggaauaauccccuugcuacucaugacuuaguuacugaacaggaagaguccacucuucauuugugcaaggaauagacuuuggcauuguauuccugguuuacacauacacauucccaaaacauaccacuuggaaugcuuugacuugaugucguaaaagguuaaaaucaaugucuuaguuuauugaugggagacuucgcucagauggcauacgccuuuuauggguaaucaguguuuacucacgucaaguaaaaugacuuuccgacaguucucaaggaaaauggaaagaugaaccaaccuuauuucgggagacugcaauacauguaggcauuuauauucaccauaccgcuggcauaaauuauuuauauucuuguaggacaaauauuagucacauugggaggggcaugugauguuuuuuuaauaggaaacauauugucguauaagccacuguguuaaaucuguauuugaaaggacaaugggggauuuucauauugccuuauguccucuuuauaggucaugagagaaugggaagaggcagagcgucaagccaagaacuugcccaaagcugacaagaaggccguuauccagguaacaccccggucccaccuacaccagacagaacaugccacucucagccaucaggaccuccaggaaucugcuggaaaccccuguuuuauauauuuucaugaccuucacuuguucuucacuucuugucuuaguaauaaguugcuucccuuacauuuucuccaacuauuuaaaauuagaacuaaucaccccaaauauauucuauggcuugcaaucuucuuuccauuaaugauacaucuuuugagagacugaaguuuucagcuccuccaguaaccuuggaaaauuuaagugagauuaggaauuuaggacuaaacccagucuacacaugaccucguacaaacagagagaaacuaucuuugcacuaaucguuauguuaagaaacaaauauguuuguguguguuuuuaucauaucagcauuuccaggagaaaguggaaucucuggaacaggaagcagccaaugagagacagcagcuuguagagacacacauggccagaguugaagccaugcucaaugaccgccgccgccuggcccucgagaauuacaucacugcacugcaggcggugcccccaaggguaagucauauugauuugucacuucaggucacagcaucaaugaugguguccagacaguggagacuggaggccgcagggaagaagcuaggagaaaugccacaagcacuuuauuuguagaugugacuuagguacauuguauccuaaagacaugggguaauagaccaguguuggcccucccucucuuaacucuuuuggcaguuaccuuuauacugauuuccaugcugcauucuuauuuuucuuuaagccaucauuuuuuaaaaucuuuuuuaucuaaugaggaacuauuauacuuuuuugccuaauauagucaugaguuuucauagucauauucucuguucacauuuaccauguaucauuuuucuucuugggcauccuuuauguuuucaagugcagaugaaaugaaguuugaauucuuuggguuacaauguguauaagcuagugauuuauuuaugccugaaaaacaccuuaacuuuaccauugguuuuaaaagauauuuuugcuggguauagaauuaucagucgaagugauuuucuuuuacuacuuuaaugauguuugcuguuuucaacagaccauucuuaucaccucuacagauaaucuuuuguuugaucuggcugugcuagagguuuuucucuuuucacaguagcuauuuuauccauguaaaacgauggaauuccaucuguccuuagucucuuaugaccaucccuucaucucauacuuaagauuauguuugauauuuucgugcauaaauuuuuauuggcuaucauaaacuaugaaauguuguuggugcuagguacuuuuguauaacuaugaauauauucagacuuugauuugaaaucuagcuaguuuuccuagaagcagcuucacccuuucgcauuuugcucuuuuuagauauguuagguggagugacucuucuuguaacuuguuauuuccauuuucaaaucaggauccuuaauagucuaccaugaacucugaguuucaaauuggauugacaagaaccaggcagucaugugucugugggacuucaggcacuauuaccucuaaucuucuggguaccuuuuaccucuagccucuguuucuuauaccagcaggcacugaauaguccucagcuacagucaguuaguaggauaaccugcagaucucuuauagagcaccuguccuguaaagucuagccaccuggguuuccaaugcucuuuccuucuugggguccacugccugagagcccuaccuuguacagucagggaagcucagggaccaugguugcugacaguuguaggaccucaccuuguguaucuccucuuccucucugguccaugguccguacucugcagaaacuguuccuguuauguaguccaucuauuccuuuucucuggcaggagggugaaauuuuggucuucuuagcagaucuugaccagaaguggagauuuguccacauuauguaagggaacccaaacuccacccacccacuugugcugauuucccucaccacacugauaguccuuucucaguuaaggagcuccuggcauuccuccggguaucgagaggacacugguucuuuuguacugaugacaucacugugaucucggaggaugggguggcugguucagggugauaccaguagucauggacagagaaagcugagagucaguugccugcugcagugucucuucucugggucacacuuccucccugaacaaacagcuucugacaauaagaugucuauauuagcauuuuguuuucugugagcaaucucugucuuucccaggcaguacuuagugaaauccugcuuauaucucuuugcagaugacaagguucuggguuacucuuucuuuagagagcaugcuuuggugaggagaguugugggggucauuuguccaggcaagagcugcuagguagauuuuuaagccgcaggccugagucuuggggcacugacuccugugcauaaaguuaccgaccuugaguuauuuaaauuuggacucagccacugcagauagcucuguauuuuugaaagguguuagaaaacucucucuucccgauugccuuugugcaaaucucuaaaaagauauaaaucaagaguuuucauuaaaucuuguaauucgaucuacaaacuguguuuggauaugcugcuuauaacaaccacagagccauaacaggugaugagaaauaugacuuaaaugugcgcugacuauuugaacacaaaauuaaaagucaaaagguuuuuuucucuuuuaaaacaguuuaaucuuauucuaaauguuugccaagcuucauagacagaucuuccucaagaccagugagaaauacgugaccaggggcauauguguccuaguuuuaauuaauucaaacagaaaauuaaggaauaagcuuggaagcuuuccuguuucucaaaauguauuccuuaacauguucccuccagagaggagcugcccuccggcacuuccuucugggcacgucuucacgggcagcuguccgcaccugcagugcugggaugcucuguggaccauuccuggggugcuaauaucugcuuuuuucuuuuaucuuugaaagugaaaaaauuacuaugaaauuacaaguguuuagauacuuaaaaacauuuuauugcacacaaaugaaaagugauuguuaccagaguuugcccuagagagcagggaguugguaagauggccucucucucuuucucuuucucucucucucuuucucucucucucucucucgcucucucucucucucucucucucucucucucucucucucucucucucucacacacacacacacacaccacucuuaaaaccauuuccagggguacauuugcuuguuuaaauuuaacaugcauucucaucgaguaauaauaauaagugucagaauaagagugacuugaaauaaaauauaaaauauaaucaguucaguugcagagaaaguuaugauaaggagaauuuguaagcuaacuaguauggaaauauaaaguuucugauauguaacuuuuuucuuuuuuuaaaugauuuuggcugacuauuaauauuagugguaguaaccaagcugugagaaugauuagugguguggaugaggggucugagggaaacauaauugagaaauuuaggccauuuucgucguuuuugugauaacagugguaggcuaaggagacuuacuaagaagcuauaagagguuacguuuguucaggguauuuuuuuggaugauugugauaaucaaguuaaugggagaaguauuagugaugguaaaauaauuuuuagcauuguagaagguuaggguuuuguacauagucuguuccauacaaacucaucaguuauaacuggauucuaagaagucuuacuuuaguuuuauuauauaaguguuuuuaauuaaaaagaaaaaaaaaacagaaaagaacuuuccguuguuucacaacaguguaggcguuggaaaggagggaauguaguuuaagcagccuagguucauucaaccuuggauuguugcuucauuagagagcguuugaagaaagagcagaggaucucaaaugcgaauaugcaaaauuaaaacagauuguuguaagucacccugaaaaaagucaagaauaugucacagguggcauuuguuggauggccagaccucuuggcaaaccuuucccggggucuguguugcuuuaaaacaucuuuuguugacuaauucaugcuuacucuguaggcucugccuucuggguuguguuauuaagccuguuuauccccggagagcuucggucuguuugguuugacaaaacaaggcuuaaagaugcagaaguccauaucagaccuggccuuucagugcugugggguuggaggggguuagcucuguccccagugucuguacagcuaacauuuagcugaaggcaugggcuucaucgcagagcugugggcaagggcuaaaucucagucuaaaccgaaugucauugacaaaggucgcugguuugugggagaggacugcaaucagucuguuuuccaaagguucugguguuauauaaagaccuguguuuaauggccaagauagccauuuaaucuguaacuagggacaaguuacuuaacaaaggaauucuuccuccccagucugcaaaucgggguuaaauuuucaacauuguugaaacagcaacuagcguguuucuagcguugacuggccauaauucaaaaccagaaggauucacugaagguugagacaggacuguagagaguacaaagaugucuuccuucccaaggggucugcgaggugguauggaacacauggaggcuuuggugacuguccaguugggaagguuugcuucuuaguuaaagaggagccaaugggcgaugacguaucggaacuccuugcaugugcgacaugucugcucuagcagugugaacccugcacaaaagacagauuaugcaaaaccuuuccauguaacacaucauuauuaucugaacagaaagaagccuccaagaauaaucuauugccauuuucucuacucaguggaauuuguguuugaccuaccuagauaguuuucuaaagaaaaagauuauagauacauuuuauaucaggcuuuaaauuuuuucacucaaucacuaaacuuaacugcaaaagaaaaccuuauuuucuaaaauuugcaauguaaguuuccccaaucgguuuugauuuguuuccuugguuuauuuuuguuugcguucauguuccuggggucuccuucuggauuucuucuccugugacauugagaauauguauacaagguugauggcaaaaucgggaaucaaacucaguaggagacagcacaagguguagcucucucaagugugucuuuaaaccaccacacaguuguuucauacaguucaugucauaugcugaauacuuuuuguacucuaagauuaagacugcaaaaaucuguggccuuauaaaaacaggagaaaguuacuuuuuuuccugcagagcuaaaguucaagguuucagaagccauuagcaugcaauuuaauguuucagaaaggguuuuuauacuauuuaaacagggacaggucaugguuuccuuccauuuuguggacaccagccugguaucaacauguuauaaagacaauggauagauaucuuuuggaauuagugaaaugagccucauuaagagaaaaauuggauauaucuggacucuguuagguauuuucugggacgauugaccacuucaaacaccuucuuaaauggauggggauacugaguaaauacaccaaguggguuuggaauuucaguguggucuaugaacauugggagacuguuuuucucaucugagagauauucacuugcaugaauaagauacaaaggauaguuuacaggccagaaacacugcugaaauuauacuuggcucugagucacgcaucaguuuaauuaacaguaaauuauuagcagcuacauugagccaggaacuaugcugggaggcaggaauaggccaugccuuuguuccuaucucagaaugugugcauucugcuuugccgugaguucuugucuucugugcucucauuguggacgucaucuaauccguuuccuuacugcguaucccucaucuuuccagaaauuaauuuuuaaaugccucuuuuaaaaggcagugugaucccaaggugaaggaggugacaauugaaagggccacaucagcugcagagagaaugcaguuacgggacaaagaugcacacagaaacaaugaagaugauaauaagggggcuggguauaauuggucccaauggggcagaucuguuucuuuauucuuaaccaugaguuuuagaucccacccauugccaguauaaccaaauugcaguauuaauacuuaacugaaauaagaauuuccaaguaaaauacacaugaacacauacauguacacacauacagcacauacauugcacacacaaacaauaugcacaaacacacauacaugucuguauauguguguauauagagagaugcauauagauguguguguguguauaaauauguguguauauauauaugugugugugugugugugucacuaguuagagaaaauuucaagacuuaauguuaaugaauauuaaauuauuuauuaucaacauauuuauaaugagccacugaauuuuugcuuguucugugaacaauuccauuuugaaugugaguaacaucaggcuaacaguuauuaacaacaauuacuuuaaggcaauuuacuugugagcucucuauauagacacaguagagauaccaggcauucuuuuuuucuaccauucuuaaguggacauuuuuucuuuuuuuuaauuagaauuuaccaaauucaucuuugucccggcauaaucaaaugaagaucccuagacaacgaugguugcucauuacucgacaauggauuauauagcucuagaaauaacuaucguccaccuuggagaauuguggcugaaaguuguaaagagggcugucccucuuuacauuucauuucuuuucuuuucuuuucuuuuuugaaggaaaugcgcaugaaucauaugccaaagccaagccguuuucuuuguaacaaaugaaaacauaauaauguggggaaaugcugcuuguuuuuuaauucuuuaucuacacacacugucuguccucuaugagguccggacacacaccauuuuaagugguuugucugcuuguucuccaacguagagauugaucuaucuaacuuuuuaacuuucuaaacacgauccuugcaaauugccagcucagagcaaccaagcagaagccagcagcuaggagcaucuuacggucuucagaguuaucugaugucagcaggcuuugcucaugggggucuccagacucacaggaugaugaggucagagcucauucugagcccccagggcucacggcgcauacaggucuagggcugggggauccucgaggccugcugugcuauugcucuguaucaggcucugggggauuuucagggaaaguuaggaauaucuuuccaaaacacacaaagaaguagugguguuaagcgagauaagagcuugaaaccaugugaacacauucuuucuuuaauuaucaccaggcuuauuagaagauaaggaugaauucagaaggcagacccaugaauaucauaaaagcccaacuuguaccuaauaccuugaaucacuuuucaguaaucuucuaaugagauugacaggggacguuccuaucuucuauuucuccuuucugcuucagaccuuuagcaaaguacagccuccugccaagagccuaggaccagaaaugagauacaguaaucuaaauccagaucuucuccucuguuaaaaagaacugcagucagagugcuccacaaauucaguccuguuaucugcccuggccacaguuucauuuuugcacaauuuuaguuucuuauggucaucgcugucucagaauauuaaauggaaaauuccaagugccagccauaaguuuuuaauagcuuuuauuucaccauauugcuguuguuuuauuggggaguguugguguuuuacugacuaauuuauaaaucagucuucaucauagacauguguguauaguaccaagcacagucaauguacaaucgguaccugucccugaguuuacagaacuaggaauucagaugagaacucccagaacaguuuuucacucuccaguugcaucauugucaagccuaucugcgccuugauagaaaucuaucauguuaaauucuaagaugggcucacauaguggccaaggguacagagcuauggaggcagacagcuuuugggggaacacuaagugucuaugccaccuggacuugugugucccuuacaucaucccuucaggccaagcauuaacauccaacuagucaacugacgaaacuuuuucauccugaaauuccuacuccccuucucucucucucucucucucucucucucucucucucucucucucucucucucucucucucccccaccccccuggggacgguuuauguccauuguguauggcucuguuuguauucuaaggcacaggaacguggccuguaccccgcauauuucaaguacagagcaccaaugccggguugggcaccauggaucggagcuccugauggagcuccugauagacaggaagugagaucuaaucuggaccuguggcugucacuuugaagagagggaucuagcauaauaacggaguauacugaaugcaacuacuggguuuugaacagcaauucaagguagaacagagaaagggcaccaaauuccacuuagaauugccaggagaaugccucaaaguuauauauaugcuuaauaaauaaauauauauguguauauauauauauauauauauauauauauauauauauauauauauacaaauuauaauacacaguguacauuuuggggccgugcacaaaacaugcuaauuugauauauaucacauuaccauguuuuauauauauaugugugugugugugugugugugucacuauauauaaccuugaagcauuauauaauauaauauauauaauaauauaugauaauaauauacuauaaauuauauauaguauaauaaaaacacuguaauucacccuccuauuuacuccacauauacacucacaugugcaaacauguacauagcacauauacugguucauauaugcauauacgcaugcauauguacuuaacauacauaguuucugguaauaaguuccauaccauccaacuguuucucuagguguugaacacacauuauuuaauagcuguauuugucuaaacauuccuggcaugucuucgugaaggauguauacccuugugcaucaucgucugaaauccuaggcaggauaccaacagcagcagaauugcucgagacaaaggaaacuuaaauccuuuuuaaaaaaugucuucauguaaaaccugaauaaauugaaguagaaccaguuagaauaaaaacacacccaagaagcaccuaagaaaaaacuuaauuguuucugggaguuuuagcaucugauuguuugaaaagagcuuaauucaauuucaaaguaacauaacuacaguucaaugagggccuuuguucuggggaaagauaauguuucauggggcuuaucaggcauuccuugcccgacaguugaagaguaguuagauugucuguuauuuucuuauuuugauuauugcaccacuguaaguuacuaaugaaaggauuauuugggaagcacuaauucuggucuuggggcugugcacaaacaugguaauguaaucucaugaacacuccaugaauauuucugugguuaaauagaaggaucuuacugaaaacugagaaauccaaagcuuauucucccucuacagcagaaagcagcuauuuagaaagagcgugcugauuuaggacagugucagaaauacuaaacacgcauauaauucguaaagaggaaaaacaggcuggguauccauuuaugaagaauugggagaauucccuugcagugcacacaucaugggacccuugaacucaaugcuaguggaagaagugauguuuugcucacacuugaaacccauguucuugcgguuuuccucacagccucaucauguguucaacaugcugaagaaguacguccgugcggagcagaaagacagacagcacacccuaaagcauuuugaacaugugcgcaugguggaccccaagaaagcugcucagauccggucccagguaagcccugagugggggaaccuucugcagcuuacaguccaguuguugcuuccucaguuuguugggaagauaauuaccucccucuagagcaccuauggugaggguguuguaucucuuugucaagaguucuuuaauaucugaaacucuaaaagcuaaucuucagaacacacaguucuacaaggcuuaacauguggaggcagaaggauggauaguucaaggccagcucggcuacuugagagagaugcugucucaaagaggugagaagcagagagaugacucaccaguuaagagugcuugcucuucuugcugaggaccugaaguuagugcccagcccccacauuucaccaccacuuaaaacucuagguucaggggauaugacacuaucuucuggcuuccucugguuccugcacaaauaucugagugcacacaaacacacauacauacacacauacauaaauaagcugaaucuucuacaaaaggaaggguguuuuaguacugugugccuugacauuuucgaaguuucccccaguaauauggaauauaaauucugaaguguugagagcagccaaaauuuuuaaugcuagccauucaucauuuaaugcuagccaccaggucugggaaguggcucacaguugacaaagugggaaccagaguuuggaugccacugagugugguaacccaccaguaauucuagcacugaggaagcucagaugggauccguggaacaaguugguuagcuaacauagucguauuagugagcucuggguccgacugagaggcucugccucagugaacaaggugcaaagcaguagaagaagauucucagugugagccucaagccucuacacacucccacuugagugugcauccacguguucaguuaacacgcaaacauucauacaugcacacauacauacauaaauaaacaaaaaauaaaagaauaaagucaccaaaauggagaaaaugauaacucaguaaacagaaagcuguguacucuaaucaguaaacuaugcccaguccuggcaaacuccauuguaacuaccauguuuaggguugcuagagucuagaugaagauuuguaauuauuuucugcuuucucauucccagagguugaaaaacuagggucugccuccagaaaucuaagauuuuaaauuuucucaaaugaaauaaaacuaaaaauugcauuugccuucuauacaaaauauccaaucaaauugaaauauuccuauguauuagaaaaucuucaaagguauuucuguagggacuaggguauuuaggaagcuucaguggucggaguguggugacugauguggucguugaaaucgacuguuacaagcaugcaggcuacugguaaauacugaggaaugagagaauaaaaaagaggcaaagaaaccaaaagccccuuuacuucaguguuccagcuguguguguguguguguugggcguggucuuugucacuguuuccuuagcagagauuguucauguggaggugccaucuucuaacagguuaugacacaccuccgugugaucuacgagcgcaugaaccagucucugucccugcucuacaaugucccugcgguggcugaggagauucaagaugaagucgguaagugagcuguccuucggauguucuccgagagauaggcuuacccccagaacacaucagggcugagagucuucugugucugucaccugugcccaggugccuacgcguuguacaguacauuuuguggguugguggagggaggggggguuucacacgugugugaaugagucuaaaauccuucagugcacauggcaaccaggggaaggaagauaccagguguuggaagauacuagguguuggaagauaccaccagguguucuacucuaucaccccguucucaugggacaguugcuaucugaaccuagagcuugggugguggccagcaaagccccgugauuucccuuaauggugcugggauuccggggccacaugcuuauacauggaugcugaggguugaagcauagcuccucucauuuacacagcaggcaaucucgcccauucugcccucucuagccccagaucgccucuuacagugaaucucaccuuggcugcugcuucagcucuuaacuuucaaugccugugagaccuaaagauguaaccugguauagagaagaccuugaagucuucaagcagugaaucaguuguugaaucccaugucaacagugauauucuaauuuauccaaucuuguagguagauacucacuaggcuucucuacuuuauaacuaagcacaguaguuuuagccuacccuguguaucgagagcucaacuccccauuuguuuuucacuuccuuaaauuucuugugacugcacguuucaguuauguuuggaagacagagaucaguaauaaguccucuauauaagaagucaagaacuggguacaguaauccaugccuguaauuguggcacuugugaggcucaaacagggaauugcuucaaguucaaguccagcugguacuacggagugaguucaaguccagucuaggauacacagugaaaccuaucucaaggaaaagauaaaaauaaaauaaauauauauaaaugaaaacagaucuccacaagggagaaaaauucaaaacauaacucauaaucuuacugaauugaaguuaaaauuucuagaugugugcauuaaaugagugugcuuugugguuagcgucacccucuuauccugugugacuuacauuaagguagcauuagcaauaucaaacuauagaacaauaagccauuagaaaggaacuguaccuaaacccgcuaauuacaguuggcacucucugguuucuaauuugcucuuuguagagcuucucauuuggcauugugcuccucuaaauauuagccacaagugagucggacagauggcgacucaaaucccucagugcugcaaaauacccaagaacgggaccacccaguaacuuaaaaucucaguggcagagagaugguuaacuagaaucacacuuggguuucuguucuuucuuucaauaaaguaagaaacugccauggggguagaucaggaacaauuacguaaaaacuaggacuggagggauggcucagugaguaaagugcuuacuggacguuuagaagaccuggauugagaucccucgcaccaacauuuaaaaaaaaaugucagucaugaugacaugugccuguaagccuacuguaggggcaaaagcagguggaucgcaggggcuugcuggccagcgcuacugcaccugugucagucgauaaggagaagaagccauugaagaaggcaucccaacaucaaccuaucagccuucgugcacacacacacacacacacacacaagauuccugucauucuacauauacuggagaccacauacuuacagaaaaucuuucuaagaucuuucucuuggaauccuggaugcuaucaucuuaagauaguuguuuacauaggaaaaaccacuugcugcaaugaacacauuacagccuguccacuacaggccugugugcccuuuaagcuccugacacaaaagcuugagguacgaguucuucaaggacaaugggcuuccuugguuguccuuagugggcuuccugaagaacugugacacaaacaagcaaaugaacagccaguaaaacucuccaucacaucgaugcagacaaacccaaaaucggcucuguaugcugcucacaaaauccuuuauauuuuaaucucuuuacuuuuguucauauuugaaguauuccauaaugaaagugugauuuguuuguuguuauccaaugcaaagaagaaccucauagaguccuuccgauuggcaccuuacaguagacacagucgucuguggauuccguucacccaccauuuuucccuaaguuaucaaacuugagguuugaaucaguucgguauagauaaggagaaagccacacuucaguuggcagaagggugagaugggaaauauagagaugcucguguguuuuggguaaacguuggcgccuuugugcaccucaacuaggauaagcucaauucagucuacagcuuggaaagaaugcagcauucuacugcuuaacacucaugguugcuuucugaguaaaggguuuuaggcugaggaucugccaguaucaguuuuucuuuaaugacacagguguaucucucucagugaauuaugcuuccaaccuuaaaucucuauuauaggccaaaaugggugagaagggggccuuaacuacaaagaaguuaugcugugugguuggagguggggacuggaaucaagccuguaagaaagaauaaauaaacaaaccaaccauacugacuaggaaucaugcugccagggaauucuggcccugaucauguuaccccauugugcuucccugaggcagcccaucugguuaggcuacagccagcucuaguaaaucccaaaucgguaguucuaguaaccacacacauauggguggccuuccgucauccagcaucuugugugccugagagacucuggaccaguccuucucaaccuuccugaugcugugacccuuuaauacaguuccugauauuauggugaccccccccaaccauauaauuauuuuguuccuauuucauaacuguaauuuaauauuaugaauuauaauguaaguaucugauaugcaggauaucugauaugcaacccccgcaauguggucacaacccacaguuugagaaccagcuucgguagacucuggaaccacacauuugaccuuguccugcuuccauggucucaggaacuuccggccgaauaucugagccuuuaccucgcauuggccgccucacccaaauucucccucuggauggccugagcaggacagguguccuguccuuggaaagucgcaucccucaggauccaacugaaagccucagcagcucuguaaagucuucaccgauaaccucagagggcagagcaggaagcaaugguuugaugagcucagacgggucugcccaugacaucagugucuagguauauugugaaaggucaccuuggaguacuggaccagcgcauauagaaggagcaggaggucuaggggaggaguccgggcccucggucccucagacauuagguguguccacguucagcaagguuuucuuguauuuugcacaaaggcggcauacgggcuaauaucaauggugaagaauucuguggcaguaucuccagcucauaauugaagaaacuggauccuagagaggccacuuaggaugauaguggaggaauaaaacugacucugaggccagggucuugccugaaucccacaucuguguucucucuggcacccauugucuugcaccgugaguucucuucucuuuaaccuuagggucuacacauaggguuuaaaccugggaggccauacucuagcuuguguugauuucuauguuucuaucacagcaauguccaauccgcugagcucugcugccauccauggucuuugacugugguucuagcagacagccuggugugcuuuagagauuuccguugcuguagucuaggaaugaggcaaaccgucacgcuuugaggucgcugucccuuaaauuaugagaugaucuguuucuugauaaugcccaaaccuccaugcuaagcuccuuccuugaccccucccauacccauugcacgaaguaccucccuuucugcugugacaauguucccuaaagcuguuaugguugaucuacccaacagaaugaugucaucgggcaguggcagcaaaguaaagaauaaagcagauuucccagaacccuuuuuuaacacuguauaaggagguuugggucgcagccuugacacuguguccuguggucaucuccagaguuuacacagucacaugguugguugauugguugauuaaccaugcaucugauuugguucuccuaaguauugucuaaacugcuguuaguucuuuuuacaaaaggcugaccuuuuauuaucuugccguuuuuaguccagcuuaaauuauuauucacaagucccaaagcacacauacuaguuacuauuuucuuuuucaaagguuugcauguaaauuaugaagcuuucuuguucagaaagguuguaagaaauguugauaaagaggggacauugccuuacgucuucuaaauccugucuaggaaugugcuguucaauucagugaugacugaguuaccguucugaugaaaugcagcugcucagaguuccugcccaugcaaaucgucgucacuucaguccccacagcucuucagcucaacgcugauuuggcccacuugccauucuaagccauuagauguuuuugucccuuguaauuucccuuaagucccuuaaguccuugcuaaauugguucuggcauugaggaauuuuuuuuaucauugucccucaagauucuucagauugcagccaccucaaggcuguaaaacuguagcagcauuucauuccgagaugucugucucacacaaggcuguccugaccaauuuaugaguuaaacagaaggaaggaaggaaggaggaaggcagcucuaauuguuucacacugguuuaucauuuaaauuaauaaaaaaagugaaauacuaaaaaccagaaagaccggugacuggguaaauccgugguuaguggggcugguauggaaugaugugccaaggagacaagaaagccacuuucauggaagagugcuuacuguuguuacaacuuugcuuuuuauuacaauuucacuguggccucuugauaaaaauguccagccuccagggaaaaaaauccagcaugucuauuucagggacagugucucuguugucugugccuauguggagcugguuacaaauccaaauuggguuuaaagucgaauauuuacaacucuucucagucugacaaaauagaagagugaguuaguacugccugagaauuauuuaccaucccguggguacuugucaguuaagagagagcauuaguuucggcuccaaacuuugucucuguaaguccuuccaugggugauuguuuccaauucuaaaaaggggcaaaguguccacacuuuggucuucauucuucuucaguuucauguguuuugcaaauuguaucuuauaucucggguauacuaaguuucugggcuaauauccacuuaucagugaguacauaucauuugaguuccuuuaugauugcuauuggauggagcacagcacccccaauggaggagcuagagaaaguauccaaggagcuaaagagaucugcaacccuguaggugcaacaacauuaugaacuaaccaguacccuggagcucuugacucuagcugcauauguaucaaaagauggccuagucggccaucacuggaaaaagaggcccauuggacaugcaaacuuuauaugccccaguacaggggaaugccagggccagaaaaugggaauggguggguagggaaguggggggaggguaugggggacuuuugggauagcauucuaaauguaacuaaggaaaauacguaauaauaaaaaauauuuacaaaaaaagagagaacauuacugagagagagagagugugugacgccccaggagauggaguucaagaccaaccuggcugccuagcuagacauccuggcuuguugagagugagggaaccagagagauagagacgauaaaauuguuaguaaauaagacagaggcacuauuuaauuuauucuguucuuacuugauuuuuaauaaaagugacugcuacucacauguaaagucuuacagcugaauuaggcacucaaaaacaacauguguucauauuucagacagacaugaggaccuuccuuuggugacuucauuauagucucaaagccaaucuguuguucccaguaucauuaacugaguguuugccuugcuuguagccacccuuauuuaaauggguaucuuugacucccccugaaaaaagacaacauuuuuguuuuuugauuuuuuuuuuucaaaauaaagccccuaguuccacgcaugaaaaugucugggcuagugcagaaauccccagcagaagauaguagccuucaaauuagaugguauucccaguuuucugacagagugagacuggguugacgaguccccagacagagagguuagccuccucagagucccagccggucuuuacaacguggggaagaggccuuuaacagauaaacucgcccaaacugccaagugcuguucuuuauauacauuccuggcuaucauauaguauaagguuucauugucugacucaggaguuaaauuagaucaauagauuauacgucuuuaggaagaucuguuaaagugacugauaaggucacaugaaugugucaaacaucccucuagcaugauucucacauagauauuuccagugcacaauaguggggaagccagucuauacuagcaacacccagaaagugcacuguccaagaacaaaugcguaggcuugguguuucuauugguuuggcuuuuauuuuuaaccaaucagucuccccugucuaaccagaaaggcaaauuguugacacugaaaccuagaaugcagcgcagugcauggagcuguguuccuguccguggaugcuggcaguccucagcugaauuaaacgucauccacauugugcugacucacuaccgaucuaucucuugguuuuuuuccagauaaaguguuaucuucucaaauccuugaaccacuuuaauugguuucuuugcuuuuuuauuauuacgguugaguugugugcguucuuuguauauucuaggcacuaacuuaucacauacacaaccugcaaauguuuuccccauucaauggguguuuugguggguuuuuuaacuuuugcuuauuuuuuauuagauauuuucuuuauuuacauuucaaauguuauucccuuuccuagauuccccucugaaaauaagccuaucccguucugccucccccugcucccgaacccacccacucccauuuccuggcccuggcauuccccuauacuagggaauagaaccuucacaggaccaaggaccucuucucccauuuaugaccaacuaggccauccucugcuacauaugaagcuggagccaugagucccaccauguguuuucuuugguugguuuagucccagggagcucugucugggguuacugguuaguucguauuguuguuccuccuauagggcugcaaaccccuucagcuccuuggguccuuucuuuagcuccuucauuggggacccugugcucuguccaauggauggcuaugagcauccacuucuguauuugccaggcauugcuguuuuuaucuuuacacguguuuuuuuguuguuguuguuuuguuuuguuuuguuuugacaugcaguuuuaguuguucuguuuuuuaauuguagacaaagucuagcagauugauucuuuauuuuuuguuuuugcacuguugcuuugguaauagauagacaaagccacuugaauucugauuggauucauuuuguauggggcacuaacuaguuaagggucucaguuuacagauuccuaccaugugaugaagaagagguucuuccuaacuaaaagacauuguaccgugugcaaauucuguugacuguagacuucuauacccucaauuuccugccuauucuucgguccauacuucuacacuacuuugauuacugugacuuugugguuaagcuuugagauuggcagguauggguucuguacuuuuggauuuuuuuggugauggucauuguuguuauuguuuuaagauugcuuugaacauucuaguuacuuuugaauuucuacuucaauugugauguuuuucucaggacuguuuaagagaauauggguuuguauuuuuuuucucauugcuaagacaaguuaucugauaagagcaguugaaagaggggugucuuagucaggguuucuauuccugcaaacaucaugaccaagaagcaaguuggagaggaaaggguuuuagucagcuuacacuuccauacugcuguucaucaccaaggaagucaggacuggaacucaagcaggucaggaagcaggagcugaugcagaggccauggagggauguucauuacuggcuugcuuccccuggcuugcucagccugcucucuuauagaaccaagacuaccaggcaagggauggucccacccacaaggggccuuucccccuugaucacuaauugagaaaauuccuugcagcuggaucucauggaggcauuuccccaacugaaugaagcuccuuucucugugauaacuccagccuaugucaaguugacacaaaacuagccaguacaauugaccccuugucaacuugacacacaaacacaucacuaguaagccucaacccuuaguuucuuauucauccccaagaucuaaauaacuuuaaaagucccacagucuuuacauauuaaaaguucaaucccuuucagagauccaguaucuuuuaaaauccaaagacuuuuuacaauuaaaagucucuuaacugugggcuccacuaaaaagcuuccuucaagagggaaaaacaucagggcacagucacaaucaaaaacaaaaauucugggauccacucaugaucuucugggcucuuccaagggcuugggucacuucuccauuccuuuccuuuguagcacauggcuugucuucuaggcuccagcugccuguacuccgcugcugcugcuguucuugguggucaucuuaugguacuggcaucuccaaaaacacugcugucuuccacuguaacuuggcuucaacaauagccucuuauaggcucucaugguaccaagccucaacuccuuugcaugaccccuucaguccggggccaucaauugcaacugagguugcaccuucaccaauggccuuccauggccucucacagugccgugccucagcugcucugcaugaccccuucaugccuucaaaaccaguaccaccuggguaacucuuacacauuaccaaguccagccacagcacaagguacagccuuggcuaucucugcaacacagccucuguggucucagaaaacacuucccaggagaugucaccucaaugaugcuggucucuucuuaauuaaaguuagguucuuaccuccagauaaccagaaucaauagucaauaguuccaguaaugcaaagguuuugcuuuaguaguucugauaucuuguuaaucacagcugauucuucagccccagcuaaccagaaccacagaaucuucacaaucaaaauagcaauggcccugaaaagacucuuuaaucuucccucuggaauuucacaagccaggccuccaucuucugcacuguacuccacauuaucuuccaagcuccuacacaacaucugacagagcucuuaacaaugaauggauggaucuucuagcccaaaguuccaaaauccuuccacaguccucccaaaacauggucagguuuuuacaggaguaugccacugugcugguaccaauuugucuuagucaggguuucuauuccugcacaaacaucaugaccaagaagcaaguuggggaggaaaggguuuauucagcuuacacuuccauacugcuguucaucaccaaggaagucaggacuggaacucaagcaggucaggaagcaggagcugaugcagaggccauggagggauguuacuuacuggcuugcuuccccuggcuugcucagccugcucucuuauagaaccaagacuaccagcccagggaugguaccacccacaaggggccuuucccccuugaucacucauugagaaaaugccuuguagcuggaucucguggaggcauuuccccaacugaaagcuccuuucucugugauaacuccagccugugucaaguugacagaaaacuagccaguacaagggguuuacuucaauucauauguaugcauucaugauggcuggaaaguucccaagguagugggagcacaaggcagcuggccucacugcuauccccaguuaguuaggaagcagugucagacaaucgcuggugcccaccuugcauuggccuuuccauuccugugaauauuccagcccuggaagaacugcucucacccacauguaaggugagccuuaccaucccaguuaacucaaucuagaaacuuccuuauaaacuuauccaaaguuuaucuccuaggucauucuaggcccuaucaagcugacaauacuauucauaauuagauuauaauggcucucuauauagaucaguuugggaauuauugcuguuaucacauuuccccuauuuucaguguaugugaauguguuugaggcacaguggcccacacgugaguacaugcauuuauacacacauguuggguacacauguggaggcuggcagcugaugcugaccaacuuuuccccuccauucuacuccauuuacaguuguugcuguagggcugcccucuccaccccgcugguacuuagauccugggaauucaaacuccauucacacuuccagaaagccuugugcacugaaccaucuccccagacuccuguuauaaaguuuuaaauaaggauuaauuaaacaacaggaugcuacagcaggccgugagaggauucuagcugaggcccacugugacaaggcaaguucuuaaaauuaguggaauucacgcuuuuggcuuucacgcuauuauuuuaguaaaauuccaaagguuugguaguccucuugucaagaugugcugucucuacuaccucaguagcuucuguccguuuucacacagucacuuacuuugcaguaaggagcaucucuaccagaugggugaggcuugaggcagcaucucccaccccaagcugcugauucucaugaagaugcggggagucauuuucccagcuccccaacucuuaugugcuguaguuugaaacaaaaccuaaagagaagcccuagcaaaaacugaguagggugugaaagcagaccacagcgguggcaagaugguuuccuggcacgaaacacugcaacagauguguccugauuccuuuucuuuucuacagucuugggaaaaaccaaugauuuuggacgguaacaagggcugguuacucuauuuuucacaagcagcugccuucaagguucuuuuuuuaaaagggaaaaaaaauguagagauauuugccacccagaauauggaaaugaagccaaauuaauuuugaagugugcuuccacaaggauuaacuggagaugagaugagcuuguuugcaugugagucagaguugggaacgaauguaauuugccucuugcuguuccucucagaaacaaauucugcaauguagucacugaggaagccucauuauucuuuauuaauagcucuuagguagugugucuugugcagacacuguuagcuaggaaaucauaaacagggagggugugucaacagggcuggagggauggcucagcacauaaugcucuuagagaggucccaggagagguucccagcacccauguuggacugcuuacagcuucuguaacaccagcuccaggcgaucuaaugcccucuucuggccaucacagccaugcacacacaagaacacacgugagugcacucacacacacacacacacacacacacacacacacauacacacacacaagacuuaauauucuuaauucaugggucaaccuguuguguuuuaugagagagagagaaagagagagagagagagagagagagagagagagagagagaaagagagagagagagagaguuugguggaggcacaguauggugucuguggaaggggguggcucugugggcccaugcugaggcaucccuucccccugagguaccagccacagaaagguauaguauagaauaacuuuaugugccucaguacaggggaacgccagggccaagaaaugggaggggggaggguaugggggacuuuugggauagcauuggaaauguaaaugaagaaaauaccuaauuaaaaaaaaagaauagaguuuauuuagggcauggggaggggaguugagacagagaaaggcagagaaaugggggagggaggagaggggaggggaggggagcggaggggaggggaguggagggaaggcaggccaugagcacauggagagguggggggagaggggcaagaggaauggggagagagggguaagaggguaagggaacaagagcaagaggagaagagaagaaagugaggaggggacaagcagucccuuucauagugaaucaggcacacauggccauuaccagggaacugugggguggggccuagacgaaaugccaacacaaccaauuaaccuauucuauuaugagcgcuguccagagaaacaguauuuugauaugugucaagacacuauucauucaggguauguuaguauacaccaaaaaccuuaucacuugggagacugaaagaggagcaacuugaguucauggcuggccuugacucuaccaggaaauccuaucuccaaaagacaagggauuaaaaacaagcaaacaaauaaacaaguaguauuugcaaugccuuuguuaguggguagaguccaguucauuucagccacugcugauagaugauguauuagcaaagacaaagaauuuacuagccauuuggugcacugaacucguuguugcugacuggcauuuguucauaaagguguuagcuacaucuuuugcuugaaaaaaagcaccuggccucuaugaaauuacccuaucucugccuuugcuuuuggucuguguagcauuuagaugugucuucccguccugagacaaggcugugucccuaagucugcaauguccccuauuacacugaacucuguacggcugcguaaguaggccaguugugaaaccagacacaucuuuggccuaaacaagggaagcaagcuggguagaauuucauucugguacaaacacuagccugagcccuucuagcccuggcacaccagcugugucuccucuuuccgagguuguaaccauaagcggaaguuuugcaggugccuggguuccucuugcagccuugccucauuaagaaggagcuuccaaguacaguagugcaaaguuaagaguguaaacgagaguguagcacguugauaggaucaugcuuacuugcauucuauaauguuuuuauuuaggaaacagugaaagcaaaccaaguuucacauucugaaauaguggguguggaggccucuuuguuugguuuguuuuuuuaaugugugugacuguuugccuaugugugugugugugugugugucuaucacauguaugccugaugccugaggaggccagaagagugccgaauccuuuggaacugaggugauggaggguugugaacugccaaauguauguugagaacugagcucugguccucuucaagaucacugaguacucaggaccaccgaagcuucucucgggccccauacauguuuccuaaugaaagucugugauuuaaaauucaaaguuaauuguuagcuuuaaauauagcaaccuucauuucauaauuacugagucuuaggaagcaacugagaguucucagaugauagccaauaucuucucuauaaaggaagguugcuacacauacuuguccugugauauaggcauccuguggcaugaaaaugaaucauugugucaucuuucuuuguuacaauaaaacuucccuaggaacucuagccaaaugaagugcuuauugcuagaaguugucaaagauaccaauaaacaguucuccagaguuucuauuugugaaauguaguaguugcuaguauaguuuuaaguguaguuuucuaauaguaaauaucuguugccuaauacaaagaaaguuuaguguugccacugagguagaugagugacaguuuucagacauuauuauuaucugaaaauaaucuuugaugauuuagguauauacauuuuacauuauauauaugcauauauauauacacacauguauauaaugcauauguauauauacauauauaugcacauauauacacauuauuauacuuuuauaugacuuucaaaaaauaagauguaggaaggcugggugugacuuacuuacuuacauaggagagugcuucauagccuguaugaagccuagguuuccuccucccacauugcacaaaacgugguaugaugguguaauaccugcaaucucagcacacaggugaugaagacagacaaaucuaagaccuuggcuacuuaguacagcuaggcaugaaacacugucuuuaaaaaaaaugucuauccauguacauacaccgcuaucauuugccacugugaguaacaagaagauccaagaacuaagcaaggauauucagcaucagugaauuguuuguuaaauaccuacaauacucugggacuguuaaagauucggggcacagucuuucuuacucaaauaacuuagaauaauuuagaauuugcuuagagaccgcagaucaucagccaagacaaggcucuguucucaccgaggcaguugaugaaggcugaucugauagcacgagguggucuugucuaauaaccacccuuccuccuaaccaccucaagaagacuacuaagcaagagggaagcuugcuuuucaacagcucaagccacguuauuuuauagguucaacuaaggccauacaucacauguggucaauaaucuaaggccauaccuaacgccuggucaauagccugcagacuaacccguuccauuggucuugauccaacggcacucacuuagugauaauagcaaauucaaggcugaaucugggaauaauaugggcagcuucagcguccuuucacugaacguguuacgcacugaagaguugucucaacagcuuugcacacauacaucucuguugauguguuaaacauuuuguaggacuugggggccaugccaccuuucuccauuugaucggaacucauaugcugaaguaugagucgcugacaguuccguggaccaugauaucauaauuccccaugaugacuucaccauugauucuccgggaccagccaugcaggcuagggcuuugccaauguuuauggucagagacuucuggcaaacagcauggaagugguguauuguugcuggccauuaaaucagacccaugaaguggccuccccugccagcagagcagaucgcuucuugguuuguuuuuuuccacucaaauuuacaaagaaaggcuaacagauaauuuaaugaaaagcucuguauauguuuuuguuucuauuauuguuaucuucauuuugaucacaaacuuuuuuuuagucucccuaagucuugcuuaauccucaaaaaaauccuugauaagcaaaguguauggcuuuucccgucauuuauuacgguauuacuuuauauguuuuggaaacaggccuguguaugccaggcugcucucauucgcagucccccugguucagcaucucaggugcuaaggaacaugguagucgucuuccuuucuucucuugcugagucugacauugcaggcaagcugacguccugcucucagcccuggauacacuggcauauguucugcuuaugucuacaguguugacuuuuucaggucgaauaugcauuuguaucucuucacaaaaaaauaugcccacagccaagggaugauuaauagaaacaguucucaucauguggcuuuggaccggcaacagcagcaucaaugagaaauuguuagaagugugcauuccuuggccucauucccagccuaauaauccagcuauguguggaauagaugugucagcuuuuaucucuguggcuaaauaccuaacauaaauaaacuuaaaagaccagcuuuauuuuauaauauaucuauauuucagaagucugagucuauaguccauuggcccuauugcuuuggguuuguggcaacuauauuauggccagaagagcuucuuaguuuccggugaccagaaggagaaaguaaagaugggaagaagaagaacugaaacaagagaauucucuguaaagacaaaucccuaacuuccaagaggucccaucucuuaaagauccugcugccacucauuaccaacuugggcugcagacaagucccuuaaaacauggaccuuuggaggaaauguaagaucuagaaguaauuggugcucagucuguagugauagugcucaguuaguacuaaaguuaugaugcucagucuauagugauagugcucaguuacuauuauaauaaugaugcucaaucuacagugauagugcuuaguuaguauuacaaugaugaugcucagucuacagugauaguacuuaguauuauaguaaugauacucagacuacagugauuguacuuaguauuauaguaaugauauucagccuacagugauagugcacagucuagacuauguuaaugguccaagguccagauauaguaauggauguaaaugauacacagcuugucuucagagagagauguuuuugcuauuguuagaucuuuuuuaggggagguggauugggaaaaugacucaguagguaaaucacaggcugcccaagcuugaagaccugaguuugaaucucucuccccucccauguaaaaauggacauagcaucaucuguagucccuauacuccuacaggaagaugggaggcagacacaaaaaccuggaagcucacagcaugagcaauaaacaagagacccugucucaaacagguuggaaagcagagacuggagacugacaacugaggcuguccugggaccuccaccuacacaccaaguuguauaaaugccuguacucacauacaagcacauguacauacaucauacauacuaauacucucucuugagugauguugccuguaaaacuauagagcuguaaaggauggaagauauucaaagacucggguucucucucucagaccccccuuuaggcugccuaccccaguguccuuagacuuuagaacaaccgcaguacaagguguuggcugugaauacuaaaguucaggaacuaccgguggaaaugguugggccuaagagaacuaugagugugagaugaucugcuuucuuccuccaggauauuacacgugcucaugugagcuuagagcucuuaauuuguauguaacuggguaaagggagaggacuauuuccuaaugugcuaccuaccaucuuccccucggauuuauuagaguaggugaugccagauaaaauggguucaaccaauucuuugaguuucuguuuguuucucuguacuuuguccggaaucuuuuauccaaaguccuugggauuggaaauguuucagauuucagaauuuuucaaauucggggcacaacgcuaccaguuauaacuagcuaucaucuucaguccaaagagcugagauucggaaugcuuugaaagcuuuagcuuucagaacaucccacauguagagucugagagcaagcccaugcaauauagguauucagaauauaucagagagcaacaguaacccucacguuuacuacugaagaccaaccugagccguuuccagucugcugcuggcaaugucugugauccugagcaaaaugggagaaagcugucucaagaaaaagagguggaagccaagggaagggcuuuguaauguguucaggccuauaggagugcgguuagcgcugagccuguguuuacauucccucguucccuuaggcagggagccagugucuugcacugaguguuuuguuuucucccaccuuaaggagaagccuucuuauaccuaaagcagaaaguaccuccuucaggugcaggagggaaaacuuaagcaaucuguggauugcucaaaacacagucuguccuuugauaaaccaggcaucgcccugcaagucaaacauuguaugaaaaugugagagguuuggcagacuguucucuuugauguggagagagaaaagcuggcuuccuuucccacauucagcucgggucugcaucuacccugcugcuaagaggcucuucaagggaacuugaaaguggugccggacccuccagcuuugcagauuaaggaucuagggugauuaacugauuugaucaaaaucagagacuaaaacuggucaggggucgagggcuucuucacaucuugccagaguucuucagaaaucaaagugaguuuuaaauaccuggggugugaauaaaugagacaauuuucuuccauuaaagaaaaguggccacgaggaauggggaacccuuuguagacaucagaguguucaaauauggccuuguguccaacacggccuuguguccaacacagccuugugcccggagcuugccacgaguugaagcgagcaucuaagcuggcagguuccggucccucgggaguucauccugucauuucugcaugucugucccuuacuccgcugacaguaaacagugucuacauuuuucaggaucuuacuucaguugcuguaaauacuucaacaaucugaaagucucauucagaagccacuuaggaagaaaaguuacucucaguggaaauugguauccuggaagucacugugucucaaugcauacuugggaccaaguaaaguauaauguggaggaguucuuguuuaaaauaccgggucuugaacucuuccucacacucagagaaaucaacucaucuucuacuucaaaugauucuugaauaauucaaaagguuuaauguuuauaugugcuaguaaaaauacaagcuuuuguagaaaauugagaguguauuuguauauaucuuugaccuaaaaaauuaaacauuauuaauguauccuacaugaaguuagaccagucuuucccuucagucucugauuuacaguguucugacuuacaagauuuucugacauuguagcgaggagaaaguaauguguuuugaaucauaauccguccccgggucacuacauguggugccagcauacagcacugcguggcagguccuuaucuuagucaggguuaccacugugcucaaacaccauggccaaagcagcuuggggaggaaaggguuuguuugaucuacaccuccacuucacuauuuaucgucaaaggaagucgggacaggaacucaaaaagagguaggagcugauguggcggccuuggagugguguugcuuacuggccugcuuucuuauagaacccagaaucaccugcccagggagggccccaccccacccccaucaaucacuaauuaagaaaaucucccacauacaggcaugugugcaaccuaaucuuguggaggcauuuucucagcugaguuucccuccucucuggugacuuuagcuugugucaaguuucacaugaucaagauaauaaucaacaauagcccucacucucucaucuugagcucugcuguucaguggacuaggugcagccguggcauguuugacuaggaauguuguguggaaggaccaugaggcuauauucgcaucaugaaagaacacauguauuuccaaggggccacugcauaaaauacuuccgggagaugacauuuacuuugaagguugaauacagcucuguuaaguaacacaauguugagguugcgcuuaacuuacccaagucacuggcauaaacuccuuuucucuuuguuuuuauuguguucaugugugggcacacgcacaugucuaggccagaggacagcaaaagguuuuguuccuuagcucuuuacaccaucuguuugaggcaaggucucucuuuggucugcaagucacccaaauggacuagacugauuagccaggagccccaaagauccuccugucuccauucugaaauuauaaacccaacaccacacacagcuaucucccugucucccucuucccccucuguguuuuggggggcaggacagguuauauccauacaacucagauccuguguguguguguaugugugugugugugugugugugugugugugugugugugugugagugugugugugucugugugugucugugucugugugugugugucugugugucuguguguucugaccacaaaacucagguccuuaccuccugacccacgcacaccccccaaacccgccaacuuaaccacuuauuaaccucagucacugcucuugacagugaacagugaaagccuggggcuggugggaacuucuugccuagaugcugcuuuccuuggaaguucagagccugcucgucucucugacagauccuuuuccucucucaguccugacccuucgcucuccuaucacugauuccaccauagaaauacuccauggagguggccuucaaauccaagaugauacuaacuucaucagaggcaaaagagaagauuaaugcuaugcccagggugaccagcauuguagaggacauucauccgaaucucggacaguucacugacagccuagcauccgcucaggaaguauguguccgauagugaacggacaaaacaagaacacgagaaaagcuaugcuggcugccaacacuagaugccaguccccaggagggagcucacugugucacacggucacauguguauauuuuagauuacauaggaaaacccucuaaaccccuuuugugguuuccugaagugacauggacuagaaaucaaauaccagcucuucuuuuauuccacaaacaaauagaccaccugauuggacaugcuccagaaaugugggaaagcuaucauuggcuauuuuccuucaaccuguggugaacaaggcauguggaaauagaaugcuuaagaagagagcaauaaaaauuaaaaucauuuccuugucuucucugugaaggggauguacgaucauuucucccuguuuagauauccaggcacaugccuguaaucucaaugguucccaaguucaaaggcaggcuagcuacauagugagucccagaccagccugggcuacauauuaagacucugucucaaaggaaaugaaacaaaaagaaguauguuuuucaaagccuuuuucuugcguauccagagugagcaggauuaauuuacccucagccugcagcugucaccuuucuugaacacagagaagaaaggaaacagaaucccuuagagaagacauuuagaucucuuccuuuugccucagucuggcuagaaaggugcaguagugaccuggguuagaguucuguucccauuugcccucuccagacucuguguauaaaauugauagugcguacacaucacacacacacacacacacacacaccaccuguuaccucauaagcgauaguuuauucugaagccaaaugcgucuggcaguggccuggaacacagauuuauuuucuccaaauuccauguuccuacauggaagcaucuuauaguaaccaaacaaagaaagccauaagucaagacacuccguaaaggcaucgguggaaauaucaggguagacugguugaggaagagcagagaaaccccaccuguaguccucaggugccaccugaugacauucuaagcuugcugacugguuggcuaacucuaguuuguacauccggagggauuuaccuaauggucgaaaaggagcugggucagguauaaaggagaacaguacaugacugcugcaggggcuauugagggcccaaagcucuacacuugcugccuuccagaguuucuggucucugugguucucaucaguuacaugggcuuacagaagggucaguggaacuuuccagaauccccaaguguauguguuaauugccuugaggugcagucuuuggguggcaguuaggauuggguuccguguagcuaagaucuucauauagaagcuugccguggacacucugcucugugauggcccagugggagaucccuugcuacauacggguacccugcucucucuuuuuuuuauguauuagaaagagaaggauuuguauggcuuuugcuucuuuuguuuuguuuuguuuuguuuuguacacugagaagaaagcaguagacagaaacagaagaagccccugcagaaacccccuuuauaaauuauucauucucugauccucaguuaugacagaaaauagaacagccucaagcuuaggguaauggcgcaaacuuaugauuucagccacucagcauacugaaacaggaagauccuggguucugggcagaccugggcuacauugugagauccugucucaagaaaauacagugguuugaauagcuuaaaaaugaaagugacuuuucucauguuuuuuggagcucguaaauucaagaugauggguauuuaggaaggccuucucaguuucuccaugauacaauuuguuucaucguauugggagcaaggauccagauguucuagaggcugccccuggggaguuccugcuaugcuggaacaaagaacuggcccagggacacguggacagugguagaaaaagacaugauuuauuaagaaaaagaaagccauuuucaggauggaacuuugagagauuuggacacaggugggccacaguucaaaacacuaacgguccuggguucuugagccuuuuuagaucauguguguagcacccaccuucccccaucuuaggagaucacagagguuuucugugugugcaugcuguuuggucacauacagccacaggaaguggagguugucuuccugccaucgguugcuuuccugugcugaucuugauguuucuucccauaaaaccugucuuggaaggagcaaucucucugguuucuccccagccucagcauccagucacccugggauaauauuuagcgucagucuucaccuuaaauggcucuucucaagaugaugcccuugagggcuaaggccuccauggauuucaucggggauccaguucagcccacaccacuuagcugggucaguccuuuggcuaggucuaauguccucccucucuguugacccuuacccuuuagccacuuacagcgcaugugcucuuuauucuaaaagcuauacacagaagccaugacauauaguaguacucuuaauuuuuaauuuuuugacaucuugaauuggaauagaauuacaucaauucuccaaccccucucagcaucccucccucaauccccuucuaugcuaccccagucuuagguugguagucuccucuucaaauccaaaauaaauacucuggccaccauuuuuuuuauguuaugaagccugagagucacaaacaacccagcacugcucgcuaaucgugcacuccauggcccaaucuagucauccuauaaaaacaacagcaugaccuucaggcuuuuugaagauaguuuugugcagacccaguuuguccagugugagcccuaaguugaaaucaucaggcuaaauugcacggcuuccuccagcugucccggcuucucuaaauggagucccugggcuugagugcagagugcaguucuccugccucugugaugguggugucaucacucugagugcaguaagaucuaaaacucgccugguauuugccacaugucuuggugccaggcacaacucagcuucuccggcuccccaggaaggaagugacauagccgcuguguacgaggugcuugaaugaggcuacuccauuuuccugcugacuugaagaaucugcagacacuucccccaaauacucccauguuuaaaucaaacagcuacaugucuugaaucuucacccuacacgugaaaaaaaaaagauuaauuuccauauuacgaaacuguaaaagguuuuaagcgccuuuccuuccugugaggcugauaaaggagugaauuuguaaacugcggcuggguuaauuagccaggguuaauuaauguuuaccacacugggacgaugaaaagagguguguaaaugcacaguaaugcgggucauuuuucaauuuauuguugaagcuuacggugugugugagugaggacaacauaaagcgcaugcguguuucagagggcuacugaugcucugcgguaauuaugaggcguaggcuucuaaguggauuaauuacauguuccugaagacgaucacaggcuaauaguguuuauuuagggacaggcugcuguuucaaguugaacuauuuggagagcugggugaggugaggagaggcuaacugugugggcaugaaaacagcauuuuaaaguaaccuuuaaaaauaaauaauagauagauuucuagagucguguauuuucaagagagcccaaagagucuuaggugaaguccuggauuaaagcugggaaguacagauacuagaagcaguuugaagagauuggaauauaaucuccuaugaacuggguagauaucccucaguguugggaguuuaggaccagauuccaggacacgcccaccucaggaauccccaaauucauggaugcuccaacuccuuauauagacaguuuguauuuguauaggacuuaugagcaucuucuugggggcuggagugauggcucagugguucagagcacugacuacucuuccagagguccugaguucagaucccagcaaguacaugguggcucacaaccaucugcaaugagaucugaugcccucuucugaugugucugaagacagcuacaguguacuuccugagcaucuucuugugugcugcucauaaaaccuaauccauugccacugcucagucaacacucacuacccuguaauguuuugaaaacagcaugguaaaagcccuauuuguguucaauacagacacagugaguguuuucccauuaacuuuugaucugagugccggagaguuggcuuaguggauaaagucuuugcuaugaacacgugaagaccugcguucugauccccagggccgugucaaaagcaggaaugacagcaugcaccuauaauccgggcccuaaaugauggaaagagaagugucugaggaauaggacauccuagugcuuguguggguccuuuccugucagccuugaguucuuugcaugcgaagaaauugaguuaguuauuucuggcacuggucuggaaauaucgacaaaugaguaucagugagcucaccacguaacucguuugagucuccuuguuccagauucuuacagggauuucuucccacuccucaccucugugcacugagugccuuccugaaggcaggucgauuccaccccuggccaaaccccuaacgcuuagcacuugccauuuccaggcuuggaugcuaucuuacuuuuucuguugcugagauaaaguacccugaccaaagcagcuuaagggagaaaggcucuaucuccgcuugcaguccaaggacacaauggaucaaagcagagcagccaaagcugcaggucacuugacauccaggacgaggaaguggaggguggugauuggucgguucuuguuaauuucccucuuuggccuaguaggacccaagcagagaaaggugugacccacauuuaggguaggucuaccuucuguuaaccuaaugaaaccgaucccuccuaggcaggcauggaggcuaacuuaaucuaaauaauccuuugucuccuugguuacuccagagccuaucaaguugccaguuggcguuauucuucaucacagucuccugggccucguuaagggaccaugugaaugaguuucugcuggagagaaagggccaucgccauagcuaggaaagcaagauuucguuaaagacaaacaggccaguguacagaagagcauacuggauguguuuaggguuucuaaaauaugcauacauuagcauuuaaaugagcggucaugccuacagagauguauuguguauaaggaacauagcccuccauugugaugaccuguguauuuaggcacauuuuccacacugagcccuuauuuaucagcauaucuuuuagggucuccccaugaaauugucuacagauguuggcaucuuccuuucuaccacgagcucaccaucuuuugacccaguuuuuucaucccccugaauauaguaguuguccgucccucaucaacuggaacuguacugagcucucuuccuggcccagcagugugugauucccauuccauacaucugcuguggucuugagcaggccaggcaggguucucuuccaagucugagggagagcacuugagagccugggccacugcauagcuacaguuguauaagucgcacaggacccugcuauaacggacagcagucauggaaaccacagugaagaguugucugcagcugcacagccaugaacagcaguccuguggccaugccagcauggccacccgccccugcuucucucucugauguguuugaagacgcacaccauugcugaaguccaaagcacguguggcagagccagucaugggcugugcaugugacucacucgccucaaagaaaauguuauguccauuuguaaggagagagguugauuuccuuaccagcugucucagagguggcucggagcucaaguggggaugaaagaaccccaaguaaugaugcccagaacacccuacaggagccgagaaggagccacgggacuccgggcucaauuaauuuuuuuuuucaucucuuacucuacguuuguuuuuuuauugguccacacuaaaaauuaguuuuucauaauaauagauggugcuauuauaaauauucugaccuuuuacuuuuaagcaaauauacgucaacaccaaguauuccaaagagccccaguaaaaugaaaauuaaggaucuaacuggaaagauuucuuccccauaaguccauauuuauauguccccaaaccuaauaguagucucaaagaugucauucucuauggccacagccauaaagauuaaauaagaaaacaagacgggacauccucuuggaguugggggaggagguaugggaugaggaacagucagaggguggacugggaggggagcuaaugacuggacuguaaaaaaagauucaauaauaauaaugaugaugauaauaauaauaaauaaguagauaaaauaauuucuaaaagacaaaaaugaaaaauaaaaaugugaguuaaauguauaguggccuccuagugcuagauuuuccaccgugugauucauuuuccaagcaaguacauccguguaauuuacacguaugagcauuagaacuucagcccacagaacuuucuuucaaagaccagugcuguagugugaaaacucugcagucagggccccagguggcugacaucccagggggauuaagacccccuaaagugguuggaaauaagaucgggaccuuggcccaaguuccauaaauaaacacggaaagggaagcuuuuuaauccuuuugccaaggccagggagccuggcuguguuuucaucuugauuucuggcuaaugccgguugauagaacggagcuguuugauguaggaguuugaaagccacaaggaaacuccucuucaagggaaaggcacuucuucugaaacuucagucuagaccagacgaugguauuucaggaaaaugucacuugcaauaaggaguaguuuucacaagugaugcuccgccuucugugaguccucucuggggacaguugccuaccauaaguggacggaacacacccccauuugaaacucuguggccaggaaacuucuacacaaaaauaaaccucgaucuagacaugagucuguacuuagacucugggcaauucucgagauugauaguguagcuccagauaaaagagcugccuuaauuuucuagacgcggagguuuguggggagagcucauugcuaagugaugucuauagagguuuuccccccaguuugggaaacaguccuacaaugaucauucucucucagccacugagguaaccugaucacuccacuucauuugggcacagaaaagauuuguggggcagagcccaacucaaauucagauuguuuaacuucucuuaacugugaaguaggguguugaagccuaguggggguuccuauggcaaccaaacagccuccucuuagauugguuacuuuucuccuugcagagacaacaucugacaagaaccaauuugaaggaggaagggaugggguuuggcuugcaguuuaaggggagauagcaugccugguggcaggaggcaacuguucacauagcauccaaagucaggaagucaggagagggaacaggaaguaggacugggcuguuaaguguucaaggcccacccucagggacugacuuccuucuucugugaggcuucaccuccaagagucagcaaacugacucuucccugagagcaccagcagcgaugagcuaaguguucagguccaugaggcugugcgggaucauccacguugauauggcaguucccacaguauuucaugagauggacauugaagaagggaaagacagugaguguuccugggggaaagaaaccauuguuggaaauggaaaauccaaacagaacugauggacaacagcuucaggcucugucacacuucccuaaugagccucuagagcuacaccuuuaaccucuuuggccuaaguuuauuggggggggggggaauaauaaucauugaaauuaucucuuucuaaauaacaugaaaauucucaugggcugaugagaggauuacauuaggaacugggguccucagguuucaguuauaguaucaguucugcuacucaauauguauuuaucuacauauuauuuauuuuugaggcauauucucacuccauauguagugcugucuuggaacucacuacauauccaagcuggcaucgaacuuauagcccuccaguuucagccucccaagugcuaguauugcaaguguggggcuagcacaugccuuguuuguugauuuuaaaccuucugagaauggauguuugugcauucuguucucaguggggguugcuauggguaccaaaugagccagugaguagcuacaaaggccacugauguggacaguguagggaggguagugggccccccccagcccccaagguauagcaggacuugaguacuugguggacuggucauggcauuggagauagcugugguuuguacguagucagagugaauacagcaaccauaggaagauuccaugugucccugcaagucagcaucucuauuagcugcugccucacaaagccaagccaggucuguccagccaggcuggucugcgaaguguccacagugcagaaguaucucuccuuucugggaggagccaggaaugacguguggccuggugcuuucuuguguguacguucuuauucuuggagacuaagaaacaucaaccuauucccaacacaucucugugcuuccccuuccugcuuaauaaaugauuuggccaagaaggaaaucaugguuguuuucaguuuuccugggcuauccugguacagaaaugugaucuugaacguuaguuuuaaggcagccaaguguuggguuugaaaacuaagauuugcugaaggcguccuccagcgcacgucuucuccuggcagugguggugcuuagcugagugugacacacucuccgaaaacuggucugucugugaugacgggaacugaggucacuacauucuugcuucugcacugcauggcuuauggcuccgguccucucagacuucaccacaagugaugacuagccuuugacaguugucaccugggagcccucuaauaugcagauuugcuaccuguauccaaggaguggaaggggcacgaggauucugucuuuucucuuucugagacaaaaguuugcuauguaaccuaggagauccucaaaccuccuauauacccuagguaagcccuauacuugaaauccuccugucucagccucccaagugcuggaauuauaagcaugcuuuaggacaccuguaggacaauucuguacuuccaacaagauccccaauggacaccuaugucccgagauugaguuuacauaacagaauuuaagugauggagugccagagacugucacccaaccuggaaucuuguagauaaggaauacaggcuuaaggaguuucagaggccacggggacauuaauaacagcaucacauuaauagacugagccagggguuagacaugcacaggcucugguuggaaaauuaaaucugaucucauagcucuaguaugggcaaaaugccuagaauggaugauggcugauuucuagucaagcucuuugauggggaaaaauuacagaccuucuuccagugcacuuggagccaaaggacaguguagggaaguagcaggcagauauauaaguaucuauuuaaaacauuaaaaucgguuuuaggagaauccucuguuaaacaaaauuaaaaagaaacucccauuuugguggagaucagagaucaguaauuuuucacagggagacaaagaaucaaaauuaagacagguauaaugucaauaaagauucaguccuagaagaaaaacagagcaagccugacaaaccgcugguucaguggucuaaacuagcccuuuaauagccuuguuugacaagguuaagauaacuccucacuuguaugaaaaauaaaaaauaaaaaauacucaguauguccaguacacagaaggcaucagucuguaauuaccaguuauuaugaaacuuguuagaaagauugacucaaugacuauaaauuuuauuuuuuagaaaccugaaauguagcccuuaagauuuugaaauuuauuuggcugaugugucauuuaauaguuauaaggagacucugggauggaauacguaggauucgugucuucccuccucuggcagaccuuuauucaugaggcccuuucgcuaaaaacaaauggccauggacaucuuuaguguccaccaaaccaaaacuaaaaguuugaaaucauuugaagaugaaaucacugugacucucucuuaauguugcucucuuugaaguaucuugaauguuuuccacaauagcuaacgcccuccccuaccccaccuuccuguuuacucuaaguuugauuugcccacauaaaucaucaaagcguuuuugaaagaggaaagugaugggguucacucugugugugugugugugugugugugugugugugugugugugugugugugugugugcuagaauucacacccauuauguaaaccauaagugaaacauuaccaucacugggcuuaauuaaauauuccugcuuuaaccuugaaaaacccaagugucuggauauuacagaagauucuugacuggaguaguaccugaugaaauguuagaugguaacaaggugcuguccugaaggggaaaagggagucuugggaaaaugaauguugucucuuagauuaauauagcaauugguaagcuuggauauuuaaaggcuucgaugguccuuaauauaggccaucaaauuagaauaaaauauuaaauuaauucaaauaaaaguauaacccauuugagccaccacgaacacaguagaagaugguuucugguggcuuugccucaccaugggaucaaagcucagugacacagucacucuggucccugccuugucggacacaggcacaauugcccagcgucagugcauuucccagcgguaaaauccugagcccuuaaucacagaguagcuggcugucuugaacauuuuaugaucauaaaguagaguccuaccgugguaauggcaauccuuucgaauuuauucagcucucugcccuuaagagcagacugaauuccuuguucuaaauggcauugccacaagugguuauuuuuaaauucccuacguuaaauuaagauaauaauauggaucccugcuacuugugcuaagagauuuuucucucagcugaaaaugucgcuuuucuugaagauuucaacuuuucacauaaauuuccuaauaguuuuuuuuuuguucguuuugaggugaugcagaugauuuuuuuaaauguguaagaauguuuugccugcaucuauguauuggcacuacauaugugcccacuauauguuucagaagguaucugaugcccuggaacuagauuuguagaugguugugagcuaccauguaggggcuggcaacuccacccagguccugugcaagagcaaccagugcucuuaacuacugagccgucaccacagcuccguccccaucgugugaauuugugugcuguucacagcagugggcuaugugucuugugucuauuuggaggaaauaucuugccaacaacuuuaaggauaaaugagacaagggugccacguugucuuugccugaacuuuccgggacccuguaugcaaauguauccaaauauaagaucuuccuaugagacggacauguggucuggucugcgcucucucucucucucucucucucucucucucucucucucucucuccaccugcucuagucugagaaaccccuuuuggggugggagugggcaguggugggaggcaauguccacucuauaaggcugguaugguuacaaaucaaccucuccagaugcaaggcuuauguuugaucugcuccgcaaauaagcacucccaggaugguaacccacacuguucaauaccacagcuccagagggaugcuggagacgggaaggaguugcaacccacaaggcuggagauaugcagggagcuagggacacugaagggcccuagcaucuuggauuaauucacuacacaguggagacuauugaaaugagaaggagucuugccucaguaucugggaaggaucuagggaaggcagucaaaugcagauugguaaagagcagcgaucagucaguucauauugccuuaacaauaucugagcucgaugcggugguacauuccuguaaucuuagaacugggcagugggggauuauggguucaagguuauccucagcuacauagaguuugaggauuccaugagauaugagacucaugucuucaaguaaaacaauaacaacaaaaaccaacaaccagcaauuuaucacauuuauauaaauuuauaacuaggcaauuuauaaaaaauaagacuuuuguuucucgcagaccuaacuacaaguuuaagaagaugcuggaagcuucagugucuuagagaacucaacuuuccucauucagaguggggacuuguugugcccuccagagaggacaagcccuacuccauuaauagcagugagagccuucacuuaaucccauccccaaaccccacacaacccuguguauuguuacuucuccggggaguaaguuucaauacgugaauuuugaggcauauucauaugguagcaggcaguaaguccacagcuacacuucaucaaagcaaaacugaggggaggucacagaacagggagacgauucagaagcggacauucgaauguugucaguauuguuaaguauguaucguggauaguucugaggcugagaauguaucgacgcuaacugccacgggaaggcaggagcgaagagaaccaagucuguaguccaagaggaaggcucaagcaucauauaccuuccacguugucagaauaaaagagucagucaugaagaaauaccauuucaaugcuguccacaugaaggagaucuuuacaccuucaagcaugggucauuuucaaaggagaaaguuggagaaggaaaugugagaagaaaagguuaagggcacagagcuugcuuauuuuuucuccuuccuuccucccguccuuccuuucucucuuccuaaggaccggcugacauuuucagacauuaugagggaacagcaagacaaugaaaaaguuucaaaguccaggaaaagcgugguaauaaaugccauagagaccucaggcauccaagagcucccuccugguucuugccucucaagguggacgugugggcaucgauaauuauuccaaacuaucuugacuucaggguauuaagugcuaaccagucaaagcauaagauuuauauaaaagaaaugcccacuuaauuuauuaaaucagacuuuggccaaguuacuggccauuaccugugacuugauaagacaugaaaaagucuaggagaagucuaaugagggccuuuuaucugugugggaaaggucauugcaagcaucaaauauugaauuuuagaucagugccacacugaguagguauauauuauaacucaaauuagacuucaaaaggacuaauuugcuagggguucuaucauuuaaaauaaucucuuguaauaaaacugacucuacaggaagauauuaaucgcauacuuuaaugcugucccuucaaauuguuuuaauggguacacauuugagcggaauauuaauuuuuccaguaaauuggcuuuuuugucaacuuaaaagaggauugaaaggaugauaguaaaauguuacaagucaaguauaaauccagguuuaauuuucuuuauuuucuccagcauugauauuaacuagugaugggcuugaaauauaauucaguaaacugacacaggcgugacucaguaaugacacacuuaauuaaucaaguauuaauaccauaugaucaaugggccucugauuuuuaaaaaacuauagauaaaaugucaggggaacuuuuuguaagauaauaggagauucacaaaucaucuguuuugggggguuuuggugauggugguagcaacuacacucauuauauuacauucuguuuuucuguuccccugguaaacuuuuuuaauaaugaaaggugcaauuggaggauuucuuacuggacucucagaucuuuggguagaucagcuauauuccauaagguugauuuuuuuuuuccuucggggaagauagaagcuacagaaaacaaauucagggacuuucaucucaggucacuuauaugauccugagaggaagagauaggagauuagcucagacagugagcauucuucaggguccucagugacaugccuugaaggacaaaguguauguuuguagcucugcugcaucuggggaaggcagcuguuuucagagcaaaggucacggugacugaauggagcaggaggcccguuuguaauauuuucucacccauccacaucugcccggagguggggguagacagacgcuauaucuugguucccagacugcaccuccaugccugcuguuaacacucuaccccggucccacaucauagcaugcuguagaauccuucaugaucacuggauacauggggagucuguggaaaggaaaaggcaguuaguucacccuccaggucuucaccucuggagaagagaaucagcaacaagaucagccagucucgacaggcucagagcagucucgacaggcucagagcagucuccacaggcucagagcagucuccacaggcucagagcagucuccacaggcucagagcagucuccacaggcucagagcagucuccacaggcucagagcagcccaucgggucaaccacuaagcucugacuuuccuuaaggugcuucguuuuuuacauguuagguggugccaagugacaccucgucacacacggcauguagucaguaggaauggccgcuguaagcguacgcuaaccgaggacacacuggcuuuucuuuagaugagcugcuucagaaggagcagaacuacuccgacgaugucuuggccaacaugaucagugagcccagaaucagcuacggaaacgacgcucucaugccuucgcugacggaaaccaagaccaccguggagcuccuucccgugaauggggaauucagccuggaugaccuccagccguggcacccuuuugggguggacucugugccagccaauaccgaaaaugaagguaagagucccuaccuggagccaaaagccuucuggguggguguggccuauguuauagguccccaugguaacaguugccuagaguacuuuugagagaaggaccugguguguggcagagaucugugucacccgcagggauaccacuccuauagauuagaggacucacaguauaugcugugauugccccaugugccgucuucaucucuacauuuuaaaaaagguaacaaaaauaaacuaguacuuuuuauuucuccuuucccuuuguaaauuuacauacauauuuacauagagagaggcacacaccuaccaacuguccaagacuggcauguacaauauagggaaacaccaucucaaaauaaaagugcauaaggaaacauagaucaggucauggaugacuguggagguggggggcgggguggcagagagaaggacagacagagacacagaacuagagacgcacaucuuuggacucccagaaauccaccugccuccuccuauguuugggaauuuaagacacugggaaauaauuauuuaaacauacucucacugggaguuauuuuaucucuuccaugaaaccaggauuugauuugcgcuucuaagcuuuuggcccagaauguccaccuuuaaugaaaagggugaccaaauuaagggcagaacuuggucccccagagagaagguuugacagggccuuguacaguagacagacgcugaaauaauccuccucagccgccgauucuuacugaaagaaugcagcgaacgcaauagaaugaguagagugaaugaagcaaguuuacgucagaacuaaagagaaaugauuucucgaucaacgaaucugcacaccugggugauguaauucuuucaggggggauuauguuagggcuucuauuccugcacaaaauaccauaaccaaaaagcaaguuggggaggaaaggguuuguucagcuuacacuuccacauugcuguucaucaccaaaggaugcaggacuugaacucauacagggcaggaacuuggagacaggagcugaugcagaggccauggaggaugcugcuuacuggcuugcuuccccuggcuugcucagcuugcuuucuuauagaagccaagacuaccagcccagggauggcaccacccacagugggcccuccgagccuuaaucacuaauugagaaaauaccuuauggauuucauggaggcauuuccucaagggaggcgccuuucucugugauaacuccagcuugugucaaguugacacacaaaaccagccaguacagggacuuagaagaaccuguuuaggaagcaacaaaauaaccuguuagcuuauuuugccauuuuuccauguucaguacaaauugcaugcacacaauuaccuugauuucuugaagcuaagaaugcuuuccaagaaggcaacaguaucugccugggguuuuccucacagugcaaaagcacugagcaaacagggugaugguuguguuugguugguuuuugguuuguuuguuugauuuugguuuuggggucuuuguuuguuuuuugaggcaauaucugucuauguaggucuggcuauccuggaacucacuuguaguccaggcuggccccaaacucacagaguucuaccugccucugcugggauuaaaggugaguugccaccaugccccgugagugagcaguuuuugaagacaggcugcggaaaucuguguauacacuuuuuuuuuucacagcauaacaacccaauuuguuucuuuaaucugaaaaaacaaaggcaacuuacagguauaauuauauuagauacuauacagcaucaacauuauuuaugggauauaaauaauugacuuucccacuuguuaaaagaauccuaccaaaacaaaaccaaaaagaguaggucauuugauuuucuaugccucaugguuauuauauagauacauuuggggcucuaaagucauuguuaccccguacauaaucuguaauaagaugaguauguaaaaaaaaauguacagccucauuuucuaagcucagcgcacaugagauuggcucuucauaguaaaagcacauacugugacaagcacaugugacacaacacagacacagucacugauacucuugacaauugccaagauguccaggcagagccuugauuuaagugagucuggacguaugcucaguacucagugcgauguagccuagccuuuaacauccaaagcaggcuuucuuguuagaggugugcuacuggggcuggggagaucacucaggaaacugguuuugccuggcaagcaugaagaccuguguucaauccccaccaccuauguaaaaagcaaggcuugguggcucuggaaagguagagagagauagaccccucaggcgcguuucccagccagccuagccuacuugguaaguucuuugccacuaagagaccuugucuuaaaauucaaggugauggugcaaauaacauguacacacacauacacacaagcacacacgcaaaucugcuaaugauuaacagcagaaugagagcaguaacaagagagggcaggaaucuagucgauacaaaggcuuaugcagaacaugugaaccaucuaucuauucagucugcaacaaugccagcuuagcuuuaugccccagggcacaugagucuuccugaucucuaagucuugaaguaugggucucaccuuuauauacccaaugccccauuagaacagguauuuugaaaagccuuuucaacaauuaauucguuuuguuguuguuguuguuguuuguuuguuugacuuugauggucugaggggugaaccuaggauuugugggugcuaagccugaccuccacuauggaugguagccccccagccuaugacaguucaucuuagaauaaaugggacuggcaaggucuuccuggaaaaacaauguugcaaauagcaacaauguugcaaauaacaacaauggugcaaauagcaacaauguugcaaauagcaacauugaaauaauacagcccucccuguauuuacucaguaacacacacacacacacacacacacacacacacacacacacacacuaagaacugcagggguugguugguucaguaaauaagaacaaugaauuguucuccaaacaugaaguccugacuuugaaucuucaacacuuucauuaaaaaaaaaaaaaauggcuauacauacuccaguauugggggcaaacauagguagauuccccuuuugccccccaaaacuaaaucccacauggcagcauauaucauauguguaacuccuguauuggaaacagacauaggcagauccugaguguucauggcccagccagccuauaugaaacugcaagcccaggcucagugagagacccugucucaaggcagcaaggugcagugcuagaaugagauacgcuaaggccugcucugcagugugcauggaccaaccaagugcacacacaggcacaccuguguguacacaccauucaugacaugcacacacaacacuauggagccauacugaauucauaaauucagagcugaaguggguucuggauuuacauuaccauuaaccccuuacauccagugggaaguuagagagccguguaggguguggguugcugcagugacccuguguacuccggcauucagugaccuggauccucacccccacuaaauggcagucaugccucucuuugcuuagucuagggacuaaacaccacauuccccuugggagaguagccagggcuccuaauggucaggucugacguuccauuacagcucugcugugugacugcucacgugacugagccucuccagccacuguccagccugagauaaucuguaucuucguuccuugcuuaaaggcaguuugagaacauuuucguggagagcucuuuaaaacaccuuuucaauggagcugggucuuguuggagcggcguggucauucucuguccagauggcucaccuugcgccuaaacaguaugcccuucaaaugaauaaguaauaaaggcauaugauacaguguuccugcugugcauuccccauguucccuguucuccccuacacacacccugagcuacuaaaaauaccuacagcucucaaaggauuuccuuucauuguccaugaggcccuucccagcauagauucaaaugcuuaccagaaagggccugauuuucuucaacaaaaagagucaaaaaaaaaaaaaaaaaaaaaaagagucaagaccaguagauaccuggucauuuaguucuuuuacauugagaaaagaaaaaaaaaaagaguuaagaauguggauggcucugaugagaguauuuucaggacacgucagggcaguuacuuacacaaauggauucagacguugagacggucagaaggcgagaccugcacaggaucugcaucgagugaagaggugaucauacgugccagcccuaccucagaacuuuggcaguugauggcugcugcgagccagggagucaguucucuccaaagaugcgguccgcgguccaguagauggcucuccaccaaugugcacgcuggcggugcugaguggacucuauggcugaaggaaaggacacaggaaguugggagggaagaauggaagaggguagaggaggaauuggggaugagggaguggagugggaacuuuggucaaagcacagcguguguauauaucccaaauucugaaaggcaauauagguagacaagaaacagaauuuuuucauaccguaaacaauaucauaaaacaaaauuuuccagucagggaaauuugucagaauuguguucuuaccucaguagaaugaauagcacuuagaauaaugucucucuacacacuaguaauuuucaucauuagcauaauacuugugggugaggaggcaaccagcuguacaccuugccugugcaccacagguacaggugcuacccugagccaaacguacauuuucugaggugugacugucaacagcgaggggagcuucguuuggccacaccagcaaccgcugcaccaauuagcuccucggcaucaagacauuuaaaaaaguagagucacccucuucggcuaacuccauuuuacaggggucauaaaaaucacgguucauauuugcggugagaaaugagauauagagaaacuguccaugucauuguugaaacagacagggcauucaauaaauggaagcauacagcaugagaaccuucaauguaaucaauguaaucaaucaaauaucgcgagaagcuucugaagugaauuuucaaaacaaucaguccuuacugcaauaaaaagaccaggugcuguuaccuuccuuuuuccauaagaggaaacaaccucgguggcuguuuggccacagucacacaccuugacaccgguucuggguuucuucgaugccauuccuccacuucuuucuagaccacguugccaguuuccacaccagcaaagucaggaccgcuucagccuccugacacgcccaauucucuuaaugcgcucagaagcgcaauuggcccauuuuaugaagacaacucucuguccuucuguucccugccgccauucuuaucaacugugccauccauucagaacggauuugggguuguggucacuuucgaccacuuggccugugagccucuguaagcuaaaugguugaaacuguggguccccaaggcucccaucaaacucccgcuggcuucccuccaccacuacgcucagauuucuuucucucuuuuacacuugccagaccugacccaggggacuuccuccucccuugccuucaucugcccuucagccacuuguuaauccuuaaagcuugguugcccucucucucccuuccuuauuucuucaaaauccagucugagcugagggaaguuguuuucugacaagggacagaacaccgccuugggaaugccaggcggugcagagucaccguggggauuaccgcgcuuagacguuguuuucuuuggaucagucccagaacgcguacaaaaggaugauugugacugucagcagauaugacaggaaauggucucauuucacacaauucagaugaaugucaucuguagagaggaagccagccauuucaaaggagaaacgggggggggggggagcccguggguuacuucuucuacccuaaacucagaaggaauuugcuucacuaaauggcaaaaagcguugcucuuccgauaaacucauauuugcauuuccccuggcaauugaauaaucccuuaguaguuaauuaacuguaaaagaagauaagauugaguagcuguaggaggagguagcuuuuaaguuuacugcugggcugggcauaaucuauuuuauuucuaaucaaaagccaagaaaccaucucuaaccuagcccagaggaaagucuaccuuccccagccuccgucuuugauccuauuguacauccuggugagugcucuaugaccacacuaaggagacacguuggcacgucaggggcgcuaagccuuuggaagugguaccccuccccauccuugaugcccaggauuagcucacaaagguucuuuuuuuucccagcugcuccuuuuucaugacuuguuuauugcaaaugcuuucccuugcucuguguucagaagccacgacuuaaccauccugauuugucuccuuugcucucugucucuugcuuccugcaccagucgagccuguugacgcccgccccgcugcugaccgaggacugaccacucgaccagguaucugacucgccccauuucgccucugcucucagcacugugcgcuucagcaaacaugccucucuggguugcacguguuacgggauagaauuuaaaacgacuguaggcaccaagcaugauuucagagucuuggcuucuccuuaugccucauuucccaaguuccuacgugaucuaguguuuguuuguuuguuuguuuguuuguuuguuucugagccuucuuucugaaacaaagagagucuuuucaaauguggggcucuuuuucuugauuucuuccuuuuuuaauaaaugaagagugugauguggacccuguccucacacacgguagaggcccagggagguguagauuucagugggaaauugauucuugcugaagacaucuccuuccucucuuguuuaguauucauggggguccuugaguggccucagacuuuuguugguuacuaacauagacacaauuuccuuaaaauaucauuauugguauuucuccagcuccagaaauacuuagugcccucuguggauugacuaugcuuacgcucagccaguggcugaaguaacacaacagauggauaugcauaauuuugcagagaagcccuuuuguuuuucugucuuacaaauuucuucacuaucaaaauagauauuucuuuuuauacaguuucccaagauuaaaaagaaauggguuucgacccccuauucuauguuuagcccccggcuaaacuuaaagucuuaagaauaaugucacaccgcaagagacauagaacccgcuugugucuacuccuugcacagccucaccccacugauagugaccgacaaagugaaucagagaggggaaagucaaugaauuggaagaucuguguauuguggagagauuuucuuccaaauagcacauaccuucccacguuuacuuucuuuaugcccagaucccaugagauacucaagagcaauguuaacaucccuuggggacaucacuaaagggagguaguuuugcuuccugguucagagguauccccaguaagaccagauauggccacgccccucuucuugccauucaaaucucuagccuuggcugcugccagccaugguccuagggaaagacuuugagaguccuucuggcaucacacugaucccaugaugugguucagcaccugagcagaaauugcagagugauacgucggaggacagcugaccucauugaucugacgaacgucuugucugaagugcuuuuaaaagaaccuugaguuauauaaguuguacacucuuugggcucucucauguccucuuuaaugacagugucacuaaguaaauguccagggaaccagcaguugaccuucccaugcuguucugccagccagugaagcccaaggcagggccaguaaguccagugaguccucaccacagcuacaaccagcucaagcuggucuccuagacuuuuuaaaauagcacgcuacucguuuuauuuuuuuaaagaugaccuauuuuuuaucuauaaacauaaaauguaauauugaggcguacauccagccgauuuuauuacauuccucuauuauauaaggauguacuuguuccuguucaaauaauccagcacucacacagucaaccagcucaucuucucacucuguuuauguaaacugaacauguaaaaggcauuuucauacacuggcaaaaaaaagucaucuguuuugagaaaagaaacuaauggcguucuacagaacagggaaagccuacaauaacaacaguauuaucccaugagacaucaauguuguaaauucugugaauacucaaaaagaauaaaugauaagguucuugcucccgggggccugagauguaaucaaaaacaacucacuuugaauuuagagaaagaugggaggacaggaauauaugaggacacacaaagacguuuggugacagagcauguuauccagggaacucucuggaaaggagcuuuccacagagagaggggagugggagauuuaaggcccaggggagggcgaggaggaaaucaguuagauuagaaacuguccugggcuuguccuuguaagaccuguauccauauauccacauccuuccaaagauagccaccgaagaggaagaugguauacaccaggcaugcggaagccagcuaagcugcaauuaugagcauggaauuugcucaccgugucugaggaguuguguaggcucuaucaucuguacuucuguguuggcaaugagucugccgcauauucagacugauaccuuccuacgcugugcaccuguuccaauaacucuacagccaccuguuaggaauccacacucuggacucugccacauugcaucuguagacuuuuccggucuuagaugcccuucccaggauugcccuccaccauugcucuuuaauaaucuuucuugucacucagaaacaaagaaaucaagggugugaguuuuggcuuaguccuuucuaugcccuguuucacaucaccaugaugaagagaaugauuuucuuucuuaucugaaaaaccaggauauuguaacuuuuagaagauagugucacccacaagccacagcaauaaugaugccgauuuuuagacacagugacaaucccagcuacucacucuuccuggaauguuuccaagcaaaaacuggacucuugcagacaauaagaaaacacaucagcagucucuucacuugguguguuaagcuaccccgccauuauucccugucccauccuucuccaggccuaacaaucuaguuucgugaccccaagagauauuuuccuauugauuuauuucauuguucuauuguuuuguuaaucucucuguaauaauauugcuuagugcguagaacaucuucuaaaugccauuacgugcugaacagcagugaaagagggacucuuucugcugagucuuacacuacugaacugugaacauugccagucgugcuagcaugugacgugaauuugauuuuuuuuuuuugccuuuuucugucaucagauacacugucaguguccucuccaccauaccaggagcuuauacgguuuuaaauggggacguaauaauugacauauucaucgcaaugcugugcucucugccucccccacccccugauauaaaagggaagacuacuuacaaguuuucacuaaaaucucagaaguaacuuuaacugccguguuacuacucgcauguggugagggaaggcugcauuagaaagaaaucacuguugaucuaacgaggaaguaggucagguuuuauaaagguuuggaggaagaugaaaauaagcaaccggggugauuuaaagagcauucaugucacugccacauuagaaaaaaaaauagugucaggaaguacagagaacagagugaguuauaauaugaaaaaaauaaagguaauuuuuuuaaguaauguaaaaauagaagguugcaguucuucaaguaguauccaaggacaagggcugucgaaugaaaacaagcagagcuaaugagaugaaacagaaaggggacuuacaggucucguugugucuuuccugucuaaauuaauaaaaaugaucucccgaugaaaggaaauuaaaguucagauagaacaccgugagaaaagaaagcgcuaagccuuuguauucguugccuagucaccuaucgcuguguaacaaguagccccagaacuuagcagcuucauagagcaagcguuuagcuccuuacagcaguuucagccagccagcauuuuagcauagggcagagcuggcugguucuggcucaggcucuuucaugaaaucacaaugaagacacugccaaagcuguggucuccugaaggucuggcuagagcugacagagaucaagcacucucuuggcugcugucaggagccuucgguaccuucccauggcagcuggcuucccacacaccaagaaguacaauagagggaauaagaaagaagcuuuggugccuuuuauaaggcaucaguucugccauguucuacuuacauagauaccauaucauccccugcuccggagaacaaaagaacaaaguucugguuuuuugaaaucauuauuaauaauaaauguguguuguauacucacauauguagacaaguacaguucccuacaacccaggcuaagaacacaugaagaggaacuugaacaacaguggcuagucauugugagaguuagaacagaagaguaggaaggcccagcuagaaggaaauggggaagugugauccagaggcagaagcgagggagagcagcauuguacugugagcagauuggcauucaucaugagccugguuuacgguggguuguccaagggaagcguugugggcaguuagacaagagguggugaugagucacacccagcauggacugcccaggucugucaauuauacucacucucagcagaagccaugcugacuggcugacgggcuuucucagugcuuaugaccuugugcuuuucagggucagcaggggguugacaaguuuuccaauacuugauggacaagauuggaagagccauuagacccagaagaggcaaugaguucccacaggaguugcgggaauucacaauguguagccagagaaaggaauccucacugccuugccuuuaaugucugacacacgugcucaaaccuaccuggugucacagauagaugccuggcucacucgaaauaggaccaggcccugcgguguagguuacagggagaccguguugcaguaaucuguaggaaacaaaaucauucucucugguaugcaaacugaccucuaccuuugaauucacguaggugcuaagaaccugccuccauuggaaacaucauggaggagguggcucuaaaagcccuuccuucauagccucagauucuacuucaguaggaucacuucagaaaacacgacaacugaugcaaacggacaucccuucugucugucuucacuuccauuucuaaaacauauuuuaccuuuuaguuuugagccucagaugaauaguugaaucaugaaacgcuguaagaauugguccaagaaccaugcagccacguauagagaaagaggaauuagguaaugaauucuauugaucccagagacgcucucuguucauugugugcuccuuucgagucagcggaugaagcgauuccacggggcguguucagcuagagagcugggaugcugagcuaaacaaauuaugugacugacagugcuaccgccgugcagagaaauaugaacaugauuuacuugcaauuagaacaaagcuccaaaguaauggauuuguucucccaggucguuaaaguucauuuccaaagccgugcauuucguuuuucuuuaagcagucccagcccauaaaaagugcacacauaauaaacaacaagccgcuaaaaccaagucaacauuucuuagguacaauuuaaccuggcaucuuaaccagcauugauuuuuccccccuuucccucccuccccuuuuaauuauggcauguguuuggccacacaggcauuacauauucagcguucuucagucuuuuuguuugcuagguggugguuaaugguuuaaaucuagggugucauuuuucuugagaaaaaucccuaaauccguuuuuccuaaaagcucuggccaagagagaacuuuaaggcaguuuuugccuccuuguggcuggcggucacacuaacggauggcccugcauacuuuguguuugacgcagguucugggcugacaaacaucaagacggaagagaucucggaagugaagauggaugcagaauucggacaugauucaggauuugaaguccgccaucaaaaacugguaggcaaaaauaaacugccucuccccgagauugcgucuggccagaugaaauacguggcaccucguggcuuguccugugucaaaacugagaaggacuacugggaauaaaaccaaaaugccugccuagaucuucacaaagauaggaaggagaggaaguggggcucuguugauaguucuugcugagcagaagccgcugagcccaggcggaacauacaaguguaauucaguccaacguugcagcuacgugagcugacuuccuaggaaaaugguuuuuucggguuaaacacaucuaaucccaauauccaaacuggaaggcaggauaccacaaacaagaaauucaaguccaugaggcucugauauuacugugugggggaagcauaagugaauuucauuuagagguggucccaguuuccaagauggucucauuauguaaauaccaaaaaaaaaaaaaaguuagaaaucaagauuuucgaaacccuuuuggucaugaccauucucgguccacgauaguuuuauuugaagaauuggucuuaaauaagcauguggggaguacuugguuguagggaugcucucucgcagugcuugguuaaguucucaucuacaaauggauaauuucaguccauuccaaccccuccuccuuccuacugcuuccccaccucccaguauuucuuuggcuuacaagggaaaguuagcagagacccuuuaaggugagugaagcccagcggugacuuugccgccucagcuucucagucagaaaucuugggcaaggcagauagcaguuucucuaaagacaauggcgguuuucuuccuaaugucagaauuagaaugaguagagaagcacgggucuuccuuauagguaggcggagauuauauaauucucuaccaaaaccucagaaauucaaauaagccaaauuccagaucguuagaguuccuuccauguuaccaguuaucacaauaaaggacuugagugggaauuuuaaaaacgguaagaaaauaccuguauaguggugcuugauaagaacuccagcucugugguuggguggagugugggagacugcagccugauuccuuuguaaaguaucuucccaguguuuguaaauaaaauguguagauccuaguaugaaucuccaaaagaaagggccuuuacuguugggcuucucaauucuggauuauuguagcaaaucuaaagcuggcuugggauucaauuuugcauuaauuuuuuuuuccuuuuuuuauucagaaaaaggcacccagccuucugaaauguaguuuucguuggaaaguuuauugcuguuuuguuauugugaaaccagaggcacuccugagcaggcugaaacugcaagguuucaaaacaaaucugggguaacugcugaaaggcuggcugggggucggggcguggcucggaagaugaguacccaggaucccguuuuccugagcuggugucauagacgcccuucucaguaauuacaugaacuucuauaaugcgacagugacuaaugacagccgcagcaauuagggguaucagcucccucuacugcacuagcugauaagauaauguacuauaauuagugcaaugaauauuacagaauuacaguauuuccuuaaagacggagggauauauccagacucacauuuauucccgaucaccucacuguaguaucauuaguuaauuaaugaucuccuuuaauaaauguguugagcuagcauuuuugguuggcgaggggauuaauuacgagccauuucuaauuuugccgcagaugcgcugugaguaacauccacuuagaaaaauuuuaucugcucuaguuuaccucgccuuugcaaacugcagcagggauggauuuagcgauggaaaucggucauucaccuaucuugaagccgccuggaaagaauuauuuagggagcuguuggcacuaacuuacauaacaaaugugcucuagaucguuaggcacagcugccccucccucccucguuuaacccaccauauaagaucaucucuuauauaacaagaugauuaaagugcagucuguauguguuauuucgccuaaguagauaaagcugggaaccacuggcuugcuuuucaaaagagcguggagacguauguauacacugcagagacuuucucaccgugaauacauuucuucuuugucacguucucaggauucuuuuuuauguucaauauaaacaaccagaguaaagcaauauugccaauuuugguuucuaggggcaacuggauaaaguaugacuuguuuguuacacugagauucucuuugccuacugcugcuucccuuggcaaacauggcgcuuuuaaaggagaguaugcguucugugguuaauugaaucuauguacuauuguacuaugaagaagguagcuuggcuguccuuuucucucugauuaacuccuguguuucagaacguuuuuugacccauauagaacaugucccuucaaagaaacggaagcaugcagguuugaaaccuagcuaagggcaaagucaccugcugugggcaggaacggagugaccuguuuccagaacaauggcggggaccucuauuugguuuuuaccaaaugcuuaccuguuaaagggcuucagaucccugcagacuucuaccucaugaugcaccagagaaauugacuucagaacccgggaagccaccuguugcucauuguuccagagacgaggacgcucaguccuagggacccaccaacucacgcuucgcugagcuauggcggaggguccccugaaacuuugcuacauccguugccucuugcgcuuacagaccuuuuucucggcuuccuuucgaagguguucuuugcugaagauguggguucgaacaaaggcgccaucaucggacucauggugggcggcguugucauagcaaccgugauugucaucacccuggugauguugaagaagaaacaguacacauccauccaucauggcgugguggagguagguaaaccuggaggcuugucugcaagugggaggcaagccaggaaguacaggcacuggcccggggccacuuaggagaaaagcaacaucccucugugguacucagggcacagcugcucucucgcuguuuugcauccaccccugggugccaugaauuuaaugugcucucauuaacauuaugcauuguuacuuuuaacuuaugacuuguauugaaauuaaccaaacuaagacuaauuaugacgcucagcuuuaaaaauacauguaugguuucucuuaaauaacaaaaaugguaucagaagucaaaaaacggaaccuagacguucauuucugauuuguauuuuuuguuguuuuguuugggccucugauuagaaccaggugaugauaaauaauacugauuuuuuuucaguaaugacuccuagcauuaauuucuggaaggaaguggcccaguagcgaauagcucaguauagcaugcgugguuaccauggaggaacauucaggcuguugcccugaacuuccaccugagcagagaucguaguuucccggaguuaguggagaagcacagggagugugggaugagguacacacgagcccuucacacugcauauaugcuggacuucuuucugcccgcagagcagccaagcagggacgcuuaccacaaaagucagugcuacgucaucaaaaaaguacaggacucgaauguaacuccuuccccgucuugauucggggaagaaagagugaaaggagguagauucacaaacauuuaaauauauuuguggugacgggaaaguuuuaaagcaucccugugugauuaacuuuuagauauauaauaguauaaaccaucuagaacccaaagaacgccgaguccaagcagaucucauuuuguaggugagaaaagucgaucaaauaaaaagaaccgcacagugccaagcuuaauacagucaggguuucccccauucuacccauugauuuccaucagaggccaguguuaaguaagcaucuaauuaaacccgaagaaagugcucuaagccauccuuaaucauacaaaggcagggacaguuuaauaaacucaagcuaaagaaagccagagaucucacauucauugguccuuagauucucgacacuucauucgugaggaugcucaugggaauuacuguggguuuuauuuuccuguccuaguugauguggauauacuaaagaccaguguguugggugaggcccaggaaacugagggggcaagaggcgaaagagcugaaaauuucacacacuagaguauaaacauguuuuguuuuguuucauuuuucucaaagcaauaacucuggggcuggagagauauccaguaaaguguuugccacacaaauguaaggaccuguguuugggucuguagcauccucacaacacaccaggcacaacauacccgggaugccaguacuggagagagacacgugaacccaaggguuugcaggaaucgacaagcuccagguucggggagagacccugacucaagaaauaagguggagagcuuugagaaaugccuaccuacaucaaccucuggccugcgcaugcacauguccacaugcaagagcauguguguguacaugcauacacacacacacacacacacacacacacacacacacacacaugcacagauaccaaauuugggguuuuguucuuucuauaauggcaccuaaguuuuguucuucaaggacuguaaaacauuaucuccaaugcaucuuucucucguuucuaaugaaaucuguuuucccccuacuucaauccccuauuugcauaugcgaauaauucaaaaacuccuuugaauuucauuaauagaauucaauuuaaauggucuuacaguggaaugacucuguccaagcugggacuucugucugggaggaaaauaagucugccaauucccaucuugauaccacaagccagagccugucucugcuugcugagucuaccagcaagguaccaaggcuaccacagagagaaccacagacagaguggauggcacaacaaaaguguacuuuccugaccagugauggagguuagaagucugagaccaggcugucagcagccuugguugcaccugaugccucucuccuugguuuguagauguuuguguucucccauggucucccgggggucuuacuauguccugaucucuuccuucuaaggacauacugggcuacagucugcccacaugacuucauuuggcaguagucauuauagccacaaucugaagccuuggauuugauaggggcacauugauacccaguaacaacaacacugagcaacaacaacaacaaaaaaaggugugauguucuuaccagaacuccauucacgcugagacaugggaauuuucucgaaggcuucaguauaacacacacuaaugcugacugcuuugagguacucuuuaggcaggcuuuggguagcaaaaaaugauacccccucaccuccuaaccuaagcccccucuuaaacaccuuccugcaaccuggaccgagugauucuuuugggcaguaaccaagagacacugccucuucagaaugacagagggaaagagguugacauguugauucuaaagaaacuucggcauccuggaagggucacugcucggcguauccaaguggcaucuucuugagcgccacucaagaaauggucuugguuuucacuugauucccuauagacucacuuuguccuggagagggaugccguggagagucugaaaucucuuucccuuuaacagucuguguuucuguccgugacgaggcuugguccagcuccguauugaguccacacugggacagaggguugaaauagaacucacuuguacugcugugccuguacccugcccuuggggaggugucauuuagcuggagugguagaacuaggccaccgagagcuacucuucagccuggggugucaguauugaagcacgcugccaugggcuucagcaagcccuucaucuuugaguaccucgggaaugcgcaggguggaugucacccucuccugccugacuuuggagcgcugcacacacucggccacagugucuccacagccacagguugagcuccccacccccgccccgccccaacugaucaaaaguauuuagggaaaauaaugcaccugagcaugaacagauuauuccauaaauaaucacuaugacaaccauuugcauuuagauuguauuuggaauuauaugucacagucaucugggggugcguagccaugcuguauaggggagaauguguguaggucauaugcagauaccaugcguuauuaagcaaagaacuuaagcacccuuccucuuugguuuuggaacccaucuccugugugugcugaagaaacgcugcacguacguggaaaugacacuauucccggcucuacuucauuuccuucauggaugagcagaccucauucaugucaguaagaacaaaaaggggcaacgaauggaccgagugucccggucacucaaggccacgucuuuguauuuuuccaucaccugggcaugguggaagcaugugucuccugaguaucucuuguccucacaaugaaagacucccaugggucacaaaguagcaagccuaggaaaacuguggagggaaaugugggcauucaaagaagccuaguggcuauuauuauuauuaucauuuauuauuauuuuugauacaguaaauagccaucaggcaugagcaguugguuuggauuuuuuaaauauuuuuuauuacauauuuuccucaauuacauuuccaaugcuaucccaaaagucucccuuacccucccccccacuucccuacccacccauucccauuuuuuuggcccuggcauuccccuguacuggggcauauaaaguuugcaaguccaaugggccucucuuuccagugauggccgacuaggccaucuuuugauacacaugcagcuagagucaagagcuccgggguacuggauaguucauaauguugcaccuacaggguugcagaucucuuuagcuccuuggguacuuucucuagcuccuccauugggggcccugugauccauccaauagcugacugugagcauccacuucuguguuugcuaggccccggcauagucucacaagagacagcuacaucuggguccuuucgauaaaaucuugcuaguguaugcaauggugucagcguuuggaagcugauuaugggguagaucucuggauauggcagucucuagaugguccauccuuucgucucagcuccaaacuuuguaacuccuugugguuuggauuuuuaauaccuaagaaguaaauauuaauuuaacgauuugcuuaacaugaugccaaagguucauucugccaggaaggcuuccuacuuuaguaacagcuaucauggcccuugaguauugccuccugaacaugcccacaauuucagucuguugcuagaggcacacaguggucacagagggauuggcacaguccucgagguagcuuugagggcccuugcuaggaggaaggcucauccuuguucuuuguuuagccggagguuucuccccagacaugaauauucacuuccagaauucaagacgauuggggauuaaaagaugccauuuggacucuucuccucgggugccuuuaaaagcaaucuauucggaagcccagagcccugugaacacugagggcuaagcuguccccauggcaggaaucgugaaccccuucugcuucccagcagcaaagggcauggaggauuagcacgcaaagcaaaccaagaaaagacagggaauugagaugcccggacugaguccgcucucggagccuuggaucuccgguggggcucccuugagcauuuauuuuggaguuugaagucagaaaacuaaauaacaguacuaaacacgaaggugcucugcuguucuuggaaaaugcagaagacuguuggcaggcagcucgagagccgcugccccuccucgagguauagacacacuaagaaacagcagcuacaugcuugaucuccaaagcaaguuuauuuauuuauuuuuuuaauucccuuauuugacauuucaguuaugggguccuagagaguggagaaaauggccagguucaaguggcacaggauugcagacaggcuugucucuagcaagccgaacaggagggugacugaaugcucucacuuuggggaguuaaucuguagagagaaggcauuuuagcuugcaagccugucgccaauuaaaucgaggugaccucauuuguugacagcagagcagaucacagcaaacaggaggagaugggaaaaacaccuguguguuucucccaaggggcagugaugcugagcaguguucucugagugcuagcuccuggguaggccuugguauaagaggaaaacacccaggcccuuacuggagugaccuggagacuggacugcaggcaacucucacaggagggaagaugcgagcagcucccaucuggaucccaccucgugcagaugggaggagucagggcggaugagcagaaggaaaugucccaggaccuaagggcagggcagcuccuauucccacugccuuugacuguguccugaagucuguccugaagucugucucgugcccagccuaaaaaggacuaacuaguucucugaaguggggucacacccaauggccaugaaggaauucaucucuacaaggcucuccaccugaauuacuccuuaggugggacuaggcgugaucuguguguaucauaugaucuauguguaucauaccacaugucuguccaucaccugguagguagggcagcacuggcaccaugcauaucugccccccccuuguuguuuuaggagccaccauaacaguaagacaguugugcagggucugaacugugccacacuggcaguaggcggggugggggcaggggacagagacaaagagaaagcuggggaauugccagacaucauuugacagugcucagcaaugggaacuagagaccucugaaaaaugaggcugcaagcuccauucaguccaggacagaauaagaaauaucccugugaaaugaaucccauagaacacaccuuaacuuuucugugggaaacaugguuuaugcuaugugcauacggacagaguccucucgucuuccaacgcggcuuuacagaggcuuggagcucauauuaauccagcagacucaagcaagcaccuccucuucuccucacugggagagguaggacaaauauagaaacaagaaaagccauuagcuacuguagagagaugugugccccgcacagucugcagagacuaacaccugcccggcucuccgugacaauggcugaggcagauuauguuuaccgugccgaccugaucuuacagcugaagccugcuguagagcucuggccuggcggaaaugaggccugaaugcaacccccaggacuacaaauccuguauguguaggaugaauggguagguggguggauggauggaugaguggauggaaggauggaucgacagacagacagauauguauguauguauguauguauguauguauguauguauguauaauuaggauagugugucuauacaguuucccuuuuugugucaaguaauaccccccuuuuuucaaauuuuuauuagauaauuuuuucauuuacacuucaaaugcuaucccaaaaguccccuauacccuaccccugguaauacaccuuuuauauacauacacucacacacacacagacacacacauacauccauauauguuaccuuuauuuauaccccuuuuauauguguauguguguauauauauacauauauauauauauauauauguauauauauaauaaaagacauauacauacauguguguguguguguguaucuuuuauuuaauaggcucucaaaacucucauuaacauuucuacagagauaaauguacuucgaaauggcagcagauaccuggggccccacaaagcggaguguuauauucugcacagaucuaagcgucacucacagucauucacagugcggcuuugugagauguucuuucuccuucaccaucccacaaacuccagugcuggcuguuucagccaaugugcccugugcagacccgaguacucgccucaagaauuucagcaccaccuaguggccagaugcagcaucggcguaagccauuggcucugccacguggugucagaaguuggggcuaaagcugauaaaucacgguuguuaaguacuuugggggcaaagaaaagaacugcacaccguguccuguuacugccuacgaguacugugcuccuuuaaaguccucggucuauuuuaaacccggaucucuguaccugcuuucuaggucgacgccgccgugaccccagaggagcgccaucucuccaagaugcagcagaacggauaugagaauccaacuuacaaguucuuugagcaaaugcagaacuaagccccacccgcgccacagcagcggccucugaacuuggacagcgaaaccauugcuucacuacccaucgguguucauuuauaaaauaacguggaaagaaacaaacccuuccguuuauuuacucacccucggcuuuugacagcugugcuguaacacaaguagaugccugaacuugaauuaauauacaaaucaguaauguauucucgcuuucucucuuuacauucuggucucuacauuacaugauucauggguuuuguguacuguaaaaaaaaaaauuagcuguaucaaacuagugcaugaauagauucucuccuaauuauuuaucacauacauagccccuuagcccguuguauauuauucuugugguuuguggcccggaaaaaacuccuacuugaaauaugcuuuaaaaaucgaugggggaugcuucuugugaacgugggcgucuagcugcuucuccuacguauucuuuuccugaucacuaugcauuuugaacauuuuuuuaaguauuccaaaugacuuagaaaauucuuuuuccaugacugcaucuuacuguacagauugcugcuucugcucucuuugugauauaggaauaagaggauacacauugauuucuuugugccuguuuuaugugcacacauuaggcauugagaauuugaacauuuuuuuuguccauguaucuuuggaucuuugauaaaaaaaaauuaaaaaaaaauuaucccuguucaucauaagcacuuuuacggguggggggagggaguguucugcuggucuccaauuaccaagaauucuccaaaaauuaauuuucugcaggaugauuguacagaaucauugcuuaugccaugauagcuuucuacacuguauuacauaaauaaauuaaauaaaauaacuccaggcaagacguuucuuugaagggugauugugugggagggaaaaggcaagaucccugcauuuaucaacccaaggcgcuucguuuaauaauacugacagagaaugaaaagccaggaagagaguaagagggaagagagggcacccugagacaccccugaggguuuguauaaaauuguguuuucauaggaauaccuuagacugguaugauuguauggugagaguuuauugcuuagucaucuagacccgugagaacaccucaucuggucacucacaccuaaccugugagucugaugaggaaauugugggcgcacacagcucuuagugcugguaaacuaacugguggaguuuguuguuuuuaaaaggcugugcuucccuggcuugguucuuccuuucugucuuagucaggguuuguauuccugcacaaaacaucauggccaagaagcaaguuggggaggaaaggguuuauucagcuuacacuuccacauugcucuuuuguuuaucaccaaaggaagucaggacaggaacucacacagggcaggaacuuggaggcaggagcugaugcagaggccauggaggaugcugcuuacuggcuugcuuccccuggcuugcucaguuugcuuucuuauagaacccaagacuaccaguccagggauggcaccacccacaaugggcccuccccccuugaucacaauaauugagaaaaugccuuacagcuagaucgcauggaggcauuuccuugagggaggcuccuuucucuaugauaacuccagcuugugucaaguugacacacaaaaacuaacagguuccaaaugugaaacacacacacacacacacacacacacaaacaaaacaaaaacagagaaaagcuguagaguuuugauuuggggguuuuguuuuuuguuuuguuuuguuuuguuuuguuuuucgcuuucaagcuagggucucaaguaucccaaucuaaccuuuaacucauguagccaaagauggccuuauccuccugaugguccugccucuaccuugcaaauauugggacugcagcaugcgccaucgugcccuguguauaugaagugcugggauuugacuucaaggcucccuguaugcuaaguaaguucucuaccaagugagcuacauccccaggcccuggaaaugauggguagagcagcugauagucugcagcaagcucuggaccugggcacuccccacauuuuugggggagucacucuuauucguggggauacgaacguucuaggauauuuaaccgcauccgccugauucuaaccagaaaugucucccgagcuguaugaugucucacacgccugugacuccagugcuugggagggaagcaagagaccaggccugccuggaaaacagggugagauccugucucaaagagugagaagcagaaguguuuccagaagacguucuccaacaccagaagacggaucaaguguccagauccugccaaacaucucuuacggaagcgaguuacaaaccacugaucuauaaacaguauuuugaccuuuauauuauguggcauguguuguauaugauacaaugaacgugcguuugaguuucaaaggacuacuggcugggaagugugugccuuccacucuguguggucuggaaucagacucaagucaucaggcuuggcagcaaguacuuuuacccacugagccuuccuaccauccuucauuuuagcuuaauggccugugcacacaaccuuuuauugaggaugcuuguauuaauuccagcugcuauaagaauaaacaauagacaaagacuaaaugucuaaacuucacauuuuucuauucuaucagggaagaagauugugauggccguguuuggguucuagaagagacuucuuccuagcuugcaccugaccgacuccucacaugauggugagggaagucucuagugcuucaucuuccuuggguguuaaccccaucuugagaccugaccugaccuagcccuaggcacuucccaaacaucccaucucuacaugucaucauugagaacugggguuucaauguaaauuuaaauccagcugcucuuccaaaugucagggagcacauuguuccuccuuuauuguccuguaucucaagaacguagggaucagccaaacacuuguaccaugugcuagagucaugguggcacacagcuugugggaguaaccagccaauaacugauuugauuuaaggcccucuccacaggguguaagagaccagauagccuugggaccuaggggaagaacaaauaauaauggucuuuuaaaaagaacaaaaaagugauaaugaaucagccaagcaccuuuuagcuuuacaucacaauauuuuaaacgauguuucaguauaccacuauaguauggacaaacuggguggaaacaccugaggguuaaauuuuucacagaagaauuaggugugacuacaccgaaaacacaggacaaauugugagaauaagauauuaucauuuugccuggccuagugagaggugauaggauaauucuaagacauuuacaucuaguacauuucuacugaugucaacgaaauugaaagcugacucccauacauaguuauguaugacacuuaaaguccaggccagccuucaguuguagugaccguaaguuuuaguuuaauuuuuuaauuuuuccccaaggagguaagauuugaaaguguggugugacuuucccacaggagacauaagcaaacaucuaucccagagagaucaucaagaacaaagaaauaauuuuccugaagucuaacggcaaacauuguguuuauugggauuaccacgggggaaauggauggagcacuaguuacagaggcaugguugacucaagaguagcuauaucaccaaaaggcccaccucugaggaaagaugcaaccagcucucugcaggcuccucucuccccaacagugugcucguauaaccuugagaaggaagggggacuuguugauauuguuucaggagcuuuccuagauugguggucauuuggcuccugagucuaaagaagucuccuggacagaaugaucuugauaaagaacacacuagcacucaucagggugcuaggacagggacuuuggugugguuagcagggugaaugacacaggguaucuaagaagagcuuaguuuguauuuauccccagugacguugagacuuucuugugcucaaaggcuauuuuacaguucaaaauuucaauuuauaucuuuuguauucagacuuaaugucuauauuaguauccacuuggcaacucuucugugucacauuucuacuugcagaguagguuuuugucuacagucuuaggguuuuaaggcugugaacagauaccaugaccauggcaacucuuauaaggacaacauuuaaugggaccuggcuuaaagguucagagguucauaaaggugggaacauggcagcauccaggaaggcaugguacaggaggagcugaaaguucuacaucucaucugaaggcugcuaggagaagacuggcuuccaggcagcgaggaugaggggucuuaaagaucaugcccacagugacacaccuacuucaacaagaccacuucuucuaguagugccacucccugggccaagaauauacaaaccaucacaucugcccuuucuauuuccagcugauccauccugucauaucaacauaacuucuguauuaacugucauagcagaacucuucugacauuuuaaaacauuugauuucuggagacuuaaaauaugaaaucuucuaaguuuguuguaguguuuuguuuuguuuuguuucaaaccuaguacuaaagcuuucugagcagacauaaacucuguauggaaauaucauaccaggaacauuaaacuaacaaaaaucacuguauaaaaucagcagcaggcuauuuguacaagguccacuguguaaaaucagugucagguuauguguacgaguuguauaagaaaaacaaacaaauuacuggccuaaaguugaguacuguucacgaaauauuucauugugugcauaaaauauguuuccuaaaauaucuaaaaggugaaaagaaagggucccacaugcuaaauaaggaaagagugcucaguuuguguuuucugguagagugcuguuguuguuguuguuguuguuguuguuguuguuguuguaauacauucuguaaagguaaacacaaauauuaauuuuccccagauagauaaccagcaccagcccacuaagauggaucuacugaaugaaguacaacuuugcaaaccaaugaguucacugacauuacuugcagaaauauuggugagauguuacuuacaaaaacauagaugacucauaagcagcugcuucaaaaaaaacaaaaacaaaaaaacaaaaaaaaccccaagucccauuugggugacacuucacaaaaacuguaucucuggagcucucugcauggcuuguaggcaggucugcaggcuagagaguccgcucuccccagcaguuacauaaguugcuuauauaaccuugguuuauugaauaaauaugaugugucuauugaacugauuucuaaauauuuacacucccagauuacugcuguuaucagcuuccuuuauuguaauagagaggugcagggcagagacucauaacuggggaggagccuugugaaucuccuaaauuucaggaacuuccugauaccuagaguuguuucuaggauuuguugagucuccaggauccucuucccuggauggcuguugaggacuuccugagucuuagaauguuuguuucaauacagaagaaacugcugaauaaca

SEQ ID NO: 8305 - RNA, 7243 nt, Mus musculus
uggcauucccaaggcgguguucugucccuugucagaaaacaacuucccucagcucagacuggauuuugaagaaauaaggaagggagagagagggcaaccaagcuuuaaggauuaacaaguggcugaagggcagaugaaggcaagggaggaggaaguccccugggucaggucuggcaaguguaaaagagagaaagaaaucugagcguagugguggagggaagccagcgggaguuugaugggagccuuggggacccacaguuucaaccauuuagcuuacagaggcucacaggccaaguggucgaaagugaccacaaccccaaauccguucugaauggauggcacaguugauaagaauggcggcagggaacagaaggacagagaguugucuucauaaaaugggccaauugcgcuucugagcgcauuaagagaauugggcgugucaggaggcugaagcgguccugacuuugcugguguggaaacuggcaacguggucuagaaagaaguggaggaauggcaucgaagaaacccagaaccggugucaaggugugugacuguggccaaacagccaccgagguuguuuccucuuauggaaaaaggaagguaacagcaccuggucuuuuuauugcaguaaggacugauuguuuugaaaauucacuucagaagcuucucgcgauauuugauugauuacauugauuacauugaagguucucaugcuguaugcuuccauuuauugaaugcccugucuguuucaacaaugacauggacaguuucucuauaucucauuucucaccgcaaauaugaaccgugauuuuuaugaccccuguaaaauggaguuagccgaagagggugacucuacuuuuuuaaaugucuugaugccgaggagcuaauuggugcagcgguugcugguguggccaaacgaagcuccccucgcuguugacagucacaccucagaaaauguacguuuggcucaggguagcaccuguaccuguggugcacaggcaagguguacagcugguugccuccucacccacaaguauuaugcuaaugaugaaaauuacuaguguguagagagacauuauucuaagugcuauucauucuacugagguaagaacacaauucugacaaauuucccugacuggaaaauuuuguuuuaugauauuguuuacgguaugaaaaaauucuguuucuugucuaccuauauugccuuucagaauuugggauauauacacacgcugugcuuugaccaaaguucccacuccacucccucauccccaauuccuccucuacccucuuccauucuucccucccaacuuccuguguccuuuccuucagccauagaguccacucagcaccgccagcgugcacauugguggagagccaucuacuggaccgcggaccgcaucuuuggagagaacugacucccuggcucgcagcagccaucaacugccaaaguucugagguagggcuggcacguaugaucaccucuucacucgaugcagauccugugcaggucucgccuucugaccgucucaacgucugaauccauuuguguaaguaacugcccugacguguccugaaaauacucucaucagagccauccacauucuuaacucuuuuuuuuuuucuuuucucaauguaaaagaacuaaaugaccagguaucuacuggucuugacucuuuuuuuuuuuuuuuuuuuuuuugacucuuuuuguugaagaaaaucaggcccuuucugguaagcauuugaaucuaugcugggaagggccucauggacaaugaaaggaaauccuuugagagcuguagguauuuuuaguagcucaggguguguguaggggagaacagggaacauggggaaugcacagcaggaacacuguaucauaugccuuuauuacuuauucauuugaagggcauacuguuuaggcgcaaggugagccaucuggacagagaaugaccacgccgcuccaacaagacccagcuccauugaaaagguguuuuaaagagcucuccacgaaaauguucucaaacugccuuuaagcaaggaacgaagauacagauuaucucaggcuggacaguggcuggagaggcucagucacgugagcagucacacagcagagcuguaauggaacgucagaccugaccauuaggagcccuggcuacucucccaaggggaaugugguguuuagucccuagacuaagcaaagagaggcaugacugccauuuagugggggugaggauccaggucacugaaugccggaguacacagggucacugcagcaacccacacccuacacggcucucuaacuucccacuggauguaagggguuaaugguaauguaaauccagaacccacuucagcucugaauuuaugaauucaguauggcuccauaguguugugugugcaugucaugaaugguguguacacacaggugugccugugugugcacuugguugguccaugcacacugcagagcaggccuuagcguaucucauucuagcacugcaccuugcugccuugagacagggucucucacugagccugggcuugcaguuucauauaggcuggcugggccaugaacacucaggaucugccuaugucuguuuccaauacaggaguuacacauaugauauaugcugccaugugggauuuaguuuuggggggcaaaaggggaaucuaccuauguuugcccccaauacuggaguauguauagccauuuuuuuuuuuuuuaaugaaaguguugaagauucaaagucaggacuucauguuuggagaacaauucauuguucuuauuuacugaaccaaccaaccccugcaguucuuaguguguguguguguguguguguguguguguguguguguguguguuacugaguaaauacagggagggcuguauuauuucaauguugcuauuugcaacauuguugcuauuugcaccauuguuguuauuugcaacauuguugcuauuugcaacauuguuuuuccaggaagaccuugccagucccauuuauucuaagaugaacugucauaggcuggggggcuaccauccauaguggaggucaggcuuagcacccacaaauccuagguucaccccucagaccaucaaagucaaacaaacaaacaacaacaacaacaacaaaacgaauuaauuguugaaaaggcuuuucaaaauaccuguucuaauggggcauuggguauauaaaggugagacccauacuucaagacuuagagaucaggaagacucaugugcccuggggcauaaagcuaagcuggcauuguugcagacugaauagauagaugguucacauguucugcauaagccuuuguaucgacuagauuccugcccucucuuguuacugcucucauucugcuguuaaucauuagcagauuugcgugugugcuuguguguauguguguguacauguuauuugcaccaucaccuugaauuuuaagacaaggucucuuaguggcaaagaacuuaccaaguaggcuaggcuggcugggaaacgcgccugaggggucuaucucucucuaccuuuccagagccaccaagccuugcuuuuuacauaggugguggggauugaacacaggucuucaugcuugccaggcaaaaccaguuuccugagugaucuccccagccccaguagcacaccucuaacaagaaagccugcuuuggauguuaaaggcuaggcuacaucgcacugaguacugagcauacguccagacucacuuaaaucaaggcucugccuggacaucuuggcaauugucaagaguaucagugacugugucuguguugugucacaugugcuugucacaguaugugcuuuuacuaugaagagccaaucucaugugcgcugagcuuagaaaaugaggcuguacauuuuuuuuuacauacucaucuuauuacagauuauguacgggguaacaaugacuuuagagccccaaauguaucuauauaauaaccaugaggcauagaaaaucaaaugaccuacucuuuuugguuuuguuuugguaggauucuuuuaacaagugggaaagucaauuauuuauaucccauaaauaauguugaugcuguauaguaucuaauauaauuauaccuguaaguugccuuuguuuuuucagauuaaagaaacaaauuggguuguuaugcugugaaaaaaaaaaguguauacacagauuuccgcagccugucuucaaaaacugcucacucacggggcaugguggcaacucaccuuuaaucccagcagaggcagguagaacucugugaguuuggggccagccuggacuacaagugaguuccaggauagccagaccuacauagacagauauugccucaaaaaacaaacaaagaccccaaaaccaaaaucaaacaaacaaaccaaaaaccaaccaaacacaaccaucacccuguuugcucagugcuuuugcacugugaggaaaaccccaggcagauacuguugccuucuuggaaagcauucuuagcuucaagaaaucaagguaauugugugcaugcaauuuguacugaacauggaaaaauggcaaaauaagcuaacagguuauuuuguugcuuccuaaacagguucuucuaagucccuguacuggcugguuuugugugucaacuugacacaagcuggaguuaucacagagaaaggcgccucccuugaggaaaugccuccaugaaauccauaagguauuuucucaauuagugauuaaggcucggagggcccacuguggguggugccaucccugggcugguagucuuggcuucuauaagaaagcaagcugagcaagccaggggaagcaagccaguaagcagcauccuccauggccucugcaucagcuccugucuccaaguuccugcccuguaugaguucaaguccugcauccuuuggugaugaacagcaauguggaaguguaagcugaacaaacccuuuccuccccaacuugcuuuuugguuaugguauuuugugcaggaauagaagcccuaacauaauccccccugaaagaauuacaucacccaggugugcagauucguugaucgagaaaucauuucucuuuaguucugacguaaacuugcuucauucacucuacucauucuauugcguucgcugcauucuuucaguaagaaucggcggcugaggaggauuauuucagcgucugucuacuguacaaggcccugucaaaccuucucucugggggaccaaguucugcccuuaauuuggucacccuuuucauuaaagguggacauucugggccaaaagcuuagaagcgcaaaucaaauccugguuucauggaagagauaaaauaacucccagugagaguauguuuaaauaauuauuucccagugucuuaaauucccaaacauaggaggaggcagguggauuucugggaguccaaagaugugcgucucuaguucugugucucugucuguccuucucucugccaccccgccccccaccuccacagucauccaugaccugaucuauguuuccuuaugcacuuuuauuuugagaugguguuucccuauauuguacaugccagucuuggacaguugguaggugugugccucucucuauguaaauauguauguaaauuuacaaagggaaaggagaaauaaaaaguacuaguuuauuuuuguuaccuuuuuuaaaauguagagaugaagacggcacauggggcaaucacagcauauacugugaguccucuaaucuauaggagugguaucccugcgggugacacagaucucugccacacaccagguccuucucucaaaaguacucuaggcaacuguuaccauggggaccuauaacauaggccacacccacccagaaggcuuuuggcuccagguagggacucuuaccuucauuuucgguauuggcuggcacagaguccaccccaaaagggugccacggcuggaggucauccaggcugaauuccccauucacgggaaggagcuccacgguggucuugguuuccgucagcgaaggcaugagagcgucguuuccguagcugauucugggcucacugaucauguuggccaagacaucgucggaguaguucugcuccuucugaagcagcucaucuaaagaaaagccaguguguccucgguuagcguacgcuuacagcggccauuccuacugacuacaugccgugugugacgaggugucacuuggcaccaccuaacauguaaaaaacgaagcaccuuaaggaaagucagagcuuagugguugacccgaugggcugcucugagccuguggagacugcucugagccuguggagacugcucugagccuguggagacugcucugagccuguggagacugcucugagccuguggagacugcucugagccugucgagacugcucugagccugucgagacuggcugaucuuguugcugauucucuucuccagaggugaagaccuggagggugaacuaacugccuuuuccuuuccacagacuccccauguauccagugaucaugaaggauucuacagcaugcuaugaugugggaccgggguagaguguuaacagcaggcauggaggugcagucugggaaccaagauauagcgucugucuacccccaccuccgggcagauguggaugggugagaaaauauuacaaacgggccuccugcuccauucagucaccgugaccuuugcucugaaaacagcugccuuccccagaugcagcagagcuacaaacauacacuuuguccuucaaggcaugucacugaggacccugaagaaugcucacugucugagcuaaucuccuaucucuuccucucaggaucauauaagugaccugagaugaaagucccugaauuuguuuucuguagcuucuaucuuccccgaaggaaaaaaaaaaucaaccuuauggaauauagcugaucuacccaaagaucugagaguccaguaagaaauccuccaauugcaccuuucauuauuaaaaaaguuuaccaggggaacagaaaaacagaauguaauauaaugaguguaguugcuaccaccaucaccaaaaccccccaaaacagaugauuugugaaucuccuauuaucuuacaaaaaguuccccugacauuuuaucuauaguuuuuuaaaaaucagaggcccauugaucauaugguauuaauacuugauuaauuaagugugucauuacugagucacgccugugucaguuuacugaauuauauuucaagcccaucacuaguuaauaucaaugcuggagaaaauaaagaaaauuaaaccugg

SEQ ID NO: 8306 - RNA, 7243 nt, Mus musculus
ccagguuuaauuuucuuuauuuucuccagcauugauauuaacuagugaugggcuugaaauauaauucaguaaacugacacaggcgugacucaguaaugacacacuuaauuaaucaaguauuaauaccauaugaucaaugggccucugauuuuuaaaaaacuauagauaaaaugucaggggaacuuuuuguaagauaauaggagauucacaaaucaucuguuuugggggguuuuggugauggugguagcaacuacacucauuauauuacauucuguuuuucuguuccccugguaaacuuuuuuaauaaugaaaggugcaauuggaggauuucuuacuggacucucagaucuuuggguagaucagcuauauuccauaagguugauuuuuuuuuuccuucggggaagauagaagcuacagaaaacaaauucagggacuuucaucucaggucacuuauaugauccugagaggaagagauaggagauuagcucagacagugagcauucuucaggguccucagugacaugccuugaaggacaaaguguauguuuguagcucugcugcaucuggggaaggcagcuguuuucagagcaaaggucacggugacugaauggagcaggaggcccguuuguaauauuuucucacccauccacaucugcccggagguggggguagacagacgcuauaucuugguucccagacugcaccuccaugccugcuguuaacacucuaccccggucccacaucauagcaugcuguagaauccuucaugaucacuggauacauggggagucuguggaaaggaaaaggcaguuaguucacccuccaggucuucaccucuggagaagagaaucagcaacaagaucagccagucucgacaggcucagagcagucucgacaggcucagagcagucuccacaggcucagagcagucuccacaggcucagagcagucuccacaggcucagagcagucuccacaggcucagagcagucuccacaggcucagagcagcccaucgggucaaccacuaagcucugacuuuccuuaaggugcuucguuuuuuacauguuagguggugccaagugacaccucgucacacacggcauguagucaguaggaauggccgcuguaagcguacgcuaaccgaggacacacuggcuuuucuuuagaugagcugcuucagaaggagcagaacuacuccgacgaugucuuggccaacaugaucagugagcccagaaucagcuacggaaacgacgcucucaugccuucgcugacggaaaccaagaccaccguggagcuccuucccgugaauggggaauucagccuggaugaccuccagccguggcacccuuuugggguggacucugugccagccaauaccgaaaaugaagguaagagucccuaccuggagccaaaagccuucuggguggguguggccuauguuauagguccccaugguaacaguugccuagaguacuuuugagagaaggaccugguguguggcagagaucugugucacccgcagggauaccacuccuauagauuagaggacucacaguauaugcugugauugccccaugugccgucuucaucucuacauuuuaaaaaagguaacaaaaauaaacuaguacuuuuuauuucuccuuucccuuuguaaauuuacauacauauuuacauagagagaggcacacaccuaccaacuguccaagacuggcauguacaauauagggaaacaccaucucaaaauaaaagugcauaaggaaacauagaucaggucauggaugacuguggagguggggggcgggguggcagagagaaggacagacagagacacagaacuagagacgcacaucuuuggacucccagaaauccaccugccuccuccuauguuugggaauuuaagacacugggaaauaauuauuuaaacauacucucacugggaguuauuuuaucucuuccaugaaaccaggauuugauuugcgcuucuaagcuuuuggcccagaauguccaccuuuaaugaaaagggugaccaaauuaagggcagaacuuggucccccagagagaagguuugacagggccuuguacaguagacagacgcugaaauaauccuccucagccgccgauucuuacugaaagaaugcagcgaacgcaauagaaugaguagagugaaugaagcaaguuuacgucagaacuaaagagaaaugauuucucgaucaacgaaucugcacaccugggugauguaauucuuucaggggggauuauguuagggcuucuauuccugcacaaaauaccauaaccaaaaagcaaguuggggaggaaaggguuuguucagcuuacacuuccacauugcuguucaucaccaaaggaugcaggacuugaacucauacagggcaggaacuuggagacaggagcugaugcagaggccauggaggaugcugcuuacuggcuugcuuccccuggcuugcucagcuugcuuucuuauagaagccaagacuaccagcccagggauggcaccacccacagugggcccuccgagccuuaaucacuaauugagaaaauaccuuauggauuucauggaggcauuuccucaagggaggcgccuuucucugugauaacuccagcuugugucaaguugacacacaaaaccagccaguacagggacuuagaagaaccuguuuaggaagcaacaaaauaaccuguuagcuuauuuugccauuuuuccauguucaguacaaauugcaugcacacaauuaccuugauuucuugaagcuaagaaugcuuuccaagaaggcaacaguaucugccugggguuuuccucacagugcaaaagcacugagcaaacagggugaugguuguguuugguugguuuuugguuuguuuguuugauuuugguuuuggggucuuuguuuguuuuuugaggcaauaucugucuauguaggucuggcuauccuggaacucacuuguaguccaggcuggccccaaacucacagaguucuaccugccucugcugggauuaaaggugaguugccaccaugccccgugagugagcaguuuuugaagacaggcugcggaaaucuguguauacacuuuuuuuuuucacagcauaacaacccaauuuguuucuuuaaucugaaaaaacaaaggcaacuuacagguauaauuauauuagauacuauacagcaucaacauuauuuaugggauauaaauaauugacuuucccacuuguuaaaagaauccuaccaaaacaaaaccaaaaagaguaggucauuugauuuucuaugccucaugguuauuauauagauacauuuggggcucuaaagucauuguuaccccguacauaaucuguaauaagaugaguauguaaaaaaaaauguacagccucauuuucuaagcucagcgcacaugagauuggcucuucauaguaaaagcacauacugugacaagcacaugugacacaacacagacacagucacugauacucuugacaauugccaagauguccaggcagagccuugauuuaagugagucuggacguaugcucaguacucagugcgauguagccuagccuuuaacauccaaagcaggcuuucuuguuagaggugugcuacuggggcuggggagaucacucaggaaacugguuuugccuggcaagcaugaagaccuguguucaauccccaccaccuauguaaaaagcaaggcuugguggcucuggaaagguagagagagauagaccccucaggcgcguuucccagccagccuagccuacuugguaaguucuuugccacuaagagaccuugucuuaaaauucaaggugauggugcaaauaacauguacacacacauacacacaagcacacacgcaaaucugcuaaugauuaacagcagaaugagagcaguaacaagagagggcaggaaucuagucgauacaaaggcuuaugcagaacaugugaaccaucuaucuauucagucugcaacaaugccagcuuagcuuuaugccccagggcacaugagucuuccugaucucuaagucuugaaguaugggucucaccuuuauauacccaaugccccauuagaacagguauuuugaaaagccuuuucaacaauuaauucguuuuguuguuguuguuguuguuuguuuguuugacuuugauggucugaggggugaaccuaggauuugugggugcuaagccugaccuccacuauggaugguagccccccagccuaugacaguucaucuuagaauaaaugggacuggcaaggucuuccuggaaaaacaauguugcaaauagcaacaauguugcaaauaacaacaauggugcaaauagcaacaauguugcaaauagcaacauugaaauaauacagcccucccuguauuuacucaguaacacacacacacacacacacacacacacacacacacacacacacuaagaacugcagggguugguugguucaguaaauaagaacaaugaauuguucuccaaacaugaaguccugacuuugaaucuucaacacuuucauuaaaaaaaaaaaaaauggcuauacauacuccaguauugggggcaaacauagguagauuccccuuuugccccccaaaacuaaaucccacauggcagcauauaucauauguguaacuccuguauuggaaacagacauaggcagauccugaguguucauggcccagccagccuauaugaaacugcaagcccaggcucagugagagacccugucucaaggcagcaaggugcagugcuagaaugagauacgcuaaggccugcucugcagugugcauggaccaaccaagugcacacacaggcacaccuguguguacacaccauucaugacaugcacacacaacacuauggagccauacugaauucauaaauucagagcugaaguggguucuggauuuacauuaccauuaaccccuuacauccagugggaaguuagagagccguguaggguguggguugcugcagugacccuguguacuccggcauucagugaccuggauccucacccccacuaaauggcagucaugccucucuuugcuuagucuagggacuaaacaccacauuccccuugggagaguagccagggcuccuaauggucaggucugacguuccauuacagcucugcugugugacugcucacgugacugagccucuccagccacuguccagccugagauaaucuguaucuucguuccuugcuuaaaggcaguuugagaacauuuucguggagagcucuuuaaaacaccuuuucaauggagcugggucuuguuggagcggcguggucauucucuguccagauggcucaccuugcgccuaaacaguaugcccuucaaaugaauaaguaauaaaggcauaugauacaguguuccugcugugcauuccccauguucccuguucuccccuacacacacccugagcuacuaaaaauaccuacagcucucaaaggauuuccuuucauuguccaugaggcccuucccagcauagauucaaaugcuuaccagaaagggccugauuuucuucaacaaaaagagucaaaaaaaaaaaaaaaaaaaaaaagagucaagaccaguagauaccuggucauuuaguucuuuuacauugagaaaagaaaaaaaaaaagaguuaagaauguggauggcucugaugagaguauuuucaggacacgucagggcaguuacuuacacaaauggauucagacguugagacggucagaaggcgagaccugcacaggaucugcaucgagugaagaggugaucauacgugccagcccuaccucagaacuuuggcaguugauggcugcugcgagccagggagucaguucucuccaaagaugcgguccgcgguccaguagauggcucuccaccaaugugcacgcuggcggugcugaguggacucuauggcugaaggaaaggacacaggaaguugggagggaagaauggaagaggguagaggaggaauuggggaugagggaguggagugggaacuuuggucaaagcacagcguguguauauaucccaaauucugaaaggcaauauagguagacaagaaacagaauuuuuucauaccguaaacaauaucauaaaacaaaauuuuccagucagggaaauuugucagaauuguguucuuaccucaguagaaugaauagcacuuagaauaaugucucucuacacacuaguaauuuucaucauuagcauaauacuugugggugaggaggcaaccagcuguacaccuugccugugcaccacagguacaggugcuacccugagccaaacguacauuuucugaggugugacugucaacagcgaggggagcuucguuuggccacaccagcaaccgcugcaccaauuagcuccucggcaucaagacauuuaaaaaaguagagucacccucuucggcuaacuccauuuuacaggggucauaaaaaucacgguucauauuugcggugagaaaugagauauagagaaacuguccaugucauuguugaaacagacagggcauucaauaaauggaagcauacagcaugagaaccuucaauguaaucaauguaaucaaucaaauaucgcgagaagcuucugaagugaauuuucaaaacaaucaguccuuacugcaauaaaaagaccaggugcuguuaccuuccuuuuuccauaagaggaaacaaccucgguggcuguuuggccacagucacacaccuugacaccgguucuggguuucuucgaugccauuccuccacuucuuucuagaccacguugccaguuuccacaccagcaaagucaggaccgcuucagccuccugacacgcccaauucucuuaaugcgcucagaagcgcaauuggcccauuuuaugaagacaacucucuguccuucuguucccugccgccauucuuaucaacugugccauccauucagaacggauuugggguuguggucacuuucgaccacuuggccugugagccucuguaagcuaaaugguugaaacuguggguccccaaggcucccaucaaacucccgcuggcuucccuccaccacuacgcucagauuucuuucucucuuuuacacuugccagaccugacccaggggacuuccuccucccuugccuucaucugcccuucagccacuuguuaauccuuaaagcuugguugcccucucucucccuuccuuauuucuucaaaauccagucugagcugagggaaguuguuuucugacaagggacagaacaccgccuugggaaugcca

SEQ ID NO: 8307 - RNA, 3238 nt, Mus musculus
gcaaggacagucggacuacagccacagcccagacaaucgaacacagccacagcccggacaaucgaacacagccacagcccggacaaucgaaccacagcuagaagagucggacagcagccaugguccacacaaucgaacacagccacagcccgggcaaucgaacacgccacaguuggaacaauagaacacagccacagaccagacaaucgaacacugccacagcuggaacaaucaaacgcagucacugcgcagauaaucgaacacaaccacagcuggaacaauugaaccgccgucacagccaggaaaaucagcauggacagauagauuuggagccuacuccagaagguaagggcggcuugcugucugaacucguuucuaacccgguguucagcaagggcugccugguauucuaucuuuauauuguuuucuugguaggugggguugagagauggccuaagugguuaaaggcauuuguuguucuuguagcagaccccugacccaugguuuagaaccguacccaccgccagguccauggaucuaauacccaauuuugacucuggccuaugggcaccagccacagaccugugcauauacauauaugcaggcaauauauacaauauauacauaaaaugaaauaaauauaccuaaaaacauuuuuuaauguauuauguuuacaaaguaaacaugaaaagaaagcagguuccagaaagcuaaacacggggacaaauaucaggaaaugauuuacguuuugggcugugauggcuuuucaggaauugaaggcuccgucuacauuugccuauccccucuuuucucuaccccagauauagaauuuuuuuuuauaggcaguuaguugcaucuuauucuggaaauggugucucuuggcucauaucucagagucccagucccaggaaggaagaaacugcccuccacagcccugauuucucuuucaguaucuuuuugauugccugggaucuguuaauuuugcagaaaucggcacgaagagaaaaacugagaaacuauuuccccgugacagagaaaaaaaauuaauaauucaacaugccuagggaaacaguaaaaguauuauagaugcauuuuaaccccacaggaaucaccaguuuguuguuucguaguagcaagggagucuuccuuugcaaacucagaggaagcgcaaagugagguuaucauuugggaagcugggcuucaaaggauguagucuacuguaagcucaggcagcuauuccacuuccaaaaucauuuuuagauaaagaaaguuuuguuuuuacagugaaucagagcacacucuuucaugaaauauaaaagucaaguuaaacccuuuuucucccuuuaauucgucaaccaacguauuugauauuuuggacuaaauuaauuugcugaggagccaggccuagugcaucuagucuauaauucuggcuacuuggaaggcuguggcaaguucauggccugauugaauuauagugcaauaucaagaccaaagugagccccuuagcaagacucuacuuuggaucucagaagcacuuuagaaacaaggccuuggauauagcucagagggcuauuauagcucagccuccaugggauuaauguggaaaagaaacgucgccagguggagucuacccuguuccugggaggguuuuuagcuguuggucuuugacuguuaccugccagugguagugccucuacaggucagacaagcaaaaauguuccuaggaaggaacagggguacaaaacugacgcugguagugaacuccugagcuagauaaaggacccuaauucuagaacacuggcucccccaucuugacauaacuacuuaggagaaaagcauuauaauuauauggaggguacagugcgguucuaagggugacgauucacuacauucuauuguccuuaauauuccacugacuuagcccaaagcagaggcuagcaaagggcugcgcgugcuaccccagaugcgcucaccguggaaaggaagguggcaggagaggguaugacuuuaacgacuguggccucagguggccuugaacauguggcuuccuuguucuaccagcucauucaccaguagcuaguuaaauuaugcaaaccacaugggacaagagcgaugguagaaaauaaauagagaaagaugcucaauguaagguuacauaugccuauuaaacaugacagcuuuauguucaucuguaagauguagcccagagauguaucuaaugagagcuauugcugaccaugagggcuguucauggauagagaagcacaaacguguacagacaugguucaggguagcucauuagacuuucuguucaguggugaccuugccaaaaaaauaaaauuacuuuaaaaaguaaauucaguuuuaaaaugcuugaacauugcuuccauaaagaacuuucugccaccgggcaugguagcacucgccuuuaaucccagcacucaggaggcagaggcagguggauuucugaguucgaggccagccuggucuacagagugaguaccaggacagccagggcuauacagagaagcccugucucgaaaaacaaaaacaaaaacaaaaaaccaccaagaacuuacugccuucaacaacccucuaaaaacaucuuuguauuccccccucccccaaggagaucgcucugcaggaaagcgggcacagauugguaccucuuuggcgacggugugccagugaagaugggucucacaaacauccauccgcuccugguguaggaacuugcacuugucgggcacgagaagggcgucgcucacaaacucaccaacugaaagagaggagaguggaccuguaucauucgcguaugacagcugauuucaccauggacacacacgggcucgacggaggucagagaacuuacccagaacuuucaaugcacgaaaaaccccacaaaggcuacacuaccuuuagcauggugggucagccucuuuaaacaaccgacugccuugcuaccaugaagaccuuauguccauacauucccuaugcaugcauccuugauggcuguauguucccuauauauucccagugccuucuccuugaauuaauuucaguuucugcauccauauagcagcugcacaaguagccacugacauucguugucauuaaggauuacaguacaaaaacagauagcuuuaauuugagcacugucaacaccaaugucuguuucuguauuuuguaaauuuaaacugcuugcaaauuguuagagacugcagcauuuuuaaauguu

SEQ ID NO: 8308 - RNA, 9291 nt, Mus musculus
cuugcacucgcuagaaagcagcuccgagcuaggugcuaucgcaaggccagagcgcacagcccggcggagagagcagauccuugcucagaucgagucaaaucggggccaaggcggaggacgaagaguccaggcuccuauucuggacuuguuccccagcuccgggggcgcuucuagguccugcagcagccagcagugcggagccaccaacucggugcuggaaugaaaaaauucccgcgcgccagugcagaaucuuucuaagugacccggagcuucgggugcuagcucugcacgaacuuucccaucaaagugaucgugaauuuuaagcaucaggagcaggccagcgaagcucuacgcgucuaaacgucuauccagaccaagaguucucugcggugcagggugcggugccaugcagccaaaagucccuuuggggucacgcaagcagaagcccugcuccgacaugggggacguccagcgggcagcgagaucucggggcucucuguccgcacacaugcuguugcugcuccucgcuuccauaacaaugcugcuaugugcgcggggcgcacacgggcgccccacggaggaagaugaggagcugguccugcccucgcuggagcgcgccccgggccacgauuccaccaccacacgccuucgucuggacgccuuuggccagcagcuacaucugaaguugcagccggacagcgguuucuuggcgccuggcuucacccugcagacuguggggcgcagucccggguccgaggcacaacaucuggaccccaccggggaccuggcucacugcuucuacucuggcacggugaacggugaucccggcucugccgcagcccucagccucugugaaggugugcguggugccuucuaccuacaaggagaggaguucuucauucagccagcgccuggaguggccaccgagcgccuggccccugccgugcccgaggaggagucauccgcacggccgcaguuccacauccugaggcgaaggcggcggggcaguggcggcgccaagugcggcgucauggacgacgagacccugccaaccagcgacucgcgacccgagagccagaacacccggaaccaguggccugugcgggaccccacgccucaggacgcgggaaagccaucagguauaagagugacccccaucucucagucuuuacgaggcgugacuuggggucacacuccagaucgccucuaaaugcgaaugacucagacuugcagugaauugaaguucugggucgugaccuucccgcucccccccccaaaaaaagugugaccauacucugcuagaacacuuauuugcccgaauaguuaauaauuugagaaagagagaaagaaucggagguccuguagauaagggcuaagcguuuccuccgcgaagccaauaacccgacuccuuacacugaagaaucucucuccaucccuuuaaugccuuuagugaauguaugaguucacuuuaacuagguuguaguuucgcgcugaguuuuguaacgucaguccgugugagcacguagcgcucaaaggagggcggaguagaggagccauggugaccuggaugugcguucaggagccugggcaacggcaguggugaucucauuucuguggccuuccgucuguccccuucccccauuugaaaagcugaccccgauggcugguggcuccguugggccccucugcagaaccugcuugggaggucuuugcuuggcucgccccgccuccacgcgccuccuaccucggccucguugcucgcacucccucucccggcagagguuggacuccccagcgcugaggaauguuagccuggacugauccucccugcuacacauucgccugacucugccguguucagucccuaccagccaguuaguucuuuuuaaucauucaaauuucuuuuugcccuuuucuagauuucucccucuuuuccgacuugucccuaggagcugguauucauauccuacuuuacgauuucucugaccgcugagucucagcagcccgaaaaaggccauuuuccaaauuggcaacccugguuugagaaaggaacuuauuccccccggggcacugggagugagaggaggcaggaacacacugcugggcagagugggugguccuagugcccggaacuggaucaagcagagaacccccugggaccccuugaaugagagagcugagccuuacagacugagacuccucaagccccaccccuuggcugaggcuccccgcccugccccaugccuuccacguggagcuggaugaucucauucgggauuucagcccuggcuucaauagugaaagggugacucagggcgcuccgccugcuucucuugccaaguuuuuacuacagcuggguagaaaugauagccauacugccucacucaggcuguggagucuucaaagaccacaaaagaaauccugcggacacauauauagacaguuugaucacucuguugcuuuuuuuguuuuguuuuguuuuguuuuauuuaaagcaaaagaaaaaaaacuuaaaaauaacauucacaguuuuuagaagaugcaaauauuuguuuuauuuuuguuccagguguauuucaguuuuauuuacuuugacuagguugacuuuccuaauauaccccgagaaggucacuauuaggagaaggacugcccaugagcaaacuuccuuuucuuuuuacaggaccaggaagcauaaggaagaagcgauuuguguccagcccccguuauguggaaaccaugcucguagcugaccaguccauggccgacuuccacggcagcggucuaaagcauuaccuucuaacccuguucucgguggcagccagguuuuacaagcaucccagcauuaggaauucaauuagccuggugguggugaagaucuuggucauauacgaggagcagaagggaccagaaguuaccuccaaugcagcucucacccuucggaauuucugcagcuggcagaaacaacacaacagccccagugaccgggauccagagcacuaugacacugcaauucuguucaccagacagguaagacaagagcuuaucaaccauuuccucaacucaacucggaggucagccuuguguuggaugggaugagaggguggggguguggcagagaggaaacccggaagggggauaacauuugaaauguaaacaaaauaaccaguuaaaaaaaaaaaaggcaucucaucuguauugccucauuuccuuucgguuauaggcuagcucaaucugucuugcuuauuucuauuuuaaauuuccacaucucaaguuccacaguucuauuuuaaaagcauuacagggaaucuugcuuuagagucaguccuucaaguccagcaauaaugaauggacaggcuucaaagugcaugugaagacaugcccaacugaagagcuaaguaucaaguccacucucuccuacuuaaaagggauuucccuugccucuuuguaggauuuauguggcucccacacgugugacacucucggaauggcagauguuggaaccguaugugaccccagcaggagcugcucagucauagaagaugaugguuugcaagccgccuucaccacagcccaugaauuggguaagucggcuucagaguacaaguuaagcccaaaugcauggauacaacccaauaagucaaucugaugugagagagagaaaacaucucagacuauguugcuaccucagccaccagcaauuuuagaagggguaggguauauuuuccacaauuucaaguauggucuuacuaggacaggagaaagugguacaaacauuugaacguugacauuuuuauacuugcccugaucaaagugaguaugagccccaauacagguugucuaauaagagagccauugagccucacucaaucauacagcuuaauguccuucuugucugcuucccaggccauguguuuaacaugccgcacgaugaugcuaagcacugugccagcuugaauggugugaguggcgauucucaucugauggccucgaugcucuccagcuuagaccauagccagcccuggucaccuugcagugccuacauggucacguccuuccuagauaauggacacgguaagauaacagcuccucuuuccagaugguguucaaccuuccuuguguagggcucucucuggcuaagugagcuccauggcucuugcucauuuccccuccuucagaguuuucucuggcaggaucauaaguaguagaucuuuaccuccauugcauccugcucccaaaguccauucauucauaaacaauaacuucucgccauuguaaaaucagaaguccccuauugaggauaacgucucgauaaaaaucuaaaguucccuagcauugauuuucccaaaaaugcaugauuucaccaaacauguauuaauaauugccucuuuuuucuuuuccuuuuuuuuuuuuauuauuuuaggggaauguuugauggacaagccccagaauccaaucaagcucccuucugaucuucccgguaccuuguacgaugccaaccgccagugucaguuuacauucggagaggaauccaagcacugcccugaugcagccagcacauguacuacccuguggugcacuggcaccuccgguggcuuacuggugugccaaacaaaacacuucccuugggcagauggcaccagcuguggagaagggaaguggugugucaguggcaagugcgugaacaagacagacaugaagcauuuugcugugaguuuucccaaugaaacauauucguuugcaacucaggguugagaagggcaaagugaugguuuaguuccuuuccuagacaaacuccucuaccugugucccguagugggacuaugagaugguagcauauuuugagaauugauugucuguuuuacauuuuucucugauucccuaaaaugucuuuauaguucuaacacugauaucuguaucuccauuuagacuccuguucauggaagcuggggaccauggggaccguggggagacugcucaagaaccuguggugguggaguucaauacacaaugagagaaugugacaacccagucccaaagaacggagggaaguacugugaaggcaaacgaguccgcuacagguccuguaacaucgaggacuguccagacaauaacggugagucauacuggacuucagcucucagaaaccgggcaaaggcggcgugcccacaacaugugguuggaaguuggaaacugggaacaucaucgccgucguucucuuuucaggaaaaacguucagagaggagcagugcgaggcgcacaaugaguuuuccaaagcuuccuuugggaaugagcccacuguagaguggacacccaaguacgccggcgucucgccaaaggacaggugcaagcucaccugugaagccaaaggcauuggcuacuuuuucgucuuacagcccaagguaggugcuuuuacacuugaaucuuugcaaaggagccucagcugggcuugcugccaugccauacaaauguuugggcugucuuuaccuauugaucuguguuccguuuugaauuuggaauacuucuaaaugcaggaacaacuccuugcuuugggauuuguuguugccuucuguugggaaggaagcuuaaaucuagcuagcacuuaaaagagucuugcauguguuuaauauugcuucucuauccccaaagaauggcccuuugaaaacucaagagcccucucuguauaacuagguuucacauacaaaaauucaugguuagauaaauuauauauuaacauggcacccaggaguuuuagaaaguaguccaaaguacuuguuacuggguaccuagcagccgcacauacgagcacacuaacuaagguaagaguuugagaauuaaaaauucaucguuggaacauguacuuugaccaaagagacucgccauuucuuuugguguuuugcagaaaggauaaauccugcuuugaagaagaaaauugaaugaaauuugcuuaagcuugucauguauucuuagcauuauaagauagcaaacuauauccaaguuguggaugaaguauuuagcaagugauuuauaaagcaccuucaacuacagcauauuauucuagguacugaccauggaacaauaaucagugugacagugaacccugcuuccauugaccuaggccagcaaauauauaaaaucaagacauuuauaagccuuacagauagcuauaugaacuguugaaaaagccaaaaugaaagugaacauguggcacgugacaaggagacuacuuguagccugggaggagagcauucccaguugccaucacaucagauguuuaaccaccauggugcauguugucuccacagguuguagauggcacucccuguaguccagacucuaccucugucugugugcaagggcagugugugaaagcuggcugugaucgcaucauagacuccaaaaagaaguuugauaaguguggcguuuguggaggaaacgguuccacaugcaagaagaugucaggaauagucacuaguacaaggugaguuucagaacgcucacuucugcaguagacacgcuguguugcucaguuggucccuagcaucuacaagaccuuggguucaauccgcaugcauguaccuguagucccaguguaugggagacagagacaagugugacaagacggucagauguucaggucaucuuugcuacauagugacuuucaguucaccuuggggaacaugaaaaaccugacuggaaacacaaacacacacaaaacaauuaacccagguacuucauguaaucccaguguucaguaggcugacuugggaggaugguugcuauaaggccuagguuagcuuggucuacauaaugaguuccaguauaaccuggcccacaagugaacccuaaaguuaauuaaucgacacaugaaacaaaacacaugcuuuggagacccuguaauuuugauauacgauuuuguaggacuaaggaaaagucacauuuaaaagaauugccuauuuuuaaagcaaugugauugauuaacucauugaaagacauauaccuguuuucuuuguccacagaccuggguaucaugacauugucacaauuccugcuggagccaccaacauugaagugaaacaucggaaucaaaggggguccagaaacaauggcagcuuucuggcuauuagagccgcugaugguaccuauauucugaauggaaacuucacucuguccacacuagagcaagaccucaccuacaaagguacugucuuaagguacagugguuccucggcugcgcuggaaagaauccgcagcuuuaguccacucaaagaacccuuaaccauccagguucuuaugguaggccaugcucuccgacccaaaauuaaauucaccuacuuuaugaagaagaagacagagucauucaacgccauucccacauuuucugagugggugauugaagaguggggggagugcuccaagacaugcggcucagguuggcagagaagaguagugcagugcagagacauuaacggacacccugcuuccgaaugugcaaaggaagugaagccagccaguaccagaccuugugcagaccuuccuugcccacacuggcaggugggggauuggucaccauguuccaaaacuugcgggaaggguuacaagaagagaaccuugaaaugugugucccacgaugggggcguguuaucaaaugagagcugugauccuuugaagaagccaaagcauuacauugacuuuugcacacugacacagugcaguuaagaggcguuagaggacaagguagcguggggaggggcugauacacugagugcaagaguacuggagggauccagugagucaaaccaguaagcagugagguguggcaaggagguguguguaggggauacauagcaaaggagguagaucaggacacuacccugccaguuacauucugauaagguaguuaaugaggcacaguagcaucugaaagaccauacagagcacuaaggagccccaaagcacuauuaguaucucuuuucuuauaucuaucgcccaaauaauuuucagagucuggcagaagcccuguugcacuguacuaacuagauacuucuuaucacaaagauugggaaaggcaaagcagaaagaugguaagacuggguuucaaacaaggcuugguuucaaucacuggaggcaaggaggaggggacaaacaagaucauuauucgaagucgcugguugcugugguuuuacggaagguugaugcaucauuccuaucaacagugaaaaguucagcuuguucaacgugacagaaaggcucaucuccgugaaagagcuccugauuucuucuuacaccaucucaguucuuaacuauaguucauguugagguagaaacaauucaucuauuuauaaaauguacauuggaaaaaaaaagugaaguuuaugagguacacauaaaaacugaaggaaacaaugagcaacaugccuccugcuuugcuuccuccugagguaaaccugccuggggauugagguuguuuaagauuauccauggcucacaagaggcaguaaaauaauacauguugugccagaguuagaaugggguauagagaucagggucccaugagauggggaacauggugaucacucaucucacaugggaggcugcugcaggguagcagguccacuccuggcagcugguccaacagucguauccuggugaaugucuguucagcucuucuacugagagagaauaugacuguuuccauauguauauguauauaguaaaauauguuacuaugaauugcauguacuuuauaaguauuggugugucuguuccuucuaagaaggacuauaguuuauaauaaaugccuauaauaacauauuuauuuuuauacauuuauuucuaaugauaaaaccuuuaaguuauaucgcuuuuguaaaagugcauauaaaaauagaguauuuauacaauauauguuaacuagaaauaauaaaagaacacuuuugaauguguaugccuauuuucuggagugggauuaacuucugggcaagaaaucugaugagacacaaacauuggacuucaagacaguuuuaaaauuuggguaaaugaacuguauuuccuguuuauagacguacuaauaaaaaagaaguugaugaugucuuuagugguaagauuguuacuaaugugguuggcaaauugcuguaaagagccagauaguaagcauuuauggcauuguaggcuaucuuuccugccacaaccaugugacagugagugcuuuguaggacugagagcagccauaaaugacauguaaaugauaaacuguggcugugcuuuaauaaaacuuuauuuacaaaaacaaau

SEQ ID NO: 8309 - RNA, 4003 nt, Mus musculus
uaagaauuauuuauuuuauguauaugagcagacuguggcuguccucaaacacaccauaagagggcaucagaucccaugugguugcugggaauuggacucagggccucuggaagagcaguuuaugcucuuaacagcugagccaccucucuaucccccauuuaguggucuuuaaauggaagagccagguagauguguuggcucauucagaaagcuagaaaacuguagguucaaagccagccugggcuauagagugagacaaaacacaacaauaaacggugaaauaauguacagggggugggggaaggccacuccuuccacagcucaggcagccccuuucacgguugaaaggcccgagcuuagaaagcugaaucugcagaagaaagugaaaguauggagaggucauccucuaucgacagcuuccgcccuucucuaccuacguccugcauccaaggcagucuugaugguucacaucagaacacuacagcugcuggccaggcauggcggcacaagccuuuagucccagcacucgauuuaauugaggcauugacucaggacacagaggcaggaagaugugugugcaaggccagucuggucuauauugagucuuccauaccugcuaggguuacacacuaaaguuuaaaaaaaaaaauaggaagggaagaaagaacuuaaggaagaaacuaguuuaagaaauauauguaaacaaacaaauauuauaaagccguuaaaauaaacacuguggguguuuguuuguuuguuuguuuguuuuggagacaggguuucucuguguagcccuggcuguccuggaacucauucuguagaccaggcuggccucgaacucagaaauccaccugccucugccucccaagugcugggauuaaagugcugccucccacugcuggcugcuaaaagaaacauuguuacuaauguucaugaauggcuaccuuaaaacuguaaaggaaacaacaaaacauuguuauaauuaucgguugucaccuuuuuacagaguuuuggaucacagccagggccugguaccugaucacacguacaugagaaaagucagaaaaggaauguagcaagcaguugauagucaauucaacaaaacugagagauggcuucugcguccuaguuuauacaccuucagacucuacacaaaagauucaguccccauuucuaaacugggaagaauauggcugaugugaaaacuggguaagaauguguggccagucaggcagugguggcacaugucuuuagucccagcacucagauggaucucugaguucaagggcagccuggucuacagaguguauaccaggacaaccaggaagggauacacggagaaauccugucuaggaagaacaaaaacaaaaacguguggcaucaaugcuuaaaaagauggguggauugccagcuguaguagcacagguccuuaauuccaguacuugggaggcagagguagggauuaucucagugaguccgaggucagccuggucuacauaguacacugaaaguucuuugcuaaaguuacauggcuucaguaaaauuugcuuagcuuuagagaaaaucucauugagguaggggcgggucauucauguuuccguguguacacauauacauacacacgcacagagauacacacacacacacacacacacacaugccuuugucuccggagagcugagagaagccacagcccccauaggauuauuuaaggagcuaaaccuaaacucagguacccaagaguuaacgcagauaccccgcacgcaggcgcagaaugugggcggagccaggaaacaccgaagacgguucugaccaaugggcggaagugcugcuccagcgaccgcccauucgagcccccauggaaacauggccuucauuccgcuuagcaagggcauccagugccacacucacccagagcuggggcucccgcacuggcgacaccccggggccggacgcgcucgcagcucaggucucaccccagagagagaaagggaacggcgcgaucuuugaacccuucuugcgggaagccagcgagcgcuuugcgggccggcgccugcgcgugaggacgcaagucccggaagcaggaagcuccucucuucuugcuuagcguucacgucuggagcagcgaaggggugcuuugacccccgccgguugcuuucugguccugguuuuuauucuuaauauuucaccaucccggacucauugucuuccuggggaccggggcuguggcggugauacaggacuggcaaggaaugccagccagcagacaaagaacagauccucuucugcagguggcaggacuuuaaugccuaaugcgucuagaaaagaaguauuuaauagcugacagucuugucauucucuuuucuauacgugacccgucccuacagagagagagagagagagagagagagagagagagaaauuccaggcuuaggaaaguguuugguaguugcauuuuaacuaggcuagaaguaaaacucugagagauuaaguauggucuuaaucucuuauuccuaccuaacaacacuuuccuaaguaagugcuagagaaaagcucggggucucaaacaggccaccacuccaacugacgcccccggggacaaggcaaacuuuaguugaucaagugggcgcucucaggaaaacguggacacagauaggaaaugcauuugguuuuguuggugguuggcugguuggauuuuuuuuaugaggcaguguuuccacguguagccuuggcuauccuggaacucucccugucggucaggcuggccucugccucugucuccaccgccuaccaaugcauuuggcuuuuauuuuagcucagguggugacugccuuuccccacuaguuggugccauaccuggaagucuuaauucaguuuagcuagucugaaaauaauugguacauagaacaugaaggagggggcgguggugcacacuuuuuaaucccaacgugagggaggcagaggcagacucaggcacaacucugaguuugaggccauccagccuggucuacagagugaauuccaggauagcuaggauuacaccgggaaaaaaaagagaaggaaagcguuagggaaaagggucacuguuuugaggagagaaggguuacacuacucuaggugaucaaauuacugggaaagagggcuuugccauuuguguaaacagguuuaaacuggagggcagcgucaagccuuaacgaggugggagagaaaacuauuugaauuccuuguugguucuaaacacaaguuuuauguuauuugcuaggagaugcaucugauauuucuuucagcagguuuguuaaucaucaaauuaaugugaagcuugcuguugucccuucuucaggagccuugcaggcuguguugaguggagccaacauagguccacuggagccauuguuaacugagaaugugggcagauauggauuagacagugguggagauaauuccaaauccuggguuucuagaaccuucccucuuguggcacuucuugucucuaaaccagagagcaguaagacacuaaaaucgugagcagguaacuaauguuaaccacccuggcuuuaaguggucuuggcugguaaccacgcugggaagagcugucaguuuaucccuguuaauaaaaggacagagaaaggggcuccagcaugaaaguacugccuuauccaaccauauacaauccacucucuuuuccuuauccaaccauauacaauacacucuuuuuucauuucuuuaaaucauuuuagaaaugauuuauaaacacuuauucauugauaguaguacacacaaccuuucagaacuggaagaaaaaaaaaacccauaaagacaauauuuuauagcagcucucuagccccaucguggauguuuuguguuuuugccaauucaauuacauaaggacuuuucccuccagcuuuuuaaaugaaagcuuuaaagcagaugugaagagaggagcgugccuuggcacacuccccaacauacuccagccacacucggccacgucuggauguccuga

SEQ ID NO: 8310 - RNA, 12574 nt, Mus musculus
aguaaaugacagaaaaaaaaucauguuuauuuauuuaaauacaggcaaaauaauuuacagcgguuuuguauuagcauacugguuuuuauuccuucuaguuucaacuuuaggaaggauuugaauaacuaaguucugugcuuacucugacugggugguagugcuugacacaucaauaaacugauauucccaaaacuuguuuuauuagaguuuaaguuguuauuuacuguacccacuacuggcaacaccauguuucacuauucuagugcugagauuaggauugggagcaaugugaaaucuuggugucagugugugcgcauaaacucuggcccagccacuauugaaaagccuuauauuaauuaggacacugucugaacuuuuuuuguuugcuaugggauaaacaacaaacauuuagaagccagacuuucaaggccaugggauugggggaacaacuuuggaaaugagauaaacaacagacuagaaagugucuuucccaauagauauggucaaguauacaaugagaacagucaugugagugauuaaacagacggccauaacaguaacacauuuauuguaccacccagcagaguacaaacacaaauaagaaaaauaaaacacugggcaaguucuacucuacaaacacaacucuuaaccuaugacaaguuccucagucauucuggucgucaucccaguccuucuucccacuuggagguuugggcccaccagcugguuuugccaugaugaucuaaauaacaaaaacccaugguaaguacauuaaacuucuaccuauggagguaagaaccacaaacugugugugugugugugugagagaggcuuaaccacuuuaucagcagucuucaucucaauauaaucaaaggacacuccuacugucucaagcuguacuucagcaaagcagagaaacuaacauacccugguccucccaccuccagaaacaauuagggacuucauacuuacugacaguacuuauaauaaaugagccugcacuucccuuuuguagccuauauucauaccacauuaagcuuacacucucccaagcccccaucccccaugucuaaauggucucggcuaauuuaaaacugccaaaaguuuuaaaauuuaauuugagccagcugugaucuccagaugugagggugaacagauaguacaaucaggagugcuauguuaugacugcacuguacugggauuugccugccucuagcccuagcagugagguuacagaugcgccaccgugccugcggcucugguccucaggcuuucaggguaagcacuccuaucugagccaccuuccauagccugaaaagacaacucauuuuuaagccaaggucuugcucuguggagcaagauggcuuggcacucagaucugcuugcuuucaccuccugaugcugggauuaaagaagugugcuugucccugcgucccaugggccaccacuuuguaaagauuacaguuucauuuucacucaccugauccacucuuaguacagugacugcagcauuaguggccaguuuaauagcccaguauuuucccaaguaaguaucuaaaauacuggcuucuaacauauccuuuacagcagggacuucagccugugaaaacaaaauuaauuucuuacucgugaaagcuuacuucgugguuugaagaucuugagccacaguggcuauggauuccagaagauugaaucuccgaguuuaaggaacacaccuuuaaucugggcuaugccuuucaucugggauuaaaggugugguggaacacaccuuuaaucugggcuacaccugcuggagacaauauaaggacauuggaagaagggagucuagcucuugcuccuucgccugcuugcugcgugagacugaguaacugcuagauccuuggacuuccauucacagcugcgacugaaccauuguugggaauugggcugccgacuguaagucaucaauaaauuccuuacuaucuagagacuguccauaaguucugugacucuagagaacccugacuaauacagaaguuggucaacuugaaguuggucaacucaacgugaaauacuuacaaggcuccuaaaugauaaccgaaauauacccucacuccaaagcugucaauaaaacuaaaauuuccucuaucagguuaaguuaucaauuacgagagcuacuuguaaaacucaaaccucuauuuugcaccaguuuccuccuuuacaugcaguguauuucuguauauaguguauagucacaaaaaagucaaaucuuaguaccucgauauccaaccccacauuuuuguuuccuucuugguguacggaauaaaguuuagagauaacuucauuggccuucacgccagaauuuucugccagugcccguggaaucgcuucaaacgcuucagcaaacuucuuaauagcauacuguucaagcccaggacacgucuaaaacaacauguguuugucagugcuuuuuuuaguacucuuuuuaaaaaaaaggccagaaagacaguuucuauagaaaagacuucuaccucuccauaugaugugauuuguuuagccaauucaauuucgguagcuccaccuccagguacaagacgcuuauccuauuuaaaaacaaaauggaaaacccaccaaguggaauacuucuuuagacgauagauuuuucaguaggcaccauuaugcaaaacgcucugagauccagugacuacaucaagcuuucaaaccuggagacuaggaacuaguacagcauuggccgugcugcagcaauggucgaccguccacacucugcaacagccuuguuacuguuuaguuugcacaaucguuuuugaagguaacauucauuagcaacugacagguuguuagaaccaccuaucaugauguucucauguuugaguuucaagaaaucacaaauuucugaaauugcaaauacugacccuugugagaacuuugaaaguauuaacuccaucaucuacugcccuuucuaugucauccaucagauugucuguagaaccucgaagaacuauaguagaaauggcaccaucuucuuuuucugccaauaaauaauuuguggauuaaaucagagaaaacaaaucccuaacuguauaaagcacaccuuaccauuacuacauaccaugcuuaaaaacaaccacuuguguaucuccaacuucugagagguaaacacugucacaaugucccauuucuucuuggacgggaggagucuacaaaaaaaaaaugauccuuguaguaaaaauucaaauguauucacccaucuuuuguuuuccaacauacauaccaauuuuggaagagcuguggcaccaacuguuuuacagagucgucugagaucccacuuugaguucagucuucaaaaagaaaaaaaugaaaaauuugauuuagucauaauaacauaaaauguagagaauaaauagcaaauaaaccagacaaggccacauacaccuuuaauccaagcagccacagaccagcagaucucauaggccaggcuagucuacauggccagccaaggaaauaauacugcuuucaccuuauucgaagugaucauguuuuucuugcacugaauuaggaagcuaagaagcugacuccugacuuugugaguguaacaaacuagccagcaaugccuaugacaucugaagcgcacgccgucuacagauaaagaacugaggucagcgcagcagcacaggcuuuagucucagcacuugggaggagacacagaguuccaggccagccagggcuacacaacaagaaucugucuuagacaaauuaagcacacauguacagcauuauucuacaaauuaagguguagccugacagacuucaaaccuaggauacaggugcaacugcaccaucuguaaggaagagcaaggauauuacugugucuaucugacuggcugcuagaugguaaaacgugccccaagcguuuuccucagugaaaagcauuuuucuugauccauacuauagcugauaagcaguucauuaaguuuacaucuuaacccuuaagcuauuccucuugcccagaaugcguucuccuccuuacucaaguaagaucuccuuaccgcuccuuggaccccacugcuuauguaaaguucacuucucccuccuauauaaauccuuuugcuguuugaucuucauuuucccuuuaucaauuguucucaguuuacugaauguacaaagcaccaagaacaaguuauaguguuguuuacaagaauguagcucuuaccucaccaacaugauauuguacuuguuagcauaaugaagagcuauguccgccacuuugccgccuguuacuaugacauuugcaccagugccugcaauggccuucaccugagcauccaugagguucuccucucccuuacugaaguucauuagcuccucggcagucuuaaucagcacgguccccuggaaaacaagccacacccucccuuucaaaccugucacagucuugguguucaaaguuguaagguaauguuuugcccaauaauuuaaagaucugagagaaaacaugaaaauauguguuuuauuaugaagcaaaauacacguacuuguuaaaagcuccucauguauaaaauuauaaaguguauaaaaugaagaccuucacucucacgucucaaagcacauguguuuucaauguggcagggacagauuuccuuuaggaaugucaggcaugcauaugcauauauauauucaaauacaaugagcaucagcaaaacaaucccuccucacaucuucccugaagcauagccacacaacccucaagucuguaaaaccaacaacuggaaucugccacgauuauuugccaugaaucuaacuacugaugaaucuaaaacauguaguuuuaaagacugacuuaacacguucaaauugauuagcauucuuaagaguauaagagaaugucaacauucacaaaaagccauaccaugagcauacaagaugcucaguauuaacaaagagcuacaauuaaaaauacugggguuggccagauggcucagugguuaagagugccgacugcucuuccgaaggugcagaguucaaaucccaacaaccacaugguggcucacaaccauccauaacgaaaucugaugcccucuucuggagugucugaagacagcuacaguguacuuacauauaauaaauaaauaaaucuuaaaaaaaaaaaaaagaauaaaaauacugccaggcgugguggcgcaugccuuuuaucccagcacuugggaggcagaggcagguggauuucugaguucgaggugagccuggucuacagagugaguuccaggacagccagggcuacagagaaaccgucuugaaaaaaacaaaaaaagaauaaaaauacugccaccacuaaguguuuuuaguuuagaauuuaguagcucaagcaaauauucauggucugaacaaauaauuuuguaaucuucaguuugcuuaagaacaaaccccacacccaaaauaaacaguaauggaaaaagcaacccaaaggucccuuucaagucacauaccuuugucucuguuaucaugccaucaaacggacaagaguacacagcuaucuuugcaucuuugacagaugucacaucaccuucaguuuccuucuuaaaaaccaugccauguaauacugaggaugaauaaauaccagagcccuaaggagucaaauuuaguguagugagaaaucagaaaauuuggguucuuuaaguaacaaagaaauagucuaugcuuuuguuucgucccagguguuggggcaugguuuugccagcugcagauagcuucugcaacuucugcgacugugugaugcucugaauucugggaacuuuucagaggguauauaaaagcuagagcgagagcgagagagagagacccccaauauaggagguugguugugguuugguaacagaugugcucaaagaagaaacaagaagaaauuuaaauucaaggaucucuacuuauaaucucucccuucucuccucucuagugaggggugaagcaggggaagaucccacaaagagcgaagagcagcuacaagcaaagaagaaauuagauucaagaaccucuuccuuucuuuccuaccuagugaugggggugaaagcgggggaaagaacgggugggaaaagagucaaaguacuaagacuggcaacccagcaacacugucauuaaauuuuaaacuaaaguuguacagcaaggcuguggagguaggcauaaaccaaccauucucacggcuggaagcacuacuguggaaggaaagccauucagcaugcugggaaaagcaaagguagacagcaaucaagucauuuauuugccugaucaccaagcacuuggcacuaauauacuaaguggaauugcuaauacuacagaacgaauagaaaaagaugguuucaaaggugagccaucucuccagccccauucuuuuacauuacgcuaaucccuauguauugggaaaagaugauuucacaaaaaauauacuuuuaacagagagcaacagcaguucucaaucugugggucacaacucccugggguguuaccuaucagauauuuacauuauuauucauagcaguagcagaauuaauuaugaaagaccaauaaaauagcuuuaagacagaagcacuaaaucuaaaacauaggguaaaauuuauggguguauagauggcucagcguuuaaggacugcaugcucuuccggaggaaccagauuugauuccagcacugaaaagguaacucagaaccaucgugccuccaguuccaggagaccugauggccucuccuggccuccaugcaacuguaugcacaugacacaaagacagaaacgcaggcaaaagacuggacaucaauuaagucuuaagaaaagaguagaacaacuuugaagcaggggaccaggcaaaguaacugaucuuggaaugggaaugugccuucacggcagagggcuuucccagcaugcucaggcucugggucaaagccccaagacuacagaacaagauccccuuguaagaucuaguuggauaugguaauagauuuuuugaaacuuaccagaaucuuacauacucugauguuaucaacauugaaauugccagaaucaggaaagauagaaacugucaaagaaauaaaacguauuuuuagaccacagagaagacaucucagugacauuagaucagugcagcuuggauuauuuuuuguaaccuacuauuacucaccacaagccugagcaauaagcuuggccaaaaacgucucgcugccguacugcuuacucaugauggagguucgaagcagagaggacacuucaucaacaucucgaagguuuuuggcagaacaacauaccaacucaggaaggaucucaugagcuuuuuugcaagcuauuucauaccccgauauuaccuaaaccaugauauaaaaauaaccguuuuaguagacauacuuuugacaugacuuacucugguaauccaacaaauguggggauuuucacauaagauggcaagugcuugcagaaaugcaugcagagccaauagcuauggacuacacggcucugaugacaacacaaauagcagcccuuacucuaacacuugucacucagaggaccuuggcuuuaagaacacuuagcaauaggaaucuuuugaggacaaauucacacgaagcauauggccaaugccuaaaauggaaacuacucaauguuauuacuaguagauuuaaaguuuauuuuaaaaucauuuacuuguauaugguaaaaguacacauauuggaauagguacaauauauauguacaccguaagcccaugugacuguccaggcacgcacaugcacaguggcucucagguguccugcucaaucuggugagcagguuccagugauacuccuggcuucacuccuccaugugggaucacagguauaaccggguacuacucgggucccugugcuugcccacgagugcuguuacccaucuagaccugaauuuuaagcuuuaagcaaaaccacacaaguacucaaauauaauuaaaguacaagaugaauacuugccucugauacugacaggccaauccucagaaguucuucagcuaguuccagaagagccccagcgaacaccagaacgaaguuugugccaucaccaaccucuuguucuugcauaugagaggccaucacuaucaucuuugcagcaggaugcugcaccugauagaaaggguuagcaagugaaagagacguguacguggagcaacauaaagucaguaaguuccuugauggcaggcaaaugccaucugaccagcucgucccacaguuuaacugugcugaacuguguuugucagcacaaacucaccaguacaaaugaaaucauuucaaagcacccgucucacagccaugcauuacagacaguuccacaaaagugccacaauuauaccuaacuuagaaaauaaagaauuugcaacuguuaaacucagcaacuuaagacuuuagaaguugguguggugacacacuauuaacuaucaucuuauccacuuggcauaaaacucuagcaucgggcuggagagauggcucagcaguuaagagcaucgacuacucuucugaagguccugaguucaaaucccagcaaccacaugguggcucacaaccauccaugagaucugacacucucuucuggugugucugaagacagcuacaguuuacuuagauauaauaauaaauaaaucguuaaaaaacaaaacaaaaaacuuuagcaucaccccuuauucucacccaaccccccacuucaugucugauacacuauguugccaauuuucuccauauauuggcuuuuuaacacuuaaacaauguuuugucaggccuguuggggcacaccuuuaauuacagcauucaggaggcacagacaggaggggaucuagaguuccaagccagccuggucuacagagccagcccaugacauccugaacagagacccugucucaaaaacaaaccaaagguuuuacaagaaauaaaacauaggcaguuuuaauaccacuuauacaucuaaacaugcucuuguuugaggaacccaugacuccccuuuuucuuuucucucugagauaguacaacacgcagucagacucucucucugagauacuacacgcagucagacucucucucugagauaguacacacagucagacucucucugagauaguacacgcagucagacucucucugagauaguacacacagucagacucucucugagauaguacacgcagucagacucucucucugagauaguacacgcagucagacucucucucugagauaguacacgcagucagacucucucugagauaguacacacagucagacucucucucugagauaguacacacagucagacucuagccgacguugacuuugaacuucggauccuuuugccccccccccccaucuccugagugcugaccgcaugcagaagccaccacacuuuuauacagguuuauacagcgucggcaaucaaagccuagacaggcaccuacacccaagcuucaaaguauuuuuaaaaagccacaaaauucaauucuuaggaauuacucuuagacacuguucaauuuaaauuuucagcaauggggacagaaccuggggcuuuguguuuguuaggcucaagagcugcaucacugagcuaucuccccaggccacauuuauaaaucaaagacuacgucccccuuuaagucaacaccacagcucuguuauucugaaggucauuuuuauuuuugugugugucuguguguggcuaugugugaauaggugccuagagacuggaaggggguggcgggucacucuaaacuaggauuccaugcucuguguggacugccugaugugggugcugggaacugaucaagaggagucugcacucaacuccaguccuccucauuucauuuaccaugaaaaauuccuccacaaauauuugugaagguagauuuuucuuagcauauucuuuaagcuguuagagaaaugugaauuuuucucauuuuuuaaaaaacacuauuuacccccuccuccaauacuaaaccacagguuuaauggagcgagagaugggcaucacagcccucuuauccugcuccaaguaucuauuccacacccucuuggacaacaaaacuucagggaaaaaaggaaaaugccaaaagguuauguaaaauaaaguaucaauauuuaccaguuuauacugcuggagaauucacauuagaaucaaucuauagaauaauaaaucucaucaucaucagagaaauacuccucaacccacccacccacagacaauuuaagaguuugaguagccaaaauggaaaaccuagaaaggucacuuauaaaucuucacaauaaaguggaggaagaaacagccuuucguccucuagauugaauacaguuucaccuaugucagagucauggguuuuugaugguuuugaaacaaaacuuacuucuagcucucuuaaaauagucgcugcaucguuugucacaaacaacuucuccaggcgauugaugaccauuuuauucauuccuuaaaaguaguugcaaagaaaaaaaaaaagguuccauuauuauucaaauauucugcaaacaacccaggaaaacuccggcaagaagccguacugauguuuagccccagaacacaccaucuguuuagaucagcaucauagccccaugggcuucccugacuaaacaccaacaugcuuagcauguaagacgugcuuaauaaacaggaauuaacacuaaaaucaauaugcuuagaaacacauuugguuucuuccguaaucucuuugugugcaucucuaauucaacuggugguuaaagggaaggaagagcuuccugaugccgugcuguuuucugcagacugcugagccuuuccacaauaguacuggccacuagugaggaugcuggacuucccuaggaccuaacaggguaacagcaucguuuccaauuucucuuuucccagaaagcugcauuccugacugaaagugagaggcacaucaaugccaccgaccauaaaacacgugaggcccgcucucuacgcuaacagucacaccacacagccugaacuuggucauuaccauuugguccguacgcugugcgaguagucugagcaagcuccuugcaggccuguauauuucuauacacagccucuucuaaucccgagaaaugcugaaaaagaaaaugucugcuuaggcaugauaaccaaguuaagaguuuucuaccgcaggauaccucuguugaguaugcuucuaagaaacagccaggaucacacaggcagucaucagacagccucaguuucccccacugggccuggcucucuuuccuaucuguaaacuaaugggauaaucaauagcuccuacuuggcagauuauuacucaccuagcuaaauaacaacuauucuuccuucugccuuuuccagggauugaacacaagaaagcaaucuaccauuaaacuacaaucccagccuacuaguacuagcuuuuaaccuaaauuugggggauggggguacuuuaaaaaaacuugucuucacuauagccuccaucaguaccgauuuacacaaaguaucucugugcugaaaugcuagccugugacagaaauccuuuaaauguaucauguccucagccagagugauggaggaaaagauggaaacuggaagcuguugcuaccccucaaaagguuaacagugucauuugcagaacuuacuaacuuacauuaagcccugacauccauucaguaugccaguuaucacuacaaaggggacaccaccucucuguacugcuaagaauccgcuauuucuacaacuuguaaaaauaugaaagacaaaacaaacguuaucuggcagcuuggggaacucaggacaaaucgcuccauaagcaaugugaccgcuuuaaaaaaaaaaaaaaaaucacuccugaaacuacggccuauucgaucugggguggggcuucauuuauccuguaggcuacgacaucggacagucagagugaaaagacaguuaacagccuucggcccggucucaacucagaaaagguaaaggaaacagaacguccagaggagaguuuucaguagagcaguggggaucggacgugucuggaaggaagcaaccaagggcaggcccaggagugaccaugccggacucgugucaucuccauccuacaauccccggcccuccaaccacccguuaccaauuccguccaaguucauuaacgcaucgccagcucgcguuaagggcggcgcccgugggcuccaugccgcagacaggggcguggggagcugggaugcaaacccgaagccgccgggggaauaacagaaaugcccaccaguuccagcgagccggcauccagagcacgcuucccuuucuagaaccuucuccaucccgaucgcggcgcggccgcccgcccgcaggccugucgcggucgccacaggcgcagacccacccucccaccguacagucccuccacgccaccuacuuuggcuccauccuugagcaucugggcaaagcccggggccuuggggacgugaagcgccauggcucggccgcaguccaccgcucacgcgcucgcuccgagacgccgaggaagcaaggggcgccgcgcacugccugcugggaaugggccucggcgccgccucgcguccccc

SEQ ID NO: 8311 - RNA, 12574 nt, Mus musculus
gggggacgcgaggcggcgccgaggcccauucccagcaggcagugcgcggcgccccuugcuuccucggcgucucggagcgagcgcgugagcgguggacugcggccgagccauggcgcuucacguccccaaggccccgggcuuugcccagaugcucaaggauggagccaaaguagguggcguggagggacuguacggugggagggugggucugcgccuguggcgaccgcgacaggccugcgggcgggcggccgcgccgcgaucgggauggagaagguucuagaaagggaagcgugcucuggaugccggcucgcuggaacuggugggcauuucuguuauucccccggcggcuucggguuugcaucccagcuccccacgccccugucugcggcauggagcccacgggcgccgcccuuaacgcgagcuggcgaugcguuaaugaacuuggacggaauugguaacgggugguuggagggccggggauuguaggauggagaugacacgaguccggcauggucacuccugggccugcccuugguugcuuccuuccagacacguccgauccccacugcucuacugaaaacucuccucuggacguucuguuuccuuuaccuuuucugaguugagaccgggccgaaggcuguuaacugucuuuucacucugacuguccgaugucguagccuacaggauaaaugaagccccaccccagaucgaauaggccguaguuucaggagugauuuuuuuuuuuuuuuuaaagcggucacauugcuuauggagcgauuuguccugaguuccccaagcugccagauaacguuuguuuugucuuucauauuuuuacaaguuguagaaauagcggauucuuagcaguacagagaggugguguccccuuuguagugauaacuggcauacugaauggaugucagggcuuaauguaaguuaguaaguucugcaaaugacacuguuaaccuuuugagggguagcaacagcuuccaguuuccaucuuuuccuccaucacucuggcugaggacaugauacauuuaaaggauuucugucacaggcuagcauuucagcacagagauacuuuguguaaaucgguacugauggaggcuauagugaagacaaguuuuuuuaaaguacccccaucccccaaauuuagguuaaaagcuaguacuaguaggcugggauuguaguuuaaugguagauugcuuucuuguguucaaucccuggaaaaggcagaaggaagaauaguuguuauuuagcuaggugaguaauaaucugccaaguaggagcuauugauuaucccauuaguuuacagauaggaaagagagccaggcccagugggggaaacugaggcugucugaugacugccugugugauccuggcuguuucuuagaagcauacucaacagagguauccugcgguagaaaacucuuaacuugguuaucaugccuaagcagacauuuucuuuuucagcauuucucgggauuagaagaggcuguguauagaaauauacaggccugcaaggagcuugcucagacuacucgcacagcguacggaccaaaugguaaugaccaaguucaggcuguguggugugacuguuagcguagagagcgggccucacguguuuuauggucgguggcauugaugugccucucacuuucagucaggaaugcagcuuucugggaaaagagaaauuggaaacgaugcuguuacccuguuagguccuagggaaguccagcauccucacuaguggccaguacuauuguggaaaggcucagcagucugcagaaaacagcacggcaucaggaagcucuuccuucccuuuaaccaccaguugaauuagagaugcacacaaagagauuacggaagaaaccaaauguguuucuaagcauauugauuuuaguguuaauuccuguuuauuaagcacgucuuacaugcuaagcauguugguguuuagucagggaagcccauggggcuaugaugcugaucuaaacagaugguguguucuggggcuaaacaucaguacggcuucuugccggaguuuuccuggguuguuugcagaauauuugaauaauaauggaaccuuuuuuuuuuucuuugcaacuacuuuuaaggaaugaauaaaauggucaucaaucgccuggagaaguuguuugugacaaacgaugcagcgacuauuuuaagagagcuagaaguaaguuuuguuucaaaaccaucaaaaacccaugacucugacauaggugaaacuguauucaaucuagaggacgaaaggcuguuucuuccuccacuuuauugugaagauuuauaagugaccuuucuagguuuuccauuuuggcuacucaaacucuuaaauugucuguggguggguggguugaggaguauuucucugaugaugaugagauuuauuauucuauagauugauucuaaugugaauucuccagcaguauaaacugguaaauauugauacuuuauuuuacauaaccuuuuggcauuuuccuuuuuucccugaaguuuuguuguccaagaggguguggaauagauacuuggagcaggauaagagggcugugaugcccaucucucgcuccauuaaaccugugguuuaguauuggaggaggggguaaauaguguuuuuuaaaaaaugagaaaaauucacauuucucuaacagcuuaaagaauaugcuaagaaaaaucuaccuucacaaauauuuguggaggaauuuuucaugguaaaugaaaugaggaggacuggaguugagugcagacuccucuugaucaguucccagcacccacaucaggcaguccacacagagcauggaauccuaguuuagagugacccgccacccccuuccagucucuaggcaccuauucacacauagccacacacagacacacacaaaaauaaaaaugaccuucagaauaacagagcugugguguugacuuaaagggggacguagucuuugauuuauaaauguggccuggggagauagcucagugaugcagcucuugagccuaacaaacacaaagccccagguucuguccccauugcugaaaauuuaaauugaacagugucuaagaguaauuccuaagaauugaauuuuguggcuuuuuaaaaauacuuugaagcuuggguguaggugccugucuaggcuuugauugccgacgcuguauaaaccuguauaaaagugugguggcuucugcaugcggucagcacucaggagauggggggggggggcaaaaggauccgaaguucaaagucaacgucggcuagagucugacuguguguacuaucucagagagagagucugacuguguguacuaucucagagagagucugacugcguguacuaucucagagagagagucugacugcguguacuaucucagagagagagucugacugcguguacuaucucagagagagucugacuguguguacuaucucagagagagucugacugcguguacuaucucagagagagucugacuguguguacuaucucagagagagagucugacugcguguaguaucucagagagagagucugacugcguguuguacuaucucagagagaaaagaaaaaggggagucauggguuccucaaacaagagcauguuuagauguauaagugguauuaaaacugccuauguuuuauuucuuguaaaaccuuugguuuguuuuugagacagggucucuguucaggaugucaugggcuggcucuguagaccaggcuggcuuggaacucuagauccccuccugucugugccuccugaaugcuguaauuaaaggugugccccaacaggccugacaaaacauuguuuaaguguuaaaaagccaauauauggagaaaauuggcaacauaguguaucagacaugaagugggggguugggugagaauaaggggugaugcuaaaguuuuuuguuuuguuuuuuaacgauuuauuuauuauuauaucuaaguaaacuguagcugucuucagacacaccagaagagagugucagaucucauggaugguugugagccaccaugugguugcugggauuugaacucaggaccuucagaagaguagucgaugcucuuaacugcugagccaucucuccagcccgaugcuagaguuuuaugccaaguggauaagaugauaguuaauagugugucaccacaccaacuucuaaagucuuaaguugcugaguuuaacaguugcaaauucuuuauuuucuaaguuagguauaauuguggcacuuuuguggaacugucuguaaugcauggcugugagacgggugcuuugaaaugauuucauuuguacuggugaguuugugcugacaaacacaguucagcacaguuaaacugugggacgagcuggucagauggcauuugccugccaucaaggaacuuacugacuuuauguugcuccacguacacgucucuuucacuugcuaacccuuucuaucaggugcagcauccugcugcaaagaugauagugauggccucucauaugcaagaacaagagguuggugauggcacaaacuucguucugguguucgcuggggcucuucuggaacuagcugaagaacuucugaggauuggccugucaguaucagaggcaaguauucaucuuguacuuuaauuauauuugaguacuugugugguuuugcuuaaagcuuaaaauucaggucuagauggguaacagcacucgugggcaagcacagggacccgaguaguacccgguuauaccugugaucccacauggaggagugaagccaggaguaucacuggaaccugcucaccagauugagcaggacaccugagagccacugugcaugugcgugccuggacagucacaugggcuuacgguguacauauauauuguaccuauuccaauauguguacuuuuaccauauacaaguaaaugauuuuaaaauaaacuuuaaaucuacuaguaauaacauugaguaguuuccauuuuaggcauuggccauaugcuucgugugaauuuguccucaaaagauuccuauugcuaaguguucuuaaagccaagguccucugagugacaaguguuagaguaagggcugcuauuuguguugucaucagagccguguaguccauagcuauuggcucugcaugcauuucugcaagcacuugccaucuuaugugaaaauccccacauuuguuggauuaccagaguaagucaugucaaaaguaugucuacuaaaacgguuauuuuuauaucaugguuuagguaauaucgggguaugaaauagcuugcaaaaaagcucaugagauccuuccugaguugguauguuguucugccaaaaaccuucgagauguugaugaaguguccucucugcuucgaaccuccaucaugaguaagcaguacggcagcgagacguuuuuggccaagcuuauugcucaggcuuguggugaguaauaguagguuacaaaaaauaauccaagcugcacugaucuaaugucacugagaugucuucucuguggucuaaaaauacguuuuauuucuuugacaguuucuaucuuuccugauucuggcaauuucaauguugauaacaucagaguauguaagauucugguaaguuucaaaaaaucuauuaccauauccaacuagaucuuacaaggggaucuuguucuguagucuuggggcuuugacccagagccugagcaugcugggaaagcccucugccgugaaggcacauucccauuccaagaucaguuacuuugccugguccccugcuucaaaguuguucuacucuuuucuuaagacuuaauugauguccagucuuuugccugcguuucugucuuugugucaugugcauacaguugcauggaggccaggagaggccaucaggucuccuggaacuggaggcacgaugguucugaguuaccuuuucagugcuggaaucaaaucugguuccuccggaagagcaugcaguccuuaaacgcugagccaucuauacacccauaaauuuuacccuauguuuuagauuuagugcuucugucuuaaagcuauuuuauuggucuuucauaauuaauucugcuacugcuaugaauaauaauguaaauaucugauagguaacaccccagggaguugugacccacagauugagaacugcuguugcucucuguuaaaaguauauuuuuugugaaaucaucuuuucccaauacauagggauuagcguaauguaaaagaauggggcuggagagauggcucaccuuugaaaccaucuuuuucuauucguucuguaguauuagcaauuccacuuaguauauuagugccaagugcuuggugaucaggcaaauaaaugacuugauugcugucuaccuuugcuuuucccagcaugcugaauggcuuuccuuccacaguagugcuuccagccgugagaaugguugguuuaugccuaccuccacagccuugcuguacaacuuuaguuuaaaauuuaaugacaguguugcuggguugccagucuuaguacuuugacucuuuucccacccguucuuucccccgcuuucacccccaucacuagguaggaaagaaaggaagagguucuugaaucuaauuucuucuuugcuuguagcugcucuucgcucuuugugggaucuuccccugcuucaccccucacuagagaggagagaagggagagauuauaaguagagauccuugaauuuaaauuucuucuuguuucuucuuugagcacaucuguuaccaaaccacaaccaaccuccuauauugggggucucucucucucgcucucgcucuagcuuuuauauacccucugaaaaguucccagaauucagagcaucacacagucgcagaaguugcagaagcuaucugcagcuggcaaaaccaugccccaacaccugggacgaaacaaaagcauagacuauuucuuuguuacuuaaagaacccaaauuuucugauuucucacuacacuaaauuugacuccuuagggcucugguauuuauucauccucaguauuacauggcaugguuuuuaagaaggaaacugaaggugaugugacaucugucaaagaugcaaagauagcuguguacucuuguccguuugauggcaugauaacagagacaaagguaugugacuugaaagggaccuuuggguugcuuuuuccauuacuguuuauuuugggugugggguuuguucuuaagcaaacugaagauuacaaaauuauuuguucagaccaugaauauuugcuugagcuacuaaauucuaaacuaaaaacacuuagugguggcaguauuuuuauucuuuuuuuguuuuuuucaagacgguuucucuguagcccuggcuguccuggaacucacucuguagaccaggcucaccucgaacucagaaauccaccugccucugccucccaagugcugggauaaaaggcaugcgccaccacgccuggcaguauuuuuauucuuuuuuuuuuuuuuaagauuuauuuauuuauuauauguaaguacacuguagcugucuucagacacuccagaagagggcaucagauuucguuauggaugguugugagccaccaugugguuguugggauuugaacucugcaccuucggaagagcagucggcacucuuaaccacugagccaucuggccaaccccaguauuuuuaauuguagcucuuuguuaauacugagcaucuuguaugcucaugguauggcuuuuugugaauguugacauucucuuauacucuuaagaaugcuaaucaauuugaacguguuaagucagucuuuaaaacuacauguuuuagauucaucaguaguuagauucauggcaaauaaucguggcagauuccaguuguugguuuuacagacuugaggguuguguggcuaugcuucagggaagaugugaggagggauuguuuugcugaugcucauuguauuugaauauauauaugcauaugcaugccugacauuccuaaaggaaaucugucccugccacauugaaaacacaugugcuuugagacgugagagugaaggucuucauuuuauacacuuuauaauuuuauacaugaggagcuuuuaacaaguacguguauuuugcuucauaauaaaacacauauuuucauguuuucucucagaucuuuaaauuauugggcaaaacauuaccuuacaacuuugaacaccaagacugugacagguuugaaagggaggguguggcuuguuuuccaggggaccgugcugauuaagacugccgaggagcuaaugaacuucaguaagggagaggagaaccucauggaugcucaggugaaggccauugcaggcacuggugcaaaugucauaguaacaggcggcaaaguggcggacauagcucuucauuaugcuaacaaguacaauaucauguuggugagguaagagcuacauucuuguaaacaacacuauaacuuguucuuggugcuuuguacauucaguaaacugagaacaauugauaaagggaaaaugaagaucaaacagcaaaaggauuuauauaggagggagaagugaacuuuacauaagcagugggguccaaggagcgguaaggagaucuuacuugaguaaggaggagaacgcauucugggcaagaggaauagcuuaaggguuaagauguaaacuuaaugaacugcuuaucagcuauaguauggaucaagaaaaaugcuuuucacugaggaaaacgcuuggggcacguuuuaccaucuagcagccagucagauagacacaguaauauccuugcucuuccuuacagauggugcaguugcaccuguauccuagguuugaagucugucaggcuacaccuuaauuuguagaauaaugcuguacaugugugcuuaauuugucuaagacagauucuuguuguguagcccuggcuggccuggaacucugugucuccucccaagugcugagacuaaagccugugcugcugcgcugaccucaguucuuuaucuguagacggcgugcgcuucagaugucauaggcauugcuggcuaguuuguuacacucacaaagucaggagucagcuucuuagcuuccuaauucagugcaagaaaaacaugaucacuucgaauaaggugaaagcaguauuauuuccuuggcuggccauguagacuagccuggccuaugagaucugcuggucuguggcugcuuggauuaaagguguauguggccuugucugguuuauuugcuauuuauucucuacauuuuauguuauuaugacuaaaucaaauuuuucauuuuuuucuuuuugaagacugaacucaaagugggaucucagacgacucuguaaaacaguuggugccacagcucuuccaaaauugguauguauguuggaaaacaaaagaugggugaauacauuugaauuuuuacuacaaggaucauuuuuuuuuuguagacuccucccguccaagaagaaaugggacauugugacaguguuuaccucucagaaguuggagauacacaagugguuguuuuuaagcaugguauguaguaaugguaaggugugcuuuauacaguuagggauuuguuuucucugauuuaauccacaaauuauuuauuggcagaaaaagaagauggugccauuucuacuauaguucuucgagguucuacagacaaucugauggaugacauagaaagggcaguagaugauggaguuaauacuuucaaaguucucacaagggucaguauuugcaauuucagaaauuugugauuucuugaaacucaaacaugagaacaucaugauaggugguucuaacaaccugucaguugcuaaugaauguuaccuucaaaaacgauugugcaaacuaaacaguaacaaggcuguugcagaguguggacggucgaccauugcugcagcacggccaaugcuguacuaguuccuagucuccagguuugaaagcuugauguagucacuggaucucagagcguuuugcauaauggugccuacugaaaaaucuaucgucuaaagaaguauuccacuugguggguuuuccauuuuguuuuuaaauaggauaagcgucuuguaccuggagguggagcuaccgaaauugaauuggcuaaacaaaucacaucauauggagagguagaagucuuuucuauagaaacugucuuucuggccuuuuuuuuaaaaagaguacuaaaaaaagcacugacaaacacauguuguuuuagacguguccugggcuugaacaguaugcuauuaagaaguuugcugaagcguuugaagcgauuccacgggcacuggcagaaaauucuggcgugaaggccaaugaaguuaucucuaaacuuuauuccguacaccaagaaggaaacaaaaaugugggguuggauaucgagguacuaagauuugacuuuuuugugacuauacacuauauacagaaauacacugcauguaaaggaggaaacuggugcaaaauagagguuugaguuuuacaaguagcucucguaauugauaacuuaaccugauagaggaaauuuuaguuuuauugacagcuuuggagugaggguauauuucgguuaucauuuaggagccuuguaaguauuucacguugaguugaccaacuucaaguugaccaacuucuguauuagucaggguucucuagagucacagaacuuauggacagucucuagauaguaaggaauuuauugaugacuuacagucggcagcccaauucccaacaaugguucagucgcagcugugaauggaaguccaaggaucuagcaguuacucagucucacgcagcaagcaggcgaaggagcaagagcuagacucccuucuuccaauguccuuauauugucuccagcagguguagcccagauuaaagguguguuccaccacaccuuuaaucccagaugaaaggcauagcccagauuaaagguguguuccuuaaacucggagauucaaucuucuggaauccauagccacuguggcucaagaucuucaaaccacgaaguaagcuuucacgaguaagaaauuaauuuuguuuucacaggcugaagucccugcuguaaaggauauguuagaagccaguauuuuagauacuuacuugggaaaauacugggcuauuaaacuggccacuaaugcugcagucacuguacuaagaguggaucaggugagugaaaaugaaacuguaaucuuuacaaagugguggcccaugggacgcagggacaagcacacuucuuuaaucccagcaucaggaggugaaagcaagcagaucugagugccaagccaucuugcuccacagagcaagaccuuggcuuaaaaaugaguugucuuuucaggcuauggaagguggcucagauaggagugcuuacccugaaagccugaggaccagagccgcaggcacgguggcgcaucuguaaccucacugcuagggcuagaggcaggcaaaucccaguacagugcagucauaacauagcacuccugauuguacuaucuguucacccucacaucuggagaucacagcuggcucaaauuaaauuuuaaaacuuuuggcaguuuuaaauuagccgagaccauuuagacaugggggaugggggcuugggagaguguaagcuuaaugugguaugaauauaggcuacaaaagggaagugcaggcucauuuauuauaaguacugucaguaaguaugaagucccuaauuguuucuggaggugggaggaccaggguauguuaguuucucugcuuugcugaaguacagcuugagacaguaggaguguccuuugauuauauugagaugaagacugcugauaaagugguuaagccucucucacacacacacacacacaguuugugguucuuaccuccauagguagaaguuuaauguacuuaccauggguuuuuguuauuuagaucaucauggcaaaaccagcuggugggcccaaaccuccaagugggaagaaggacugggaugacgaccagaaugacugaggaacuugucauagguuaagaguuguguuuguagaguagaacuugcccaguguuuuauuuuucuuauuuguguuuguacucugcugggugguacaauaaauguguuacuguuauggccgucuguuuaaucacucacaugacuguucucauuguauacuugaccauaucuauugggaaagacacuuucuagucuguuguuuaucucauuuccaaaguuguucccccaaucccauggccuugaaagucuggcuucuaaauguuuguuguuuaucccauagcaaacaaaaaaaguucagacaguguccuaauuaauauaaggcuuuucaauaguggcugggccagaguuuaugcgcacacacugacaccaagauuucacauugcucccaauccuaaucucagcacuagaauagugaaacaugguguugccaguaguggguacaguaaauaacaacuuaaacucuaauaaaacaaguuuugggaauaucaguuuauugaugugucaagcacuaccacccagucagaguaagcacagaacuuaguuauucaaauccuuccuaaaguugaaacuagaaggaauaaaaaccaguaugcuaauacaaaaccgcuguaaauuauuuugccuguauuuaaauaaauaaacaugauuuuuuuucugucauuuacu

SEQ ID NO: 8312 - RNA, 34400 nt, Mus musculus
gucgacugaaagccauguuaggaacuuuauuuaaccgucagucuagaaucaccaucuaggacuuauacugacacauccagacaagcacauuagaaaauguaaauuaaauauuauaagguguacuacuaaugaaacaugggcuuaauaggacaggaauauauaaguucagugguuuuauugcaguuagaaaaauuauauuaugaaagauacaaaaaaaucauuauuauuauuaucauuuguuuauuuuacaaucaguaugccaucuuuuaccauuauggcuuuaaauuuucacucuacccaacaggugucaaagaauaguuuaguccaugccuuaauaaaacaguuaaaauauuuacaaaugcaaaauagauguuuucauaacuggaaaguucaccugagaauucacuguaacaucgccauuugcuucuuucuuuuuuuccaaguuguuaacgcggcugaguacccucaucccuguaucauguauguugaauuccuaauguaaaacuggcuaagcaucaagcuacaguaaacuguuagaaagcuugcagguggacaaccaauguuauauccauauuuauucugaguauaacaauuuaacaaauuaauuugauuguagcuacaggauucaaauaaggggcaaaaauuuaagaugacaaagaugacauuauuguaucaagucagacaugacagcuuuaaaaaaaaaaaaucaccgcgccuugagaaggcuggcuuauacaauaaggagcucugauugugugacuaugcaaaacaccaacuaaaaccacuguccaagcucugcaugaaggaaaaggcauacguuguacacauaugauccuccuaucauuugucuucugcauccccccccccaauauuuccuuaaaacaaaucuucuuagaaaagaaaauguuuuagaaguucacguuaaaauaggcauacauguauaaugcuaugcaauauauuucuauuauuacccaccuuauggcccaaagacaaagguaaaaccuguccuguccaccuaauacaacuugaaaaucacaaagguguguaugagguaguguaguuacuuguauuacaugcuggcuguuaaaaguaauguuaaauuuuaagaaauauuacacuuggccaauuaccagacaccauuaaaauuaacccuuaaugcuaaacuguucauagagagaaauuuaaaccaagugucuuuaaaaaaauaccuuuaaacugaggagagaacugggcuuuaucauaaaaugguaaguaacuuuucaaagcaaauauuuacauuuaaagcaaaagaucugacguauguacacacaagaaccgaugacagacagccgaguguccagugagguaggaaauccauuggcuuguauaagauuuuacacuuuguaaaccagagaaguuuucauauuauguuaaguugaagucuaaacuuacaaauaccaaauagcugcguggggacauauacauacacguauguauguauauauacauauacacauaauuucaugugugcauauauuauauauauacacacacacauacaacucuuuuguaacaugggauguacuuucacacagugagcacucucucccaggaaaauugaguggacuucucaaaauuucuagaaaauaauuccaauuuaauuuucucuuccaaagaugaaaacacauaccacccuuccucccucccuugcugcaccccaaggauaaagggcaauuaucugcuaacuauaaaaucaugaacuauugcugcugguccccguaucuccucauggcaaacaucagcuugccagugaccggaugcuacacaggguagugugcacucacuccccucccucccuccucccucccuccucccuccccuccuccaucccuccgucccucugcccuucagaagaugcagcaugcaaugaagcgucucuucagggaugagaccuggagaggugcaguccuacugacugucccccugcacccugacacaggacucuguaagugcuucggggagcgacuauggacucccuuguuggaaaugucugaugcagagugccuucagacuuccggcuuuccccugcucucaacagaagguuaugagagccugagggucagacccacccccacccccccccaagccuuaauaaaguccuauacccuaggcauauaaaauagcguucagaagacuuugaauguccuguucugacugcaaccugccucaugaggucaggccuggauauccaacaucucagugcucagaaugucuccaauuuuaaggcaucucacauuccuugaacagggauauuggaccuguauaaacaagguuuuguuuccacugcugaggucuacaaggugagauuccagaauggcuaaaaaucacugcagauguuaccgggguaacugcucagauucuuaucaauucauuuucuaccaacauuaaacaagcacaagauugaucuuucaaugcccaagucaaacugguacacgcgccuuuacgucauaccaaaugagggaauaggaaaaaaauaagaggauuaaaucuggcucucaagugcaaacccauuaacggaccgagccgaaccgagcccgaauuuuaccguuucaaacaccggcagagccucagauccguguuugucuccaacacggcuuuuuuuuuuuuaacagacuacaagucuucacugggauuccaaugagcugcucuucaggucauuguagacauuucccucucauugacuccaaugcccucauggucaucaacgaccugcaaugagaugaucgacagccuugugcagugugcagcucuccggggcagcuccuccuccacgggacagaaaguuccuaacagucuagacaagguggagacuaaagagaggaacagaacugagaacagggaacgaugauacacuuucugguuugugcagucaaaacuccuagucaauacugaggauagcagaggccuccagcucaggccagcuguggcuucugccuagguccugccagggcagccucagggucaccagccaaugcuggacuuugaaggagcugaggugcaggacauuagaguucaaaggagauuucuuuuccacauagacaagaaguaccccacuucuggggagaucaccacugcuccgcauaggaagggcucuucuuccugaucaguagguuauccacggcccacgaggacugcgugcagaugcuccgagcuguugaaauggaugcugcggcuuccgcugcucuaguuaguuugaacucuaggagauuauuaccuggucauucuauauuuucacauccaauuucccaucauucaagagauagaacaucuccuaugaaaaccaaggagaacgcaggaucaccugaaagagaaauucccucaacagaaagcuaccaggaggacacaggacugcuaagcaagaagacacggccacgcuaggcuucgagacaaugccgaaggucagagggaggccaugggcugaaggcugcccgugggguuuacucgucaguagugcacuugucagacaucugcugacagaagucugagaucccagcacucugccgacaggguuccaacagcguggccugcucuggggcagcugcggugguuggcggggacuccugcaccagcuccuggcuggccgcgcugcucccucgcccacagggagguggugcaguuggaggcacgucagacacacugaaaaccgauguaaaagcaagcucgccgucgggaguacuuuuuccuuucucagaaauuaaaaaggaaagcgggcagucggaggccgaguacuuggcaaggaucuggaucugcucggggcucagggcggcuuccuugcacaccugcugacaaaguccggucagguucugcuuugucucccccagcguugacagaauguggucucgcuccuucagcaagcucuccuuuucacuuugcugugcagaggagagagagaacacaacgguguuuacugugucccccgacagcucuaaggcaaucagacacucagugccuacaaugucgucuucaguaagacccugcugaaugcugccuuucaaccccucacacacccaugucaacucaccacagacacacuugcaguguuugcugcugcgcuacucacgguaccuaagugacgggaccgacugaggugcccagacaccgaggaagggcucacgugcaucaguauacaguggaaucuuuuccaccauaaagaaaaaugagguuaugcuguuuggaagaaaacugaaguuuacaauaggugaauugagucaguguuccaaacacagauguucucucucguauguagguccuagauuuuuauguagacacaaaaaccacauaugauaugaaagcaggaagaagucuagagaagcaaagacgacuaaagggggugggagguaggaagggaaugaggcugcucucagugaacagcuugccaagcuuguaggacaggggccucagguaauguacuauauacacuacucuacgugcagaguaguccacguacgggcaugcggaaacucagagcugaacacagagacagacagacacagacacacacacacacacgcaaaauaccaaagaaaggcucauccaaaacuccuagagucaguccuuauacugugcacaccaguacucguguguguguguguguguguguguguguguguguguguguguguguguguguaguuaaaacgcaccaccaaacauccuuauacucuuaaaugaaacacugaaagaucaaguaaggcggaaaguaggggaaagaacuuguagcuggcuaucaaaaggggcuggguucuggccaugguucuaaggcaaacucauuauccugagugcuuggguuugaacuguggauaacuacgggcuugacccugugcggaaggaaaccaacacaguuccucgguuagccccugaaacuuaccucacuguaagacucagcuaaugcugccuuccugagaucugacugugagcccaggauuaugucaaugucuuagcuauagaauccacggagugacucaguaaacagaaguaagacuucagcguacccguaugagaagugaguuccuacaggguaaggagugaggaggcuaacccuguguguacuguuuacagugcgguauuuucaaaucccuacaagaaaguguaccacuaaguacguuuuccugguccgucccuucugcccacaucaggcaucaccgccaauaguguuuuccuuuccccucaucccgccgccuccuucaccuccuaccacucacuucuaaugucuuaugugcuaggcaaccuaaucaccgagcugcuugugaacugagaguuaauaagcgcuaaccgcaggacaaagguuucccccguggaaacagcacgacuagugucuaagggaaccagaggccaccaccgccugcucucugcucgcugacagcucugaagagccagggcuccuagagaccacccgaugcuguauuucacagcgguaauuucuaacugucaaacuuuugguccuucuagcauaaaaauaguuuaaagguagcaagagcucugcuagauacagaugugcucuuacacguguguaccuagcagagcucacaaaaauauuucuacgguguuaugugaaaauuuaauuauuagugguguuuguaaaauauuaagauuauaugauauuuuuaaauaugcaaugaauaggaauucuuuuauuauaagcacaauauaaauuuuuauaauccaaagcaauuccccaauuuguucagaauuuuaguuuucuuuuaaaauaaaaacaagagcaggucaagaaugugcaugugcgugcucguguguaagucgggucuucauucagccauuuccucuuacacagacucugucaguuacuacagaugaaaucagucugcaggugccaagacgggaacagcacuggcuucuauccccgagaagaaacacauuaaagccaucugugcccucuuuucuuugcaccucucugcagcuagugggaauagaaacaagacccugggagaaacuaacaacccucuuuacucagugauaguuauacuaacgucuggcuuccucugucaccgccgaaaggaagccauucucaacggcaggagauuuaaugucaagugcugcuggccuuucaaauuaggaaagguuaacuguaacagugaccguuugggcuuccuuuuacaaaucaaaaccaccauucagagaugcucuagagaucacaaauauuauguaauuucuguaucuucauguaacuaucuaucuauguauguggucucuccacauucacaugcacacugcgacacuaaauaaaaauguccaagaagagucaggggaaggcucagagggucaggagugauuguugcacaaacauaaggaucugaguucgaauccccagaacccaaguaaaaaguuaaauauggccauacacuggggcuacacugcuguagcggaguagaaggucuuagagugacugcuguggcuugcuggcuggccagccuagccaaaaaaagucagcaagcugcaggugugcucaaagggcagaggagaccgaagaaaggauccggacagccucuggccccuccugaacacacgggagccggacucgagugcccccuucccacagacacacaggcacauauauagacacacacacgggcaauuuuaaaaacaagaaugucccacagaagcugacuugugcccagguacagcacgagcucucuaaucuucccucuguuccucacacgcccagcaaccccucacagccaccucugaggcagcuaacugcuaucuccacuuaugcuauuuugaaaaccucaauuuaccagggcaagucagaauaguugcuaaggagugaaucaaaccaacccaaccagagagcuucacagcacggcccagacacaggaggagcaggagcucaaagcgaauguaggcagcuuaagugagacacugccuggagacuucucaaaaaccagccagcgcuugcuuaacaugagugaggcucagaacccaccggggccugggggagaauggcaucugagcaccccaacuucaagcaccagcuaacuucugaagauuacaaucgugcgguccugaacaggaacaugccugaggucuucugagguaacugaacugcuguacaaacauggaaguggugccccgugcaacacaccagugcugcugagcucucaacuguuaucugcuggcuacacaccugaacggcguguuccuucccggagcuguuaaguaaguguuugcauauccgcgccuauccaaacaugaaagggcuccgugaagacguggauccgagagcgagcagcuagcgagcaccugcgcaggucccugcacaguggcgcuuccuggacugggcgcugcucuggcuggcugcgagggcgagcggggagcgagcagcacgacugugcacaccaggguccuggcaagcacauauucaggcuuugcuaacugcuucagugcacuguguuuuuuuuuucuucaguaguaaaccuaguucaugauauuguucacuuuauacuucagggucguuuugcaacauuugaaauaacacagcuuaucauacaaacauaaaauaagauggugccagcagagcuccaaguuuguaccuaaaguaagcacagacacugugcggcuacagcaaagcauuuucuguguucuuagcuuugcuguacucuuccuuuucccauuuuaaaguauuuuaaaaauauauuuauuaaaaaaaaacaaaaaacaaaaaagcacacacagacccagcuugcacaggaucaguaguauugguguccccaugacaccucgagacaccuugucccucuggagggccucuggaggugugucacacacacauggaagcccucuugugauggcugguuccucuagcucccuccggggcccugccuggggcucagcugacaagggcucacacugcagagacagguacaagguggugugcuugguuugucuuguguucuccauuaccccugcagauaagaaggcagcagaggcuccugccugguggggacgcccugcagucacuuguuucacuacuguugcauuaacuuaccuggaggagggccgcaugccacggcacauacaugaaggucagagggcauucucucagucuaccaugugggucccaugggguaaacucaagcugcugggcuugguaccaaacucuuuccucaccaagauggcuuccuagccuggaauccgacuucuaauggaauuugcuguggucuacagaggccaccacuuucucuauauuuucucuugcaguuuccccucccccgccucacccucugcauggugacagcaacccgugagcuucccccacaguggggaaacugauucagcagagcacugaaucauaccaugaugccacuguaugccaugauaucacuguguaccaugaugucaccgugagucaugucaccaugagccauaaugucacugugcaccaugcaucuguaguuuaagcaucacauuuuauacuucuggcagcuuccuaguucuuacuugcuaauacacacacuuccugccacgaucccucuccuuuuggagaaagacgugugaggcaggagggcaggcccaacauuuauguguaguucaccccuugccucugcuccuaggguuuaucaaugacgaggaugagagguaagaacugagcaggguucaggaauccccacucccacagcccaauacaaccacacauaagccagcagccucuccagguuuggugacagaacugagguacgagagcagcaggcccccaucagcugcaugcguggccgcuccaaaagacccaauucucagcuuucugcugcggucaacuacucuacagucucucucucucucucucucucucucucucucucucucucucucuuacacacacacacacacacacacacacacacacacacugacauaagucucacgaggcaguccuccuccgucuacuggggcauuuagagaugacuuuaaauguuacugugcucaugaaugccuugggagcugggaggaaccgagucuuggguuccuagucccacacuguucacaagaccuggcucuguccucgggacuccacuacagcacauuauuccaucuuccggguuuuuuuguuguuguuguuuuguuuguuuguuuguuuguuuguuuguuuguuuucccugagacaggguuucucuguauagcccuggcuguccuggaacucacucuguagaccaggcuggccuugaacucagaaaucugccugccucugccuccugagugcugggauuaaaggcgagcgccaccaugcccggcacaaaugaacaucuuaacuacaaagugguaauauaccacacacacucacuuuagacugcauauccuacccucaucacccuaaauauaugcauuguuuuaaaaagggagggagggagggagggagggagggaaagagaaaguuuaaguuauuccacaaccuaguaucugccuucaguccccaaauaugggaccuccgagccaggcaauggugaacugcaaagcuccucucacacacacagcccauucgcuccccguacaugaagcacacacagugauuccucagcagaccuguuuauuuuuaggaacugccgcagaagacuguaggugaugaccaguugaggggggagggaugcaggaagcagaggcgggcgcucuaguucacuccugagacgguuccacguaaccccguguaaaaagcauccgucccaguaacugacaagcaagacuacaagcucauccgcccagaggcagccgguguguggcagaacgugcaggccugcugccugugugggucugcucugugguccugggaacucucgucagucugaggucucaccugaguucuccuucaucuuucuguaccguuccccuaaguaugugcacacuauacacaacacaauaaaaauuuuauguuucaaccacucuuaaaaccauaaaaagaucuuuuacaucuugcuguugcuagucucgcucagaacuacaauguucacgcuugaagacccaguuauaagcacaacuuucaacuuucacccuugaugagcaaagacacaaaaccgaguaucugaggacucacucuacugucuccggcugcugcagcccugucaccuggcccuuaugugaccuucagcuggccuacacguacaucauuguccucucccacaaaugugggcaaauuaauaaucuugcaaugagcuuaugcuuugaagcuggaagagacagguccaauaggcaaucacuccgugcacugaggaugacacggcggcagcggagguuucuacucuaaccauaucacaucacaucagacuucucccuuggcagacagagccugguucaucugcuuggucuugguaccagaacagguaauucaggucugcaguucuacucaacuggaaaauagcucuuacaggaaucaaacaucauaaaguauuauauaauuacuuuaaucuuuauucaaccacuaagaauuagaacagccauuaaauugaaaacucaaaaaaaaauccagaaauacuuccccacccacacauuuuuaguauaugcuaaaaauguagaaugcauacaaaucaaaagaauuaauggagacccuauuuuagaucuucuaaucuuccugaacaucuccuaguuucucuuaaaugguauuugaacucugaaucuuaccuuggaacuuaaguaacucuuuauucuacaaacagaaaggucugggcuuuagcaacccgagacagccacacacuuaccagcuucucgauuuccgacucaagguucuggauacagucaaguuuccucuugcgacagcguugcgcggcgauucuguucuuacuccuucugcggaugucauggauacagucgagcugcucuggggucaguuugugcauuuucaacaaggauuggaaaucauuucgugagagcgaaauuauccguugggcauugaauggcagcuucaccuagaaugugaaauacacauuaugaacaucagugaagacauuaguggauaaagaucaaugaagacugacuacgucagugacacgggaagucaccuguuacauuuuuuuagacacuuuagcacauuacaaaagacacagaccuuagguuggaggaacaguucagaaguuccuggugcuacagcccugcaggagagcugaguucugugucuagaccccguguuaagcagcucacaacugacugugaccucagcuccagggauccaacaccucugcucuaugugggcaccagcacacacgugcacauacccacacaaggacacacauaugcaccuaaguaaaacaaauccuuaacaaauaggucucugcucuucaguuucuacauaauccaccccaauaagaccuaacagcccaccugacgcuccgggccugggagagaguucaacagucacacacaucagcaaaccagacacaccagccaaacagcacugcauucaaaaggaaguuaccuuaccaguguauguuaguacuuuacuaguagcuuaaagaaguuacuaauuaacaacuucuuuaaguuucugccuaaagaguuuuuaacaugugcuccuuauuuccccaaauaaauuccauuuuauugaauauuaauuaccacacaaaggcacuacacaauacuuguugguauuaagugggcuaaucauuucuauagcauguuaagaaauuuccguucugacaaaaauuuaauuucauauggcuuauuuaaaaagcaauacaucucacuugccaauggagaaacuauuagaacaaaaaaggaggauuuuuuuccuagaguauuuuugggucggucuguuuuggugguuccaguaacugaacccuggggccuuacacuccaucuccuuccagaaaaggcagccuccucugucuuacgcuguaaaauugcuacaaagcaaagacaguggugaagaacgggucguggaaaaauagguccugauacagggauggcaggaagcagcgccgaugcgaugaaaaccagcaucgaguuuucaggaagauuaaagugcgugccacguacguagcaaggacuccuacccccagguaccucugagguuugaauucagaccucaaagugguguuugccuuucuacacgcacugcggcgcucacauccacagcagcccaggcagagacagccugagccuggcacggcugagagcgugaaggagagguggcgcaugcgcacucuguggaacucaggucagccuuacggaaaaggaaagcugcggucugaagagcauuccaccgggccaaaaaaaucaaccaaauuccacggggugaacccuacauuaucuuacccauuacaggugauaacuaaaacggucaaaccaacagcgacagaagagggaggugggguggggcacggguguucuuagaguuugaauuacaaaagcaaguuauagagaugcaccacgcgaauacaacgccacuaauacagugcacuuaggacacuaaaaaaaaaaaaaaaaaaaaaaaaaaaaaggcaaguaaaacacacauaaaaaggacaaagaguauggcugaaaauuagagaagcaaagugagaauggccacuguaaaaagaaaacugacuugaaaacgaaagaauccuuauuucuaagacacggaucccuacucucuacugaaucaucuuacaggaagcaagcauuuguacaaaccucuacacacugaaugcacagagcaagcuugcugugguuaauauaagucaguagccacaaguaacucaugcuaaauuauuaagauaucuauuaaacaaauacuuaaaauggcuaaagaaaaccaaaacaauaaauaaaaucaauagcuuugaaaauuaauucugagaaagcuuuccugcacaccacaaucaugcagcuauucacagccagccacggcucacauaucagacugggcucagguuugauaaccugggggcuacaggcacuacagacuaaaugacagucuccuuuaaaaguuaccauuaaccacagaugaaaagcuugcugucccuucucccuacuggaacaugugauuacaaguuacucaagccuauguuguguucucccccaugauuaauacacacagcaaugugugaugcaugcacacacuccaucucacccagccggagcuuaucacauggucucucccuuccucccucgcucccccaacccccugcaucucccaugaacgggcugugugaacagugagcgcacacguccacuuaccucacaguccugcucccuggcagaacaggacucgcugucaccuuccguguccgucucagagucaucucccaggcuaaucacacaagcauacgggcaaggcuccugcugaggcuccgagacauaaucguaguuuccaauuuccaaguugcuugagcagccuucggaacucagaguacugauaaaagggcaguugacggaacugagaguugugaaaguccgcuggccuggcucggggcucucacugauccugauacccaaccagggacacucagaucgccuuugcgaguagcccuguucugggccgucuuuggccacagugggcgacaacugcauuuggcaaggcgaguccgugcugcaaaugucacuccagaagccuuuggccaggugcucugccaccucucgcuccacacuacuccgauccucagaugcaaggcugcugcugucuucuuuagggcccaugcuagacuucagauauaaauccugauuuuccgauggcuucucguccugggcaucuggccucgacagaggcuuuucugucuucacgguuuuacucugcaccccagcaaaggccacgucaccugacugcucauauguguguaaggcugacaaggaguagagcccgugagguccugcagaauccugaggcaagggugucccuuggggcugcucugcagggcacugaggggagggauccuggcccucugugucuucacucuccauggcugccuucauuccuucacauuuuaaaaucacguguaaaucugcacagcccugcgcucccccaaaacacucaaguucagaggucucauuuggcuggacagaggcaguguggacaucucugacaccggauucuagaguucggaucuugucaguuccaaacgcuuucuggaacuuucuguauuuggggcauagagauggcaaugccagggcuccauccuuguccgugcacagggacuggcacgccugacugacacuguccuggagagggggggaugcuuuuacacugcccugacaccugcgggagucacacugaggcgucugaacacguuucuuuuccaagaauucaucugcuucaucgauuucgagaucuuucuguucugaaaaugaaaauuuaaaaucugcuuucugacagugugaggagaagcauuuuuuucuugcgcauuccugcugcucugaaguggaguccaaaaacuuaaacuugagaaacuggaagcaggauuccucgauauuguguacgcuuagaaacuccacacaccugcacacuucgucaacauugucuuuacuuaaaaugaguuuggcaguguaggcaaacugaauuaaagguucaaauccuuuaaccguuaccuguuaauacacaagauaaaaaucaacacacggcucagcagcugucuggucggggagacagaagagcaacaaggaaagggcaaacugaucugagaucaccaaacgauaggcacuuuaauucuguuagaagagauagcccucuaggacaucgaacgaccuuuucacaggggucacauaucagauauccugccuaucagacacuuacaauucauaaaaguagcaagauuacauacaguuaugaaguagcaacaaaaacaguuucaugguuggggucaccacagcgggaggaacuguauuaaagggucacagcaucaggaaggcugagagccgcucacugcucuaggaaaugcaaaacuaaggggcaccagguuaagcagaguacaagcccuacucaacaggacuaagccuccaaccuuguaauauuccauccauacauguuacuccuuaagacacuaccaugauuccuccgugucgaaacaauucaucuugugaacaagaaugaacuguagaggagaacuuuuaagaauuaaaagagcugcuggagagacagcucagagaucacaggcacuagcagcucuuaacgucugaguuugauuccagcccccacauagaaagacucacuagggcucuaacuccuccucugggagacuggcugccugcgcuggcaccugcaugcccaucauacagacagacacacguaugcacauaaacauauagcuaaaaaaauaauaaaaauaaaacaaaucuuuaaaaaaaaaaggaaguacugucuuaugccaaauauauccaauaguaacuuuuuuaaugauccagagugcuaagguucuagaacucccucuccaggccccgagcagcagaacccuugcuaugcagauaucugugccuuuauacugagucggcauguaccaagcugggguggaaagagccugaaaacaacagaaacacucacccucacaguuaaauauguaaauuacucuagaacuuuuuugaguuacuaucaaacugccccaaaauacuaagacuugcuaaaacaugcuaaccuuacagcauuuagcuaggaacagcuacaauaaaacacauaccaccaaauucuuuaagaagaaaaaaauggaucauccccaaugcucgugggaauguccaauggacacccauuucagucauuugaucauuucuuaugaaucuaaauaugcaaccuccuuauaugaccagaaauucacuucuaguucuuuagcccuaauaaaugagaccuugaccaaaaaaaauccuauaccaacuuuuaucuguagcagauaaaaacugaaacuaaguuccuucaauguguaaaagggucuaaaaagaggaauuaagacauaacuaguguacuauacuuaucagcaacacagaaugagcuguugacacaugaaacuuggauaauaucaagggaaggacccuaagugaggacaggcaagccaagaggggcacauaacacugcacagucccaccuacacacccgcugggaaagggucaaacuucacaagaggaggacagauccgugccugccagcaucuaaagccagaagggggaaaggaaucccgggccaggcguggggaggaauuaguguaaggaguacacacccacuugggugcucaacuacucuagauccuaacuggcugucccagagcucacucuacagaaccuaaugaaugcaggacagacacaggacagacgucugacugccaggcauguacuguguccacagcaacauuccugugggaacauaauuacuuuuccaacauguuagccauagaacacggagcaaagacuaagaggaaacucugaauuacucuuugcaacugcaccggauuuauaauaauccuaauaagaauuuccguaaggauuuuccaaaauaugcuaaacuauuaaauaguauaugcagucuuugcaaucugucacugugaugaaacaauuaaaauauuugaaaacaugugacauacuuugucagaaugaaugugaaacauccaaauauacacauuauacauacccauguauauaaauauauacaccuucucucaaaaauccauuacacaaacuuugcucucccuguagaaccuccuuaaagagccggaaguaugaccuguaggaagacucugacugugacucgugucccuuuguaaaagcaaugcuaaggcaccccugacucacaccucaacacuacagccagagccgcacagaugcagcaccaggacaagcuccccugccugcggguuaguuuggaggucauccaauuaugcccaacggggaacgucugcaugauacgucauagacaacucguccuacacacuuccuccucuuccuccccuuacaacuguguccacugucaaaauacgcuaauggcagugacugccaaagcacacaugccaguaaacagagccaggaagcauagugcaggcagcccucccccaccucagacaagcccccugaagcuaggacaauggcagagacaauaauauuuauaagcuugaguuacaccggcaggacggacauacguguguaaaacaggacuccacaguaagacaacaaaugacuuguuauuuuuaaccuuucuuuauugggagggggauguggaagaguauaugccagcgugcauggaggucagaggaccauucgcaggguucgccccucuccucccaccauguggguccaggaaauuaaacccaggccgacacgacagcuugguagcgagugccuugaccugcuaagccaucgcacuggccaaggcaacauaucacuucuuucacccugaagcacagacaagguuaaggaaaaagaaaaagaaaacaaggagacacccacuuccggagcgccuguucucaugggagaugucucaggagagagagcgcacacguccugaaccggugugcugaccuucaaucacacagccagcacucccuaagccagaaccucuccaggugcuuauaacuccuguagguggacuaagauguagguauugcaucaaaauauuccacuguucaacaaguguuaauagccaaagugauaaucuuacguguaaauaguccuacaaccaaagcuagaagguuccccgggaugcccaccuccucgggagacuagggcuugucucaguuuauaaccaggagggagcuagguaacagcagguuguaguggccaccaccguggccccucaccucuucaggcagugugacggugagcucugcgucagucuggccuacgauucucgaguggaaguagcugcugcacgcagccagcaccgagcggugggcucggaaccgcuggcccuccaccaggacagucacaucacacaggacauccuucuuccgcuggucauugaggcugagcaagacguuggugcuaugcacagaggacucguaggcaaauaccgcacucucacucacagacauccuggguggcaacugggaccagggagagcaguggaaagcaugcuucucacugucaucgaccugcaaacacacauggaagaugucacuuagcaaaucccgugggaacugggcuuuagacgacaaacugugaguauagaguaagguauguacuugucucugacacagggaaaccuaagucucaaagggacaaucuagauucauucaacaagcuucaaguaaagcgggcugacgacagauagcagcucuaccuuaaaggcaagaaucugagaaagugcaaaaacuuucugaggcugggauggccuggaugucucaaaggaaggacaguccacacugaggacagguuugauccggcaaagggcugccagaaccuucagucagaaucccgucugcuauuucaagagucuaccaaugugaccagggugggaaggucacauuuggguggggcagccccccccccaccaugucccauucacccacaucaaggagagauuagguuuuccuugugccuuccauccaucgacuccaaccagcacaaagugacgacguugguucaccagcacaagaaagcggcuccuaugugucaggacacaccuuacaagucaagucuacacacagcacucuggaaggccaaagucaggcaaagccaugacaucaccgagaacauggucucugaugcacagaaagccuuggcuuccucgaaauguuacaauguaagagaaagucgucacaauguauuuggacauaaaguggcuuccaaacauuggagaucaggagaucacagcacacaauacuagcacucacaggaggcggcaacccaaauacaaaauacaaucaugcguguuuauuaucccugacaugacuucugagacacauaccccugagccacacaagaaaacuguaauaaagucuaaaggaugcuguucucccucagguuguuuggaucccaagugaccccagcaggagcagugagcggguagcaucaggaaguaacaggaacaccaugaggacccacuaagaaggccaggcucucuccuggugggccaaguguuggcccacucaggaucugagugcucccaugcucugugacacaccccucacuuuucucaggcagguacacauacacaauuauacaauucugugcugaguccuggcgccccgccucuuacccuucucuccagcucuaacccaagccaacgucaagcccuguuuguacacauacuuuuucuccuacacggcucccaagcuuacacagguaccaguguaguuacacaaaauuaaaaaauaaaaaaaauaaauaaauaaaaaaucacacaucagcacuuaacucuuacgccauacaaaguacucuugacauuuucgaccuuuuacaaaauaaccccaggcacuagagagacggcucgggguuagguuucuugcuguugagaagggcaggagucuggauccuagcacccaacucugggcggcucacaaccgccuguaacucuggcuucagguacacuggcaucuucugccucucggauggcuucagccagcugacuccaagaccuuuaaguuuggccuagaugucacacgucugucuagacuguguucugccacaauccacguacacagcacuugcccaguuagagacaucugcugcuaaaugaaugacuugacauuuuaauacaaucccagaucauguaauacaauccaaauccaaacacugcagguagcuaucggugacuggaaaugcacugaucagggcucacaaagcgaggugcuuagauggcuuuuccagauccaccaaaagcccucaggagcccugcucacaccucguggagcuacaacccuggacaaguggcugaggagaaagggccgccacuguaaacaccaccacuccagugacuugcggcaccagugacaccucagcauccgcccucauuucugaggggcaggaccuagggguguugggacugagcgucaguaaucauuuccaccuaauaccuuaacuauguaacggccgugaaagguuccuuucaacacccaccaggaacuuucuaccacuucuugaaccuaaaagcacagggcagcacuccaggcacccacagcuguaacuguugacuuauuaaaggcaaaccuggacucacuacgccggacuaguucuguauucucagaacugagccaccgccccagucaaggcaagggugugcagagggaacugcugacucacucccugaagcugacaaaggaugagcaugcaguccaaagcuuccugaaccucagcugucgaggucugcucucuacucaccgugcacaggauacauuuuaaugcagcucguuugguugguguuuucacuuucaaaaugacaccggaaaauaaggcacggggcucucacucaucacgauguaauaacacuucagauaaagaaaaaaccucaacguaaggugaccuaagauggcaaggcuagguguaugacaacaaggcugcaagugugggaagaacuaucugccacacaaaucccaagacaaugauguguguuguguccgcauaaacaagaccacccguaguccaaaucuucugucuucacugaacaacgacacaaguucuuuuuacaacggcuaccugcaccaacacucuacgcauguggagaauacaaaugaaaaacaagcacauucaagaacucgaccaagaugcucaaaacaagagggaggauccaggguaaauaaacaaggcagcagcuguaguucaaguucuagaacaagggaauugcuacaaagagagucagcaagucacacaagauacucaacaggcauuacagcaaguucugaaguaaaagcuggccauuucgcauuuaaccauacuauuuaaugagaaagaaagauugucaaaaggauuuugccaaucgcaugcaugcgugugcgaguuauguguacacacacgaauaugcaucugucuagauagacauugaccaauggacaucagagaugauacauaggacauucaacauggcuuuuccgugaaagccgugccuggaucugcagcugauccagccuucugaaccugacuuccucuccuuucuagaagguucuucuccuugaugcuucuccccucugcugcccucaucagcugccgugacuucauguccaccuaacuggaaugcauggcuuuugguggcaagccccugcccccauaccuugauccuugauaaacuucuaacucgccaagucaguuccuguauuacacaccaagcuacccagaugugaguguucugaacuuugguaguuggccuugcauaacuuuuucuaguaaaugacagacaguugacacauuaugguacaugcacauuuacuccuuugacuuguggggguauuuuucuuuaaaauguuaaaaauuuagaugaggcugcccacagaaaagaauccucaacauuauguauuuucuuaauuaucauucuugaguuuucaaaaaacuuuaacaucaaacuuuguggaaauauaaaccagcaacaucuucccaaaaccauaagacuugaggccuuaaggaagccuaaagcaggacaugacaagaaauauuuuuuaacaccauugcauacacuagcaagauuuugcugaaaggacccagauguagcugucucuugugagacuaggccagggccuagcaaacacagaaguggaugcucgcagucagcuauuggauggaucacagggcccccaauggaugagcuagagaaaguauccaaggagcuaaagagaucugcaacccuguaggugcaacaacauuaugaacuaaccagugcccgggagcgcuugacucuagcugcauauguaucaaaagauggccuagucggccaucacuggaaagagaggcccauuggaguuugcaaacuuuauaugccccaguacaggggaacgccagggccaaaaagggggaguggguggguaggggaguggggggguggguaugggggacuuuugggauagcauuagaaauguaaaugaggaaaauaccuaauaaaaaauuaaaauaaaaaggaaaagagaaaaaaagaaauauuuuuuaaagcccaaaugaacagagcaaagcagaggccaucagcauaguccaaagggguguguuugaaagcugguaggucaggaaguccccggagagcuggguuaaaauguucuacagcuagaagaacuuucuaaaaugacauuuuuaagucggcauacaaagcaaugagcuucacgcagcauuuucaaacaguguucuaauugguccugccucacugcgcucccugcccgccaccccucuugccccuaguuucuaccccugcccucuguagcaucuccucuccccuccccaccaccuccucaugcuuaaaugguccaggaauuuucuaaaagcauacaaagacaccgagaaacgggccgcaugacaugcagcuugagucggccgggcuucucccucuucccacucugaacaaucacauagguaaguaaugcguguugguucaguuuguuuuccuggcuuuuguuuugauuuaguuuuuggauuuuuuugagacgggguuauauauagcucuggcuguccaggaacucacucuguagacuaggcuggccuugaaccgccugccuccaccucccauugcuggaaucuaacaugaacgccaccauucuuggacaccauucuuugacugacuauacauuuacaggacuaaaugucauauuugaaauuuuaaaacaaaguuaggcuuaaaagcaaggagcuggaacugucagagaagccuggaagaaaguaaauacccaugaaacccucaucaagguguguggguucugcuacuccucaggacucagcguugccuccccaaugcccugcuaccugucacuaucacuguacaucaacaugagucuuccuuccgauaugcaaacggguugugucccguacucgauuuccaauuucuuucacucaucucaaugacuuuaccacacacuaauacuaagaacaucugacauuucuuucugguuguuguuggcaaauauuucauuaugcaagaaugcaacaauuuguucauccauuuaauuggugauagagauagauaagggacuuggccucagcuugggaugcuaauaaagcuuuauuagacacugccuggauacacgcaagggcugagugaucugggaggugcacucccuuuagcacucaugcgauggccucacagaugacgaaaucccuucauucugcuaccagcauggcagugccaguggccccgcggcagcuccgacccgacacgugcugcccucuagucuuggcuaucauggugugcacaguaguucugggguuuugugugccuaccucauggucauuaauauugacuaucgugcaugugccuguuggccaauuccuuaucuccuugugugaaauacauuuaauucuuccuagacuuuucuuuauuaucuuugaguuggaagagcuagaacugugauuauaguugcaauaaaacuauccguuaauuuagagaaaauagcuaacagauagaguucuccggcucacaaauauggcuugccucuccauguuuaaggacuucuucaaugucucuuaauguuaugaugaugucuagagaagaggugguuugugcaucuucuauggaauuuauuccuauacauuuugugguuucuguagcacugugaauauauuugagcucuugagcuuaacuguccaaguuuacuacauaauugcaacguauuucugagauaugaaccagaacccuucaaccuuaacuaacucauugauuguggcagcuuccuuguaaauucuuguuuaacaugcacaucacaccuucuaaaagcacaggguuuuacuuccuuccuuccuuccucuccauuucuucccuuggugcagugacuggucaugugacaguagaggaccugccacagucccuuaccagggacuuccacagcucaccucccauguggcacagcuuuaguuacuacaaugcaggguucaaaagauccuguccuaucuuaaggcggccaagcauacaauaaaaacuauuuagaauugagugaggcaggcucuuaacaggagaaacaaaaucaacacaaguauaaggggagggaagaggcagacaggaagucaaccagucucagacugauacacaaacauccuacagacacagagguggucuccaaaacguucaacgccagaucugacuaaauaccacgucuccgcaguuaggaugcagugaaccaggcuguucccucuaccuuuucacacuccaaacaacaucauauugauuacacuaacagcaaacugaaaggcauucacagaaauugugacaaaagccagucagauucaguuaaguauaaauugcugguaaucuggcuuugaguaaaaccucuaaagauuucucaaauaggaaaggcauccaaaagagaaaaauccauuuuaaacuaaaaucuuagauuuugaccaaaucaggaauuaagagaaggugggaaaauacaguagaggagugggggugguggagugacuacacagaauuccuaucaccaaaccaagcauagcaaaggucccucuaaauucucgaccaugccugccauccccugugugaugguuagcaaggucagccuggcaagcaugagcacaccugugaggacucauccucccgggggcagcacagccugagggcucuuccuucugugggcagcacagccugcugccggacuucaccuuacuggugcugagaaccuuaaauacccucauguuguggcgaccccagaccauaaaacuguuuuguaacuacuucauaacuauuuuugcuguuaugaaucgcaauggaaauaucugaugggugacucugugggggucaggacccacagaaugagaacugcuggucuagcagcagcccaaacugaggaagcccaguaagaaaagcucuccaucuuugccugcuuguuuuugagucuugcuggagaggucauuucccagcugcucugaccacuaucacggucuacacugcagccauccauggaagauauccgaacccagucuucagccuuccaacauggagugaaagccgguggcucuugaggacccuccccccccccccaggccucucguggacugugcagcucugguucucagccccacacccacacccauuuagagugcagagagucgggcacuaucgguuaagccaaucuaauuaacucuuuuaauauacagcaguucucuuggugugccacagagaacccuggcuaauacacacuuauacuuagaauucucaacuuuucuuucccgggaagggcaguucacacugucuccacuucccucucugcaauuccaugugaguccccucuguaagccagauugucaguuuccucaguuuccucagcaacauucaacacccuuucaucuccucccugcgaucgaucgcugggcugccaggaucccaaugcuccagggacuuccaaccuaucucucuggcaggcugcugucuauuaucaaccugacagaaucuagcaucaucugguggggugucagccucuagacaagccugugagggagaguccggacccaucuuuacugagagcaggggacagaggagccggcaugguccaggcacggcaagcacucaccucuccuuugccuaacuguggaagagcugugaccagcagcaagcuccucuaccuccaugucccagccaggauggacuacacacuugaccugugguccaggguaaaggcuuucuccccuaaggugauuaucacagcaauaggaagagaagaugacccuccugugccugcaggccucuagaucuuagagaaccuaggcugucuucacaucucaccucagcuuggucucccacaaaccaccuucacgggcuuaucuaaagccacagaaagaaaauaaacucaaggucacuagauacuccuguuuguuugugauuuaaucuugacuucggucuuaaucuucagacgcacauacccagauauagacucauauuauuauauauaugccaaacaagcgucucaaauuaacaugugcagcaauaucugguggugucugucacuacacuccuaggauauuaaucaaaauaggaagguaauuuuuucuuguucuuccuucugcuucuguauucaaauuaucagcuauaagcacaccaccuuauaaauaaaaagaauaacuauaagcauaaaaugcaugcccuaguuaaaaugcagcucauguuuacuuuaaaagucgauuaaaguaagggacaagugacauuuccaucuucacaaugggguuuccugcacucacuaacaaggauuagcucaacccuguggaaaaucucccagugacuuuaaagcacacgccucacucacaaugacuaucaaagaaguuugauuuugaaaaguagcuuggcgcuagggagguggccaaggguaaagucgugcucugcaagcaugagaaucagagucugggaccccagcacccacaguggcaguccacacuugugaguccagcacuaaggguggggaaaacacagggaggugcaggcgaacgcaucucaggggugcgcugaccagccagccaagccaaugagugagcuccagauucaaggagagaugugcgucaaucaaucaaaaagaaacacaacgaaacacaaaaugccauugggggguggggggugacagaggaagacaccuagccaucacagagaugucacacagagaugucagccauugaaggcaaucagagguuccacgcauuucccucgacacugacauaugugaacccuggcuugggggauccggacacaagcaagugauagcaucaacauugaucagacuuuuaaggaaaguuuuuacacacugauaaagaggcauccauggcagggguggggguaucucuccuuccagaaaacuuagucauugagauaaaugagccagagucaguuaucuugccucccugggaggacggaggcuggcggcaucuccaauguuuauccucagcuaagcuucuggagacugucucggauuugccaacgcagcaagcaguauccuccaccaagccaugugcuuagcaucuaucuuacuaaggcuccucugacuuccccaaaugucgggcuucucguagucugauucccuagcuacguuuuacuacaacuggcaacgcugugacagaagucugcuggccuauuaagcuguaacuucuguaaaauucugccaauaucuagagacguuccuggcuuaugaagccguaaguaccuguuuccuacauugcacguguuaaccgagcaucuaacaagcuaggaugucacacguguucagauaaguuuagcaacccgcccugcuaucuacacacacgcauguguaucugugugugagucugggaagugcagcagcgugcacgggagacaggaacaaagcaucagcaaaugaaacacgccucacccacccugaaccccaggaauggcugcugcugucaauggggaggguggagggacacaguccucucggagcccuuccaccaagaacagcuucaugucagcugacucgagugucuacuccaaggugccccagauacuugaggucugaacccaaccagaccagggacgaaggcaagcucucagaacaaaacaccccucacagaaacucaaaggaaguagagcuugauccauucguguggagucuuuuacuacaaagauauaaucaaaagaguaucaaaaacugacagcggccacagacuuagcaucaacuggaggcugguuucucucaauggcagcucagacugaaggcaugucagaagaugcccacccaacagggcaccaugcuuuucgccugcugcugagccaggcacaccuaugacucuaacauuccagagguggaggcaggguaguuguggaguucaagaccagcaaaacccuucccaacaacaaaaucuuuuacuagaauggaaaaaauauauauauacauauauauauauauauauauauauauauauaugcacacauauauacauacacacacacacacacacacacaaguuuguuugcugauucuucccauuuaaaagauggguccuacccaggagacagcugugugcugugccaagaagacaggucaggaaguacaggaaauaaacaucaguuccuuggaaaugacaccugugccaacacaguaaucaguuuucacugcaaaacuaguggcuaaauauaaaaucuacacauaaaauuacgguucuggccaggaaccacuuacucuggaauuacagccuaauaacuguauuaaaacauuaauaaauguuuauagcuuuauauuuuguaaucagcucucugaacugauugagccaacaucuaaaggacgcuggcaucuuuggggagagagagaauauuaagcauaggaaagcaccaauaagcaggggggugggugggagggugggugggucucacuacgcacuccagugcaugcugaagacuucaccucugucaaaagcaccuuccuucaauaaaacagacaaauggggaagagggaacagggcugaaaccucacucaacugcuuagucuacagcuuacaaacauagcccacugcuaacgcccaggcuaagaaagaacauuggaaaaaggcucugccauaaggaacugcauggaauccaggcucauggaggaaagagaaagcgacaguccagggucacugaccccaccuaaaaagugccaaagacuuuuaaaaggugaaauagcuuuaucagauaggauguuaggauggauaagaguggcucccagagacaggcucauagauuuggauguuuggucauugggaauggcagugcuugacuggcauuaggggguaugaccuugcuggagcaaguaugucacugaggugagcuuuggaauuucaaaggccaaagccagucccagcgucugucucugucucucuuccugcugcccguggauacagaugaagaagucucagcuguuucuccagcaccauaggcaagccucagauaagcgcuuuccuuuaucaaagcaguauggcuguggggucucuucacagccaacagaacacucacuaagacggacagaaaccagugguaauuauuuuauuacaaaaguauucuuuugaacaaagaauauccuagggcuuugagaaaaugcauuuaaacuuccuuuuaacaguauauaauuugcacacaauuucaaugcguugugaacauuuccaaagucucccaaugugaagaagagagccugcagcuggcaggcuucagggcaguccaggugcccuaacagcaguuacuuaaccacccaggaaggacucugucagccccugguuuguuuuuguuuuuguuuuuuuauuuuguuuugguuuuuuuguuccccagguuugccuuggggcaguuuuuaaugaacucugagguccuaaguggaaagaagaaagaaggucugcucugagcacaauguggcauuagguguacaagaugggggaacagcuccaaacucuauuugcucaauccacucuacauccauuucaggaucagcuucuucuccaucucaagagaagaccuggaagaaugagcuaaucccagacacuuccucaauaaucauggaguaugaaaacagaaacucaaaaccucuaagggugucaacucaguauccagucaagaaggacacagaacacugucuccacuaaacagcuaaaaucagccaacuuucaaagcccagagcaccagaacuaagaauuagcccaugcuggaucgcugugcaaucaguagacagguuaguaagcaaacagccagggcacauugagcaugucguggggggggggggggggggggggauucaaaucucgcuagcaggaacucacucacagggguugaacugagagaagccuaguguuugcugugcauuacgaaccaucacagguacagcugcagcuaaaugcaccccugucuuugggccccugucauagguagcuccuccacaggcuugugaucuaaaggacacacugggcguacaggaugcggcuggagggcaaauguguacuauccaugccucccauaaauaaacuggaaguagaacugagaggccaguccacucuagcacuaaucagcgaggagguuguggccagaugcagugacugcuaaaucugaugggagaauccucaccuaggauucgagcagaauccagacagaaauaaaguacuuuuuacaucuucaaaaaccaguuacaacuaacagcagaaugggguguuccauagcucugccaaggcugagaacccauaagcaccaaccugaaaccuugcuaccaacuuagcaucagcguccacuugaguuguauuucuaguggcaacaccugcccuaaggcaagccuccagcucaccugcuagcucaacucccaggaggaccgaagcaagcauccaaccugcuucuucucucuggacaccagaaaauaacaccuaacaauuuauguccugaccacuugguucacaguaacacacacuucauccucacagcaaucuaugacagagaccaccaccaucaccaucgccaucaccaucaacccuauccgaaacagcaagacacaaguuacgagcugaccccaaggccugaagaugaugacuuugccagaacaugaucuuuagcaauucaguucuauaucucccacucaaagcauauggcuccccagagagcccaacuuuagaugccgcugccauguacuacuacuaagccaggagccguggauuggcagugauggaaaccgguauuuuaccugcaguuuugaaauguuucucucugcaaauugucuagcuuuuagcaaacagcacuuaaauuccccaugugucuuuuuuuuuuuuuuuaguuuuuuuuuucuuuguuuuuuuugagagcuuuuuuuuuuuuuuuugguuuuucgagacaggguuucucuguauaguccuggcuguccuggaacucacuuuguagaccaggcuggccucgaacucagaaauccgccuggugccuccugagugcugggauuaaaggcgugcgccaccacgcccggcuucaccaugugucuuaauccaucccaccaccuaaaguaauccccuucauguugcaggcugaagagacucgggguucaggguucaaacaauuaucccacgaauagaaaguuagaaaaaugaagggaggggacuguuaaaacccucagccaucaaaagcaagcuucccugugaagagucuaaugacacuuggucaucucaacaaguuuugcagcuguucuuaugagagucaccaccacaguacagagcuacaaaaggacaggcccugauguggaaccaaauaguagccgugccuucugggucagugaaaugguucaguagguaagggugccugcugcccgaccuaaggcuaaaguuuagugcccagaaccaugugugguagagggagagaaccuauucccacaggguguccucaaaccuacacagagagagagacagacagacagagacagagagacagacagagagaagagguugacugaggaauuccacuucccaaggauuauuuaaaugcaguuuuaacaauaaucacaaggauauaaaaagggggaacccuuagccgggcgugguggcgcacgccuuuaaucccagcacucaggaggcagaggcaggcggauuucugaguucgaggccagccuggucuacaaagugaguuccaggacagccagggcuauacagagaaacccugucucaaaaaaaaaaaaaaaaaaaaaaaaaaaaacaaaacaaaacaaaaacaaaaaaaggggggacccacaaacuuccaaaggguaagagaauuuuaccuuaaauuuuaaaagauuuuguuaugaauauuacauuccaaauguauaaauuaucaaaccuucuaaucacuacacacauucaaccaaccaccuuuggggcuugccuacaaauccaauaaaauguuaucaaaauagaacuauguaauuuuuuuauuucuaucacucacuuuaagaauguaguaagaaauucccaucuuuuauucuuuacaauauaaaaacuacauaugaagugaaagucaaauacuaagaauauuuugaaauuacuacagcucucggaaaagaucagaaauuaaacacacacagaaaucuguugcagacuuggaaugauggcaauagcaguggaaaguaaauuuuauauuccucaacagaaaaaaggauaaagugugcauaaccacauuaucuaguaugcaaauauugaugucacccuccucguuuaacuuccugauguggauauuuucauguuagaucaagcauccuguaaucuaccugaaaucuccuaacaucugaaagagacaacacugauaacccuaaaucuaaaacagcacaccaaccgcuccccugcuacagagguuugaaaggaaugaccaucaauaauaauuugguaucguucuugcggcccaugcaacccuugagaggguaaaggcacucgccaccaagcuugacggccugagguccaggccccagaacccacaggauuaacggagagaaccacaaaugcaaacuguccucugaucucugcacaaauacaaacacaaaacaauaaaauaaauacauguuuuuaaaaaucaucguucuuuuagucaaagggaagaagaagccaguucucuucauacacuuucccuuucccaaacagugcaccgaggacugguguguguguguguguuuguguguguguguguguguguguguguuuucuuuuuucaaaaagaaauuacacaagauccauaaaaucaagagagacagacacauccauagaccccucuucuuagccuugacccaagaagacccgcugacucuuaucuauucuuuaccaccugaccccagaaacuaguuaugcaggaaaaccuaaaagcccuaaaaggaaauccccuuuguggccucauuuuaaaaaaaaauuauaaagaauaacuuaagcauguauacaccacucugcaucaaaauacuaaaggcaaagcgaggacagcaagggaaagaaaugauauaauacugcugacugccuuacuucuaucugaaaucucaaagauccagcuuccuccagcacaaauugagucucccgcaguaggccacgaggcugcuguuuaaacaccaccucgguguuccuuggccacgucuuaagcacgcucuaccacgucagccacugauuaccuggaucaaaacacacagcccgcagcuggacccccuccggccuccugaagccaccccucgugugugcagcucagccuuuuauaguggaggcaugugaugcgcguaucugcaccagcuguuccuaauuaccucucagucuggggugaaugacucagcaacacaaacucuuuuaaagagucacccuaccuuguuauccaaccaacguagcgaacaaagggaagccacuugacagauccgacgguuaaacaacaagaggcgaucacuccuccaaagcuacccaacuccaagaugacucaccaggagccuuuuuuccucuagacucccuuacgauguccaaagccagaaguggcaagcgccuucaagcccagcccagagcuugcaccacuaccacaagagcaggaagaauaggccaacccauaccucuucccauuucucugaauauuuguagagcucaaaagcucggccacgaacaaaaaucuacaguggucauccuuuaaucuuucugaacugccuuuccugcaaacccagugagcugagaggagugcucaaugccuaaacaaagacccagcaggggcaucguccuccaaggcuagcagucacaacucuacaauucuccaaaaggaaaaagaacagcauccugaaaaaaaaaaaaaaagucuuuguucuuccaagccugucuggggagcaggauuuucccacacgcguucuuucagaauuacuacuacgucugccuugacucagcgcacgcugaacauagagagcucacuacauaaaagccaucggcgcaauuccacuaaaugacaccaaagucccggagaagaucgaaaacgcgcuggcccuggcccuaccggacacgaacacaaaagcuggugucguuaacaucgagacccacucugccuaugcugugcgaguccacauuacaaacgugcgccaagcaacaacaaagggaagcgcggagcgcccgguagucccggaaccccggcccgcucggccuugcccccgcagcaggcggagcgggacgcggcccgcggcggagcgcggugcagggcggcgccggcacggccggcccagagaguccgcgcagcgcguaaacagcgcgcagcccgccgccccuucuaggcccgcgcggccgcccgccaccagccccggugacccccggaaaggacggaaggacggcaccgcgcaccgcccgagccacuuaccggagccgagacgcggcgcggcccgacugcaggcggcaagcggcggucaggugacucacucccucugcgcggacagccgcccgucuccuccccugcgcuccguuccucu

SEQ ID NO: 8313 - RNA, 1175 nt, Mus musculus
augcuugaaaacggguauguuuuauuuauaucaauuauaauguaacauuuuacuuucuuauuauaauaacaagcaaaauuuaguaaucauuaucacaugcccaaacugagaauauacuugauauuuuacuauauacauuagaauaaauauugaguucaacaagagugagcacaaauaacacccagggaaucacaauguccaaauaagucauuuauauuccuaccucaggggaaaaaaucacaacuuucaucucaauuuauaucuccuauaaaaguaguucugccugaaguacucacaguuucuggggugacuuuauaaaacacaugagcauaagccagggacugauguuggaaguaagccuuagacguagcugguggaagauuuucuaggcacaguaacauuccuuugguuauccuucuguggcacgcgguaugcagggacuggguaucugugccaccguuccuuucuguugcagcagcaauauccgcagagcagcccgccuccaaugaagaggacagcagcgguugcccagccaaggaagagugcuccuccaaguucucgcuucugcccugcaugaacgguugggucguagaaaucucugaugaugauauuagcaguccaggacacuggaaucagaacgaagauaccagucagaauaaagagcaccccugagguuccaagcaaguaggcuuugacccucucgcuggagccggugcacuggagcuguuucaugccgcagaugccaauaaugagagcaaccaaggcaagagccacagccacacacaugagggcacgcgcugcuuccaguaccggagggagagccaauauggaguuauagaauuugcacugcaaggugaccauagcuugcuggaugcaguucauccaaagcccuucccagauccucucaaagauaauaauguugcugccgaugaaagcugacacucuccauugaggcagaaguguugucccaaucgucccaaccaaaccgaagaauccaagaacuaguccagcgaucuguaagggauaaaaagccauugucuuuccuuggccuacugcuucagccuggaagggaaggaagacagucaagaugcagaauguguaggagucuucuagucuagaggagugccuggucuucuccgcuccugauacccaugauguguucguccaaaucagca

SEQ ID NO: 8314 - RNA, 495 nt, Mus musculus
agagcaaauuaaaauuuuauucauauuaaauaugcauuuugggaauguguuguagagguuaaugauaugaaauguucaaagaagcuguuuaaacauuccaaaauuguauaaauugaugucagagaaaaugaaauucauauuucucuggaauaagagcgaaaaacaggacgacaaguauuuccaagucccguguuuacuucuaauuacagcaauucacucaguagaaguuggagaacccauaucuuccacagcaugaagggcggcggcagccacauccauagccuccauagcuagagccauauccauagccuccauagucagagccauauccauagccuccauagccagagccauauccgaagccuccauagccagagccacagcccagucugcggaugcuguuacauccacagcccaggccuccaaagcugcugccauagccguagcccaggccuccauaguagccgcuguaguagcucaugauuuuagaagugg

SEQ ID NO: 8315 - RNA, 624 nt, Mus musculus
ugugugaugcaugaaacuaguuuauugggagacuaacaguaagacccugcccacccaccccaacgggaaacaacauuuauguugcugucauuuucagucucucaugaaaaagcuugucuugcuucuuuuagcugcagaugaguuucgguuuauagaugggcuccugcugagcauugcuggaccacagucuguaucuuguggcugccacgggaggguggaaggcaaacauugcuuuucagguuguuucuugggacgguagcugguugaggguccuguaaucuucaaagccauuggaucaucaguaggugcuguagccgaagccagagccagagccccauggccuguagaggcugcugccguagcaacagccuggauugcugaaguuacuaaugccaccauagcagaaguugcgggagcuguacaugguuccgcagccaugguucaggggggagcccaaaggcacaacacaguucagggggguggcucuguaggucccauggaaguugguuccauagcagggauacccugggaaguaguuuccgcagcagaaauagcgagucaugguggcagauguggagagagaguuggauagacugugaagaacaaguuacccaggugugaaug

SEQ ID NO: 8316 - RNA, 939 nt, Mus musculus
aggcgcuuuuauuuuauuuuuaaauaucagcuguaaagaucuaguucugcauuguaaccccaaccuccgcaacagcuaacuaaucugccugcugaauuuccuggaguucaaggccagccgagguggcugaggguucggagcucccacagcuuggucaggcaagcaucucaauagcugguuugccaauuagcuaauugagucagauaaaugauaagcucuuugaaauguucccugcgccuuuuauauuucuugaacauugugaaucauuaggcagcguggcgggugguuggucgaagguuuguuucccugagccacuccacugugcacuggcuugaggagggaucgauccaucaucuuuggaguugggcgcgcgcacgccuucugugcugcagagccccgggcuggaccaggugcucucaaguuccuuccgaacgugaugcaugucugcuucucucucccuuucuguuuccaaggauguuaacacaggcgagggcagcgaguuugcggacagugggaucgaaggggccaccaccgacacggaccucuuguccaggagauccaaugccaccaacucaagcuacucgccccccacaggccgagccuuugugggcagcgacagcggcagcaguucaacaggggaugcugcgcgccaggggguguacgagaacuucaggcgggaacuggagaugaguaccaccaacagugagagccuggaggaggcuggcucugcgcacagcgaugagcagagcagcggaacccucaguuccccgggccagucggacauccugcuaacggcugcgcagggcacugugcggaaggcuggagcgcuggcagucaagaacuuccugguccacaagaagaauaagaagguggagucggcuacccggaggaaguggaagcacuacugggugucccugaaagguaagggaggccagccca

SEQ ID NO: 8317 - RNA, 942 nt, Mus musculus
aggcagucgccggucggauccucucggguguaggucagauuugaacggccaccaugucgagcaaaaaagcaaagaccaagaccaccaagaagcacccuaagcgcacaacguccaauguguucgccauguuugaccagucccagauccaggaguucaaagaggccuuuaacaugauugaccagaacugggauggcuucauugacgaggaggaccugcacgacaugcuggcgucucugggaagaaccccacugaugccuaccuggacgccaugaugaacgaggccccgagccccaucaauuucaccauguuccucgccauguuuggagagaagcugaacggaacugaccccgaggacgucaucagaaacgccuucgcuugcuuccaugaggaagccacaggcaccauccaggaggauuaccugagggagcugcugaccaccaugggcgaccgcuucacagacgaggaggugggugagcuguacagagaagcccccauugacaaaaaggggaacuucaacuacauugaguucacacgcauccugaagcacggcgcgaaagacuaagaugacugaagagcugcuguggcugacacgccucuugcguuugcuugcucacuuccugucucagacacacacaccccauaggaccacugcguaccacuuauuuucucagucacuuccccucccccauaggaccuacugugugccacuuaguucagagcuuuuccucuuuuuuuaaaauguauuuauuccagacccuuucugucacuuagcuuguguauaaucagacuggaacgggggacaacguuguaaauuguacugaaaacgagaugcaaauaaaaaaugaaccacugugaaagcccaagacaauauauccggauuucugguuuugcuggauuuuuuuuuuuuuacauuuuuauauaauaaaaauguuauuuugaaac

SEQ ID NO: 8318 - RNA, 4373 nt, Mus musculus
uguaaggacauuuaauuggggcaggcuuacagguucagggguucagucuaauaucauucaggugggagcaugguagcaaccaggcaggcaugguacagacagagcugagaguucuacaucugaaggcugcuagcagaauacuggcuuccaggcagcuaggaugagggucuuaaagcccaugcucacagugacacaccuacuccaacagggccacaccuccaaaaagugccacucccuaggcugagcaaauacaaaccaucacacccaucuaugagacuaaaauaacauuagcaucugaggauggauaauuucuacagagcuguuuagaagaguagccgucauacggcuuucaguaauauuuucuuaaaugaugcuguccacugcagagguccgcaguggggccugcagaugccuuggcccugugaggugaguauaagaggcuuuuccugaaaacauguacagucuaaaauuuaggccucacaauuucaugcguaugagucuuuuaccuacaucaccaugugugcagcacgcaggcaggcuggaagagggccauuuaauucccugggacuuugagcuuccaccgagaugcuggguucuucaccagccagugcucuuaacaacagacccacccucccaguccuuuauuuaucuuuaaaacuaaaaugacaggugugucugugugugugagugugugugucuguguguguguaugagagugugucuguguguccucaaguccaggugccucugagggccagauguuugcaucccucuauuucccugcagacagagugacagcaaacaagucacucugagaucugccaaccuaaacauucuccuguaccuuguguuuuagaagcacuucaagcucaccucaauacacugacagcuuauuaauuaaauauauuauuuaaauacauuuaaaugugccauguaguaggcucugggauguguaacccccaccccuccgaagggauauucugaauucaggguacucugcucaagcaggaaacacaguuuguguguguguguguguguguguguguguguguguguguuuugacaauuuuagugcucuaagaggcagggagaaccagaggugggcaacuaauucucacuggcacaggaggaucccuggugucuaugagagcacacccugcucaccagaaguucagcaaacgucagccaagcugggcuuuaaggaauguguagcaauuguucaagggaaggaagggugccuaggucuggguuuugugugacaaaacuuuuccuguggagaggcaauacaucuuaugacagaccaacguacaaauaccagcaaaguccaaguaagugaaccaaugaauuuuauugggauugcuuaacaagagcagacaugacucagagacagcugcaucaccaaaggccaccccagcauggugacagcucacaagagcugggaaccuggagcacacuguacagucuguaggagccuguccuuuccaagugacucaguuggucucugccucuucuaggaggcuggucuggucucaucuaagucugcaucuuggcucauuugagacucagcucuuacugcuuaguauggcagggagggaccuagcaaaucugcucaguuuuagggacuuccugaagcuauuuuggguuguguuccuuucuacuuaaggauauucccugcuagaaggaauguuuccaucucugagggacuauacacacugggggaagagaagacaacagagcugagagacugagaucuuccuguuuggaacaaucuuuuaguaagguggaugccuuuaaugaaauucaggugagaggcaguauggauuugggaggugaaggagggugcagaaggaaaagguguuaacuuucuuuucuuuuugaaacaguuucaggcugaucuucaauucaauauccuccuacuucagccucaauaagccacuagguacacuguuuacaagauaaccgcaggucugcuccucccacucccugggccaagcugggagagcucuaaagcgaggggaaggcucuggccuggauuagggaagcgguuuugucacuagcuuuaaggcuguuuuguggcucacgccaccuugagaaaggccaaccugcaccaacuacgaggauuuuacagagagccgaggcaugugcgaaccucgucagucacgaacaaugcccuggcgaccgugaaacucaaguucacuugcuggacauuagcccaaugagucccggacuauccaauacuuggcuaaggccacucugccuaccuaaagucuguuugguggcggauauuaucuggcuccuaagagaggggacgcguugagauuuuaucucaccuaagcaaauuccuguuucucccuagagucagccacaugccgcccaaacuagaccacgugucgcagguacuagguuuuuggcucuucgccuccuccauucggugcccccccgccuuccaaggccuuagguggcaggaaaauccuuuaccuccgaccaaucccaccgcugccaagccgcgcgcgcgccaacucuagcucauucgugcgcgucauuggccaccuccaccuaugucuggugacaggcagcuucacggaccuauuggagaaggaggcggaggccagcaggcccucccgaagcugcuuuguuaggggcuccuucgccguggcccgugccggcaggucucguuauucuugcugcgguuuccccaggcugcuuacgccagagcaccgugucaaggcacccgggagugugcaccgccggcaucccuccagccacagggcccaccuggcgcccggaugccgcucagguacccggcgugcgccuguugucacacuccagcccaacucugaacgccccgcucccguguccuccgccucggauuggcuggacggaggcggagcgauuguccgcagcuccaaucggagcucgguuucccacgggcuuccgaggccccgcccccgaggcccgcuggcccaggagcccugacaguucccauuggcagacggcgagcgggccgaagggcugagcagcgccgcugccgucggguucgcagcucugcagcgccguuaaggcuucggcgcccgcagccccaggggcccagcggccccgcuuugugccuggccaggucuucaagauccugggugaacgucacuggugaguacccuggccuaagccggucgggcugacuggccagagucuccacgagggauggcgaugagaaugccuagagccgcggugcccgugacgggcacguccugacucccauucgcacacuggggcucccgguggguccuagcucccccagaccgggcuuugcuuguauuguuuucgugugcauacacuugggaggugaucuggggagggaaggcacaucuguaucgcgccaaggagaguccagaaacuagccgagacagcggagcccagguacuggagccgaaugcaagugacagugugcaggcguuggcauucgaucauucuggaggcaggaggucagcguugaccugaggcggccucaucucuauguauuuaucggcugauuuuuaaucaacuucugggagggugugugugugugugugcacgcgcgcgcgcgcgcgccuggaucugucugugugucucggucccggacuugggcacuuacgggccugucccuucgccaacguugccggguguucaccuuggccauccaugcugcgcucccggucgggcacaccacgggagagccuugggggcgggcacacagugugaaggaccugcggugggcuagggagggggcauuuaaagcagaauccuaugggugggcagacaaugacugguccagguaguggggccguucuuuacguccgcgcuccggauccuauccggaucuggcccucucucccgcucugcuucuccgaugccugugcacggugaggcaggccaccgggcuguagacccgugugaggccggcuuuuguuuacagaccucgccauugggccagagguacgcuuuuaaggccaggccacagcugcaugcccccaggagucagaaguugaugcgucuucaggugacgcucccuccuuuggucuccggcccgaagcuucacggaaaagacacgauuccacgucuucgcaccagcccagccccgccccgccucacgcucucagaucuucugcaccuagaggcgcugauaucuuuugcuggggucggucaagaugggcuguccgggagcgaaccucgccacggguaucccuuucugguggcauccucuggccauucucuagggucagauagaaucuaagcugucuuuuuccuucgugguggcuggcagguuuugaaggacgcgcgcgagcccuugggaacacugcaauucacguuugcuucucugguacccaugcggucccgcg

SEQ ID NO: 8319 - RNA, 7389 nt, Mus musculus
aguuacugauccccaaccacgaaauuauuuuuguugcuauuuuauaauuuuggcuacuguuaugaauuguaauauaaauaucugauuggaagaauagaugauauacaaccccaaaggggucacgacccacagguugagaaccucuuacagucaaaguucuuuucaucaaauuacauuagaagacaagauaaccuagccaguagacacuuucugccaacccugauggccuauuugaccccagggacaauaaaagguggaagaauaugaacuuguuuuccucuuagugcacacacccuaaaaaugauuuuuaaaacuacaaggugcuagguuaaacaaaaaacuugucaaacuuagcuuuaucguaccuagaaguuccuuuuuguauguucccauuugacauuuagaucugagcucuuccuaaugauggaagaaaugugucuguagcuuugccaggcuucagcuuucuggugacccuacuuaggcuuuuaaguccuuauuagaguaucauaaaacaugcauccgacgaugauccaaugucagauuccaaggacagacuugcagcuugucuuuccaacuaaaaauacugagacgugagccacuaaaugguuugugauuaccaaguuaauccgcauugagucaucccccacaucaaaacuacauuaaggaaaucaguuacauaggauuuaccuggaacuucaacauaacuacuugaaaaagcauuaugagcaaucuuagauuggaaaucuaaacuuaaaaauuuuaagguuggaaacaccaaauuaugugcuuuuccaauuuaguugucucuucuucagugacuucaguauaucagugagaacuaugguuuacacccaauuuguugaaaauacuucaauugaacuauuucagauagucacaagccuguuaauauuuccuuucaaaggcacucuuucuuggguauuaaggcacucaauuucauuaccuggggcuauaaaagucgauuuagccagaaccuccagucaaacuuggugucauuccccgagcuauuguguuuucccugagugccaaccuuaaagaugggugguaccaacuucacuuggcuaguagagcuagcugaggcuccauguuugccuucuaugaguuugauacaaguuuacuaaagggcuuuuucuuaaaucaugacaucuaauccuaauacaauuuuaaaauauaagguuaaguacucugaaucuugagagcuuucaauaauuucucugauaaggggcagaaaauuuucugcucaaauuuuguuugggcuaccacccaccauuuugaugguaucacauaaaacacuuucaaaaugaaauacuaugaguuagcaucauugagucuguuauugaugcucaauguauagagcuaacuuaaaauuuuuuuuuguacacauuaauaggcucaaaauaagugccacacauauuuacuaacaggcucaaaugagaauuucagcuuaucaccuguguagucuggcaaaauauggaaaggcacagaaacagauuugaauucagugaguuguacacagucuccaucagcugucauugcuguccuuagcccagucaaaggagucacacaguuacaacucuucagauuacaguuuaaugguuugaggguagcagaugagucugagacucagaccacacagggaauguuuacugcgcaaucccaaucacuccacaggccaagcggcucccagcauuuccagucuuuguacuuucuucauuuccaccuuugcccaagucaucuuguuucucauggaccuuugaaaagaagaacauuuagguuugaaugaucaaguaacuaguacuucuucccagcaauacuacagacuuaaauacuagcaguuaagagcagaccacuaaguuuuuccuugcuaguggcuauuucuagaugaaauacuaagacccaaguaacuaccagguacaugcugaucuuagcuccuccccaacuacacaguagucauucuuacaaauuucucuaucaaaaucucauguugaaagaacuauaggccuacacauaagaggcaauucuaaguaucucuacuuagcaacaagacucuaaagcuuuauuuuacaacacuuaugaaugacuguucugcuucaccaauagggcugaagagcauucuaaggauaaagggucaacugcaaggaaggaagugccuacugaaaaguuagcugcccgaggugggcaagagccuuuacuacuugguguucugcaugacccagaugcaucucccgaggguaacuugggaagacggcucccauaugguaaccaagcgauaaccuacagacuugaauacugccauccaucgcagauuuuagacucaacgaaauguugcaagggggggggcaaucauggcaagaaaauccggcuguuuuagacuaaagacuauuguauccucaacucagauccagucucaucaaauguaacugcuuucuacugcauuucagcacaacaguguucuuaacugaccuaggcaaauuaauucuuuacuaucacagccaauaaaagaacuuuuuuccuacccugaacucuuaacaauuuaugugacucuuuagaaacuaguuuaaccaccauaaagucaugggaagguacauaacuauguuagaagaaauccuauguauauauccuuauaugaaaaacuuaccaccauuguacggccaaugauggaaugcucuccugagagugagaucacacgaucuucaauggacacauuggccacaccguccuuuccagcagucacauugcccaggucuccaacaugccuaacauuaaaacagcaucagguggaugaacaaugaugucuauuucacaucacuagaguucaauaacuaaguuaaaaucugacuaagucaaauacguaugaguggaugaaaaaguacacauacauuaucaacuaugauggcuuuuccagaccggcaaaggucuggaaacacaaaguucaaaacagguagcuacaggauaccuugacagacaguucuucaaguuuaaagguagugcucugagaagagucauaaucuggggcuuuaguaaaguaugccagcuccugaguuagcaaagguuugcucccaggcccccauucuaaaaacaggcuagcccuucuuuauuuaggacuuuccuaagguuucacauacaaauggaaucucaacuaguuuucauuaucugcauuagcguccuauuauacaaugauuuacuuugccagugacugacaguacuguuauccaugauauuuucuguauugguuccuuuuggcacuuguauuaguucaucuucaauaaaugcuacaaaaccaaaucacuuuaagaguccacauuugucagcuccuucacccaacagaagcuauucuagcacgugggguugugggagugaguugggugaauggaaacaaacacaaaagcagaggcaggaggccaugcaguucugucuuacugggguccuccacagaccccucuccuccaccaugcauacagagcgugcugcucaccucucuucauccgccgggccaccauguuucuuagagugaggauuaaaaugagguccugcacugguacagccuauuuaccagaaaccagcagucagauuaugaaguaaaccccuauauguaacaacacaggcauucuuacaaccuccaacauagcaaacacugaccugguaugugcuggggcgauaaaaacaggcagcagcgcccugguguaaguagcugcacuguauagccuuacauucucaggcuaccuuuuuuuccuagacugucacauuuuucuuuuuguuugcuuuugaguuuugagacagugucucacuacuacagcucaggauaucugcgaccuaugacccucccaccuuagccuuagggccauggcagugucaggacagcaugccuggcucuuguuccuuccuuguaacuggaacagaugugaucuuuaauggcacuucuaaaguuaaagucccacauuuaaagaccuuggcuuuuaagaagggagcauacuucaugauaaaaauacuuaucuuucuagaccaugugccaccaaacagcucaccugucuagcuuuuacuuggggcaggcagacuguuagauggcuuguucccaagggccagggcugguguccucaacuccaggagguguaccacacuacucaugugggcuaagggaugccagucacaaggcacagcucaacaaugcagcaaguccuuuuauaugcaggacuuccaguguuuacucagaccaagaaaauaggaacugggcaggauucuggaaggagcuuaacaaaucaaagcuaccaggccagaggcaacucgggguaacuuuaguaauuaucaaaugggucaaacccaauccuaaguaacuguagaacaaauuauggcacauagcacacagguugaugguacaugccuuuaacacagcacacacaagacuaaauuccaggccaccgugggcuauguggagaagggaagaaggcaggggagaaggagaggaaaggaaaaggcucucgcaacauggaugaggcucuuaaaugacgguaagcaaauucagaucauuacuccaauaugguaaaaguucacuaacugcaauuuaagccacuacuuuuuacugacuugauucuaaucccaaauagagaaaauaaaucuuacuuaagcauuuauauugaaucuucaguuuuugucacuucugucccgcuaugccucucaugcuaaggcaugguuguccuuagacacucugccuaaugcauccauccucaacgcccagcuccaaacacccaaauaagcacccaauaaacacccagaauaagcaaggugcugcuuaauuauaauuacaaugaagaaaaaucaccuucuuuaccuucccacacuuaaggaagcaagcaauacuugauacuaaauaaaauacuuuuguggcuacuuuccaagguugaccuaaguggucauuuuaacuuuaucuaaaagaaaaagaaaacaaacgagauaguuuuaaaugguuaguaauuggguccugacucaguuccuuuccaucacuggucacuagccagccuaggaccuaccuuguguauuguccccauacugauggacguggaacccaugcuggccuucaguuaauccuguaauuuguccugacaacacaacugguucaccgcuugccuugauuuaaaaaaauacaaaaaugaagacaucaaguuugaguguaaauacuccugcaccagggcuguugcuggguuacacccuaaccaagcacaguaaaaagcucaagucaaaacacacaacagugaaaaucaaaccuauguucagauccaaguagacccacuuccuacaggguggcucuggagacgcucagcucuaggccucucucucccugucacacuucuccuaacacuugcugccagaugccaugugugcaggcaccuggacugaacagcauuuagaaagcaccagguggaacaaacaggggcuacugaaugccaggccuggggaagagauggcuacugcacugucagacuugacucuuacagaacacuggcugccgagaacccuguucuccacauucagugauuuuaucaguuccccuauuuuuauuuaguggucagaaaaugccuuuguccuacugccuguggagauccauuugggucuaaccagagcuaccuuaaaaaaaaaaucucauuagcuauccaaaucuagaaaauuugccacuuaacaaaaaagaaaagaacacccaaaauucaaauuaguacugcuccagaaaguguagcaauagggagaaaauguaagagcaaccgaccaacaagcaaggacaaucauuuuuuagguuuuuuuuuuuuuaaauguccaacuuuugcaacagaauaagggaauaugaacuuuggguagaaaaaucugauucugaaaaguuggcaacagguuaaaucaaccagcuuugauuacaacugccaaucuggaaugcuuaacuaucguuucauuggguacaaagggcaccagcgauguguaguuugcagcgucacaaaaauagugcgagcugcucuggcauggcaugguggaagaugacagaaacccacacacagggguaagacccagccgaacuucgucuuucucacagugaauuacguggggaggagaaaaagacaaaaacaaaaaacuuccacaggaaaacaacaaaacgcauuucaaugccaagaaacugcuggaaacgaggcuaguuacgaaaaacucuaaauugccguuaucaguucucgucguaaaccaaacacuugggauucacuauggugucugccuucucacacguauguccaccacuucagagagcacauaacgcucauuuaucaaauauucucucgggauuaaggugaauacaacaacgguaaccucccuaaggcucuggacacaaccuuaccacacacaucuucccugugacgcauguguuuuugcagggucacaguauuuucgaaaauaucucuauguacuuuuccaaaaugugcucagaaacucgcugugguagaaaaaacccacagccgggucucucucuggagugcaaagcaagggacggcuguccaaggccaucucuuucuuuccgccuugcgacacgacccugaccuaguacagaacagcccaggacuuugcuuuaaagugccgcaaacgcguccugcggccuuaguccggucuggcaccaccggguucaaauauucuuacaacaaucgcagccgguggccacggggcucugagccugugggacacggacaccggaaaagcagcagccccagaaggauaacggaugccaagccggcucucccgggcaggcccagccgcuccggggcgcggggaggcccccgcccgcccggaaggccccgcggcgccccgggccucgcuucccggcgcccagccccugccccaggccacggugacucagcacuuagcgggcucaggccguggcgggggcguggcgugcucccgcacaggugcgccgcgucaccgcggccugcgccccgcgccccgggccuugccuucugcucgaaguggaugguucccugcaccggaccgucgcccuucagcacgcacaccgcuuucaucgccaugcuuccccgggagacgcgcggcggccuccuccggagggaccagagagagcaagacgagaagccgacggacggaaggcgccgcaggaaaggaccgcgcaaaaaaacgaggcccuggcgccacggagcuuuuauaggccugagucugaccacgcccaccuuggcacggaaccaaucgcuacccgcggccuccgcccgcccuucguggagcucccuggccgcggggcacgcugggggcggggcggaggguagcuccggcuccuggagcgugcggacugagaaaguucccgaggagccugagcggggaaagucgcuauugucuucuaacugu

SEQ ID NO: 8320 - RNA, 113678 nt, Mus musculus
cgaguucggcuguugcgcgcggggaaggaaggaggggcuacgagggauuugaaagugcucaagcugcggaguggagcucgcuucuguccccgccgcccgcgagcggauuaaauuucugcaaauucaaacugaauggggcuuucuucugcugccuuccagagggcgccugcagcccgccgcgcgcuccucuccggcgggagcggccccggggagcaccgcugaggacccggcgggccagagggcggcggcgcccgggcuugggggacuccgccaccggacugugccccucucggaccagcagccgcuguucccucucacagccgaucggggcaccagacgggaccgcgggcgcgaucugggcgaucgauccucggaggacgaacuucucgggggcggguccccggucgcccggucgccagcuauugucugcgcgcggcgcuagcacagaggcgcggggggcgugagcacagagacccgggccgggcggggccggguccagggcggcggcaggaggagccagggcagccccgggagccggaggaggagcggcugcgagcgcgggagccgagcgagcgcgaugccggcagcggcgggggacgggcucuugggcgagccggcggcaccggggggcgauggaggcgcggaggacacgaccaggccggcggcggccugcgagggaaguuuccugcccgccugggugagcggcgugucccgcgagcggcuccgggacuuccagcaccacaagcgcgugggcaacuaccucaucggcagcaggaagcugggagagggcuccuucgccaaggugcgcgaggggcugcacgugcugacgggagaaaaggugagcuggggugcgcgggccuggcgggaggacccgggagcacugucccgcgagcacucagccuggcucuccaacccaguguggcuagacgcacgcucaggcucuccuagugggccaccgggcaccuacugauggaugaugguggugaugggcucacguucguggggugggguacccgggcagauagauguacccgcgaagcuaccccgcaccgucuuucuguuuuguuuuggaagggugccgccuggcggacgccagggaagggaggggagagguggcgguggaggguccugcgguaggggcauggaucagugcagaggcgggaacuagauccaggcugggguucagcuuugccuguggaaugugcggcggcgggagagcaaggcagccagucugagguugcuuagaguuucaucccuccugggcucaggcgaggacguggaggggaguuggggcccuguaagcuccccucuccccccgugugggcuggggcaacuguuggaguaacgauccugcuuuuggcaggugcagaacuacacaggcccuggacucuagaaguuugcagauaccuuuucaucuuucuagaagacaguaaaggaaaggggccccucccccacacccggagggacucuacuucgaccuaauuagaagugagagagugaacucuugccaggccgggugcgggcagaucucagguguuaacuuagauuugugaaaagaaacccaagaagcugacuuacuuuugaggcuggguggccucaggcagggaauugcucugggcugccaaacugguaucuuuguagggacccaauacucuaaucacccaggcuggggguuguccgcgcgggcggaggaggggaacucagccgguccuagcagcaaauagcccaagggccaagcccucgggccugcugcucuggguuuccuugcccagccuagggguuugugacagugaugaacugugagaagucuggugacaggccagggccaccacacuagucauuuucuagccucuggauaccuuugauuuccucuugguuucuguuguccuggaaaccccuacauuugagcacuggguuccaucacccuuugacuuuaucuucuuuuucuguagccauuccaaguggggugccccuuuauacuggguaagcaggguuagaccgagcagucauuuucaagugucucuugcccgaauuuccaagcaaaaaaaaaaaaaaaaaaaaaaaaaacacccacaaaaaacaaaaaaacaaaaacaaaaacaaaaaacaaacaaacaaaaaaaacccagcauucaguaugaacucacauuagcucuucaaaggagaaacucuuuagacccguccuaguuguucucaguggaguaagggaauauuuauuuacuuuuuggugcgcagugggcugucugccggacacacaucagugaugcagacugauuucagggagcucauuucuguucuggcagggagaggcgaaggacuuugcucucaaaaucuagaggauuuagucuggcuaugcacaucaccucucuaaagagaucagaacuucuuagagcuuuuugccauguugggcuggaccucagcuccucacuagggcaguuuugccccaugggauaauacuuuuguccuuggcugcacugccugggguauucaggguucagcccugauucaguucuggacuccuguguuagcuccugccuagcaggaauaaauacagggagguuucugcccaacuggggucuagaugaagggucucauuuccuccugucuuuaugauggcucaauucaucuuugcauugagaggaggauuguugaauauaagguuuuuucccccuggaccaguugaucagaucuaguuaaagaccauaguugucaaugcagaggccagggaugcaaaccuuggucauuccugcaaugcuuuucuuuaaccaggagggaccuuucucuggggacaacagaguaucagggagggaccuggauauuagcuccuucaacggugagcuuuaaagaaacaguggugcuauucauagcuuuuaucucccuaacccuacaccuuuaaugcuuaacuaauagauguggguuuuagcugauuauagagaugagaaggagagggggaggggagagggcuagggggagagggagaacauuuggugaguuucugagucccaggcccuccuuucuuuuggguuuugcuuuauuaagcaaagcuagaggaaaagcggaggcuaccucaagcuauuugcaaacuaaacugcaggccaaggggcuucacuucaggaaaggcagauucugugaaagcuugcuuccaggcucccagccuccccgccuaucacaacuuucuuagggugcguagguuuaguuaaaggcuuccuuuucuucuccuuuuuagugggugcagauuuucucuuuuaggaggaagggaugaauccuguggugggaacuaaguccucccugagccaccugggcagaaggacccggaguagcucaucuugaggaaugcguuuguggaacagaggaugaagggaagacgagggcaccaucucacauuccgucuguuccagagccacucuuaucaaagcaugcauuuuauuuugguugauuugugguuaaaucuagacucuugcucguugaaggcguccgaggcagugugggugguuggugguguguuugguaaggugcacauuuccagaacgcuuuggauaaaaauccuccuggguuugcuaggaauucccggcugaguccagaagacaagcacguugcuuuacccgcuuuccuuuuggacucaguccugucucacccagaggcuccuguugccaccgugaagccguuugcuuggaagccauccaaaucucgauggcccccuuacugcugaacacaaagggauggcuuagggcugagaccuaaguuuugcuucccuuuagcuuuuaagcaaaaacuaucucugcccaucuggcuuuauaaaaauaaauauucacucaaucaugugagguucuuaauuacgauguucucagucauggcuggagugauguuuggaccaggagacaucauucgguuagauucugaacauguaauuccccguggcuuugacauagagaacaguugcugggcaggaguaugggcuagcagcguuuacagacuggagagccucuguuuuuugucucaaagugguucucguuagggaagaaggaccuguguuaggcccaugagaaguuaccaucacauuuuaaaacuugagugacaucuaacugaaauggcucggugguuaaaggugggugccggccugaugacccaaguacuuucaucccugguacucuugggguagaagaagaaaaccaccaacuccugcauguccuccuguaaucuugagacuuccacaagugcacuuccgcgugugcccuccaucaguaaguguaauaauauuaaaaauauuuaugaacacggugaagaagcgcaguggggaaggucuaagaccaccucgggcacagugggcuuggaaggccaacuggagcauucaguagagccaugagcacuggcaccuucaccugggaugcagaggccaagguggguacaugaaagucagugaagggacuccaggaacucagucuaaccuuugacuuuuauuuaaaaagccccuuuauacgugucaguagagcuauuuuggggcgaaaacaaggacugccugcuuaguaaguugcaagucaucacucacggagugcagcggcaccagauaccuggagugaagaaguuacuaaaauuacccuuuacuacguuuuuuuugcggagcaggaaauaugacuaauuuuagagguggccuuuuggcagaucuguuuuuagcauguauuucugaaacaaacaggugcuaaaauccuguauuucuuuuuaagagagagagagagagagagagaaauuucaggagcgacgguucugagguacagggcacacguggagaacuggaaguucccauuaaccuucagcaggggcuccuugggaggaaggaggcaguuuucagaggcaccugcccugugggucccgcgugcaaggcagugccuauaauuuccuggauuacagguggugagguugugggcacacucuuuugaacuuccugccucgccucaucuuuuugaaguacuuggggaacgcuggaaauuggcacguagggcuucuuccccagugcucguugacacagggccaaaggacuucaaaggauggcgugagucagcaucccuaagcagacuggugcccggugcucgcugaggaggagcggcgcccacgaggaggagcgcaccuugcauuuucucugcaggugucccgcucuacuuacuaaucugacucaggucugugggcccauccaugucugcaugucucuggcuauucuagggauguagcaucaaccagagcggcgauuaucuucccaggaggcguagagagcgcuagccacaugggccuguuggguugauggccuggguauaaauuagcauuugggcugaaguuuguugucccucucaacuauucauugggaaaagugaccuugagcugcuugccuggcccuccuuucucuaccucuacaguacaggauuauggguaucugccaccaugccaugccugguuuaucuagugauagagauugucuuaguuauuguuauauuguugugaaagacaccgugaccaaggcaaaagaaaacauuuagucgagggcuuguuuacaguuucagagggugaauucacaacccucauggcagagagcauggugacaugcagccaugagugguacuggggcaguugcugauagccuacaugugauccacagucaggaggcagagagggagacugcacugggcacgggcuuuggagacuucaaaagcuuacugcuggugacacaccuccgaauccuuccaaaacaguuccaccgacugggaaucaaauauucaaauacaugagccuaugacggccauucucauccgaaccaccacggugagcaaacucaggccuuuguguaugauaggcaagcccucguacugacugagccacgccagccucacccuuuacuccgcccaggcccugccauacucagaugcuguccucuggauucucugcucucucacgggcgugugguuggaugguaagaucaccagcaacagaaaggcgacgcauccugaggcuucagcccagaugcuggauucuugacauuugugcagaauggagucucaggaugaagcaagaagcagaguugaacuuuauuagggagaauuuagggcuggaaaacugcucgggggugggcucagguguagguaaagaugcuugaugccuagacuggugaucugagucgaaucucugggguccacaagauggaagaaaaaaacucacuucuccaaguuguccuucgaccuccauagguguaccagggcacauguguccccaaacacacacacacacacacacacacacacacacacacacacacacacacacacaauuuuuacagccggggagauagcucaguuagagugcuugcugugcaaauguuaaggucagaguugggaucuacagagcucaccuaaaagccagcugggugugguaggucaucugguaucuuagcaaggagaaggcagagacggagacuccacagagcaagcugaugagccaggcuagcggaagaggugagcauacuuguagccucaagaaguaaaguggagaucgacugagaagacacuugaugccaaccccaggcuuuccugugcccacacaggugaacacguguauacgcccagacaaaugcacacacaaaagucuuaaauaugaggucaguggagaggugcuuaaggagagaggaguacacacccacguggguguguaggcuccucaagggacagcucaucgcagcaacagucguacuuaggauguuggccgcuuucaaguugugucugcgaagguugcugagaaggcccucccccuuucccucccccuuuuuuuuucaagggaugaaacgaugauuuuaggguggcccucuagaugccuuggaugggauggcagucugguaaagccaugugucgugaggguugcacaggggacuaaaaccugucuuuuacuguagaugggguuucuuugugaaguuucuagaacauggcuggcuuccagcauggaguggagggauauacagggaagggccauaucuguuuuagaccuuaagcaugguucauuaauuuauuuuacuuuuuaaugaguuauuuauuuuuauuuuacgugcauugguguuuugccugcauguaugucugcgugagggugugggauccccuggaacuggaguuacugacaguugugaguugccuucugggugcugggaauugaaccuagguccucugggagagcagccagugcucuuagucacugagccaucuuuccagcccucaaugguucauuguuaucuuaacauccuuacgaugucucucucuguaaaaggggcauuaucucuacacagacagacuucacagcaaagguuaacugugcuggcauccuugacucucagcuggugagaguuuucaaccagacuccuggguggggauucuauucuucccaauauccuccaggcucccaagauguucuagucuaccuuacgagaccaagcagacaaguguagagaaucagagccuggagaucacacucacugggugaugcuggcaaauuccagaguccuuguguugagcaccagcacuguggcuuauauuugccaguggauuuggggucuuuuaugcauuuucuccucaggugccggcagcagguuucugcacaggugagcaccccccucucagcgucuuuaacugcagugacucagcagaggcaugccucgaguggcuuuucuuucugacuuucucuauuaguuugcuaaggugucuguaacaaguuaccacagauuagguggcugaagcaacagauauuuuuugugucgcauggcuggaguccagaaugaagccugggaagaggcccccacccuccagagguucuuugcuucuuuugguucucgaugcugguagcaccucuguaacccaugcuuguuaacauggccugccaaucucugucucccuuuuccuguaguguuguucucaggaugucuccuggcugagucgcuuccuucuugcaauaaaggcacccaucacuggguuuagaauccauucuaaucuaguuuugccuccuuuuaacuugauuacauccacaaagacuccauuuacaaaugagaccauauucauaggccacuagaacacuuguuuaucaaucuguggcuccugaccccuuugggggcucaaacgacccuuucaaaggguuugugucucggauauuuauguuaugacuccuaacauaguuaugaaaaugauaguuaugaaguagucacaaaaauaauuuuaugguugggggaucacuguaucaugagggacuguaugaaagagacacaggauuaggaagguugagagucacgggccuaaaggucaggacuugaagcugcguggggggcauaguucaaccugcuacaucuuaggucacugaagaugucacagguaauuuccuggcaagcugacccuuuggaagacagaaauguguucccagggacuaggaaagcaaaggagugcuggagaucaggguuggugagggugguuccuucugaaagcugugggaagagucucucucucucucucugucucugagaccuuguuccuuggcuuguagacaacugucuucccucugugucuuuccaaguuuuagucauuugugucuccgaucaccuuucucuuuuugggguacuggcuguuuuggggggucacccuguaagaaaccuccauucaugcucaguaagguaucccaagaaggaagaggucagcuuccccucuaauaaccccacccccaacuccaugacaucucuaaagaccuugucucugagagguguggagagcccagccucucaucugugaacgggaggggcgcaguggggcucuuauugaugcauucacaucauccauggucuggaugcucucaugagcucaccuccucacgagaccauaauaagucucaugaagaggagacccacugcccuguuccugaugccaagaguccccucgggcacacacagggcauucacuagaguucaugauggacggaagaaugcuuugaucuucccggguguuguagagcaccuuuucuucuggguauaacaagaugccaucuuggacuuugcccgguagccauagcaacaagagcagaacaagacagugcaagccaggccugagauaauggcaauagaaccuuuaacaaacacucaccaguauaauguguaggagaggggagucaggaaacucccccaagacuccagccauuguuuccugucucuuuccaacagcugcaaaugaucccaggagauuuggggugcauaaaaaaaggguuaauuaaaaaucagaacuacaugguguaacuucaauggggucaccaucugugauggaacgggacuuuucagcgaugcugcuguuuugggggucacccuguaagaaaccccucacucgugacuccuugaucucacuaaaaugggcuuuggugaaauuguacuuuggucuauugcuggugcccaucuagggugaguggauguucaccucugucucuucccuaggaaaaguuaccucacaugagaugagaggagggcuuucugagccgucagguugucagcugucacucauggccauucuccccgccccccauguuucuggccaugucugggguugauccgcuugcugggcugacacccugaagaaaaccauggcccaacaauacugugcuuucuauagcgacuuguuagggucguuaacugguuauuagagugacaggaugagacaggagacacccauucuguggugucuuagcaccguucuuggacccucggcucuucccagagacugugaaccaacgcuacagcagaugaaagagguugcuauuugcaaacauacaucuuuuuuuuuuuuuggaugucucccauggagacauacguaggcuugaagucugccucuuugacuauaauuuucuccguuaaguuuauuagucuccuaacccagauccuugccgaagcacucuguaauccucagggcuccacuugccucuuuuuggagccauuugaugagauuuggucucauucgcugugugaccuuugcaggcuuucauccuuggcuugaguuagugucuuccagccugucuuguggcucuguguugucaggacacauugcugcaacaguuugaacacuauuuauuaauuaaugugguguguguguguguguguguguguguuugccuacgugaguuuaugcauaccaugugugugcagaaaacuguggaagccagaagaggccaucgggucaguacugggaacugaacguugggccucugcgggagcaacaauguucuuuuaauugcugagccaucucuccaguccuuugaacucuguuuuuccaugagccaccucugugggucaccugaucuuuguuucuagagugggcaggaagcaugaguguccacugggcacaaagggucacugaagagacuuagucuucaagccaugauaggacggaggucagaauccugcagcugccugucuaugucgcaccagcugcaggccaguuccuucaugucguauggauacgacgcuucugcccagggaacauuuugugguaguuacuacugucuucauuuccugucuuuguuuccucuuguggcuuguucagcgcccuggggaucgauugaucuuagcacauaaaaacccaaagcuugggaaacccaucaaagaaaacaaagccagauucacccaagaaaacauuucauuaacguucuguguguuagcugagugcuuccgaaggaaagugucggucaguaggcugcuaaccacaucauucaucaguuagggaugaacgcuuagagcuccaggcagagcuggagagcuuguggguaggaaccuucacgugugguccuggggagcaagggaugauuucccacuucuguaacacccagcuucugucccuuacacgcucaccauaagauugugugugguguguguacauaaaaacauauaugaauauaauguuaaauauaaauuauacgauaccacacuggguauagacauaaauaaauauaacguuuuggcagcagaguuucucagggaaggaagcaguggagggggaaggggagagagacaggauggcuagcaacuuuuguaaguucccuaggagaggagauacucugaggagagacacuaggucucucccuuugguugaaacaauaggcccgaaggauuaaaaguuccccaguaaucucugcugcagaaaggggaagccuggugccagccagaagaggaagugucuccagaaagagauuucacacagcugugauagcuugucagaguaacuuucaagaccuucuggagcugagacacugacuggucgacccugggugacaaggaccacaccugaacuaggacugcuuacccaugcaugccuccugcccucuguuuaaauccuccaaggauggauagggugggcauaugugcuccuuuuuccauuguggaagucuuggauuugagguccaaagaggccaaggaagaggguugccuuuuuggguaagagacuuacagaaagagucacuaauaccacagacaguagaugucaggggaacagagggguucagguccacauggcagaguggggucccuccuuacagauucagaggaugguggcuucuugccguaugaacgaugaguacuccacaguacagguuggcucuugggaggaggggggaggcacaggaacuucuguauuuugaggaaggaauguguggucuugaggacuuguagagaagugugaaggagagccccauauacugaaugcaugucgaccccaggggccaagagaauggagucccagggugagaccacucagcuaugcgaguggagugaggagacucagcuguguuuuggcacugccuuagcagugacuggucugggaucuaacaucuccaccuuguuugucuguauaaaagaaaaggagggaaaagagggaggagggacagagagaggaugagugccauaguuaaccucuagcugcuuccugaaacucuuagggcaucuuggaagccuccccagccuggagugaugguuaagaggcugguaccaaucaauauucauagaccaggagggccuugucuacgcaaauacauaugguguauuuacguuaugguggucuacaugaaccggcuuagcagagggauuggagagggguggauggacaugaaaauaaaaacuaugaguaaacgaauaaccacaggucugucuggaugccugugaagagccguggaaucaauuugaguuuuauuuguugccaagugugggcagaagacaaagaggagacugacggaagcgguuggguugaucuucgacuauugcagggaacagguagauuucuacgguugucacagcucccccuagagcugacaucauuaaguuauuuugaugugguugcaagacuguuaagucacuugaugauaacgguaauagauugacucuuuguugauuacuuuguuuuaaggcuaagguagcucaagguauaacccuuggcuuugggccuguaacguccuuccagcucugcacacuuggggaagcauggcagcccgaugcggcuuucugaagggcgcagacacugguguagccucuccugggaagcuccccacuggcccugcaggacagauccugucccauguccugcugccaggaagcucauuccucagaucugaggagggugacgcugaaucaucaggugagaaaaauggcucccaaagccacggaggcaggauuuccuggaucauugcucagccuucaagauaagccugauuuuuauauuguuaguauuagaccuaauacuaaaauaaaauaaaauaaaaaauauaaagcauagugugugucaaaggccuaaaaacagccucuaauuuacacuaggagaguucauuuaaaucucuagguaucccuaacuguaggaaauggccuggccugcuuacuacuuuucuuaauaggaaaagguuuuuggcuguaagaguuuggauauaaaauaugggacuggacuggcaaaaugauggaucaaagugcuugcugccaagccuggcaaccugaguccagucuccaugagcugugugaaggaaggagaaaacugacucucacacagugguccccugacuuccaugugcucccaugaacacacacacacacgcacacacacacacacacacacacacacacacacacacaaaaguguuuuuauauaaaaauacauauauuuguauccccaaauggaauuucuuuugguauauuuaaaguaagcuuuuuuuugugugugucuauuucaaaugagauuucuuuguauacaaauuauacuguguaaucguaaaguacauucauaaagacagcgacacuuucgacuguuuucagauaccagagugggcucugggcaagcagacagcuguaugaaaaacuggguugcaggaaggacacgaagccauucuuuucuauagucugggcagaaucaagaucgccauccuuuuacacugaggaacaacucagaaaaaucguacacaucucuuaagugaagcaggauugaagacguguuugaauacaguccuucccuucuaggcuggggaaguccgccagcaaaugaacucauuugcucaucucuucuggaaggagccuugaugaacucgugaucuuuaauggccgucgcuuauuuaacucuccguccagaggacugaagaucgcaggcacaaugaggauuuuguccaagcagccaaauuuauaaauagauugaauuauuuguccagcagaauaaguuuuaugaucacuguaauuuagcaggaaugucucuaguaggcauaauucuuuguaacagaauuuuuccuacuguuagacagugucuauucaacaagagacagcuuugcccauucagaguuacauacuagcacaauuuggagaaaucuaaucucagguuuuauaugucucauuuaguagaaggauggaacacaauaauuauuuuucuaagcccauuuuuauaaacauucuuaagagcagauccguacuucagaaaauuuuauuauuguaaacagcaucagacaucaauuuaguaucaguauaauagaauuuugaccauaggaauuauaauucauauaaucaucuauuuauaauuucucacauaaauuuauugucuccaaagcuuuucuauucuuuaaccuucuuuaccaaaaguacacuuuacaaugcauguuaauuguuaaucaauaaacaaaugagaacuuaggaaaugauagugcauuacagagauacauuguaacauugucaaaaagauguugauauuuaaaaaugcauugauauuuugguaaauuccaagaugucccuguauauuuuaaaaccaacaacagcccucuuuaccugcauaacguacccguucauacauguucacagaucuuaaaaucaaguauauggcacucuauaaccgugaucagagccacagguuuuagguuuuauuuuucucucuuuaaaacagacaguuuacaugcaugcaacauuuaugaacaaacacauuugugaacaacugcaauguauagacaaagugaccgcacacggaaacaucauggugaccucuaagcagugagaggcgcugaggacagaguggagguuuuuaucugggccuacugagccuuugggaagaguucagccucagaagggggcguggcuaggagccagucugggcggucugaaacuuugauucucugagaagcuucugcuacuuggggcugaaaacugcagggcccuggaugggugugggugauugggcauauuucuuucagguguguagccccagacagggguggggggaacggcggggcgggggguggggggggggaggggagggaagaaucuacggcuaaaaggaguuuugaggcugaaggaaagcagcuuggcuaaccuucugacugaacccagaauaucagguugccugggaaugugcaggagaaacaggucuugcucaauccuagaguuacuuuguuagucaaggaccaaggcccccaaacuuacuagguauugggguacauguucaaccuaacccaacagacuuauuagucuaaguuuuuuucaccaacaagugucaagacucacaaggagccuugauugccagggaccaagcuaacuaacuagcuuucuuucucccaucccuuccuuucccccuuucccuccccucccccacgcccacuuccauuccccccuccauaccucuuuuguaacucaagaguauuugaaggcgcaagggacccccuuuguguguucucgccugacuuguagugaaaucugguuuuacuuuagcuaugagucagugguugugguggggaucacucaccauuuuggaggggcugaacguuuguugguggaggccugggaaauuucacugggagaaacaguggcuguuuccuguggcauacuggauccaggcagggugcccguguagaggggaucagccaagagaagaaaguuacgggggugggggggguggggggguaggaaugagggugggggaggggcaggagugggcagcagagagaaaugggaagauuuuagggaugggcuuuagagggaaggaggcugaaagccgucauagcgcgggagacccccuaaguaggagaaccuggaugcugccauagagaagcugggccucucaucacgugaucagaggagcccuggcuaggaaggacagcggcaggaggcauaaguccuauucuugccuggggaaaguugcucuggguagggccagcuggaagcuuuuuuauuuauuuuuuaguuggguuauaguaacguaacuggauuuagaaagcagcaggcaacuugcugaaaggaagcugguuuuuuuuuuuuuuuuuuccauuuuuuauuagguauuuaaggaagcugguuuuuuuaagacacaaaaguucccaggggaagucuguaccggugccacugcucucugugaaguuaccuggguccgcaugaauccggggaucaaauuuuccaguggugaggucagacaaguugagaggaacaagaggcgcagguguccauaugccuuugauuuccuccugccuguaugagcagcgugacagccauugucauccuggcagggccggaacucacagagacccaccuucccaggccuccccagugcugggcucaaaccauaccuggugaaguuuucaaaucaaauugcaaagcucugagcucauauuuugaguagcacagagaaaagucccugaguuucuggggagugcauccacuccuguuaaccucgagucuuagggucugcuggguaccaccaggguuuccaaguccuguguccugggacaagaagcuggagagggacacaugaauaguaggagcagcagaaaaaauuuauucacagagcgcuucugaggaaggaagugggcaagagcagagagcaaaaguuaagauauuugugggccacuucugauggccuggaaccuucauagaucaaucauacagaaaucaugggccauuucuacauauguucuguuauguaucucuccggcaugggggcuuccugucagguuuuuuuaauauguauuuucuucuccacguuuuugcccuuauaccuacuugcucaugugggcugucuggagccagcacaggccucccuuagucaagaagggacuucgagacccaaggaaugaggaaaugcuccuacaggugaaggcuggcugcagugcguguguguguguguguguguguguguguguguguguguguguguguuggguguggauggggugggguggggggaucagagccccaugucagugaaagcaacgccucaagccaacugcccucacguaucuagucuguccuccagcugggaucacccuacucccacgcagaagugggacuucuaagugcauucuuuauuccagguuaaaauuuaauuagagaagcucgucugacucgguucucagucgaacauuuacauuuaauaauaccaauaaagagagcuuguuuugaaaacacggcugcagguuugugaaguguuguucccauaggaugacauuuuauucuauuaaaaacgaacauuugugagcaguaguugcaauuucaaggccaauuugaaguaauaaaacucaaauuucccucuggaggggaagugcuguggcucuugcgcuccugccuaauucauuacuuuauuucccccgcucagaaaugaguuguugucuuguucuuucucccuccucuucccucccuucucuuccucuuuucuccuuucugaucauauauauuauauauagagagagucauuaaagcaacagacaaagaaccagagagcaugcgcaauaauccagucaacaaacacacagcaguggcuuccugccuuuaaaggggucaucacucaacaacguauuuauuuaaauaugugucugugugcauguguguguguggggggggcgugugagaauguguguguguuuguguguguaaauugccaaaugcuaauucucuuuuucuuaugaucaacuauguaugugggacugagaguauauacccuugggcucauacaugcuaaguacauacaauaccacagauuagugccucucaccuaaaugcuguaacaggaauaccuggaaagcauuuuugacaaaccauuuccugcugugaacuucagucacaggaggguuuuagaccuuuugagguucuuagcacauucaggugggucuugggcuaauggcugcccggguuuucuuugauagccacauagcauguucuucccaucaucagcucguucucuugcugugcguuucaaaccucaugauccacucuccuacgguuacagacaacauuaauguuuuccuccuguuugguuaaacacgccucccuuuucuuauuggaaauaaacacaaaguuaauuaaaaauugcuuuaagucauacacucccgagaaaaucagugugaacauuuaguucacgugugcugcauacacauaauaguuauguguaguuacauguacaugccuguauuaguuacauguaguuacaugcacaugcauguauuauuaguaacauguaccuacaugcacaugcauguauuauuaguuacauguaguuacaugcacaugcauguguuauuaguuacauggaguuacaugcacaugcauguguuauuaguuacauggaguuacaugcacaugcauguguuauuaguuacaugcaguuacaugcacaugcacauauuauuaguuacuuguaguuacaugcacaugcauguuuuaguuacaugugcaagcauguuguaucaguuacauggaguuacauguacacacauguauuaguuauggauacugcugaccuuccuuuccccuuugauuucaacauugauauccacuauucauacuauuuuguaaguacccuguauuuuacugaaaauuuagugcuuugcaacacuguuaaguccucuuuuaaagugugauguuuugugauacauuuaaauauuugaaguuacuguaguauugaaaaguugggauugcuucaagauuuccccuguauaaacaacacugcugugacuguccuugggacugucucucugagccauuucuuaggaacaauacuuugaaggguuuugauauauuaccaaauugcaauucagaaggauucugcuucauggcaacauuguaugaaguugacuucuagaauaugugucuugguauauugcuaaugguuucuaccacguuucucccauauggcaguuacuggcuauuuccauauuaaagauauuagcuuuaucuuuauuguguuguagcuauuaucuucuacuuagucacuuggcuuucuuucugauucauugaugacuuuuuggcaaagguccaucgagguuuugcuuugcuuucuuuagccaaccaguugauaccucucucucucucucucccuuccuuccucucucucucucucucucucucucucucucucuuucuuucuuucuuucuuucuuucuuucuuucuuucuuucuuuccuucuuuccuuccuuccuuccuuccuuccuuccuuccuuccuuccuuccuuccuuccuuccuuccuuucuuuuuuguuuuccgagacaggguuucucuguauagcccuggcuguccugaaacucacuuuguagaccaggcuggccucgaacucagaaauccgccugccucugccucccaagugcugagaucaaaggugugcgccaccacagcccggcgauacuuuucuuuagugucccccuuguuuucaagcuuacauagagagagaaggaguuguuggcuuugcuuuauacauuguccgugacuugccaguuucuuguuuccugaagaagccuuuuugcugggguagggaggcaccuuugacuauauuuucucaccuguggcauauuggcgggcugcaggcuuuggggguucacagcuucugccucccaacuuucugcuucugugauuuuggguaagguauugaagcccuuuuaaacuuccguuucuccaucuguagcacagucaaaucuacuucaugaauauucagugacaaccaugcacauauguauauguaaauggaguguguguugcuuagcuuagagugugugugugugugaaagagagauuguaugugugugugaguguugugugugugugugagagagagcgagagaauguguguguaugagugugugugugugugugugugugugagugagugagugugauugugugagugagcauauugcuuuugggagcacuuaauuagcuuaaagcauauucaucauuguguuggagaacacauggcaguuauuuaugcuuuucauuuagauccucagaccuguucuuaaacuuaaagguauuuagaggucagauuccuugagcuagcaagacagagaccgcccacuagguuuaucuggacgacggaguugaccucugaggauagaggcgagggggugaagaggaucaugggacaccucugcagcaguuacccccccccccccccagggcaggaaugccucuggacgugcagggacacacaugucugcauuccucagcuuccacaccccucguaucugccugugccaugagccucuuggcagccuccauucucugccuggggaaggggcuucucuguccccugguucuuacuuucugcucuuuuuaggcaucugguguguuguguguguguggguagguggugucccuuaccuuucuaggauucaugacaccacaccagggaugaucacugaaccuuccuggccucaccucuuagucaccuuuauggcccuuuuaacgguagagacuucuuuccaacaaguaauuaagaaugaaauuuauagagacuucugccccagugaccagaguuuuaggguuggggcugcgucgucggaugugauuuugauuugauggcucccacuuuccucaacaggcagcuggacauuuccagugugugcugccuuuagcugaccccugcuuagaagccccuggagcucuugagaccuccgcugacagcaggguccuggauaggagaaugggaucuuguacuggaguuuccuggaguucuguuuccaaucccacaaugcccucauccuccccucccacaaggccauuuugcucuuguaccucucuggcugcauguggccgccaguugucccaggauggagacgggauauuguuuccuguugccugugggacacgaacacgucuugaauuaaagcuaauuuuggaguuugaaguauuaaaugucaaauuugaaagagaacaugucuaagacuucuuuguuguaaaaaggaagguuauccaaggccuaggggaagggacgggaagaaagaagugggaaaaagaaaagaacugguucccucgucccugcaccaugacgcucugucugcaccccuggaaaaggcacccuucugaugaagucugcuguuuuaauauuucucuaccaaaaagucauuuacgauaagguagccugaacucuuuccccuuuuuguucuguuuaaaaugacaucaaaucaguuugcuauaguauuacuuaauacauagaauguauggcuauguauaaaauuaaguaugguuaaauaauuuuauuuuauuuauuuuuuaagugaaaaaccauuuggcagagagacugaagugucagaguggucaacacuggggaacugucccaauuguaauuggacgaaaacaagacacacagcuaugguggugaacuccuuucugcuuuuguaguugugagcaugcaugugugucucucuguggauguguguaugugaaugccugugucugcagaugccagaaagcagcaucguauccccuggggcugacauuacaagugggugugagcuuucuaguaugggugcuaagaaccgaacucagguccuuccuguauaagagcagccagugcucuucucugcugggccauuguccucccucccucccucccucccucccucccucccucccucucucccucccucccucccuccuucccucccucccuccuucccccucucccuuccuccauccuucccucucucucucccuccuucucucccuuccuuccuucuuucuuuuccuccccccuccuuccaacucaaacaucuauagguacuuucuacauguagaguuugugcuaaccaccugugugggcuuuuuacaaauuagagacagcucagcuguguuaggaacacagcuuuaucaaacuguaaguaaaaaccggccagugucaguccuggccucucucugcuuuggcaaagccuauuuuguggcuuccucuagaauaggcagcgaaggaggggggagacucuggaagggaaccauguucaguguguguugcucacuguccaacagaccggacauaccccaucuucuggaacaaacagagucuaaaagaaaccgccgugggccuucugaccugcugccuucucucuugagucuucacucaccaggauacuggagggacucagggcucagacuuguaguguggcaggaguuccagacacaauucaaacaaggugugagagaccucagucuguguauuugaugaagaaaaaucucaaagugcugcucagccccccucacuccgcaugguuccguccauggaugaaugaacauggugacaguuuaaucagggcugugacggugacaugcaaggggagagaauggaaaggcagagccucugaacugggauuuuuuuuucuuucuuucuuucugggaaaggaauuuggugguuuuggguuccuuugguguguaaccugagaggcucauccaucucuuugugacagaggaacauuuugguguugcgaaugcaacuucugauuuaucacacgcagcugcgugggccgcgucucccuggugccucccugugcccaggagcaagcccagucacucagcaaggcuuugccuuccagaaaggcuugagagcuggggcucugugugcuuagguggcugcuggggacugucacucugggcauguguacagggaagcucagaugacggagggggacaccuggucccucuccagucuugcauuugcauuugucaaggcugaguuggcccccccgcuaaaauugcuuuauuacagucugaauucuuaguaccucugaauguaucucagguugucuuuaagaaggaaggaaaacuggaaucauauggacugcccuaauccaaugcagugccuucucuuccaaaagaggaaacuuggguagagaugugcgcacacagagacaagaccagaggaagaagagacucgggguagccaucuacagcuggggagagagagaggccucagcagaaauccacucuguuugcauugugggcuucugacccuucuaacugggagacagugcauuucugccgucuaagcugcucaggguuuugugauagcagcagacagacaccgugcuuacacgcuccgaaugccaaagucguugcacccgucacagcggacaacuuuggcugguuacugagaggguuuucgaacuagauccucccaccucuuccuucuucaugcaggaagcuuuuggguuccccucacagccuuccccucacuucacucugcucuaugauaaauucaucagguccaaaugcugcagcgccuguuccuagacacagcauccucaugguggaaggaacggagcuugcucaucaggcccugguuugguucugugauagaaagcgcagggcugucugauuggguagcgggaggggaaggauuccucucuaaagaaugagaggagccugaggcaggaggauugccaggggugcuaaaccagccugggcucuguggugaauccacucucucaucucagggggaaagaaaucccuauugaaagaaugaaguauuuuaaguucguuagaaacucuucaagggcacaugugugaaauuauuagggugcucccagaaguguuuagauuugauuauaggaugcuuuuguguggcccaugaauaucgguaauuucccuaugaggugaguaaaugagaaaggcuguucugugcggcuuccaaaguguugccacuauaaccgugguucuugcuaauagcauuuggugcguaguccuaucuuuccuuggcugcuugugauaaugucuacuggccuggugucuuaagccacagacauugucucuagggugucacaggcaguuccuucugaggaagacaccaguuagacuucucuuccagcuucuuggagucucagaugaugcugggucuguaauggucuguuucccugucucccuucugucugucugucucuuguccagauuuagacuauuaugauaucccccauagauaccaagcgauuaaauuacuuauaugcaguaaacugaugcacuauaucauuuaaccuaggcaccuccacucccaaucucuccuagguuguuuaucaugcuaauaagaugcaaaugauaugcaaauaguugcuaugcucuuugaacaugucuagggcagaccccgauuuccuuucccaaauaucuuccauccauggcugaaucaauggacgcagaccaggaccuccauguuucuugcucucuaugaguagcuuggcugccucuauaugggguguggauuuugaaccgcucagcucauuaguuuuuuguucugacauacuaccuaacgcaaaccauuuaguaagacucaaugcucaugguucccggggaaggcgugguggugggaguaacucccagcuguagcagucagacaaugaggcaccuuguucaucucucagcagaccaggaaguggagagauccaagguggaaguagccugggguguccucaagaccugucucccagauacucaucucuuccaucgaggguccacguccuaaggucuccgaagccaccaggaacaguaccaccacccgggcacuaaguguucaaacccaugagcccgugggagauguuucuaaucaaacccauagcucccaccuaggaggucuucaccgcuggagugcuugggcuaauggugcaguaucagaauguggagagacauagugccccuguggaggagagaugcgugguagagacaaaguagagaagggugcucuucggcuaaaguaggcccugguagcagucuggucccgugaugucuuuagcuggugugacuucccaggaagagcgggagcaacaccaugcauuaacaccgcacaacuuuauaccucacccacgcacccuguggugagcggacucccguccagcgaagcguccuggcucuuagagcaagcuuuaugcuuugugguuuuaaaguuagggcagaacucgguguguugagcaugcuucuuacagcuggaugcuucuucuaguugauguuguggguucucucucauucccacauugaguguuguuuugauguggagagagcaaggugggcaggggaagaagcuuccagaagcaagacacgagguugcaaugggaugucuaaugccagaccaacucuucauggguacacuugaaaggcagagcagaagguuaguuucuagugaugcaaagagucgaugugaagguguagccuuugcugcucgugacacacguacccgagggagcaaacagaguugucuauaggaguuccuuaaggaauuccauguguaggcuucuuguguuccguggcuuagagaugaaaguguuuguaguacaugccaugguagcagguuugcuguggcucccuggcaguccucacaggcagaugagugggaagggggaagcugccucuaucuuggaaucccagaggagaggcuuugacaaguugcugcugugucugugguggccgagacacaaaccagggacuggaggugagagacauuuauucucaccuccccagaggcuagcacaggagauggaguugucagcuugucccuguaagaaaggacuuuuugcuuugggcuaacuuuuagggguuucccauaaguuuuaguccucuuuggcacuuaacuacacgcggcauuguggagaagucccccagggaugugcaaguuagcacaucgguuccgugcugugguaggagaugacagggcagagggcacugccugcaggaagggguuaacgcuguucuugcaggacuggauuacuaacacaaaggcagauuguuauaaagugagcugcucaggugguuuugucuuucugcacaaguccucuugucugucaccuuuucugacauguuaccacacauacacgaggcccucacuggaagugaagcagaugccagccacccucuugcuucucagccuucagaccaguaguuaaagaaacuuuucuuuuuucuuuuuccuuuauaaaacucuucauuugugguguuguguuguagggucacacaacagauucagucuauacaaggcucuucaguuuugugugauguuucguaggaccuuuccucuguaugccugugacccuucuucuaaagccgccauggcuuagacaccguggcccucccacaucaaugaccuugccuugaccgauuagaucuauaaccacccuguuucuaagcggggucacacuuggauguccuggguagggaugugauuucauaucuuucuggagaacacauucagacacuaauguguugcaaaguggcuuuccugucuucgccacggagggcucugccuccccgucucccucauggucaucugcuauggcuccaucucaacaucuugccauuguuuuggauuuucuacccucucuuauccauuggucuaucugaguugccuucaguucccuauggcugaucagugucuaccauagccuggcugaguccuccagcauccucccaucuccgggaccacauguugugauccauccuaacugucuagauaugcacucuggucaggccacaguccugcugauaaugcuucaggcucucagagagaacuccauuugguucugugccuucaagaccaucaaggucagucuccaugauccucaguucuucugacgagugcucuguccucuguggggaccuccuggcucccucugccuuccccagugagcauaaacuuccagagugccagcguucaucuccaggguuuguuaucaucugccaggaucucuaaugggacuccauaucacugcucacacuaggugugugaauggguguuggaucaacuccuagguuuguuuuuguuuuuuuuccccccugguagaaucaggcccuagaaguuuugaaauuuauacuuuuaucugcucaucucgauuguucccaaacagcggcugcuuagacaagcucaguggaacaaaggucucugggaagcucugacuguagacaggaggcucugucaugguccagagguuuccucuuccagcccugugugcacagugacacccaaguuaaucaguaucuacgagucagccuuucuccaaggacaccgggugugugguggcuuagguuuuaacuucuggauggcuuggacaaagagugguuggaagaaauccccagugguguuuaaggcugggcccaguggaaggaacccuugagaaguguguuugauuccuuaaacugccuuaguaggaugccacaguagaugguuagagaagcaaagacacacugccccauaguuuugaaggcuagaaggccaagacgaagguguuaagagggcaggguccaugguucauggcgguauaaaaacaguuuuuacacaguauucuugccugugcugauuauauucucauaagcccagcauuccaagaaucucuuuaaucuaugguguuaagguccugggaguaggacuucaaguguucuagaagacacaucucaacaccagccauugcuagcauggacuccccuauccagccugaagcaugacugcugcguggggugauuaaagucugucaggucagaagguuacacccuguagguaaggauguggggaagcggcacuugcacccugucccaccuaguccccgggaagacauccggcugccuugcuagcagcacuccauucuggaagccuuggagugauagccaagagcaguuauccugggcugagcaugcggucagggcaacccugcuugcucugcacaggcuagagggcuguucccgagugagccuuugagaucugaggccaaggccuguauucgucaccuucugcucggcgaaugccucaaggaugggggcauccuugucuagugagccccguccugccaguagcguuuuauuuccccugugagguggauucugaugaucagugacugaguucugaaugugggugaaacagucucucgagugaauucugcuaacugagcuugggugaucagcgaagacguucuaauggccuaacggugauugaggccuaacgguuuugucagaguucugaugacccaugaccgaguccugguguuuggugagugaugaccagugaucuaaagcuagaggccaguacgugaauucugaugguuggugaccgaggaccgauagucagcgguugacuucugaugacugaagucuuagcuucuuuucccauugccgugauaaaggacuccuacaaaagcgacuuaagggugaaguuccaggucacucuucaagguuugguccaucacgauggagaaagcaaggcagcagaggaugaagcagcugcuuguguuacaucuacagucaagcuguagagagugaugaaugcccagggcggcuuaggccacuuucucuguuuauacggaauaggaucuugccagggaaugcuaccgcucauagugggcaauucaggucaucgacauaaucacacgcaggugugauuccauucgaccauuugacaauuaacccuuaccguaauagucugugauuuugucugaggcuggguguugauuugcucccccauaggacauugaugguaagaagauuugagaauuaggcuguugguugaagugaccaguauggaggguaagauguuccuggucuuccuugcuuacauuggcuuaccuuagguuaucuauaauacuugaccccuauccccuguguggucagacucagggcagaaccacaaucaccucacccauuuguuccaagaagcagcuuaucaagucuucuugucacagacaagcccaaaucacaauccugccaugucccagguaggggacccugggguaaguuucuuuuuuuucuuuucuuuuuuuuaagauuuauuuauuuauuauauguaaguacacuguagcuguccucagacacuccagaagagggagucagaucucauuacggaugguugugaaccaccaugugguugcugggauuugaacuccugaccuucggaagagcagucgggugcucuuacccacugagccaucucaccagcccccugggguaaguuucuuaaucuaugucaauuccgaguuucucucugucuggggagagcuggugucuucuuuagaaggauagaguguacacaggaugcagaaaguggcuuauaggaccuugcuugccaagugccuaguggauuagacuagucccaacuggagacugucuggauuugugacuguggucuccuugugugccuuuuuuacacuguaguuaacaaagauauaaaauagaccauaucagucucacccuuauugacugugaaacuagauaauuuaggccaugggagauugguuucaagaccccuaaagaguccuaaaaacuacggaugucaaguccuuucuauaaaaugaucagcguguaacuuauacacuccuccaaauuacaucagcauuagcuucuauauacaucuaacucaauccucuguaaauaguuguuauauuagguuguuuaacguuuaaggcauauauauauacauuauauauauugucaguacuuguuaguauggauacaggaaucauagauucaacuacauaccucagugaggcuucaguggguacuggaaugagguggaggaccagugacgucacaugguggugggaugccggguaugggugcacauggcuucaguguggggcuccugccugcacaugacgugacuucaguguagugcucaaggcuggcuuggaacuugaaaugaucuuccugcuuccacaccugcgggaaauguuugacugugcccguaucuucugcugaacugguugaaucuuaggaugaaaaccucagauuggaggaggccugacuguauuuacaaagcugaaguuaaucagacaguuguuuggauugacugauuguauuuggaccauugagccuagcuucuguguugcuuaauuguaagugaacacaguuaauuucccuucccuucccuucccuucccuucccuucccuucccuucccuucccuucccuucccuccccuccccuccccuccccuccccuccccuccccuccccuccccuccccuccccuccccuccccuccccuccccucccuuuuuuuguauguguguauguuggugugggugcacguguaguuuaggcacacacaugugucauggggccaaccuugggugguguucuuugggagccuuccaucuacccuuuuugguaacagagccucucaccaauuaggcuagacuggcuggucauugagcuccaggggucagcacagcacugccucccuggugcugggauugugaccacugccgaugcuugaguacuuuccauggguucugggggcugaacuacaaucacuucauccccucagucaucuucccacuccccuaaccuuuucuuugugagugauuaaaaaacugcuugguaaaaugagagcugcccucuugguuauuuuuuuugaaaguguuguaacaaucaacauaucuucuuuacucucucucucucucucucucucucucucuuaaugggugggagguuagauuuguaaccggcacaucuuguuucccaugaaagcaacauuaaaaucuuuccaaccugauuuugaccuagcaaagccccauuuaauugcgaugaaggaaauagauaaacuaguaguuaacccagauucucaggacgaggcccucugggacaggcauuuaagaguugaaaaugguaacuccgaucacagcugccucgaaacucaaaaaaaaaaaaaaaaaaaaaaaaaaaaaaaaaaacaccaaacgaggcagcaccucagaauuuaagugggaaacauuucuuugaaguuuaucauggucucucucuuuucuuugaaacgguuccuuuaugauucugauuauauaaauauucacauccuugggugucucugucuuucacauuucuuuuucuuuaauuuaagcuguuuacauuuguguauuccuuuuguauguaugggaugcuggguguggcgcacuauaguguggaugucagagggagcuuuggggaguugcuucucucagguuugguggccagcgucuuuaccuggugagccauccaucucuggccuaauacaguucacauuucuuuauuguguuuuuuguuuguuuguuuguuuuuguuuuuuccaacucucaggcuucaggaguagucugccuuguuuuuugaggcagggucucuccuuggcccagggcuuaccaauugauguuaggcugacuggccagugaguaucagauuccugucucagccuuuacugacugagcuacacagcuccuccuuuguuuaacccccuccuggacuuuaaaugauaaagacuagaaaguuaguaacuuguuggcuccugugaugguuuguaugugcucagcccagggaguggcacuauuagaagguguggcucuguuggaguaggugugucacugugggugugggcuauaagauccucauccuaguugccuggaagccaguauucuucuaucagccuucaggugaagauauagaacucucaucuccuccugcaccaugccugccuggaugcugccauguuccugccaugaugauaauggaccaaaccucugaaccuguaagccagccccaauuagauguuguccuuauaagaguugccuuggucauggugucugcucacagcaguaaaacccuaacuaagacaucuccuaaauuuaguucaaagcagcugaaaagagagaacccagugugguaaauacccauaaagacaugguaacuuucuuuucaaagauaaagagcaaaagcuaaggcacaagaguuauacuuaucgauaaagaaguuaacgacggcauaggaaguacacuacagugccccagcuggaagacgcauccugugauugguugggccgggcuuacucaguagcauccuuucuccuagguucugggccucuuguccuucagaucuuccuuucuuagcauuaaaauaugugaaaguuauugacuccuugagcccuccagugcacaugucaaagccccgacugacucccaguaccuggaagauggcuguuuuugcaaacagagucuuugaagaggaaaaugagcugccauccucauuauggccugugguccagucugagucuuguuuuaugaggaguuuggauucuuuuaagugauggccuggcagugguaacugaaggugggcacggaagagaugagggaugaccggguaccacauucgaauguucuauaaagagucugugcauggugaggagaggccaggggcgagggccaaggaagcugcuccuaugaaggcugaaggguccaggagagugagcaucuucccugggaguuaaggacagauacaggaggaucuacaagcgaggcugguugagauggcuuagugggugaagguauuugcugccaccugaugaccugaguuggauccccagaccuacaucacagauggagagaauugacccuuacaaguugccuuuugaccuccccaugcccgcuguggcucuuccaaccacacacauaugcaucccucagaaguaaauguaguuaaaaaagaaaaaaaaaaagaaaagaaaaagaagaagaaacugaaaggaaguuugaauaaagggaugggcuuauggaggugagagugucaaccauacugugagaagggauuuucugccagccacagagaagccucccaagaaacugccccuguuaaggcuuugaucucgaacuucggaccuuaaaaauugugaagccacagauuucuguuauugaggcagccauuguauucagguagccugaauggauggaugaaugaaugagugaacgagugaguaagugaaugaaugaauauucugggagaugaugagagagauugggcgaacaacuuguguuaaaaagaagaggaaaagagaccuuaguuuuaggaucucagccaucgggccuccaaacagcucugcccuguucacagaagcaugcacacacagaccugcacacccccccucccccccccccccccccccgcagucccccucuuucugcuuauggauucuguguccuuccugagcuguuauccgcuuuucugugaagcugagcauuuagucuuccguggagaggaaaggaggccaggaggauuuaugaaggccuugcaggaacacaaauucugcuuuauucagacugacaucauaauugcacggggauaaaucagagcagaguccggggaagggccuucuuuuccgagagucugaggaacgcggcuccggggcuggucugacagaaggugauuuaggugggacuuaggcagcgaggcugaaggaagccaccugcagcgagcuguaaggagcuugagugaaugcagagugaaugcagacccggagcccugcuggagcccuguguggacuuaauccuuccucucccggagcuauccugucugucacuccccuggguccuugucaucucugccucccaguguugacuucugugccugcccagagcugugugucauuaauaguuacucaguaggagccuuggaugauggucaccgugugccaagcacagcguguaacaccuuggucaaucuuauuaucccugagucacuacagggaagcuucuugucugggauuucucaguucugggacccucagcuuagcucugagggccaaguagguucagcugcacuuugacuuuuuggcugaguucugggucucaggcaggcaguaugcuuagagaccaauuaauuugaacaaagcuacguggcuagaacuuccuaacaguuugcuguaguugccucugaccgucugaccguaauggcuaccgcauacuagagaugagccaggcauaaaagaugugucguugaagugugaaauaugugucaaaagaguuccaaggcuuuauaugacgaagagcuuguaugauagcucauuaagaacucugaaugcagaggcuggaagaaaauggcucauugguaccuguugcucuugcagaggacccagguuugguucgucuuaucuacaggguagguugaaacuaucuguaacuccaauuucaagggaccucacacccucuucugaccuuaggcaccagucaugcaugugguacacacacacacacacacacacacacacacacacacacaccaucccuggaguucacugacucacuuacugaugagcucuggaccacugagagauccuaccuuagaaaacaaugcagauggucccugcuuaggugaccucugcucuguacacucucacucacacccaugcaugcauacucucgcuucaagugugcacuccccacacacaagugcacucucacacacacaaacgcaaacacauauaaaguguugaaagugguucuguuauaugucacucuuuuuaaaaacccugaaaaaaaagagcgagaaaaugagagaaagaguugcgaggagggcgggguaggauaaggauaugaaggccagcaaggggguccagucagaaagaagugcuggccacacccgaguuggaucucuggccuacaugaaaguggaagaggacugguuccacaaaguugcccuuugcccuucacacgcaggcugugacauccuucccaauaauaauaauaauaauaauaauaauaauaauaauaauaauaauaauaauaauuauagggaaugagcaaaauaaaggaguccguguuucacgaugacuauuaugcaaaagcauuugaagaaugcaaacuuuaucugaacaaaagcgaggggggcaaacagcaauugauagacuguaaguugucaaaauaagauguguuccaagaaaaauacagcggagggagcaggaagcagggcugguacccaaugauggagaauuucaaugaucuucuuaagggcucguauuuagagauguccugucauggcacuuagggacaaugcuucagccucaccaugugauggauagaaacagagaaggcucagagugagcgcuaugcuugcagccuugcaggaggcuagcccagauggaauguucuggaggcuagcccagauggaauguccugaaagaagaaacuugguugugagcaggaggaaggaggaagggauucagucgcugaagcaguagaugaugacaacauagagucucagagaacccaggggacucuucuaagggagguuuaggcacaguuaccaucguaaggaugguguguagggaguguggagugcagaaugcccaccuugggguauccuuggguugcugcuaaucucagugaacgaguucgguggacugggaacuguagcuauacagagcccacccauugcccuuugccuuuguugggucucuuugcuuuccacucguauaaucuaggcuucccuuauguagccauugguguagacucuggaucauauggggucugagucagaaaaaaaaagggacagaaaugagggcugagcagcgaauggggaucgagaacgcaauauuuuagcuacggcguuuauggauuucccucagaggccaaguguggggaaugcccagagagauugcauggccuccacaaaacguguaucaauaguacuucaucuuccugucagaggccccaguuuccugaguccuacuaugugcacacucagguugacuuggcagucuuuuaucauggcuuacaaaggcaacaaucuucuuaaggaagaaggcaggcucuggggaagaauuacaagccccacgcaggcacccaugucugcaguccagccuuggcccugcuagcucuguuuuuuuuuucccccaguccaacaggaucuaguuucuucuuucccaccagcaggguguguuuccagggugauuugcccaauaaauuagaaccgcaguggaguguguacaaaguaaccccgggaaaguagcuuccgaacucuacggggugggcgugggagggcuucccagcccugcaguggcugauuauucuuuuucccucuuaaaauagagucaaggcuuuugcuucugcccagugccagguauggcagcugucggggagguugguucuaaugagcucugugguuucuucuaggggaaggacauuuuuuuuccccacucauuuuuaauacuggaagggaagacacuuaucccccucauuuacaaagagaugaauuuuagcuugcagccacagugggggguuggggugggggaaggccagcagggagacagggggucaggagcaguuguguucagcuacauaaacagcagcaauuagugggucccuguaaaaggcagccaugcgcguuugcugucuggcaucucuuucucugggaauccgagcagcgcugaaauuaauuacgaagguggcaaagggauauuuucugcuuccuguuaaauaauucucauccacacaggggcacguuccagucggaugcguguacacacagguucuggggaaagaaggcaugaagccaauugauuuucaaaacuucccacugggucauguuauucaagccaguuuucagucacuuucuauggaauucuggcuggggcuggagaggcagagccccaaggccauugucauuuuuccuuuucuggcuucuuuaggggugugggagaacuucucuuuugcugauuuccugcggcaggucacccagauucuacuguguguaaugaaguuuacaagggcaccgcuaucaacuccuuaguuugcuuaggguucauaagaagccugggaugggccggguaaacagcccuggccuuugcuuucucaugguccaggccuuugcuuuaagucuagacgcagaggcuugguuucucccgaggccugccgucauccugcagauggcugucuccuugcguguccuuacauggccucccuuugacuguccugacagggauggcaaugugguaaagagacaucagugccccuccucucggugagcaggagauuuccacaaugguuuccuccacgcuggcgucucuccaggacucuuaggcugaggaaaagaaaaaucugcaagacugugccagccagaggggaagcuugccgcccagaaagagacuucucgcaucugacuguguaucagaccccaugaaggagagaccccgagcugagucagggauggcccagggaugggugggacaccucuggaccaggacagcuuugcaugucucuugaguuguauuuaaacccagcccucuuucaggaccucccggacgggcauggaguucacuuggaacucuuuauuucuuaacucuuuauuucuuccccugucuaauguggucaaaucgagucaaucucuuuccuguguucauuaugguucauuggccuaucgaggaugcugggcuagcuuguuagggcuaccaggacccaggcugggaccuuaacuguaacauuacuugugcccaugaccggugucucucucuuaugaacucauuagcguucuuggauugaagaucuacucuuuuaaccuugaguucccuucucccgaauguagucacaccggagacucagcccauacauuacucaaucuaaauaaguucgaguuuucagaauuuucucccuuuaaccaagugcacuuggauucauucauucauucauucauucauucacuugagugccuucuguguguggcaggauacuaagaauguggcaggaaaggaagggaccuucucuccuaggcuugcguggcucucucagagccugucugcagugagugccaauggcuugcagagguguuaagugccuuggaggugggaagauaggacagagguagggguucugagcccacaggcggccuugcuaagagggaacauuugcuccaagucuccugagguuugggagucaaggccccuggagcaguguuccuguguagccugaggaaaagcaggagucagucaguauggcagcugggggaggcaggacagauaggagugguugagguggggcugugcaggcaacauuagggcauuggcucuucuuggagaaguggggagucugcauucagguguauucacauggacccggugcucuugagaagguagcaggugacucagauaaaucuggggcauagaaagacuacuuggcugagauccacccaccuaccuaucccuccacccauccauccaucuauuuacccauccacuguccauccauccaucugcccauccauccaucuacccauccacuauccaugcaugcaugcgugcauccacccaucugcauacaaacaccuuuugucuacccacagcaucccuucauccaugcucacauuccagucuucccucauucuuaguucuugcugacuuuauuaagcacaaggaagccaaacacaauuucugccucugugaguguguguguguguguguguguguguguguauguggggguguauuucagucccucuuuuucucucucccugucccucccucaccucucucuguguguggcuuggaaguguugggaggagaguguaaccugagucugagaguggagugggagcugggagugaagugugugugggaggaauuuccaggccagggugagcggggaccagagcugaaggcaaggauaugaucagggcagugugacccagggcagugugguggggagggguggagggagggggacuuaggagguggagcuggcaggccuugaugauuaauuagggauggagaguuagggaugggagggagaguggagagagaaguagaggaggcugccaguuggaacagccuguggauacguggaagauacacagaggugacagacaguguugaguggccuuuggaugauccacacacagauggcugcaagcacauuaccgcucauaugaagcagagcagugcugucagccauagcuuguggacaucauuagaccuagggcaguagaggagggggacaugcacgucucuuaggugagaaaagugaccugagaccucagguccagagaccccgaggcucugguggaaggagaagcugggggugcugugccugggggaagggaauugggguccugaauuagguccuuaguguacuagggacuggacggggacaguugcagaaaauggaguuuguauugcaagggcuuccugccuccugcuuuuuaucuucucuugagcaaaacacaaaagccaugacaggagucuggcaacuguucugucaagggcucauuugucucuccagcaagcuagacacgggcggggcuuauaauuccuucuccauuauugaaaucaucgaggaaggcuugagaggcccaagccaccgggugguacacaauccgagguucugaagucucaugcccggcuuggaucccgaguguugccagugcugaaccuguguugcuuguggcaagcaaauugaggacaggagaggggcucugagcacugccucagucuuggugauucagcccuagguucuuguucuuacugugggggacccuggagugauaauguuugguggcccaucugucuguucgggcuccguaaagguaucccauagacuauguagcuuaaacaccacacauuuauuuucuugugguucuagaagguuaagauuggaagugcugacaagguuucaccucaggccugucucucucuuugcaguguccucccguggccuuuucuguauguaacuaagaaagagacacaccugaccuucuggucuguuuucguaugggcugguuagcgccccgccccugugacuggguuuuacuuguaaucuccucuuucaaagcccugucuccaaauacagucacacugaagcuauggccucaacuuaccuaaggaagaacaauucauuuuauaacaguugguaauuucaaaccacugcaaauaauucgaaccucucccuacacacaagcuugcgaagccgugacucagugauggcguauagucguuaccuggaacaguauccagugagcguucgugccgaaugccuguccauuacagcauggaauauuaauuucaguuuagcagauaauauccauuaagaaaccaaagugcuccgaacagaaagcuuuugggggcucauuuccaccuucaaaagaaaucuaguuguuagggccucuauucccugagcaguuagacccuuuauacauuacaauacaaaagugcuuugaaggccagaacccuggaaacccagccuccacugugaauuuuguaaaguguguguaugcuucugugauguugaaaggaguccauuuuccucucagccacacagaagacucauuuaacacccgaguuuccuauuuagggagucgguauaucauuguggaucuggcuuucagaaggaugagacuguccggaauccaggagaagggggugacuugaaaaugcuauuaacucuggucccguguagacagucucaaccaagucaguauuuaaagaugagagagguuaggcugguagacccgugccuugggacugaaaagcaauaauaccauugcggggaauucaaaacaccuggaggaggcucguguuucuugucugugggccacaacuguggguguuguuccauuggcugacuggagccaaaugcguucucacucucuacaggcugagccauuggaaggaacggaugggguggugacaaugacauaauguaaggaguauucacaaggugcagggcacaguacucugugcacugagggaccaccuggcuuagggagcuguggacuauugcuguacccacaugugaugccuguaucaucuuauuacuaauauauuacccccacccucaaauguacaacaaggccauugggguuccuuucugucacaggucccuuuucuccuguuuguggaacccaggagaguccuuuccuucuaucuuguccuggagagccacagggcccauuccaugcaaggcaaaaagccuuuuuguguuccuuuaggucuuccuguuuuaauuaauuaauuaaaucucaagggacuucucuuuuuuguagugagcucaucucgauauuuaaaugagguuucggccauuggcucuggguuuguuuggacagggaaagaggaagggcgguggggaguuacagucuuccuagcugcgcucuuucuuaggagugcagagccagguaauagauuugcuuccagccgcugugaguuaggccuguacacagcucugccacuuggcagcugggaauaugggguggccuuugaacauagauuccauuuuuaccuuuaacauuuuauuuuauguguauggcuguguggccugcagauaugccugugcaccacgugcaugccuggugccugcagaggccagaagaagguguccuauucucugggacuggaguagccccaaguggguuugugugcuacugugugggugcugagaaucaaacccggggccucggaagggcagccagcgcucuuaaucacagaaacaccucucuagucccgaaauagauacuuuugaaaaauucucagagccuuugcaacucagauccuugcuuucaaugaucucagagaagugguucucuugauauucucagggagacaugugggccuagauuguccccuguucaaccuucuccacaccucccaacauggaagaacuaaaaaccacacauguccccucauugggaguuccuacggagcauagccacagugcuaccccucaguggcuuuguagcaauagucuuggauacugguguccucucucccauggugcuaaaucugcuuauuuuacaguuuuuuuuugagacauuuuuuuucccucuaaaacucucuugccuaacacaguuuucucuuucaggcagagaccgguguccacguuggcuucuaccuggauggaaaggguguccgagacauuucacugcggauuacccgauuuccauccuagcaaaccccuggucucccuggguugaucacugauugccuuucccuuaauccccguucaguucccacuucaguuguuguacacacaguugauuaaauggcucuggguagucagaacggcgucccacguuuaagccuuaucacagcggaggcaaaauggagagaagacuuguuuuuuugaagaugcagaggaagcucaauaggcaacccucucuccccgagguagcuuuagcccuucgggauguucucacagggcugcugggugacucgaacggggaauaagacaucauaugcucgugauaugcgauguuaguuuccuuggguuacugugacaaauuaccgcugacuuggcuugaaacagcagguaaugauucuccauuaucugagauccaaaguccaaagucaacuucaucgguucuaaaugaagaagacaaugggaccauauucccucucgggacccuuggcuuggcuuuguucugcucucugguggcaaacuaaucgcgaucuccuuguucauguggccgccuucuucgucugaccuuuuucauucucuaaggccaccugugauggucuuuggaacucacuccauugacguaagggaaccuucccaucucaagauggagucaucauguccguagagacuccugucuuaauuagacaacauuuacagguuccagggcuugggagaggaaccaccauucuuugugacuccaguuuacacacuauccuuaccuuggaccuccgugaggcagcucaaggguggggcugaagggauggucccaggggaaguccugagaugcucccugcugugaguccucuggggugcucccugcugugaguccucugaggugcucccugcugugaguccucuggggugcucccugcugugaguccucuggggugcucccugcugugaguccucugaggugcucccugcugugaguccucugaggugcucccugcugugaguccucugaggugcucccugcugugaguccucugaggugcucccugcugugagucauaccauugcccuuuugaccccuuccaaggaguugagaaugauggagagggcuaggaaguguagacacucuuugacuuacguugguucaauuuaggaugauuugacaaaguggaccucgccauuuugcauuuggguuguuuccuuagcuggcaguauguggugcaguaccccugcuggccagcuuuggugaacgugaccauucguuuugacagcaugcuguacucuugagccaggaggaaugguguaugagugcaugcuguguauuuucuuuucuuucuuucuuuuuuaugguuuuucgagacaggguuucucuguguagcccuggcuguccuggaacucacuauguagaccaggcuggccucgaacucagaaauccgccugccucugccucccgugugcugggauuaaaggugugcgccaccaugcccggcacuguguauuuucuaucuaagguuuuggggcuaccuuggguuuaccaggauauagauccaugauacaaagaggagccuguaauggugaguguuagcugucgacuugauggaauucagaaucaccugagaggcugaccucugaccuugccugugggggauccuaugagcugucagggugagacugcaggaaggacaggagugagcugggugcaguuagaaggcagccuggccugaggcuggcaaggaggaugcauuugggucguuuccuuagauggcaguggagccuggaaagguacucuuaaagcuuguaucacguaaaguucccccucccccuccccugggaaguuauuagugccuuguugcugcuguaacaaagucucaguuccgggcacuggcagucugauaucaaagcaccagcaagaggucugucucucccgaggccccucuguuccucuccugguuucuagcaguugcucguguuccuuggcuuguggccccaucucucuaaaacccaccuucuucuguccuucucuguugagccacacaccaguuucccccugccuccacugcaaaagaacacuuuguaggguguguaggcccacucugguaccucaggucagauuucucaugacccuuaaccauguccucagagucucuuccaaaauaaagucauguugauaugauucagggauuagcacuuagugucuuuggauggucauuauucugcccaggauaagcaguuaaugagugaaauaaauuaucucaacaguaacugugugcaguuuuuucuuuuuucuuuuucuuuuuuuuuuuuuuucgagacagguuuucucuguauagcucuggcuguccuggaacucacuuuguagaccaggcuggccuccaacucagaaaucugccuaccucugccucccaagugcgccaccacgcccggcucgcaguuguuuuuuuuuuuuaaggucauaguuuuugcuagcuuuuuagacuaccauuuauuuguggcauuuucaagacuucauugccaaagggcuuuaaaacacucagacagacucaaucagaggcagcucucagcuauggcuuuucagcauccucccauccccaaaaagauagauuugucugucugucuauguaauagacauacggguauguacauacauagaugagugugcauaggaugcccauaugugcauaucugcauggagaucaacaguugaccauggcugucauucuuuagaucuuauccccuuuggguuuugagacaaggucucuuaguugcccggaacuugccacguaggcaagccugacuaaucagagagccccagggauccaucugucucucugcuuccccaucagugggauuacgagcaugcaccaccaugccuggcucgccccacccuacccacaaggguucuggagaaggaacccagguccucaauuuacaaagcacacacacacacacacacacacacacgcacacacacacacgcacacacgcacgcacgcacacacacgagucaggaagaaguacgcuugcugaagcuaugauguuaaccucuagaaugaguuugagaugaaccagagccaggauguaacuucugcuccagugggcugcuaggaaaguccuggccuggaagguaaggauaggacaggaaggugacgugcugugacguaagagcugagcaaaccuccugcaggguguguuccucuuguugguucccccaaggcccuugguuuguccuucacaucucugguuaaaggggauggaguuuccuauuaggagcaagcugguucugaggacgccauacuagacucagggcuucacagcugcuaugcccucuucagccaucucaguggcuaggagccucucagccacuaccguuuacaaugcagugugaggugcagcgggaacagacccugcauuggccacgagcaucuuaacaucugaccgagccuccgugugcuggaugugaaggagcguuggguggcucuuuguagccuucucuugaguuggucugucaggguucagggacauaaacgacagggagggcgacugaaggacuuaggauauuguagacccaucucugaccacacguuggagacaggcuguauccuagguaguucaugguggggccaaugagaaaaugugagugaaccccaaaacauuuuauccauaaaccagggcuacagccccuccacccagugucuagguggaguguagaccgaauucaggggaggccugggcaaaggucauggaguuguaagaacauugaugcuguaggccaggccaugugugaauggccagaguuuugcuaaguuaaauuugucuuuggcuuguacuuuuucucauuuucuucuuauuaauaguaucuuuguagcucaauugagguugaauugacagccacaguguguauguguuuauugugugccgugugguguuuugauagguguggauauugugaaaugauuuccacccucaggcucauuaagauuccgucacccuccucggagccguuccuguguggugagggugcggaaguccacaguguguuuccauuuaaccacagccaccuugauguucgugaggucucagguuuuaauuaucaggaacuaugucuagaagauacuaucugagccuuucaccgcaaacauuucuauuuauuuacgaacuuaccuugcaguuauguguagagcuguccugaugugaaauugugccagguacggaggagugaccgggaggccccugggugucugcugcacucagggacuccaagcucuguuccaaaguacccuucagagguagcaguucugagcacgagggaggcagugcauccgcagcucagaggaagaacgguagggagaugggaggaugaacuggcaugcuguuuacagcuggccacacugaagggaaccgaggaaguggagguaccccucaggaccuggagggggaagaggugacucucugaaggaaaagagagaucugaggguagugcagauaugcauggauagaauccucuuuucugccugucccccuucccauguuuaggacaaggacauguggaacguuugugggggauugaaaggugauuugccaggagccaccacuggaggcuggagacggucugaccccgauugcguaggucacagagcugcagagcugagguccagggagcuguaucugugggugguccuucccuagacccucugauuuugccuagaacugaagauggggguauaguguagccauuccugaagagugugugugugugugugugugugugugugugugugugugugaguauguguguguguguguguuggggcucagggucaccggaaggaaagcagcagguuccaugaacaagugacagaguccucacuuccagaagaaauugggaggggggugucucaucucugcacccucccuguggagagcuguuugacaaguuguccagguucagguuugccuaaguuaaucuuacuuuccuucuuuaauaaagaacuuuuuucuucugauguucugcuguuuguuuguuucuucauuugaugcuaucugauggaccuaguugauuuuauucaugguguggagauggaaggcacggccuugcaccucuuaggcaggagcugugcagcucagugagucccagcuucuaaguugcuucagacccaggucuccccugcugcagggaaagggcucuguauccccgggaguucuagagacuccccggggaauggccuuugucuaggugucugauaacagccacacuuucuguuucaaccuuagguagcuaucaaggucaucgauaagaaaagagccaagaaagacaccuacgucaccaaaaaccugcgucgagaggggcagauccagcagaugauccgacaccccaacaucacacagcuccuggacaucuuggagacagagaacagcuacuaccuggucauggagcuguguccugguggcaaccucaugcacaagaucuacgaaaagaaacgguuggaugaagccgaggcccgcagauacauccggcaacucaucucugcgguggaacaccugcaccgugcgggggugguucacaggugagagccaggcaugcgcagacccccgaaucuguacugagcagacaccccuagcaaggcuuagcaauugcaacuccauuuacaacgucaugguuuuguucugugaguuguuuugugaauuggauccaaagaguugaacuagagccagagcgccugggccugggucuugccucugcucuauaaugauucuuuguuuguggguaugucaugucaccccucuguacuccacucagucucuucaucugugaaaugggagugaagguacaugucucucuagugagcuaguguuaggcaagaacacuagaggugcuugguacagagugagugccaggcuaguguuagagcuguucuuaucauuuccaaaggaaguuaucuuagugucacuuccuguugcuauaauaaaaugucaugaccaaggcaacuuagaggagaaaggcucaaauuuuuaggauacauuuugucacaacggggccaucaaagguggcaagagcucgaagcagcuaaucauacuccuuucacaguggagagcagugagugcuugcagaguagugguuagcucacccugcccacacuuacacagccuagggaauggaaccgaccacagugggcugggucuucccaguagucaagauacucucucauugagacauuacucagaggguucuagauuaugucgaguugacaaagacaaaaugcauuguauaaugugugaaaauuucaaagaauaaacaaaaguaguguuuaaaaacaaaugguaacuguguagagcaaaacaaaacggagccacagagcucacgcaccacaagcaagggacgcauuacccaggugccucgcagugggugagguggcggcaugaaucgcucuugcucagagauuucauuguguacugucugaugguagcugcucuguaaaugcuuuguuuuguugagaggacucaccguucggauugugacccuaguccuuaaaaugaggggcguuuccuggaauccuaacaaacccugugaacaguaaugcagaucaagcuugcuuacaccagcuuguucuauuggggggagcgagguaagagcggugcuacuguugccgcugugcaagucuuugugcaaaaauaggcuuaaacuagauucccauucccccuuccucuucaagagaauacugagugcuugcgggcccuggcagaguauccaaguuugguucucagcacccacacugguuggcucacaaugccugcaaccuuagcuccggaggaccugaugcccucuacagccuuuauagacagggaacucauaugcacacauccucugcauugucucccacacauacacguaggugcauaauuaaaaauaaaaccuuaggcuggagagauggcucagccguuaagagcacugacugcucuuccagagguccugaguccaauucccagcaaccacaugguggcucacaaccaucuguaacgggaucugaugcccucuucuggugugugucugaagauagugacaguauacucauguacauaauaaauaaauaaauaauuuuaacagggugcugguuguggugccacauggaaggcagaggcagguagaucucuggaaauugaggccagccugguucauauucugaguuccaggccaaccaggaauacauagugagaccuugucucuaaaggaaaaacaaaacccaaacaaacaaaaacccaaacaaaacaagagacagagaaaaccucucuaauaaaugucuugguguuauuuauuuuuauuuuuauggaauuguaaguaauuacuauguuguugaaaaauugaagaucauucaacuuucauuuuaaaaagcaaaaucaagagguaaaaugugcauguauauauuuucacaugcacacgugugccuuuaaaagcauguuuagacacuguaaaacugagcugcgaaguccacaauguaaaacauacaauuuacuuguauuaaguguauucagaguccugcaaccaucccuacacccauuuuagauuaguccuuauuccucacccagcagccuuguuccuaugacagccauucggccuucuucccucccgccugucuucuguggauuugccuauucuagauauuucucagcaauggagccauaaauccauguuuccuuguugcuggcgucuuacgcagcauagcuuuucagaucccuccauguuagagcuuguauuaguuuucuucuucacagguaaguacuauuucagugaauggauauaacacagucuauuauucucuguaucugcuaauggacauuucgguugcuuccacuuuggggccauugugaauaauguucugacaagucucacagugaguuuuuuguggccacguguuuccaugucugcggauccccagagacuucuucuguacaggaguuagugggucacgucuuugcagaaacacguauuugcuuaacaugcaucuugaaugccaccucuuauguuucugaaagccauuccuuccugaccaguugaaggacuuaauaaacucuagugcuuccacuucccagguucaaggacggggcgguguccucccagggagauuggcucugugggaugcccugcucugucucuguugugugguaacccaggguuaccacaaagauguccuguugcuuaaggcuuuucugggcaggcuggggcucaccaccauccagucuuaucacuuccuguugagguaagaaucuacuccauacauguagccuuagucacacacuaucagguagccaugcuuguuagaacucuccacuuuuggucaguaaggaagggaauucguaacuuugccgugugugacacuguuucuggcuuguguguccugacacugugucauccccuggcugacaugaggaaaugaggucagaagggugcuaggcuccuuuuuuguuugacaggggcagagacaucaugacugaaucagcuuggguuacagacuccgugggucacagcagaaaauauaaccugggaggggggcuguaaggggugcaaguguuccaugggacuugguguuuuuuuucccaggguuccaugcuaucaaaaaaaagacaagugacaagcuucuuaggaucagaggacaacaaaggaaacuccugcagguccugugaggugcacaugagucucccccgcaggaaauucucaacagccccucuaaagcagucuuaacaaaauccaaucccucagugcaauuacugucagaaugucaaaggaaggaauuuaauaauguuuugauagcagagacaggaugcuuuaaaaaaaaaaaaccucucaucuguagcuuucuccuucuuccucucucucccucuccuuggaaauagcuuuauaauccaauacuggugagggcuccggucuuuuaaaguuaggaaaauagagagcagaaagauagacagacaaguauggcuugcuuuucucucugcaagugugugugagagcgugugcgugugcgugugcgugugugugagcaugugcauguuugugcaugugugugagagugugcaugugugugugugugagagagagcaugagcauguguuuguguguauguaugagcauguacauguauuugugagcauguguaagcgugugugugccugccuuuggggacacacauauaugcaggccagaguugacaguggcucuuuuucaguugcuuuuccaucuuauuuuugaggcagucucucacucagccuugaauuuacuacugagguuagacuguccagccuucuguuucuccuucugcagugauuacagacacgcgccucugugccugguuuuuauguggguauugggagccugaacucagaucuccaugcauguuagcaagcaugcuaguaacuaaguuauuuccucaggccucuggaagucauguuagaaugugucacccuacauggacgugggggauggguuguugagacaaccauuaaaauauuccuuauccuauauucacaggcgaccuuuauugaaguuguggcuuuugaaaacuccacagaaccgacuuuuaauguuuuuuuauuuaggggccaucggcauauuuuugccugucacuucuuugguccccccuuuacccuagugguguagaauucucuuuuucaugugcuuguggaggaguaaaguucauaaauuauucugagguuagaguuuucaaacgagcgagagaaguuagcauuucagagaaggcuuggagucucugguggaaagacuugugagcgaauagauugaaccaugcaacgcaucggaagggaugccgcuggcgguguagacucugggcucuugguucuugaguugcaggaugccuuaagcucucaggguuccgaagauucggguuggguccucauauugagcuucacccucugagacauugcccuacccccggauuguuuucuuccccgccucuaaaaugcuaucccagcaggaugccagcaucagacaauuugccuguuccaacagagcuugacucuuaacuugaacccucaagaacccugugagacucaucuggucauucaaaguaacagauuccaaucaaagucuauagacacugcauuccagaguacuaucacaccgcugucccuaagcaggaagagacaagacacaggccugccugcaggaccagaagaaagggcuccaugaucaaaggagagcugcagcgggugcuuagacaaguguuaacaccucccugcccaggaccuugacccuccucauucaucaaugggagagguguccccccuacugagggggaaggcugcgggaaagagaggcucuuuguucuccugagguugacaagaggcaggcaccaccugggcagguugcgcaaauccuuuuaacuuuuaggagauguuucucagcagaggaaagggguaggcaagcgagaggugaaauucugucuguucccauccaggaacugcaggggaucccagggccuucuguaacaagcaaauaucugucugcagcuacuggcuggagcagagaguguguguguguguguguguguuuguguguguguguaugcuggauuugaaaaacagagucgcaaaugguccaucuugccaaaacuggaaguauaugcccucugugaauugacacguacgcucagcagccuggacucagauucuccaaaccaccacucucuauacugucuccauugcuuagaaccuacaaugggcgagggcucagacuuccugcuucuuugccagucugcucuauaaagauauuagaucacuugugugggauccggucaguugaccucaauagggcugaguuuguagggaguguuaguccuacucugugaugagcucugguugcucauggucaccacuguccuuagcugguugcugcccucaccaucuuucucuguucccaauucaaguuaacccuucaggucaggcaccgugguucuguacacgcaaagcaacugucugcuuccuacacucacgguucugaguacuuucugccuggucuccgucuucuguccagacuaucagaccugagcucuaagauaacggauguuguuccaggggucugggaaggaaaauggaaugaauucaacuaugaucagcuuucugcauugggguggaacucuuaggggagcagucccaaguucuuucuggaauauuccagucuccccuggauuucaggugggaguuucuugguuuuuuguuuguuuguuuuuuguuuuucgagacaggguuucucuguauagcccuggcuguccuggaacucucuguagaucaggcuggccucgaacucagaaauccgccugccucugccucccagugcugggauuaaaggcaugcaccaccaugcccggcccuagugugacuuuuuaacuuuaucuuuguuauuauuuuuuaagcugguuagcaacuugcuuguggaauauuagaggaaauaaaauucucauuuaaggcccgugucuuaccaccaugccgucuugcaaauaaucaaauuuacaaaugccuuggucuuagugccauacuuuuaaagguaagaccuaacacaagaagacuccagcucacugcaaagugccuguugccuuggggagcuggaagcuucccucacucuuagucuccgcuuauuacugaaauacacccauggcucugcccacaggacaaaccuucucccccagacuuuaccuuccugaaguugcucuagccucacccacuggauugcaucccucugacauuugcuugagagggucacgcccuucaugcugaucauucaugccaaauuguuuauccguugucuuuucugaagccgucccucuuccacauuaucauauguauguguguguguguacauguguaugaguguguguguacaugcauguauguaguguguguguguaguauguguagauauguauauagauaaggagguagguaugugcugggcauggaacccugcucauaguccccaaaucuucaagaugacccauguaauauuagaauuugcaaggugacuaucuacuccagcuuccgguuuuuauaacugguacggcuagcauccucaggacuaccguauuuccaacuccacuaauggccuugacuaggagucucucggaguugcaggcaguugugaggcuccuuacgugggugcugggaacagaucaagguccucugcaagaguggcauguguucuucaccucugagccauccuuucuccagcccugaaggaugcuguuugucuuuuguuuucuuuuaagggaagaauaaaaagcucaggagcucgacugccuugcucagcaagugugucagcgagagcaagcaugugagccuaaccccgccucacucauuuucuagaucaucucauuuguugccugucugcucagcccccagcucuggggaggcgcuguucuucugucucagguuccccucacugcucuugaauuuggccgugucagcaauuugcacugcuucucuucacuuucauuuagggucucaucccugaguagcuccuggccuuucuccugaauuucuaucacucacuguaggccucaacuuuguuacaggcucagucugcugagggucaggagcgagaucuuccuuucuucuuaucccaggauccuggaagcaucucucugucucugucucucucucucacacacacaacacacacauacacacagugcgcacgcaugcaaucacaacuauucuguccgcguggccguguacacgaucucauguacaugcaugcaugugaugcagucacacuuuuguauacugugacacacacaugugugugcauguguacccaugcaugcauguuuucuuccacaggcaugcacacacguacauggaauacugucauguauguguaugugcacuuacuaaguaaggcacacaagcacacaguggccacaugcaugcucaccuccacaccugcucgcccucugcagcacccuucccguguguccccuuguuucucgagaucuguauuauugucugcauccaaucaguagccgaugucuaugacaacaggaguccuuucuggcucuuuccucugucacacuucucuguccaggaaggcauuagcagggcuuccuuaucgccagaccucccaaauucaaggugacuaucuuuaccagaaauuuccaggagaguugagguggguggaaaaaaaccuuggccugagcucgcucucucucucucccucucccucucccucucucucucucucucucucucucucucucucuuuuugagacaggguuucucugucuagcccuggcuguccuggaacucacuuuguagaccaggcuggccuugaacucagaaauccgccugccucugccuuccaagugcugggauuaaaggugugcgccaccacgccuggcuauggcauaagcuuuaaaugguuaggaauggcuuauucuuugggaaggaccuaggacaaagggcccguuggcaggugaggcuuccugugaguccacugugcaucucugugaaccccaccaaacacucacuucagcaugaggcauggccuguggcuguuucuccucggagcugaccaaucagcagacggguccaagggccuuuuguucgccuaugugucugucugaaggccuccuccauggcuuuccuugagccuugacaaaaggcagcuuuggcagcagcuuuucauuacugcucuuugucguucugaagacuccgcugcccuccagcccugucccggaaacccaucuccggcuuccccugguauaacagccugcuccgcccuccaucuuguuuuuccuaagcacgcccacccugcuuaguacaaaagguuuccaugacucuuuccuuuuaaacgguguggugcuuugauggguauaugcggugugugaaugaaggugugugaagguccaaucaggguaauuagcaaccaucauuucagacguccuuuccguguggggagaagauucuaaaacuggccuucuagcuguuuuucaguccacauuagauugucaucaacuguagccugccucguucuaccuguaccgcucucagcccuccuuccccauuuucccagauucuggcaaccacuguucugccuccuacuuagagagagccuccucuucuuuugcauccacaaauggcugggaacgcacgguauuucucuucccguguucggcuuauuucacuuaacgcgcuucccgugguuacguauccacaggaaaaauaaugagcagucaaucaccugcacugccgagguguccaucaaaggugacggacaaaacaauguggcacauacccaguggcacucuguucgacagacguuuguggcaaugcggcugaguggggacacaugaaucgaaauaagccuuccuccucuucgaaguccuguagcccagaaaaagugacuuccgugagcuagccucagacucgccggccaugaggaaaugaaccuguugauguuuuauuaauguuguaagguggagaaaggucccucauuucccucugguuaaaaaacgaugauuccagucgaggaccacuaacacguaaccaagccauucuuuaccugucugcugcuggagccucucuucccacggggugaagcuggcauauaacacagccuggcauuccaaucuugugaugggucuagacgaggggccacgcuugcauuugggccauaggagucugacgaagcuggguuuuucuggacaauggcgguaauuuuuaaaagguauauuaugacacaaaugcaaaaaaaaaaaaaaaccuuaugaauaaauuuaccccccuuuuugugcucaagaauacgccuugauucugugauuucucaggaucauuuguggccucugugggcauggcugagcagcuggacgguauuugaguggcccauuguucagaagcaacuuggauaauaaugucagguaauggaggcugcgccucagcgaacaccugagggaggccuagcguguucuuaacacauaagcauaaaggcuucuuugagaagauuguugauuuaguuuguagaaaaauugcacagaaaccccaaagucuccauucacuuucccuucccuuccccucuguccccucaccuguccuccccucccuccccucccgugcccuucccuuuccuucccucccucucuccccucaccuguucugucuucuuacagaucucagguacccauggcgcccauguuuuaguuggggaacucgugugcagacaucagcauuaaccaaaggcuguggcugacauuaggguucacggcagcguaauuucuguggccccugucaauucugugauguccuggacaccgcagcauagcuccuuaaagagccauuugacuaccagcuaaucccucacaucccaucucccagauacuccagccucuaauaugaaaugaccuaucuaguguuugcauagaaccuuggacgucucuagauuacuuauaauaauagcuaaaccaaugcaaauaccaugcuaauguuacacugccccaccaagggcaaggaaaggcucugugcacucugcauaggaaaucuuucucccuguauauuuuugagcuaagcccggagaccuugugaauacagaggacuugcaguagccagguaaaaacaucugaacacuggacauuaagucaggggaguuaguaugugcuuauaaccccacccuuggguagcugaggcaggagcauugccagaaguuuaaggucagacugaacuacauagcaagacaccuucuuaccccaccccacacccccuacuucacuccaucucaaagaagaagauaaaaacuuccuccaaauuuggacaugggacccuuugacucaagaguccucaggaaaagcauuccagaaaggguuaaugcuuuugccaccuuggcaaucaaaaucacucagcacagagggacuucaucuccccacuguuggccuccggccauccugguagugaaacugguguuaacuggcauucucuaggaagcugaacaaucuggaugggcccccuagcuaacgaggucuguucuauccacgucuccuggggaccggacuuggucacuuggggaagaguacuggaugggaaggcagucaggauuuuauucuccgcuuacugaauaauuauauuuuauacgccucuagguuuuauuaacuuuccauggguuuugcuuuauuguuuguuuuuguuuucuuuuguaguguuucuuuucugcacucgcccuaauuguugcuguuccuucucuaggcauucauggccccagaguuacucagccuugguucauuauucguaacaauuacuuucuuuuuaccuuuugacucuuuaagcuggcuuucugcacaauauuaguucugaacauuuuuccccccuuuaauguccgacugugacuuccauuaggcaaggaggcuuaauuucauuugaagcaaaccguggcuuugccuuagacugaaauagugcugcugcccugcggugcugccgugaggucugcuuccaccgaaucacacuucgggcuguucucggacacuguugugccuuugccugccgguuggaauuaccguaaaugcuugaguaaauguuagacguauguaaagucuuaauuaucuccaggaaagaaaccaucccuugcagagucucugcaaaucucuuaucacaggggcacaguggaacccaacacucagagucaccgaugacgccugggcucuaguggucauccuaggaaucugguagaaaggaagaugaagaccaggggaaggacauucgucacaacuucaagaagaauggcuuccaguugggacgcuugagagacagcauugaaagugguuaauuuauggagauuuuaaauggugcuuaaggguuagcauuucaagccaguauuaacacacacagauacauuuauuacaguguuggccaguguuguagcucaguaggugagugcuugccagagagugcgaggacccaggcugggaugugaguagugugaaaaaggaaagcaagggguuccauuuuuaacaucgacuucaggaaggguuagcuaccaugcugacccagggaagcccugauucugccuugacgaaugguagugaaacuguuucaugaaaugugagguaugugugugugcaaaauaauucuaaaguuagggcuggaugugguagcacacauuuuuacuccuagaauuuggguagcagaggcugacagaucucagaguuuuaggccagaguggucuacauacagaauaguguccucagcuagccagagcuacacaguggguugugugaauguuuuaguguauccucuuuuguucuuguggugucugggcuacuugaauccaaggcuucaugcaacuuuucagucugaugugauauugcaacuuuaaagcuaaauaguagccagagagacugcauagcuccauccuguuccugagaauucacauacagguuuucuaaaauccugacucaaaggggcgagacccaccagugggaguguggguggggcugcaugacaucuagggugacuuaguauuuggauaugugugaugcuguuaagaaguaguuucaaguggauugugcauuguuccacuggaguugaagcuauaccguauuuuuucccagccguguaugcauucagaggauaguguauguguguguguguguguguguguguaaacauacauacauacauacauacauacauauacauacauacacacauauauauauguauuguauuuauuuacuuaucuaucuaucuaucuaucuaucuaucuaucuaucuaucuaucuaucuaucuaucuucucugccuggauguuuacacacccuucauccacaugucaggccccgggggcucuccacagccuucugguuuugaguccacuggacauuuucccucccauuugacucccugauucuuccccgucugaaacccagccucggcuguucuaaagaagcuuucuuccagcugcuucuugcccaguccugcugcgaauggcuguccuccucggggagccugugcacacugguuugauuugauuugauuuuuuuuuuuccuccagguuuuccgcccugucccuggauagucucacgucuuucuugaacgucaucucuuucucauacugaguugagaauugguugcuggcaggacagguuuggacgcaagcuuggcugccuaguguugcuuuaugcucaaguuuguuaccaguguuuaaaaauggugaccaaauggagacuccuggcuuuucuugcaaauggacaggcuggcagcacuggaacugggcuguaagcaacuguccccucccagugggacaucacugcccuguuugaggauauucaucuguuuauggaccucuguguaagguaucagcugccauuuuuguuucguuauuacauuucaaguuccccauaucagcccuucugauuucucuauuccuacguagggaaauuaaauccgggccaguccuagcagacaguaaauacauaaauguguaugcauagguacauuauggagaagcacuauuaaaaauaaguuuuuaaauucuauguguaugaggauuuugccugcgggcaaucaccuagcauucggaggccaggagaaggugucagagcucucagaacugcuaucuggaacaguugugaguccuagaagccacguggaugcugggaacggaaccuggcuccucugcgggagcagcaagugcucuucgcugcugagccaucucuccggcuccuagaaacauauucuuaguuagcauucaguguaugucagaguugagagugaaacuuaagauuccagaauucaugugcugacugagaugguuuugagauggcucguguguauacuuucguuguacaaaugcagauucugccucugaaacccagaugguucucuuugguuuaauuuuguuguuguuuuaguuaguuugguuguuugguuguguguguguguuguuguuguuguuguuguuuguagugcuggggguuguaucuggggcguuaugcacauuaggcagccaccacggcucuagagcccagauaaucuguuugguaaucuagcuucucucugugauaguuacucgcucaccugcaauacucaaggauuccuuggugcaacggagaggaagacaggcccguucccuggaggagcgcacagucagcuagcacagugcucaagggucccgcucggacaucugacucuacuugcucuuggucuccacuguccaugagggauaucgccuacugucagaggaacuccgcauuccaucugcaaacucaauucccuuucuucgugucagguuaacauucaggcacaccaccagggauuaggaggccaacaucuguggaauccauuauuccaccugugauaacaucugcuugcuaaauagaugaaaauguuaucaucugccaacgugccgugacaguuccucugaaagggaggcccacggaggcuguggaaaggauuaauuaaaucugcuuucauuuuuuuauugauuuuauuuuauacuuacuuuauuggugugagguagggcgggguggaccguagcacacgugugaaggacagcccgcaggaguuguccgauugcuccuuccaccauguggguacuggggauugaacucagguggucagacuuggcugcaagugccuuugccugcucagcccucuugccuuguuuuguuuaagcgcuuccucagauccacgggugacggggauugcugcuguucacgcugucacagacccuggccuuucuguucuuugauucucagacagcaccuguguggcauguuguauccccacuuuuuauuucuucuguuguuuaugcuuaccuuucagaggugagguucacuucuggagacugcucccugccuucucugcccucgcuacacuuugugcuccccggaaucuuuuagcuuuuauagucgauggcaauuaguuauguccugccuuauggaugcuuacucgaugacaagguuucagcagaagggguugggguggguugaaaggggcugcaagaauuuucacuccuuuucaggagcgagaugacguucugcucuuucaaaugcuuaucugaaauaugugguuuuguuuauuucagagacuugaagauagagaauuugcuacuagaugaagacaauaauaucaagcugauugguaugacuuuuuuuuuuuaaaagcaagauuaaguguuguguugucaguuauuaacuuugaaaguugcccgugaucuaugucuaauccucauacaagauuuuucuacaucaucccuuguucuucucauguuuaauuauaguuuuaguaaugaaaguuaauuuuuaaggugauuuaauaauuuauuuaaauaauaaauugaaaauaucaggaagacaaaaauaguaucauuugauuguggaaugaguuuuauaguuccagguaaauauuuguuggucacauaugucuuugaacuuuuaaugaucucuucuaugugugugugguagauguuugacgugugugugugugugugugugugugugugugcgugugcgcgcgugugcaugagugcguauguguaccuguguguggucauggaggguggagaucaguaucggcugucuuccucagucacucuucaguuuauuuuugaaaaaggaucucaccaaacacaggacuaacccagcugauuaggcuguguggccagggagcaccagggagcaccagggagcaccaggaagcaucuaguaacacaugugccaccaugaccagcuguuugcuuggauguugggaauccaagcuuagguucucaugcucucacggcagacgcuuaccaacugagcuacccuccaagcuccucaaacugugacuucaaaugguuccuaccgacagaccuuccugccugccucccccccuccuuccugcccucucucccccucccuagauuuuuuuguuuuuguuuuuaaguaucugugugcugccugcauguauacuuguccaucguguuugugccuggugcccacggaggccuuaagagggcauuggauucccuggaacugaaguuacagauguugugagccaccauauggguucugggaauugaacccgaguccucugcaagagcaguuggugcucuuaacuccuggcacucucagcuuuguagaaguuuuguuguuguugguuuuuuuuuuguuuguuuguuuguuuguuuuaguuuugguuuuuuuuuuuugcuguuguuuuuguuuuuuguuuuuaauaugaauuaacaagaaaauguauuauuacuaguagaaaauaguuuggcucagaaaugcugccugaaucuuauucugcuuuucuguguaucugagaaagccccaaacaaggaaaaaugcaaccugccuucccuuuuuacuauaaucuuacccacacguagugguugaagagggguagggggcuguggagagaggugcccggagagggaugacucgacucccgauucacugaaggaaggcggcaggguacacaggagugauuagaaggcgugaucggucccuaauucaggaucuuaaguaaauaccccgacuguuuuggaagaacuggguuauuuuugcugaugauauuguguguguguguguguguguguguguguguguaugugugugugugugugugugugcguuguguguguguguguguguguguguguguguguguguguguguguguguguguguguguaugugugugugugugugugugugugugugugugugugugugugugugcguguguguguuuguguguguguguguguguguguguguauguguguguauguguguguguguguguguaugugugugugguguguguguguguauguguauguguguguguguguguauguguguguguguauguguguguguguguguguauguguauguguguguguguauguguauguguguguguguguguguguguguauguguguguguguguguguguauguguguguauguguguguguguguauguguguguguguguguguguguauguguguguguguguauguguguguaugugugugugugugugugugugugugugugugcgcacacgcacacgcgcacucuuggcugucaauuucaccaugccccagccgcgaggcagccagcaccguauuucuauuuccuuucauuuccuacuucaaaugcaaguaauuuccucugccuagaugguuugaaaagacccauuggcaucuugaaucuaacucaguucccaguaagggauagacugcagggacuccagcccauuuccccgggagauucggagucuugacagcuguugauggauuuacccauuaguggaaaauuaacaguuaugaggaaaccaaucuuccccacccuacacaggcccuuuaaggacccuauuuuuagcagauucuuagaccagaccagugauuuucuuuuuuguuagauugcuucacuguugcacuauggcuguccugagauacagcaguguacagaggaggcccugcugaaaggucugcaggaucucuuucuagcccagcucucugggaucucuggccuuuuacaaaagagcccccagaggguaagagguagaaggaagccaucccacccauucauggcuaaugcaugaguugucuuugggaaaugcagaggugacaguguccguugccuuaacagcagagauucugagagaacaagcuugucaagggcgggcucaugucacagugacagguccaagaguucauuccaucugguagccaaggccgccuguggagcguuuccaggcccugucaggccacuguccacaguuucuuccccucacucucugccucagcaccuuuucucuccuucugucaagcgguagcccuagauaaccacuugcaaaucuguccuguuguacaagcaaggcugcuacaagagacagaucuccgcaucggugagagccuuucacagaagaacugauaaugguuucaauaggccagacaucccccaaaggcugcacccacagugcugaggaccacucagugacauagcaggugcuuauaugaguagccagagauacccaaacaagcuuuaugagaagagacauacaccgcagucugaagggacuacauaccuaagcuagcgccuggaauucucaucucaggaaguguggcgauugcuuuuuagaccaggaaccuuccuuggguucucaccucuuggcugguaaccaugggguuaacaucuaacuaaccaaguauuucaagucuucaagacuguaaaaaagacaaauuacaacuaguuauucagaucaaauuugccuaugagguuuucuagcagugggcugcaguccugaccaugguugggaagguccuaccccacccuguuuguggcgaaaguaaaggaaaugauguacacacagcagaagcaaggcacagagaacccaauugauuauaguccacaggggccuuccaugagcaugggacagcuugcgaugugcagaaaccccgcuacuuauuguaagaguagauuacagucuguucaccugucacggugggugauuguucaccaugccuggaaaggucuucaguccaaacuuaaaacauauggaaacaucuugggccaaacuuaauuugauaguauaaggugggcaaagccuauugggaaaugacuuggugucagaggaaggaggcucuggucuuugaguuucuguuaguuucuucuuucucucaccucccaaugaccuaaacaauaccauaaauguauagccuagaagauaacaagguguuucauucagccugcuucccaauaguacuauaaaucaaagauacauuguauagccuagaagguauccagugguuuguucauccuacuuuccaggaguugaggggaagaagccaguuucuuacggguuuucuugccucuaggauggguagugaggaucaaagguaaagacuaagccuuauuauuacaauguuaacuugaaagcccuuugaaccucucuucuucaaacgauuucuuuaggugguuuucaaagaggauuagagcuauugccauuucuuaaugguuucccuguuucugaaaccauuugguuuaaauaaacuugggccaguguuucaacuuagcuagaguuaucaggaguaagauuuuugauucgaucauauauuuuucuucuuacaaaaagaagagaggaagaggcaggcaaaagcgaaggcagccugaaugucuggguacgcucucucacccacagggauagcuagagcugagaagagcugugaagucaccggggucuucuucugagacugcguuuugcagcacucagaaaaucgagugauaauuagcuuauguauuuacuaaaucuaauugaggccaagcuaucugauguuaccgggaggcagauuucucuccagucccccccucuucuaauuauaggcauauguguaaaacuuuaauaaccauaauuaugaaugugaaauauucugccuuuuaaaaucgaguguucuuggccaagauggugagaacuuuaaaugcaggcucugagcccuccugcuucccaaauccugcacgauuuuaucuccuugaaacaugcucuuaagauaaggccaggcucuauucccuagcuugccugggacagcagagggugagcuggccucuuaucuugcccuucuugauagaccagaugcaggggaagggaggaggugaucugagagaggcugcccuucgcugucacagagcccccguugaccccaggaaugggaucuuugccuuuaaucuuggaaacuuagaaaugcguuuucugggacugcuuucagauuugggccucuaauagacaacuuuccuuaaaacuuugacucuuucaugguagauguucuuacagaggccuauuagcccuauggcuccucucuuccuccccugcucuugugccucaguauauacacugggaucugggaacagggccccucaccguugccuguucagaugggagcccaccugucaucuguagcugcagaaaggcuuuucugugcagauuuuaugguguccuguggggcaaacuggaccaaagggaaaggaaaugggcagggguuagagggugaaggcauggagucaggaggagggaccaguggugggugggaaauacaaucaaaacaaaugaagaaaaguucaguguuggaauagacuuccugcugguccuuuggucagauccuucauguaggcucugauucuuccucgggagccugaguugagggcuugguguucuuuggagccugagagaguugcuggguucucucuggacaagccauucaguuauacagaucacugcaacacuuguuaagaagcuuucuagccucguccuugugaccuguggcauguggguugcuucccacccuccugugccuuuugucauuuccugagcuuucuccauggcuucuguggugggcaggcacuugcgggugaagacaugcuagagucaagcaaaaggcagaaauacugucgguagcgcuguugcagaauguacagggcucagguccagccucagagccaaucucugccuuacccugaagcuugggagucuuaugucugugcauuaagagcucaguauuugcaguggaguucaaaggaugacccaggaucucagcucuuaauucugagaucaacaaagauugaagaaagauaggaggggagggacggacacuaacagcucucuaauuacccucuaguugcaguaucuuuaaagaucaaaaguaaagaguucacaaaacucuaauagacccaaaggagcugugaggcacuuuggggcucuccugcuggccucccagaugccuuucuaaucuaagaaaagcaacgccaugaggucacauagucugguuggcaucaccgaccugcugggcguucuuucuccagccaacaugcggggcugcuuaaacuguguuuccaccccuccagcccuuuccaacuauaguaacccucuggaaggaauuucuuaaggacuuuaaugaaaugaaaccgagaugaagaagucagcuguaagcggucacuggugccgauggccuagccggagaaaaucagucuccauucaguuucucccagccuggccaccaggcagccaggaucucagcgugcucucccuucccgcuucaguccuagaaagcuaacacucucuccuuacccugcaugacucauuuacaagacucgguagaaauauguuuuggcucaucacacuguuaggucuagcuggauucugcagugaguugauguaaaauguuccaccgaagccagggagcgagggagccgccaccgggcacgccuuugucuugagaagucuaucagagguuaugguuugcagcugguggguuuccugcuggauguuaaauuauguguuagacugagacaauguuuccuuuccugcucuggguuguuuuucuucuucucuccugguuuuuuuuuuuucccuugcaauuuucuaacucagaguucauguuuguguucucuuugcagacuuuggcuugagcaacugugcagggauccuagguuacucggauccauucagcacacaguguggcagcccugccuaugcugcgccagaacugcuugccaggaagaaauauggccccaaaauugaugucuggucaaugugaguuauccagauuguaaaagugggucgcuguucccuccugcgguccuaugucccuuuucugugaaacagucucucacuaucugacaagaauguaccuauaugccaugggauaugucauccgugguucucagagcccagcaucccuuuuucuuuccagauuuuuucuuuauaaacuuccaaaauggcauuugcaaacauuuuauugaggagcugggaaaagcggaaaacccaggcaagucuucacagaccuugcguugauguuccgcaaaccacauguucuuauguaaaacuuuuucauaaagccagaucuuggggugcagggcugaagucgcagcugccugggaggccgagggaggaggagcucaaguucaagcccugccuggccuacagagugaguuuaaggcccugggcaacugagugagacucugccucaaaucaaaaggagaaaauggguagaagugcagcuaggggcaaaccguggccgagcgagcacagggcaggcucuggguucaauggccugcaccacagaaccaagccaaacaaacacgugugaacauguauaugcacauacguauaccacgacauacauauaccauauaggcuugugugagcacauguacacacacacacagcaaaacaaaacaacaggcauguggauguacauccacacaucugcacacguuacauacauacacacucauacacacuauacaccacacacauaccacaugcacacacccccaguauacaugcauacagcauauauauagacacagaccacauagacaugcaucacacacgccauguaaacagacacacagcacacauacaccgcccccccccuacacacacacacacacucuaacaaacacacccuaccauagcuuuguaagcaugagcuuuaagucugucugaugcugcccaccucuuuguaccugccugguccccacccuccacuuggcucuucuccuguguuccuacccauguuaacuugcuggaaugcuaguccaucucucauuccagucuggcacccagucuuuacuccaagagcuccuuguggacucugcauguuucccccugaggaucccugugcccgagcagucuucaccuccgagugacaguuugcuccugaguccagcucuuaagggagcauaugguauuguguugcuccaggugucaacauggcgagaugaagcgggaaucuccugaguguagaaaguacguagaggagggugucaggcucuucugucaccucuucggacacagaagccagucgguuauccauguggagacgaaagcacuggcugagaggaguugaacuuaguuuucuccccuuugccaaguuguuuagccagggagaggaauucauauccagcaaccguugacacuuugucucucagugcugugaccaagacacaggguccugcucccaagggaagguucucuccaguucccuuugcccauggccaccaacucucugucugucaagaagcagggacucugugucugucugggguagugguggcaggugacacuggggaagaagaaaggcgaugauguugggccacgaugccuggauagauccggagcuguugucugcggcuggcaaaugucauccuucacucuucuacacugguagacgggucucuccuggggucccucaacaucuguauuaguguccccuugauggaauuauucucucuacgaagauaaugcacacuguaggcacucgcaagaucucuacaaggccaggugacccuucucagagguugcuggcagggagacccuggagcagaacauguaauguggagaaucucacucaugcuaggggagaagaauccccaggagcaagagggcaaguugcaguacccaagacucugcugagugcuucugugucuuuuuugcuggggccagaagagagaucuccuuuccugccauuggugguagagccggcuacugugacucacuugcccacuucuaagaacugaauugugucacacaguccccagcugauauuuugaaguccuagccccccaccccccaugucaagguauuuggcgcugggccuuugggagguguuggcuuuggaugaagugacgugguggggcccaugaugcaguuaggguccuuauaagagacacaaagcuuguguugucugggugcuaugaggucacaagacaagggcagcccugucccaucuaggaaguagacucucaccagaacccagcuuugcucgaucuuaaucuuggacuuucauucucuagaacugugagacgcuguguauuauuugaguuucccguucuguggcauuuugcucugguuagccaguuuucuguggucauaacguaacaucugaagugauuugcuccugauacagguuuguuuugacuaauaccucugaagguuccagucugugacugauuggccucauugauuggggucuuuggugaggcacaggguugaggaugccaugaauaugugacagggcagaacugcuaaaguuacaagccagaggacaaagccugaccgucccuuccagagcaugcuuaggaauuuccaguagacccuacuccugaagaguacuaauaaugccauccugggaacuaugccuuuaaaagcacaugaaccuuugguggagacagcauugacauagacugggcugaccaagacacauaccuaccuacaaguccccuauagacaggcagaggcaugugugugcacagaacugugugcaugaaacaccucaggaggugugugcaugaaaacgagaaagcaguggagggggcccuuaaccugcucccaagagcugagcaaagcuggccggguaggaagaggcggggaaagucccgggcagaguguaccaugcaucugaucacugccaacucuuaaggucuuggugaaaacaugaaaccucagagccuccuuuauacaaugaauuuuccacucccuuagaguccugugccugaagccugggauuagguuucugugugguacccauggcuuuguugacagcacugagaaauggaaacccaaagagaauucaauucaaggcuugcuuacaccaagaguggaaguggagcccacuuccucccuguuccaguaccacuauuacgaaaugccuccuuucuuauugcugugaaacauacacacuucugaagucaaaagcaggcuccccucugcaggggcuugugagccugcuggguggcaggggcuaacuagcugacgagucugaggcgagugaggaggaaaccccagcuucuuccacaggaaggccuggagaacucuugagacagccuggagugcuggagcaucuggugaugcuccaccucugguaaugugagcauuaucuacgggaagggagauggcgucuuguggugguccucauuuucaaugguguuauuuucaggaccauacaaauuacccuuaauaucccguucaccuuuuuccuucaccucacuuuuuuaugcgcacgugcuugagcacaaaugcacacaaacacacacacacacacacacacacacacacacacacacacacacacacaugcagguacacacucauucauucuauuccucccucuccuucuccccucuucucuuccuucuuccucccccuuccagugaacuuugagauuuuagacacaaaacuggaauguucauucuggcgcaucaucagauauuuacuaucauuucuugacuuuucccucagaguggcauauguucuaauuugagaauaacuuuaauguagauguacuuuuuuuuucccucaggccugccucugccucccaaguuccgggauuaaaggcaugcgcugccgccgccgcugccaguggcggccacuaccaccaccaccaccaggcucagaucuacuuuuuuguuuuguuuuuguuuuuauuugauuuuuuuugagacaagagucucucuauguagcccuggcuguccuggaacucacuguaucaacaaggcaggucuuaacucagggaccugucugccucugccucccgagcacuggcauuaaaggugugcaccaccaccaccuggcaccagaugaacuuuuugaucgaguauaacuuaacuuugagaauauuaugaugcuuguuggaaaaacucagugagccucuaagggggggggggggaagacaucaggagucuuguccccgagaaugggagggggcaggguucucaguuggucacuguggcugugaaaauuagcugucucauguacuuaugcauaguccaugggccuucuugagcuuccugccccuuccuucacaggagaggggcccugccuuucccugagccuuugaguggauaaguuggguaagaggcaacucgcucucaucucucuacagaaaagagugcucaggaagagagugacaaacuuugagccagguccuaggcucugcauuuacagaaaugauaccagaugccauucccugcaggcaggggucacacacagaaggguuuucucuguucaugauaaaagaugguggggaaaggggcaggaggacaucuguauucaucuggggaaacugagguacuucuacuuuuaaaagagaaaaucagcgccugcugggugguaccugccucuuagcucgggaugcaggaugcuggggcggagggugauacauuugaaguuauccugggcuacacagugaaacuuugucucaaaaauggagcuuucuucagcuuuggggcuuaaguuaauaaaauacaagucauuuccccggguauuuacacccccccucccgccccaacaccuuuguagcuagcacauuuauuaaauagggcaugaaagcaaaaaggaacaaaguccuugagauacaccggaaagcguuuucuuccaguuuaauggaagaggguugggaagaaggaugcuuuuaagauggaugaacucuuccgagucuccuuugaggacccuaaagugggagucguacugaacacugaugcagagagaaagaaggacagaacuugcuggcacgggguuaauuuuaaaaucaugaaggucacuccuuccugguagaccgguauggaaccaaggugcccacgcggcagucccucagcuguucucugugugagcacgugguugucaagguuccuggcagcauggccccagcacuugggaccucacuuuugaccuauucugcagagucgacacuugcuuuguucuagguaaaguuucuggcaacgucuccagggagugcuggcuccgagucuuuccucucagaggaaguuuucucuagagauuauuuuaauguguugaacugacuaucaggaccagcgauugccuucugacucaggaccaaagaucccaggcuauucuccaaggggacuuuccuccuuccggcugcuccuugcugucaccaguccuuccaguccuucucuuuugacaccagaguauuacacaauuuccgcuaucccauaggguuuucucaaccugccagggcucucucuacuuccucuugguuuugaaaacauuagcacuauugccuuguggcucccucccccccccccccccaccauguaauugcuggcuuucuucaaagcuagcuauccuggacucauagagauccguugucugccacauagaacccaggaaaccccugggccauauuucaaaaggcuuuucaggaaauucugagcauguuuugaaacuccgccugguucuaugggauuacagagguuuauaaaccgcauuccacaagucucccuugguauucuugcauacuugugaaaugucagaggggcugagucucucuuuauccacauauuaaacacggaugaaagcucuaggggagaggaauuaagauguccaaucugguuucucuuuuaaaaucucccagggcaaucugacuauuaauguggguuucuguuauccauuacaauagggccaaguuguaacuguaguuuuuguuguuguuuuguuuuauuaaaaaaguuucauuauuuauuuauuuuuaaugaaacaacagagauuauuuggugccugguuuacaccagacacagcacccccguggguucagcuauuuggcccucagauuaucuauguuuuaagaauaaaugaccuugggaugaagagagagaagucaucuguaagggcgggugugugaguuuuuaauugagcacuguaucagaacuggaagacuuugggcaaggcagucaaguucguccuugcuggcuggaguucccuggugccaucuuaaacacaguagcuuucaucuuaaucuguggucuaaaguagauaacggagagaggcagagaccaguguauuaagcagugacuuauggaggguuuuuuuuuucuuucuuucuuuuuuuucuuuuauucuuugaagccaagugauuugguaucuucagauauccuagaagaaaguuuugcaaagguuuucgaguuguuauucuugguucauacauucaacaaaccccuucagcugguuccuuccccccucaccucacuguacccuacuucuguaggcuuucugaaggcauucagagcauucagccuguggcaaagaagccacauguccccacuagagaagacauaacauggaaggugacagggcagugucuucaggcuugagugcuguccgcugcccgcugagaggaagagcagucuugaggucuucacauaauggccuaggggagguuuuuguuguuguuguuguuguuauuguuguuguuuaaguguuaugagcgcaugaguccagaauuagguggaguaaauuuaugacuugguacaacuaaaauacccaaaguaauuuacaugcuaaaaugaccaagacuaaggagccccugcuuauuccaauaaacacguuaacauaacccaacggggucagugcugaagaggaccuggguggcugucuguagucugugcaccccucccggcuaggcagggguccugcgagcccugcagcccugcuaugaugacuugauuucccacaacuuaggcuuuaucuucccaauggcuuuuaaacuagacugaguacauucagagagauuuaaaaaaauaaucauuauuguugcugauguguggauuuguguaugcgaugugcuguguguguguguguguguaugcgaugugcuguguguguguguguaggugaugugcuguguguguguguguaugcgaugugcuguguguguguguaugugaugugcuguguguguguguguauguaugcgaugugcugugugugugugaugugcuguguguguguguguauguaugcgaugugcuguguguguguguaugugaugugcugugugugugaugugcugugugugugaugugcuguguguguguaugugaugugcuguguguguguguguguguguguguguguguguguguguguguguaagagagaaagaguuagaaaaagaagaggaagauaauuuucaucucagcgggcaccugguggucagaggacgugacaguuuuccuuuaacuuugacgcacauuucagcgcuugucugcuaagcacugugaccuacugagccaucucacugccccccaccucccaccccagagggauuguuaagccagauacuaccaggccuggccccugagacucugacuucucaagucuggagcuggucccaggaaugugcguuuuuaaguguuuggguggugccggugcaguagcgugaggacugcgcucuggaaagugacgcugcuuugaugaucaggacucuuacaggcgcaccacucacaguuagcuaaguccaguuuuuucccacuuccucauuagauagugugaauaauucaguucucacugugggagaguaucccgucuuguuccagaagggacugcacaaaauacacagaacuucacuuuggccaccgguccucguucagcccugcaggggggauaggcugucugcaggcugccggguugcaguuuaucuuggagaugacuguuuaguggccuucaguaacuguggaagaggccagagguuuucccacccauuaaggccugugucuaaggccucucuguggacacagaucuuacaguuuugagacggcuuaguuuucuuuucuguuacuauugaagucucccccaaaaccaagguguuuggcucuaucuaaaacacaucaaagacggagcacugcgcagcggguucuuuuuuuuuuuuuucuuuuuuuaagauuuauuuauuuauuuuauguaugugaguacacuguggcuguacagaugguugugagcauucaugugguuguuggggauugaauuuuuaggaccuccacucgcuccggucagcccaaagauguauuuauuauuauacguaaguacacuguaacagauacaccagaagagggggucagaccucauuacguuugugagccaccaugugguugcugggcuuugaacucaggaccuuuggaagagcaaucagugcucuuaccugcugagccaucucuccagccagagcaguggguucuuaaggucuccacacaacucuccuuccuccccuuccacgcuuccuuccucagcgugccucuguugcccacuuccuuucucuaugagaucuguugcuugguauggacuugcagcaauaccgcauguucuugcugccgucucccgcucaccaugcuggucccuguuguuacaugcgaugccgccucgaugccgcccgaggaaugaaugcauuucucugaacacacacccagagugacugcugucacuggcugcgcauaugauaugccuugucuguucuuggcuccuguuccuugguuuaugccauuucucaccuggccuugugcagccaacugaagaugucuacgcuccugcaugaaaacacucacuggagaugcuuccuggguuaaaagucccuuuuccuuaccugggcacucguggaaaagcagugcagcccagcagucucuuggacucagugcucuuugcucagagggguuguguuuauuuguuugaggguuugcccauuccguguuucucuucaacucaccauccaaaaauggcagcguccucgccuggcugacaguacucagucaaugagaggcauccagcaagaaucuguggaaugaaugugugugugugccugccucccugacucuguucugaguucagagagagagaacugggcuucagcuuacuucugaaacccgagagcgcucugugcugugcugcgggcuccaguaccugucauuauaaggaaugcauaauucggaggcgccucuguggaauuacacucaagggucuuaauuucaaucagucucauuggcucuguuuugacuggaaauccuguugccuguuuuuaaaaacacauccgccccggugccuuugaacagcggagaccucuuggcaggcaggcaagcaggcaaacauuucuuccccaucaggaaaucucaucaacaugauaguagguuuauacauccaggaaauaaaauccucccagaaggcuucacuguccucuggcuggcuuuggauauaagcaguuaagcccacucaaccacagcccagauacugggccagggccugguggccgagucuuaggacaaacaaucaaaggagaaauaagauugggaaagaccuuccuuagugacaaaccggagcuaaguucaagagauggauaaaaggcuggcuuugagugugggguuuuggccucaaauggcugaaugguaagcagaagcugucauuagcccagcacugguaguucuggcccuguguuucaucugccucuaaagucacacuuugcguguuguaucuggaaagauuacagacuagcaaggucucuccugauucucucaagguguauaguacuucccuucgucuggaauuucuugguguugacaucuucccauuacaaugugacugucuccugcucaaagaacuaguuugggcuuuggaaucuuugccuguauguaguggacucuccuggguaugggacccaaguggguguuucccacguguuacauacacagcccgaggugaguuuauggcauuccccuuuguguaccccaugaggccagaggugcaaucuucugccuguggcaucguuuugccggucaagagguuucagaauuuggaggaguuuagguuguaaagcugacacuccgcuuggauucauagacaagagaguguggcuccuccucgggagggagcucuuccagggcucacucaucuccgagccccucagaacgucuucccaguguucucgccccagccuuuccgaugucaacaccucaacugggacaugaugugaggguucuggaaagauggguuagccagaggcuccgugugcgugcucugugccuucugcauccagggccucuucugcucucacacuuugaugucuaucuuuccagaggcgugaacauguaugccaugcugacggggacccuaccuuucacuguggagccuuucagccugagggcucuguaucagaagaugguggacaaagcaaugaauccccugccgacccagcucuccacagguaaugcaucugcuccuguggguugaggaucugucgccugcccucgcauggucugaacucauuuuggaagggcuguugguuugaugugaguuccuucccuguguagauacaacaggguucaccgagcuucccaucccuaagcaaccagaccacucugugugugugcucgcucuucuuguaauuugaaagcuccaggccccuccuucugucuuugguacaaagcacacacaucaggagggccuugugcccuuugcuuggggacuagcugcaggcucggcuguuuuagagugccgccuuggugaggagggcuauaagcaugcuuacguuuccguuagucaguuuauuguaaggggauaguaguuucagucauguguuugaucugugauuuguuuuauuaugugaacucuugaggcuuucagguauagguagguucgguuacuucaaaacaaccgaucauacgcguguuugagaaguucucucaaacguuagcagcuucaaguugcaauaagagccuugaguaaagauuggguuuugacucuguaaauggacaggaucugaucuuuucuuugguucacacuuuacaucaaguuccuggucugagcugggcgugguggugcacgccuuuuaucccagcacucgggaggcagaggcaggcggauuucugaguucgggccagucuggucuacagagugaguuccaggacagccagggcuaugcagagaaaccuugucucgaaaaaccaaaaaaaaaaaaaaaaguuccuggucuaugcuccacucugagggucacuuaauuguucuguuagaaagaaucuagguucaaugaaaugaggcuuugaccaagaaaggauaauuauuuaacuucccccuuucugguacauggauagaacagagcauuuuauuuugccacuauuuuauuuuucccuuggguuuauaagcaucuggggaacuggcccgagauuuagucuugucaauggauccaacuugaaaugaguucuugggcauaauuaucuaauugagcuauacugugaccuugccacugacguguaaucucuggagguugacagcuuuggaaggcauuguguccuugggaagagaagccacuguacugacuucuagaacaaauaguucugcaaugggagucugaccucauggaguuagaaagugcacaacauauugaagggaucaccacauugaggcauuugggcacucggggucgaaaagugcuacaaaguauuauaggaaguguucagccaaccguccauuuauucaucauuucauauccauucucucuguccaugauaacuaggcacaugcuaggugugugucugaaagagagggaaugagccacauauagccucagcuucuauaaaguacacacaucuaugggaaaagaaaaaaaaauauauaugcacacauuugcccacacacacauauauacauauacacucauacacauacacacauauauacauauacacucauacgcacacacacacacacacacacacacacacacauauauacauauacacucauaugcacacacacacacacacacauauauacauauacacucauacgcgcacacacacacacauauauacauauacacucauaggcgcgcgugcacacacacauauacacacauauaugucaguugcugcuuuaagugaacuaacagguaauaauucagauaaagacauaggaaguaaacauuuuuuuaauaaaauguuuuugaaaacaguuuuuuuguuguuguugugacuuuuuuuuuugaugaacacccaacuuaaaacaugaauggagaaaucuacacaucuuucacccaguuucccacaaccauaguaucuuuaauugcugauguaauuuccauuaggaaaaagacauugauaaaacccacgucucccaguguauauuuagcaccaugugaauuuucacagugcaaauugccacuguguuggagacagccacuaacaucaaggcacaccucccccucccuguauagcuuuugucaccucccucucuucccccuacaaacccuuauaggccacuaccuuuuuuccaucucccuagcauguuugaaaugaaggaacuauagagaugaacaaauguacaagcccuguacagaucucuugucucacuguaacuguguuaagauccacuuuaguugauggaugaaucugaaccuugucccuuuucacggcugaguuguauucccauguauggacauaccacagguuuucuuuuaaccguucacccauugcaggaccacuggauugguuucaguuugggacuacuuugaaugaagcugcuauaaacauuuaccuccagauauuuguaugaaugugauuucuguaaggccaagagcuaagaaccaaauuacugugucaauuaguaagagcauacagcuccauaagaagguaccacgcuguuguuuggaguggcuguaccaucuuguguugucccucgaauacuccaucugcagcuuuauuauauagucuuaaacacugccaucucucacaggggauucugacaugcuucugaugguguagagcuugcuuuguccuaaaugacccaugacacaggauacuaggaagaugcuggaaagaguaagcagggguugaugaguaugagugggacuccgagaaauuagacaguugcugauuuucugucuuaagucaucagaacagcagucagucccaacucccagaggcuuaggaccaccaaggcuuacuagugcuuauauuaauuaaaaguuggaucaagaauagaagaguucugagcaccucaaaaguagaaucucaaauccauugcuaguccaugcaggggagguaugggggugagaguggggguggggcucuccacgcagcaguaaaagcuacgcuuaccuucuggcaugugagcauggcacgugaccucaguuguguaaugagcauggguuagugcaaccccaccauaaguacugaagguggaaaggcagagauacaugugagcugcacuagugugagccacacacaggcugugggaggagcaagccaucgcaacaaaccugguuugcucucuuacgacgccaucguuauauccugcaauacuaguuuaucaguaacaggagaagccgccccuuaguggaacacagaaugcagguguuuucccguuaccgccuuuuuacacagucaagcacagugaaugccgucauucccaguuaaccaaggggaaacugagucucggagugagcaaguugguuugacugagaacccaggauuuccucugugcucugugauuucuuucccuuauuguucaaagaugugcacacgcaugcucacucacgcucacaugugugcggugcccacagaaaccagaagagggggucugacccccagagcaggaguuagcagguaguugugagaugcccaucauggauaccgggaacugaacucugguccucugcaagcauagcacucucucuuagcugccgauccgacccuccagcccccuucccuuauucaacacacagucuauuccucuacagccccugagcgugccagucuaucucuugucuucaggucuugucuuuugagugaugucauugcggauugaaaaugcaacaacguuacuguucaucaggaacuccuaucuucaucaaucugauauucucucaguccuccuugccgugauugcgccaauuaaaccucauuauuauuccauuuagaugaaauucaaaguuucauuuuuauuuuagcaaaguucaguuggaaacaaauuucagcacuccuguccuugcgagccuaugacgugcacagagagucaccucccuguccccaucacguaacugggaaccuucagcuuuggggggccuuacggaugcucgucuagcugguuucugcuuucugcaaguuggcucuugcauagcacagaguuagcgaaugcuuuucucagcugagagauuuuuuuccaacaguuuacucuuucuucucgggcgccauagcaguagcauuuguaauacauuccaaacagacgcuuucaguuaagaggauucugucccacagauccaccagagagaagcuaaagacuggcauugcuggagguugggccugguuaaaauuuccaagaaggcuuaaccaucuacugccaauggauucuuagcucagaggagaugagagaguagccucccgccaggacaggccucugcuugcaucuggccggcugcuuuaaugucagguggcuuugucuguugccugcagccccugccuuuggcaguguccagugcucacauaggccaguucagacuugagaagucugacugcuccugaaagaaaggguguuggcaccacagccaugccuacuuccuguuauuugcaggugacggagucccuauucagcuugcuucaacccucucggcuggagcagagagcccaagagucagcuugaaggagcugugacuugugacugugcuagauuccacuucugggaugauguagucccucuuggccccagaggcacacagauauguucaagauccaaggacaaaccucacagcucucugaggauguccauaaagucuuuucaggauagugacgugauguuugugacguccauagguacaugacucgucagcagagacuugaacuaaaauuacuugugcucaucagcaauuugugaagaucuagagcauuugcuggugaaaauagaacagaggugugcauucagcauccaucccuggcucuucugcuuaaucacccuucaaagaagccuggccucgggugugaaaggaugccaguccuuuagggguacacaucagagaucucagaaagcacccuaacucaguaccuccaguccaguucguaaaacccaccccuucguccuugaacaauagaugcucuuguuuaaaacccaaauggugaguugagaagaugacucagugaguaagagggcuugcuguucaaacagaaggaccugaguucaaauccccguccggcaccugcauuaaaaagucucacauaguuguguauggccuguaaccccauuguggagggcagagauaggauuugcuggguuuuguugaucuccaaguucagagaagagaccgugucaugaaggaugacagaacagggcacuggacaugaucucuggcuucuguguuugaacucaugaggaugcacacaccaaacaacaaaaccaaaccaaaaagcacuccagcagcucuugcaguauagggguacagagggaggaauauauuuguucaaaaccagaagccucuuuuggggggagauguuaggagaguuuuauuuggagacuuaacuauaaaacuguuacuguugaggcugagagauaccucagcaguuaugagcauucacuguucuugguaagacacagguucaguucccagcacacacaugguggcuaaccagccaccuguaacuccaguuacagaggacacccucuucuggccucugugggcacugcaugugcauagugcaauugcaugcaugcaggcaaaaccacucauaaaauaaaauaaaaauaaaugaaccuuuaaaaaagucugacagcauuaaauguacauccacacacccauucugucucgcuauguucuugaagacagagggccgcaugcacacuggggcucuccuugcaugaguuaccucaugggugugaccuggcaaagggcuaguucucuggaccugauucuggucucacaauuggccccucuuuugauggcuucauuuccaccauagaaauagggcucacagaagggccaucauucuuuuaagugcaguauaaacugacaacugaacgcagaugagaaagugugaguuuucaugaccgcuccuggcuaagcgggguucuauuuuaaaacacuggcaaagugcuccugacgaaaagacggagcaacguggagugcaaacaaauggagauuauugucugggacuuacuauuuggucugacggaaacuggaugcauagaaagcuaaaugaaagaacuaucuggugggggccuuggaggaugggauggcucaguugguagagcacuugacuugcaaacacaggguccugaguuugauucccccaauucuacagaagagcucugggcguggugaacaccaugauuugugcuuguaaucccagcacuagagaaggagagacagaggauaccuggggcugauggaccagccagucuaguccaguuguugagcuccaggcugggagaaaaucuaauaauaauuuaaaaaaaaugaauggcauucuuuuuuguuuuuuguuuucuucaucguguuuaguuucuggagaauuucauguauuuauuaaacuaacccuauuccuggucccccccccauccacacccccuucagauggcacuuuagguggucuuccagccucacauacaugcacacacauauguacacacaccugcaugcacaugugcacuuguauaaacauaaacaugcuuacauacauacaaagggaaagauuauuauauucuguaucugcgagggaggaggaggagggugugucuuauguguccuauccugggggcuggccuugaacuugcuagguauugggggaugaccuugaacuccugacccaucugccucuaccucccaggugcugggaucauaggcacacaccuucacgccuggcuuuucuggugguagggaucuaacccaggacuucguucaagcuaggcaagcacucugccaaaugagcuguauccucagccccuugcagggugguacgcuaagacgcaauagaauaggaaaauguagucucagaaaaaugcaggaaaacugguccucuguguguggacucuucaguucgguguggacucacacugacuaguacugaaccugugaccuucuaaaauacagauaugcaugauauacaguugucguuccuguuaugaucaugaaggauacagcuuucugucucuaguguuuggguagaucgaggguguucuguaaauguuugucuuaugaaaggagacccaggguacaaauugcuugguagggacuaaaguaauacagguggugaggauuugguagccuggccaaugguuucucucaucccuucuuacucucuaacucaacauggcuggaguucuauaccagguauuugggcugaaacuaugagcaaauaccacggucauacauucugcccagacugccccuuccuuuuagugggcagcaucagacggacauggguuuguagugagguacuugcuaaaacucugugacaaacuaggauuugaagauacaaguuccaguugaccuaauacuuaaacaaaagcauacagaucucuggugucaugucagccuaguuagcuggccagcauggguuuaggcuagccugggcacuacauuauaaucucucagagucugggggaaaugugaguggcauagagaauugauuugaaagaaaggagccuuggagaagcacgugugugauccuggcuacucagaagucuaagguggggaagacagaaguuugaaguccuccugggcuagccugggcuauagaucaaguucaaggcuagccugggcuaccuugugaaagcccaucucaaaaucaaaaguaaaauagggcuaaaaacauaugaugccacaggcuuaaccccugguacauaaaucaauuaaccaaucaaccagcaaguaccucauugaccuugugagccguggugccccaugguaagggucaaagugucucguucaaauccauucaucuuuuuucccuuuugauugcucagacaccaccaugagcauuuuuuuuucaguuucuacucuuucagccuccacaugugauaguaguacaucucaguguuugaucucugaguggcuacaggagcacacagauuauuccagaaaugcauggcccagggagagcaagccaauugcugcugucuugggucccagacauccuuggacugaugucuuaagcucuuuggauauacagcagcucuuuaaaagauaaaugugggaggaaaugcaauuuaaaacuccagguaucugaagguggggcugaacucacuuucugugagcuguggaaucgaagccccaccagagaccccaagggcagaggcuccgaggggcugaggaggugcaagaccucgggcugcggcuucagugucugcagcuguguucagucucuaagguguguucuuugugguguguaucucacaggggccgucaacuuucugcgcucccuccuggaaccagacccugugaagaggccgaauauccagcaagcgcuggcgaaucgcugguugaaugagaauuacacuggaaaggugcccugcaaugucaccuaucccaacagguaaaguggcacagauggaggaacaccuucuccagugagauguggcccgccugugagcccuccaagcucgggacaggaagcuguaggugaucgaagucaaagcuauuuauacccugccccaauccccggccuggcugugcccgccucaauaaccucuuacccauagacaggcccaucucauugggcaggaagaugcaaccagggcuguccuagguguuugugccagaucgguccuguggcgccugguuaggaauggaagcugagcuauagcacaucccuuaccaagccucgcucugauggacugcaacuucccuaacgucuuucuaguucacuuaaaguguucauuuaaauaaacuguggagugugugccuauguguaccuguguguaccugugugugugugugugugugugugugugugugugugugagagagagagagagagagagagagagagagagagagagagagaaaguggauggauggauggauggauggauggauggauggauggauggaucaaucgaucaauagauagauauggggggugguggagaucuacuggugagcucuccugccagcauuaagcuucuugaaucucauggaacugggucuuucaccuucagaccugcuuccuccugcuuaacucccaugucucucagccccgaguuccuugccuuaaggcaacaggaaugggaacaaggaaggucagaucauucacuucagcggccauauugugggcuugcucuccaugagggaggguuacaggcgggugcacugagagguaaaccacccacccggccugucucugcagacuacggaucaggaaaccagcaccggagacauuuccuuguucuuuuugacucguuugucguucuuugagccacucugacugagggauaaggaccuucccuuuggcuacuucaagcacauauggagaccaccugacuccagccuucugggauagcucaccucuucuuuaaacccuucagagccuuagacgcucugucaagcuuggaugaggaccagagaaccacagacaaaggagcagggugggggcauccucuggccauacuuuugaaaauccccaagucuugggccaaggaagucuagaaauaugcacuaagccauaugagagcugaaaucugagucccuuaaacuagaugcucaacaaggcucucacucaggauggccguucguaggauccgcaucuaggauacuugaccacauucacccuugcucugugcauagaggaggugaguuugucuagucaccauuugaaaucuagcauucggcucuuggguaguaauuuagacaaagucuggguuaccuaaguugucacgggaaccuggaaauugacaccguuuuccaauaccuguucaauuugggccaggaacugaaauggacaccagaaaaauuacccccccugugaaccugccaacagagcugaggggcaaugucuucucacugugggacagugcccaggcugcuucugguaagaaguggguagcacugguggcaaccaaaggagccauuagguuaaugucuaagggagcauauccuauccacccaacacagagccuguccaagacuguggaucuggcccuagaaacacagagagcccuuccuguguuuagcaaccucuucagugauaaagauuuacaauauggcuuauaguuuucuagccucuccacagggggcuagaggcaggcuuuggugagguaaacacuaauucagucuuuuacacuuuuuagccaucuugaguagugugugcaugugugugugugcgugugugugugugaaucuguaugugugagugugacugugugugugaguggggugugcuuguguaaaaaacuagcuaauaaaugguaaaagugguaaaggucuuguuuaaagaaaauagcagcuuggggucuuuuguuaucuaagguuauuggauaaagaagaaaaaucuguuucgauaagauaggagagcaaaauucuaaacuguugggggaaguauguguuauuuacaguuuuauuuugaaaaauuguuaaucuucaaggcaaaaaaauuacauaucccugguaauuguuuuucuugcuuuaccggcccuuaaauaaaccuuaaauauaaaggcggagaaacauacagccaaagauacauuauauauaauuguaaaaucuauuuucuaguuucccaacacugcucucuccugguuuaauuaguuuggauguugucaguguuuccuucccuuuggggaaaguuaagaaaauaaagcccgaguuuuacgcugcuccuucgcacagcuuucuccuaugaaccccuuugcuuuuaaagggacacacugaagugucgagaaaugacauagcacagugucuauaauuuaaaacauuuuuagcaacaacaauaggaaccccaaaugcagcaagcauggcaaagcauacccaggcgagggucacucagcuaaucacagucaucucuccauaucuguggggccauucuaugugauucuaugggaucauucuagugaucuccccggaaaaaagauauuaaagaucuacagacgccgcagguguggugggacagaccucuagucccagcacuugggaggcagaggcagguggaucucugugcguuugaggucagccuggucuacauggugaguuccaggauagccagggcuacauggcgagcugcuuucagucccuccaccacccaagucuacagacacucaagucuccuauauaaaauguauacuuuguacauaagccaugcacacucuuccauauacuuugaauuaccucuaguugauuuauagucuuuguuaugcuguauugccucagggaauaaugacaguaaaaaaaaaaaacccuuuagagucuuuaugcucaguauggauauauuuuuuuuucugaaauguucugucuaagauuaauugaauucuauggauggggaacacacagguuauauaguaaacccacaacuguccuauauauguaaaaauuuucaaaauaaaaagucagggggggcuggagacguagcucagcugagacggugccagccggcaugagcccuggauuccaucggcccacaccacacaaagcaggcauggauggcagugugcgccuucaggcccugaacucaggagguaaaugagagggccuguuauucaaggucauucucucagccgccaccuuugugagacauucugagaacguggagaggugacuggcucccugugucuaccccucacaggauuucuuuggaagaccugagucccagcguggugcugcacaugacugaaaagcugggcuauaagaacagugacgucaucaacacggugcucuccaaccgcgccugccacauccuggccaucuacuuccuguugaacaagaaacuugagcgcuauuugucagggguaagugggaauccuccccaccccacccccacccccccucucgcacagcagcaucuucugucuaguguggcgaagcugccgacacuugauccgugcuguuauuuuagucuaaaaccugaggcccagucucuagaguguggcauaaaggacuggcaaaacccguuucuuagauggugcaguuggucugagaugugcuccaaauguucucccauaaaaguuaacccugcauggccgacccccgcggggcuuagcucuguuugucuucuguucccaguugucugccuguauucugucaccucuuagcucuuuggguucucuacuuagaggaacuggagucuaaacugcuaguaaaaguugggcagcagcgccuggguguauaaaggaugggauacagguuagcuauucacuaguccgccaucugucuccaugguuugugucugcaggauucaaccaaccguggcucagaaauacuuaggagaacauuguauuagugguggaggugcgcacauuuucuccugucauucccuaaauaauaguggcauggcauuugccuuguauuagguacuguaaguaagucagagauuuaaaguguuugggggaggagcacagcuuauaugcaaauucuuguaccguuucccguaaaacuuaccacaaacugggauuuuuuuggaaguccuggaacaaguuaccuuagggugccaagacaaaaaaaauguguuuagguuuacgacugcagaaaauaacacaacagcguuugcuagguugacuccugcagcuucacacaggcuagcugccaaaaagcucaagggacgggguggaguuaagggacaggcuugacaguuaagagaacugguugcucucgccaaggacuuguguucgauucccagcacccacaauguuguucacaaccaucuauaacuccagucucaggggaucuaaugcccuccacuucugccacucccacaguauacauacauguaggcaaaacacucaugcacauaaaauaaaguuuuaaaaaaaucuaaauaaagagaguccaaguguguugugucgcacaugaagaacaguuuaggccgcaguagaauguugauauuauggcgccuuuaucaucuuggccacaguagcucauaugucagucucuccauauaaacaaucucucaaggagaaugcuguaagacagcauauagauacuauacaauacugcucugcguuggugcagaaauguagccauaguauagaccagcuccaacagagucagagaaacucaugguuaacagaagcccauuagagguuugauugaacacugucuuaaagaugaccuugacucuguguguacuguaccuugaggucugguggcaugucugugucucagcuaggaggacaggauggagaugguaagaucaaacuucuagagauagcucagugcuguuuaaagucucacgauagccuaaugugucacagaauuccaccaaccaggaagguuagaaacauuucagaguuuccaucuuagagcgaaagaugaaaauccaccuguagcuagugaaaugaccugauagggcagaaauggcaaaacaguauucacaaggcaugauggcaccagugaagcucuuguuagcagagaggcugagaugcacuuagauaacagggcugagagugugaagaagcuugccugggagucagccaaacaucuggauggaaguguagguguucccaagccaaacaucuggauggaagugcagguguccccagcugacucagcucauaauuagcuuccaggaaaauuuacccagagcuuucguggugugugugugugugugugugugugugugugugugugugugugugugugugagagagagagagagagagagagagagagagagagagagagugcaaaggaaagacguaugugagaagaaacacuaaaaagcuuucuccaacaggaacaaugagcaugaggagauaaaugcuuuguauuucugauggggacccaucuugagcuuugaggcuuugagacaguaccuguguggugaccauaagucauaggaguaugaugccaggugacauguuauccucuucuggaacugugacaaacaacucagggaggagaagguuuguuugguuuauauuuccaagucguaguccaccauccagggcagucaggguaagagcuagaggccugaccaauggaggaacgguacugguggcuuggcuuguauucuagcuugcuaacuuucuuauggagcucagaaccaccugcucacacugugauugaucaauuaauaaucaagaugguuccucacagacaugcccacagacaagccugguacagacaguuacucaggaucuguaaccaaacuuugauauguaguugauauauauacaguauauauaggggauagauacucacuuaaagaaaaagguuugggggcuagagagauggcucagaggauaagaacacuaccugaucuuccagagguccugaguucaauucccagcaaccacaugguggcucacaaccaucuauaaugagaucuggugcccucuucuggugugcagacauacaugcaaggaggauguguguguguguguguguguguguguguguguguguguguguguguguguggugugugguguguguuuguguugugugcaugugugugcaucuuuaagaaaggcuugguugagcccauacuuuggaaagugaaagugaggcucaugcccuagccucugggguguauccccauucuuugucaugacuugccagagaaggggaauaacuucaggcagaagggccaacugagugagguggccuuccuucuaacagcgcacuuucuuggugacugacucgcuguagaagacaauaccagucccuuccauguuaguccugaugaucucauuaucuuauaccagcccccuuugcaggcuuccugagggcaaacuuccaggaagcacacucaagccacugcaguauauucuguuaauuuauuaggugaugaugaugaugauaauaaugauaaguggcucucugcucucauuagaagaaccugagagagacuuggggcuguucuuuauuucucgucuauaaaaagagcccauuuucaagucucuuucucaucuuauccuuuuaaauuccugcuucacuguguauuuuauaaugcagauggugcauugguacaauggcccuugaugaaucauaaauaugcauauucuuauagaugccuccguucaacuucuucacucauuaaggcucugggugauaccauuuggacaccaugccagagguuaaaaguuaaucuuuccuaaugguucccaaacaaggaggucaugugcacacugauuuucuuauucaaguaaugaaugcuauucagaaauuuuagagugucaugauggagccaguguguagggaaggucuuaguuucauguauuacugaauguauaauguugcuauagacucaggugaguuaggucuuuggguguuuuucaaggguagguagugucugaguuaggguuuuacugcugugaacagacaucgugaccaaggcaagucuuagaaggacauuucauugugcugcuuacaggcucagaguuuuagucugaaccucaucaacaggugggugcagggcagcauccaagcaggcauggugcaggcagagcugagaguucuauaucuucagaggcuuuccaggcaggaaagaugaggaucuuaaagcccaugcccauagugacacaccuaauacaacagggccacaccuauucuaacagggccacaccuucuaauagugccacucccugagccaagcaacuccaaaccaucacagauggaagggugccugugccuacuuagacauuuacaccuaggaauuuacaccucauacugucuugacgcugugccaugcaagucaagcaagagggaccuugugucagaaacgcuuaggcugugucuugcuuagccugggcuccuugccuucugcugucuuuuccucucuucagcuuugucuagcaucacuuuuaaguguugcgaagacgacuguggcuuuguccaguggaaagcauucccugggaacccagaccacgcgguuaguucugacuggagcgggguuugauuuuccugagcaggaacacuuaacucuuugaucguaagauguaccugguauaagaacccgucuucuaggcaaguggagcgaacuggucuuugccuauggcugcagcugguccacacagcgauguccagauguggcucaucuaacugccuuuaggcacugucccaguuauuuuggccaaucaccaacaacccauguguguuuuucaaauccagcccagugaacuagcauacccagcucccuguguuugccuuucuuucuccucugcuuuuuuuuuuuuaaucuuucuuuuaucaagagauacauauuuugggcuggaaagauggcucagugguuaagagcacugacugcucuuccaaagguccugaguucaaaucccagcaaccacauggugacuuacaaccaucugcaaugagaucugauacccucuucuggugugucugaagacagcuacaguguacucauauauaauaauaaauaaaucuuuaaaaaaagagagagauacauauuuuaagcugccuccuucgauggcuuccacuguggcuugcuguggcucuacuuggggugauguaaucccaucaccccaagcuaguuuuguuuuguuuuguuuuggaggcugggucuccugucccaggcuagucucaaacuuucuauguagucaaagaugaccuuaaacuucugauccuucacucauuuugcacauccuaggacuauagguguagccacugugcugccaauugaacucggagcuccaaguucuaggcaagcucucuaccagcugagcuacauucucaguccuguucuacaauaagcaggcgggcaugccacuuccuacucagugugguaagcagcucuuucucccagcuuaaugaguugguugguugcugcuuucuccucugaugguaaacacugggcagaugaaagaaccaagacccagaagagaguagagccuugcccaaggcugucugagucuccugggcucuggguucuccuugaacucaauacugggaugagacucuacacugcagcucacugguguuucggccauuuuugauguuuucucagcuaagcacugguugaaaaaauaaaauucaugacuguguaauggauguuccuauuucccaggacuuaagcuauguuucuuauuucuuucuccggaagaaaucagauauccaagauagcaucugcuacaagacccagcucuaccagauagagaagugcagagccaccaaggagcccuaugaggugaguggccccgaagcaaauucaggggcucuuaguccauuuuaguggagaaugaaaagaaagucaguuacuguaugucuuaggguuauacuacuaugaacaggcaccaugaccaaggcaacucuuauaaggacaacauuuaauugguccuggcuuacagguucagaaguucaguccauuauuaucaacaggggaagcauggcagcacccaggcagacuuggcacaggaggagcugagaguucuacaucuucaucugaaggccacuaggacaagacugucuuccaggcaguuaggaugagggucuuaaagucaacacccauagugacacaccuacuccaacaaggucacaccuaauagugucacucucugggccaagcauauacaaaccaucacaccguaggacauagaaauagcagaggaccaacagccuuacagcugaguccuguagagcuggucuaccgcggagccaacauuacucaaucuccaaaccacaggccuucuguaccacauaucacuaggaacauuuccacgucuguguguccacugugucucacagaccacuggcacgcagucuuggaaaggcaagacucccugguuuguuaaugguauuugcuuaaaggccuuuuauuuuuaaauuuccauuuuauauauucauuaaacuuaguguuacuuuacauaaacacuuuucguacaaaaaaaaaauacuuuugggaguauuuccccacauacccugcccucuuccuuucucccugaucuagaauuaacccuuuguuuccccacacaucuucacuacgacuuucaggguguauacauauaugguuucguguacucuggaaaaucuaggaccugcacacaagcaagacaugguguuugucuucugagccuggcuuaauucacuuaauauuauuucccccagcuucacccaguuuccugcaaaggacacaacuuuguuauucuuugugacugaaaacaaucaaaacccaacccaaaccuucuggguuucuggauaggauauagagcagaucuuccuuccucgcgccucagcugucggacaccucugacuccauggcuuggcuauucugaguggagcugcaguaaaucuugaugugcaggcaucucugugaugugcugacuuggaagucugcugggaggcucauucugaaauccaucuagaugaacccuuugaacacucacaguuggagccaaaacacaggguucucaagauacagccgaauggcccagcuggugugggaaggaagaggugggcgaagagcaagggaagcucuagguggaagugagcuuucuagucagauaccaccagggccuugagaugaccugcuguguaccugagagcaaaccaauaggcuucuugaauuuagucaaaacuagcauccuauggcagcucggacugcuacaaacucggaccaaaacauugugaagagguuuuguugaggaauuucagacccagcaccagacauacagggccuccugaccagacaugcagggcuuccugaccaccaggguuccccuguauguuuacucaguuucauuccaaggagacaaaacucuucccuguagagaguuugucagcagcugaggcccugucagugaaacuuuguggcaaacucaagaauucgcucacggaaggagcaaccagaaaagggccccccuccagaccguggccaaccuccuccuugucuauaucaaauucucaccuugacaaugggguuggccuggcucugucuaaggccaacacucuaagggcagagugugaaugcuacaggagcccaggaauggggcagacacugaagguggaggcugggcuuugcugacuguccacuuuagaccaagccucagggcaggggagggaaaaaacagaggaggagggagagcuauuggggggaggugaggggcguuggggggagaugauguuggagagagggaugccugagaaacuggaaagaugguuuggcagaagucgcagagccgcacagcuguccuggggaugcccgggugaacaucuuugaggaagcagagaaggcagaaaacccggugcacggauuaggggagacagaaaaagcggagauggugacuaucacagaaguucugggauagaaggggagagaacuuggccucugugggaggacacaaggcugggcugagagaggcugagggaaugagucagagaagggcugggguagaggaaauuaauuaauugccuccuuugucugagaccagcugugaaucucuaggauaaaaaagauggaaaaaggccuuugggaggaugggccagcagacccugagcgauacacccaugccaggcuuuuaggcugaggguaggagaguagacuggagagucagaugcuucugagcuguaggccuagcuaaucaguuccuacuccacguagcccuccuuaacaugcaugaaaacacuucccggugucguccucagaggaggcuguguccucccugggagcauagaguagaaacgcaguauccaucaucaggggcauagaguagaaacgcaguauccauccaucuugaaaagacagccccuccccuuguccugcuaaguaacuuguccuccucagaggaggucuuguccuccuccgggcauagaguagaaacauaguauccagccgggcagugguggugcccgccuuuaaucccagcacuugggaggcagaggcaggcagauuucugaguucgagaccagccuggucuacaaagugaguuccaggacagccagggcuacacagagaaacccaggcagguuuuggcgaggggggggggcggggggcaggggaagggaaagaaagaaacacaguauccaucagcagggacucagaguagaaacacaguaucuaucuugaaaagacagcuugucaccaaguccugcuaaguaacuuguccuccuuguccucuaaggaggacgucuuguccuccccuggggcauaaaguagaaacacaguaagcccccccccaagucuuucucugugacggugaaccccucaaacccucuacucucuugucuccaucuuccaccugcucccagccuccaccccucuucucuuggaggcucugccauguccuucugguccccucauagcuacucggcauucuuuucuccacacaguagccagagugggcuugucccuauccuucuuaaugccuuuggaggcuccaagacauggccaccuaugugggagucacuugcuuugccuuggccccauggcuuggccucacacccaguagaaacgcagucuuucucuugcuuuguguccacuuccccagggcuaggagguucauuuucgucacugccuacccuguucauucuaccuggaucuucuccucacuuucuuugcccagucagugccugugugucuucaaauauggagguauggccagguccccaggacccuugccuuucucagacgucugcugcucgguccccauucucucuaaggcugcguucuguuguacggggcuggucucagcacuuucucguuuguuugagggagucaccggaugaacaaacagcucuccuaguuugguccaugaauuccacaaaagcaaggauuauguuagcauaccaggagccugcaugguuccugccaugguggaaaugcuccggaaauauuugcuaagugaaaaaaggaaagaaugaaaagcccccuugcccugugucagaaacggaauaaagugaggcaagaacggaagagguugaacuguccaagagcaacccuuaggucacugccugcauccuaagcaagaggcaagaucacuagacugcucacccuguuggagucuggagcaugcaaaauucacuucuagguguccauucaauuauaaaaaaagugcauguacccugagugucccccaggccuuccugcuccugucuuuuugucugcauggcucucgcacccagccuucugcggcugugucuguaagagccagagcccuguugggaaagaggcccaucucgcauucagacuccuuuucuuugacgguuauuuccacuuggccagagaacacauggcgaacguuugaaacauuuguugaaauauugaacaguuaggauuuaaauaggagcacuaaugggcaaacugcaucucaguuuucuaugauccauuuguuucuccgaugugcaguauuacuucugcuaauugaaucacaggcuacauuacuagauaccccacucaucucuguuggaaccuagagaguggaguggggcuggcuagaaaauguucuaggaaggucuuagauggcccaggcuucacugcagccccugggaguucacucuagcugccacuggcuggcauuggaguggguagggggguggggggagaaaaugccagggugaggguggauggggucaggugauggagugugagguugcaguucaugggggggggggcauugauuggagggccacauccuccuuggacgucaugaagcugugguguccugugcccugagugugcggguggccucuuuuauuuccucauuucuguucuuuucucuacuagaggacaaauaagccuaauugaguuuucaaagcuucccuuuggggauuacagugcuaugcuacuaagaauucuucuucuucauguaaaaaggcaaagacugcuguguagaaguggaacauacagucgggugugacggugcuugucuuugaucucaguacuugugaggcagaggcagggggaucucugaauuggaggccagccugucuacgugugaguucuaggucagccaggacuauacagaggaucccagucucuaaaaaacaaacaaacaaaauguggguaagacauguaucucacuuggaaacaccaauuugugguauccaaaggaccccugggcccaguggaauggagaugggguagucaucuacuuaguuaaaauggcuucaaaugggauacauauaauggagcaugcuuuuaaacacagaauuuaggaggcauugccuguagaccuuugggaguucaggccauccagggcuacacagagagagccuaucuuuuaaaaauaaguaugguguaaaaauguuuuuuguuuaaaucucuuuaaaaaugauuuauaaaacgugaacuagaaguguguguguggggggggugucucuccagacaaggcugaggucacggggcagcaggggacuggauucuucugaccuggcuguuguaccaaaucacacccaggguggaacucucaguuccagaggucaaagcgacuuagggcugccuccucccgagggcuaggacaggaaagcuacuccagggcuuucucuggugucugauaguuucugaugaucuucccugcuuggcuuccuucuuaugcauucuuagauguguccgaagucugacaaugacaccagccauauugcagaaggguaacuuguggggacgauuaguuuaaaaguaaauacuaagaugcucaguuuauggcuuaguuaaaaaucuccuugacuuggggcuggagagauggcguaucaguaaagcagcugcugcucuggcagagggccccacgcuguccccagcacucacguggggucacacaacagccuguaaccccaguuucagaggcucugaagcuguccucugucuuccaugggcaccugcaaacacaugaugcauaugaacucacacagacacacauauacauacacauaaaauaaaguacagacaaggagcuauuugaaauugaugccagcugccaaagggaaaauccauuuucuccaguggaguguuacaacacacgaagaacucuguggcuuuguuuguuuguuuguuuguuuguuuugauuuuuaagagaaagagagagagaacaugaaauugggcggugaguaggacugggaggagcuggggaagagggaaacauggucaaacuaccauauauaaaagagaaaagaaagcauggagaccggucaagcaguuugugcuucuggcaauuagaaugguggcuacacugaggacaaagaggcugggagaagggccagccagauguggcccagcagggaaaggcacuugccacuggaggaccagaguuugcucucuggaacccacaugguggaaggaaagauccagcccuacgagggcuccucugaccuccacaugcgugccacugugugucuccauagacauaauuagcaagcaaaguugaauuaacaaauuagaaagagaguuugagcuggggaaagucugaggagagccucucaggugcugggugggaucugcuuccugacauggcugucgucacuguuggagagacacgaugaaccugcugcuuugucgggcaagcacuccucccuucugagcuucaguguuuaauaacuuucucugcaugugagucaagauaccugcucccuccucacaccgcuauuagaguugauuuguuucugcgaacauugaaaugauuaauuuuccaucagggggagcccuggggggggggcggguagaguucugggaagauggaauagcugcagcuucuugaauugaugagaacugguugguguuccucacaggccucccuggauaccuggacgagggacuuugaauuccaugcugugcagguaagaauuuggggaucucugauggguuagcaggcucuccagagagauguguucucucucacuugcauacacauaugaaaauagagauaugguagaaagauagacagacagagaaccaucuuuuucauucuugugugugugguguaugugcauguaugugcauguauguguauaacuagggagaccagaagagugcacuggguggcuuccucuaccacuuugugccuucuuuugaggcagggucucuuccugagccuguaucugguuuuucagauuggcuggaagccccagaaauccucuugucuuggugcucucaaaacgccaggguuacagguaugcauaaggccaugguuggcucguacaugagcgcuaacauccaaacccagguccuggugcuuggggagcaagcacuccgaggcacagagucagcuuuccaagccugcugguucucuucuuaaggcuuucaauugauuguaugggacguagcacauuaggaagaccgucggcuguccuuagcugauguggaugcugaagagccuaaacauagccuuugcagcagcauuuacaccgguguuggccacacucuagccaagcugacacaugcaguuaacugucccgugauccugaguaucagccagucuccccugaaccaaccccugcaaccaucuuuccuuauccugcacagaauccuguccauagcugaucagauucccccucggaugguggcuuggugcuaccgugcaaaacugacucuuucucugucuuuuacuccuggaucuaugaacagccaaaucuggcuuucucuggcaugauaggcacaaagaaaccaauacagacuggcuaaugacaucugggaauguuggccauguaggguuggggguaggcaaauuggcugucaugcuguaagcauccagguaaagcucuuugauccucagucacgguccuggugagcuucacuugaauucacacgcugacuggagcaucuucagcugcccucagcccccagggcucacccucaguaugggagagaagacaguuucccaaggggcaguuccuccuucagccuggcgugauaggaggucugucucuguuagucagacuguuugccaaucugaucagcuugcaggugcaggauggauucuugcuuuugccugcggagccaagagggacccacacuuuugauuaaagauggagauacacuucccuggaggcgaugguaguugcucagggucccacagcauguugcagagagccagggauggauucaacugcccaagcuaugaccauggcugucauucacuggugacugcuugccucuguggauggucaggaaaggagaaucuaaaaggccagcuuucuggagcucaaggcuuagagucugaggagcaggccucccccucaggucaguugcuggagcggauucccaucugucuccguacacuugauugauguugguuucuuccacugaaugguaaaccauccuuucaguacucagacagaggacccccagagguagcuaguuagccuagacaaaucuaugcuccccaaguuugaugagagacucugauucuguaaauaaaacagcaugaucgaaaacagcagcugauaucaacuggugucuaucuggccugcacaugcgcucucucucucucucucucucucucucacacacacacacacacacaauuguuuguauccaccucauguggucuccucugaucucccuuggugauaugaagcuuuccuguggguuaaaagggaagagugcuuagagucgagauggugauuuuccucagcaguuccuuagcccucaggaugcucggggacccugaccaaggagaaucagggaaagcaggucccugccagccucagcucugguaggcagggcccaugcccucagaaggcauagcaccaucuauuuuucuuugaagauuacuuccuguuacauaagauauugcuagcaugcugcucccuaggggaugucuuuuggagaaaauaggcaaauggaaaggucuaaccgggugaucgcaggcacgugucuggggcaguggaucagcugguuaaauaaacacauuuccuuuggaccacucaacuagcccaagguucccuaucaaggaguguugaagauggagcucuuaacugcuccugggaagagguacaauggaaucucuauggagacgcuuguucugaggguuuguggggcaugcuggggcacaaguccaacaaggauggccuuagcagggcuaucuggagguguuuggccugcaagcgguuuccccuucacacaaugaggcccucuccucauugccaagugucccucccuugagcacaggaacuuguccuuacaggccagcagccuuggccucccucuccagcagacgcccacaucuuaccuacuucuugcuacuaaguucagucugaagugagacuggcccuagagcuuucauaaccugauucuuaaaccauggaaacccccaaaggggacuggaaaggagccacaguagucucccacagcugcuggcugcccaccugugccugggguacagagcggucugaaggagccuuugcugcucgcucucucccucucccucucucccucucccucucccucucccucucucccucucccucucccucucccucucccucucccucuccuccucccccucccccuuccucucccucucccucucauguucuaaaauggggugaaugcaauuugaucuuuuuuuuuaucaaguuuuauuuuaaagugcauugcaacaguguaucucaucagguuuauuuuucuccccccccccuugagguaggaacggauagaaauggugacuuugcagaugaacagaaagaguaaaaaagaaaaaguaaaaagaacggaagaaguuccuuuagacuuuucagggcaaaccuaucauacccucuuucaagcuccauagaggucuguaggugugugugugugugugugugugugugugugugugugucuaucugcccaucuguguuugugugugcugccuguguaucugcuugggucuauaugugucuaucuguguguguaucuaaguggcucugucugucuguguauguguguguguucuguuuguguguuguucuauuugugucuauaugcauucacauggcucuguguguaugugugucuguccaucugucugucugucugugcauuugcuauaaaagcuuguucuccuuugcuuuagaaaagguagaauguggaccauuuguguuucauagaaacagaggggcagagagcaguagagaccugugauuaucuccugccugccuucccauggucacuuggaacacaccuuguagcaaucuggaugucuuggugcauuuucuguuaacaguagaaugcccgagaccagauaauuuaugaacaacagagguucauuucuuacauuucuggaugccagugucugcagagggagggccuucucgcugcaucacagugugguggaagggaccguguguuuggaaguacagcggagagucuuuuauugggaggcugcuccuacaguaaccaagucucuuccagcugccaccaccugacccuauccuaggccauguggaguucauaguaccgaugagggcugugaaucacugaguuuucagucaguucaggaggagucccuggaccaucccaggcucgucccucaucacaggcuuccugugaccuuaguaauggcagcggcggcggcugaggaaggagccuguaguaucuaugugagccgcucuccuuacuucucacccccucacugguuaaggguuaucucuccccgguguuucuaucccugggaguggcacugaggaccccacauccucacuuccugucucugcacaacgagcucucugcaaaggaaccgggcauccuugucgggaagggcacguuggugaaagugccaagggccacuuccucgcaaagcucgucagcacauaaaugaaacauugaugagcucccucaaauuaaaaauacuguucagcuuaaagggggaaaaauguagaaagcugccuuccccucacccagggcaagaucagggaugccuugcccagguuuaacaguaaauacgagugucgucaucagggccagagaaaggauuucuccuucugcaguugcuuaguggcuccacuguucccagaaacuugaacucaauuaauuuuaaucaguucaguuuccacugacccuuucucccucccgguugcugcuuauaaugcugggucuaagugccuggcucaaugccagagacuguggggcugaaggcaaaucaaacagucgaguccacucccauuagagggauuaggaucugguucuguagagauaaaaucuacagcucaaaaaaauggcaauauccaggcggguuuuaggucuguacauaagugcucccaugcuuagacuauagugaggguuaggaacucaccaggacuucucuggcucuuuaguguuuagacuaaacaugcugggucuccuguuaaaugaaagcagccaucucuguguuugccaagucucugaugcaguuagcaucucaggguaccacuuggugauguauauguauguauauauguauguaugcauguauggauggauggauggacggauugauggaaggauggagggauggauuuaguauuuugagacaugguuuauuuggaauuuuucacuguugugcuauccauaugaaaaaacaacuuauaggauaaauuauuuugcuucugauuucagaguuuucagaccauaggggucagggcagagcagagcuggucauaucauagcggauggaagcaaauagauauuaggaaagaggccaaagcaaaauauaacugcaaauaacacacacucaguggccuuucucucaaccaagcccugccucccuaaauuucaccucuucccuaaccauccuuuccaguuuugagaccaucaacugauacauagauaagaucaggauuugcccucauagacacccccaggagcaggcucuguaaagccccuacacguugcucaauccaaucaaguugaagguuacgauuaaccccagccaggucucacuauguaggucaggcuggccuugaacuugaaauccuccuugcucagccucagaauaacgaaaucauaggucugcacgaccaugcuuaaccauggcaauacuucaaagcacacaguaggucuuuaaaacucuggcuuuuuugcuccuuaguuccuucagauuuuuccagaauacuugaucacauagcguggccuuggccacucuggaacauauugacacagugcaguguaagugagcuagagagagguucacuugcucccaggcagagggaguuggcucucuggagcacuggcuagaccucagacuucuccucaguccacacacggguaagcauacaacauuuaaaagaugaguuccucucaucucuucgggugacuuuuucagagaugaagccucgaguguauucuugugggugucugacuagguguguucgcuuuguuucgaaggauaaaaagcccaaagaacaagaaaaaagaggugauuuucuccaccguccguuuuccaagaaguuggacaagaaucugccuucucacaaacagccaucgcccucgcugaucacacagcuccagaguaccaaagcccugcucaaagacaggaaggccuccaagucaggcuuccccgacaaagguaggucaacuccauuguccugcucagcucacugugugcggguggcugugugggcucagaacagaggcgacugugccgcuggaaagggcccaucgguacauccaaggccaagggacucagaccaagcagcgggguggaucaccugugcaggguuggagaagacagagaugggugugcgcaguaugaugaaaacagagauggggugcauagcacugcagguacacgguguaaaaggagcagacacagagauauggcagcgggucaucagggugcucgggacuguggaagaagacuugagauauaaagaacuguagaggcagaaaucagaccagaaauuaguguuguaggagccgaggcugggguacaugguacuauagggacugucaucagauagauaguugugguaugagagucugcagguccagagcauguaggggcagaagucugcaugcauggcauugugggacuggaggccagggcauaagguaucacagaagguugggguguaagaauagagggagaugugcagccucagagacuggcacacaccacauucugggcuaggaugaguaccugagauugcaugaaccaaugggauagauugaugagagcaggagguggaggcaaaaucgggugcugggauguagacuuauuggaaacauggccccaugagacauucaagugugacugugucuggguucuggagugguggugggauuccccgagccaaguucaagucccaguucugcugguugguugugggccagaggucuuccuuugagucccuuaguuguaauagccacuggcuguuagagcuacuauaaauaaacucacuguguccaauucagaaucuauuccauuguugauaacugauacgugugaucaucccuggauggcacagguuugagauucgugagagaaaucccccccccucacugggagggagacuggggguguccuaacauggaaucuugagacaagaguguucucuuuauauagguggguugcugagguuuuauuauuuauuuauagaggucaaagcacagacuuugaggcucagggaggggaguggucaucugaggucaacucagacuuguugcucugcuuagugggacucugggguggcagcuccuagcccuccauuucccagagcccggccggucuuggugcacagaacauagcacuaggaagggaagccaugcuugugcaccagccggaucacugacaagauuagccauuaaugaaauccuacaucuuccugcugucacguaccaggcaucugcugccugaggagauuuauuuccgugucugaguauuuauuuacguggggaaggaagauucuccgagcccuuggcugcuccugaagccacucgcacugggcagcagcuugcuccugcagcugggcuuuaaaacguuacucagugaaaagacccugagguggauggagcugauucuuuaucagcuuggugcucuuucccccaagggucgagccucugggcggggggagggggggggacgggggggacgggggguugcccucucuuuccugggacaguuuacaaacccagaugcuggucaaugccaacucgagaugggaagucuggccgcuggcuaguugccuuugccucacaguucuguuugaaguugccgaggcugccuugauuuuaaagccacaagggaggcuugaaaaaaggaggggcaccuacagccuggaugauccuggaagguuuugcgcuaaggggaaagagccagucuucaaaguucagcuauccuaugagacuauguguguuccugcaauggccaaguucagggagcugcagguggaaugggguugucagaguguagggaaacaagacagaauggaugagucuucaauggcagcauuauuucugcaggauaaaauagcugugugucuuugccaaacuguugagugaaagaaauugagcugguaaacuuucuguuacauauauauauauauauauauauauauauauauauauauauauauuuuuuuuuuuuuuuuuuuuuuuuuuuaccauggcaaacuuguaagaaaguaucugagaggacccaagucuuuccauaguuagcaguuggaaggaagaucagauauguggguguucaguaagccagacucuguggacguuuuagcuuuuaguggauguucuguugagcagcaaaccucuguucaaaagccucugggauuuucaguuaccaaaauagaguggcuguugaauuggguuagccuggugccuccuauacccuagaaagacuugugggguucuguggggccucagauguucuggcugauucuuccucuaacuagacuaggguguuugcuuccuccugcuugcauuaguuugcuugucucaguuaagcugguggcugggggugguggcugggggugggggguggugguugggagggcaugaacacaauggcugugugugcucuuucugaaccuauuuuucauggucuuguuuccuugguauguagauuccuucgucugccgcaaucuuuuccgaaaaaccucugauuccaauuguguggcuucuucuuccauggaauucaucccugucccaccucccaggacaccaaggauuguaaagaaacuagagccacaccaaccagggccgggaagugccagcauccuccccaaggaagagccccugcugcuggauaugguacgcuccuuugagucuguggaucgagaggaccacauagaacugcuguccccuucucaccauuauaggauccugagcucgccugugagccuggcucguaggaauucuagugagaggacacucucccaggggcugcuguccggaaguaccucaccucuccaaacuccacugcauuccacgcuggucucuuuugcccacgaagaaaagaacagccccccgaaagaggaggguguguguucaccgccucccguucccaguaauggccuccugcagccucuggggagccccaacugugugaagagcaggggacgguuccccaugaugggcaucggacagaugcugaggaagcggcaccagagccugcagccuuccucagagaggucccuggacgccagcauguccccucugcagcccacagcccccuccagccucuccuuugacauggccgacggugucaagggccaguguuaaccugggauggcaagauucugggucucugugaggacagccacggaacagggcuccacacaggcaggcaccagggcaugggugaacaaccucacgggagcauccuuuauucuuuuauaccugccacacaaagucccacgcuuguaucagcugaaguccacagacucaaaguccacacacuuacuuagggacccucugagacgcugcgacuagggggagggggagggggcgaacugugggaaucacaccuuccagccugagauuuucuuugcuauaucaccaaucacugagcccucuccaggauccccccagugggcucagagcuaaaaaccacaccuccaucugcugggccaaucagauuuccagacugguaccagguugucccuccccuccgcucugugugucucucacaguucuguaacugaccgucaguggucaguuacagucucacgcggacgugccacucgcugguaaggacguucacccaaccuagggaucccucuacagagggaagcaaccccccuuucccuaacagugaguccccacagagugcugagucacagugcuggaccgggaggaagaugggauggcgccucagacagagauggaacccagcagagagaacccaggaggaagacgaagacucauuaaacgcucauuccugugcaacguuuugacagguuuuucuuuccucucuuucuuuuuccccugaccuuuucuuuuuggguugaaauuugcugaggauugaacgaacuuguccaaagagaucuuucuuuauaugaagucauuaauuaaauuuuuuuuuuuuuuuaaagacagggucucauuaaguagcccaagcuggcuucaaacucaugauccuccugccucagucuccaaagugcugagauuacaaguauauauccgugucuggcucaaaauagcaauucaaaaacaaaaacuaguuggccagaugaaaaguaguuuuaccaaauucacguguuuuuguuuuucugagaggcugcagcucagauggccgaaaggcuggcuuggguggcaacaggaggaccacaguggccugccugccuaagggauaguagccuagccauccuguguuuauaccguggcaacagcagaaggcauagaacuuagcuccagauggcucuggagagagagaaaggauucuuaaagcagaguugagacagcaagaagcagggaauucgcugugucaugcuguucugccgugguuagaacuuagcuguucugcugggagcuaggagcaggcuugccgcccccugggaacacgcucacaagacgguucguccccaaaggaaacagugccccccaaacaggcuuucaguccaugcuguaaucugcaccuuccccuccaggauugaaccaaagaugcauuuccgguuuugugacugugccacucugugugucucuuguggaaccugguguugucugauccuguccggcuggcgcuggauggaggacugucucugugugcaucgugggcccugguacuuagcagaggacaaagggcacuguugucaggaggggaagacuuggcacgggcuggaccacaguuaguuuagaaguuauggaacagcucagaaucuucuggccuuugacuauuucagauggggucagagaccagagcuguagccaggaagccagguucaucaucuugguccaucgauucuaaagugggcaaauuucugugacgucacaaagccggccuuugccagugagggcugagacacaguacaacugccucucauuuacugguggcgggcggcuuccuuuggccucucagagcucugacugaacuagaagagaacacggauuuggcugacccuggaagaaagcugcucuaguccuggcugaauuugguaagaccuggacuacuuaaacuuuagggagggacugacucccucccgaggacccauuacaggaggaggccaggcuuuucucccagagcugaugguguucuucauucagcauggcuuccguucagcucccaggacuugacacugaaaauagaacucuuuaagcagagagaagaggagagccauccacagacgcucuccguauuugaugugacguguuugagcuuugacgggugaagaguccuuuuaaaagauaacugccagcugcaggcaucuggcucugcaaagcugguaggauguguaccuguguacugugcccgcccccuuucuccuagcccuuuaugucuuuuucugacuguuugcuuuucucguauguaugugugccuguguuggugcgagccuguggagaaagagucucccauccuucaaaugcuucgagaacagcgucagauguacaacuaguuugccugcguugcuacugguaccuuggacucugaacucagguuacccaccugaguccucaguaggcaguggacccauugagaggcaaaugagaacaggagggagacaagcuguguucuggggcgcacauaaacaccugacagacgagucuaggaaaccgcgugaaagaagaaauguuaaauucuuuauuguuuuauuauauuuauacggaaaauguggcuauccuuuuguuaagugcagaguguauugucuguuugacccaugacugucuguccuucaugaaugagucuuugccugugauucuagucagccuguggcuacugaugggaacggccgaucugucaucaugugaaguccaggaggaagagucuauuuuagucauacgauuuggucaugaguaaggacuauauuuaugucaccacuauugaauauauguacuuuuauaauggcugugaaauacacuuuuuccucacaaugg

SEQ ID NO: 8321 - RNA, 679 nt, Mus musculus
gcuuuccuccacugucccguuuguccagcgugauuggccaauggggagaacaaaugauuccaagggaugcuucgagcuuuccauucucuccugcuagcacaggcugaucucuuugagugacuuaccaggaagcugggacagugccagacagggcuguaagucaggucugggaacccgggcuuaugaggaccucugcaaagcugagggggaaucagugggccuguggcaauuuagguccuuucuuccuaaggucuuaugguuacaugagccugucucugggcuuuuauaauucaucuucuucuuggaguuuccccgcuuggaacacggcuucgcccccuuccuccuugauuaacgaugugcuggauggagaacauggaugaaccgggaggccugagcugaggaggccuccagcaaacaaucguccuuugaauguguggcuguucggccugcccagauccgucugcuuugugcauuuugguucguguauuagaguuucuuaaaauaggacucaccaccgaagcucacccgggcuccgagauaaagccuugagcuggucugcagggagcagcgugagccaaccagcugcggugaugacgggccacagccucaugcugggcucuaaaucaugguuaaaaccccagagcuaaaagcaucaccccucucuggcacuuuccauuua

SEQ ID NO: 8322 - RNA, 8095 nt, Mus musculus
cgccucuugcaccuugcgcaugcgcagagguauuauucccgugagguuccggggcgcggcaaauucguaugucauggcugcuuccuggucucugggauguuccuugaccgcuugugguuaaaaccgccuggcuaugucgagcgaguccccccugcuggagaagcgucugucggaagacucgagccgcuaccugcggcugcagaagugggcaaacaugucgagcgcagacgcguuagggcuagagaaggaacggccugaggagaaggcggccgcggcggagaacccgcugguguuccuuugugcccgcugucgccggccacugggcgacucgcucaccuggguggccagccaggaggacaccaacugcauccuguugcgcagucaguucgggccgcccuccugcgucgggguuuccuggggcugcgggggcugggguggggacgagagcugucccagcaaaccgcaggagaggcgucccuguggguggcucacgagugacaaguuuuuuccugggucuuccaugccccccaagggcagcgguugagcgucauccugacguuuuaggaaggugcuuccuucaggggaguguuuucacaucugacggacucugucagcugcuuuggggacuuagcuuaguguccuugggcagucuguucaacugcuugugccucaaguuucucgucuccaaaacgagggauaaugaugggauaacggggacgauuaaauaaguguaugguauauggccacagaguaggcgaugucuuuacugggugagucccaaugcucuucgcugggucauuuuguuuaucucuuaaccccacugguuuucagaaaaggaugugaaguaauccuuguuccaccucuucucccagaaggcccccaucccuuuagugcugaaccacgggaguaccccacuucccaccagucuuugggcucuuuuuuuccccuaguccucuaaaauacaaguuaaaguugaguuaaaaguuccugucugcagguguguaacaacaaaccacacuaacaaaguguugcgacucucuuuccaggcgucuccuguaacgucucuguggauaaggaaccgaaacuguccaagugcagagaugaagacgguugguaaguaagauauuuaugugaauaugugagagaaaauuuuauuuuauuuauuuauuuuugguuuuucgagacaggguuucucuguauagcccugccuguccuggaacucacuuuguagaccaggcuggccucgaacucagaaaucagccugccucugccucccgagugcugggauuaaaggcgugcgccaccacgcccggcugaaaacuuuaauuuuaaggaaaaaucuucuaccgaccguucugugagauugcuugagauauaacuuuucaugguaauugaaugcauugaaaagaagaaaggauccauuauuugauggugauagccccuuaagaucggaaagugggaguuucuaagauucugaaaguguauuuaacacugauuuuuagggcucugaguuuggugccaaagaaaauggaaaguaaagcagaaaauaucuaucuuaaaaucuccaaguugaaaguguccuauuccugucccagugcugccugucucuuccuuguacuggcagacagaaaauacuaauacagagcccacacccacagcugacugggcuacgcagacaggccaucuguggcuguaagucacuagucccagguuccaugugcuggggccgaggggacagauaacuugucacggcugacuacuaacuaguguuggcaagugcuguccucagcagacugaguagaaagcucugccuuuuauguuugcuaccccagagaggagccgugucuugcugagguguagaaacuaguucagguaguaccucaaucagagaaucaagaggugggacugacuugaagguuuuaauaaugguuuuaguaauauucgaauauaaguguuauagaaacuggcagggaaauugcauugacauugauaaagaugauaugggugugacagauuauguuguuggcaaguagcugauuucaagcuuggaaaucucaauuucauauauuuuuaaauuuauuauuuucuauguaugaguauuuugcaaguauguauguauguucaccaugugugugccuggugccuaggaaggucagaagagggcauuggauccucuggaacugggaguuacagacaguugugagcugcacuguggguacugggaguugaacuuggcucucucucuacaagagcagccagugcucuuaaccauugagccaucucuccaaaucucaacuuuaggugauauuuuauuuuguggccaaaggcuacgagcccaaggaauuagcuuccccucggcuagagcacugauuacaguaagucuuacagggaucggggcauugccuuccucccucugagguguucugcuucccgucuugagucuuuuaaugucagcuccuuuuccaugugugucaggucuguguagcagguccacucuucugcacugacuguguucccacugaccaggcuucagauugguagagauuugagaaggagccgccuuucccugucagugaucugggguuacuugagcucuuugcuugcauggccucaacccguuguuuguauugccuuaaauugucuuggguuuguuucaccagggcccugugaaauacuguguugcuuugggaugcuuuuacguuuuucagaagguccuuucuacugaacaucuggcuaagucauuauaguggucaacgaaggcaugggaugggcuucagaagccgccuauagagcuagcaguacuaucucuguuuuccugauuucuguccuuuaccgaggagggucuuacaauugagccaguucuuguuuaaagcugcuuuauagugccucguguugcuucucaagucuuguucaaugauaagcugaauugggcccaaugauaguggccgcuuacucccuacuguuccccaaggguguucuagggucuggauuaguguggacuaugauaaagaaccuauccugccuaguucuauguuaguuuagcucuaucugaagaggaggagggaaccucagugaggaagagccuccauaagguugagcuguaggcaagccuggaaagccuuuuccucacuagugauccauggggaggcccagcccauugugggaggggccagcccauuguggguggggccacuccugggcugauggcccugcguacuguaagaaagcgggcugaacaagcuaguaagcagcaccccuccauggccucugcaucagcuccugccuccagguuccugcccccuuugcguuuguguccugacuuccuucaccgauggacuacaauauggaaguguaagcccaauaacccugugagcugcuguguagauucugggaacaacucaggugcucugcaagaguagugcugcuuuuaggcucucacccagucccucaaccccaagauauaucgacauaucuuaugggaagucuuuuaaacacaccauggaaacaauaccgaaugaguggcagauagcuuaaccaguucuaucacuagugaaauuuuaccugguggugauguuuugaccuuuguuccauauguuguugugauaauuagaaagcaucuccaugucugucuugccuugccuggcucuucaguggcucccuuugguaugaugucaagaacagacacuuagugguaacaggucccaugugaaggaggaauuaaaauacuuugaaguaauaacccauugucguguacauuccaguacuuuaauuaagaguagaucuagccgggcgugguggcgcacgccuuuaaucccagcacucgggaggcagaggcaggcagauuucugaguucgaggccagccuggucuacaaagugaguucuaggacagccaaggcuacacagagaaacccugucucgaaaaaccaaaaaacaaacaaacaaaaaagaguagaucuaaaaauccaguaagcauuugguaaauguugggacuguagaaugguaauuuagguacauuaauuugcaagggcuuuugggagacauuggacugugcggacaguuuaaagaugugagcgggcacagagggagagccagauccguggaacaggagccaagaagacuggagaaacaguuacgcagagaaauaacagaaacuucaguaaaaugccguuaaucgccuguauugacacgucucuaguugauaguaaaguguuuaugucaaaguacaguguaaggaaacaggacaggucuagcauggacauggcagaugcaugucagcgacugagguaacuaacuggucauggugacacacaucuacagucccagcaccuggaugguuggggcagaggaccaggagaccaagcugauucauggugaauacuccccaccgggcuugugcaguuguucuugccauggggcaucacccaacugugcagaacuuuugucugaaagucugcaaacccacugccugcuccuggagcagaguuacagacuggcacguggguuggccauguuuuuauuuguuucuuuauuuucaagacgguuucccuguguagcccugccuguccgggagcuuacuggauaaaccaggcuggucuugcccucagagauccaccugccucccaaaugcugggauuaaaggugugucccaccauuccuggaggucugugagugagacugguucuacggcuacaguacaggguuaaugcuuacaucagacaccagguggcuuaaaagccucaaaugcauauucucugcuucauuacaauaaaauugccucuuuuccuaccuagaauauuaaugauggguuggacauuguaaaagacaugcagaaucuguguuuuuaaauuuggaccuuuauaagcauccauccaucugucugucugucugucucucucucucucucucucuuuuccuuucucaucuuacucacugcuccccucccagucacccccucccacaguccuucccccacucuccccuccccuucucugaguggguggggucuccccuguguguccccaccuccguggcacaucaagucucugcagggcuaggugcauccucucccaccgaggccacagauggcagcccgacuguaagaacaggagacccagaaucuuuuuguugcuuuuccagauuuuaaguaguuugucucaguaccagaucagggacucaguucuggaaaacccuggcuuggcauuuguguugcccaagguggugcagccgagggcggugcuuguaguucuccugaguccuccugccuuuguucuuccucaucugugugacucgaugugucagagagaagcugugugugcugaugcagccuucucacccaccacuugccacaggaggaugggguaggagggcuggccuacagaggaggcgugugugugcaugugcaugucugccugccugcaugcaugcuugugugcauucgucuguguguguguguguguguguguguguguguaggucagggacucuuguuucacuguguggguccugagauugaaucagguuguuaugcuuggcagcaagcaccuuuaccugagccaucuugccagccccagcucauggguuugagcaaggaggguucuuaaagagauugcugcuuucucccuaagcaguggugcuucucuguugcagcauccuugaggcgcuguacugcacgggcugcucccucagccuuggcuauguguacagaugcacuccuaagaaccuggacuacaagcgcgacuuguucugccucagcguugaagccguugaaagguaggucuaauagaugagcggcugccuugugacugguucucacagaauuagguccucagaagcugugugacgacaacaguacaaaaucaccaccguuagguucauguguguucuggaguaacaauuucugaugguaaagaauuuauuugguauuggaaaagacagauaguagauuguaggaggaaauguaugaccuuucuuugaagugaaaaaucaauugaauuuuuuguuuauuuauauuuuacuuauuuuguuuugguuuuuuugagauaagguuucucuguguagcccuggcuguccuggaacucacuaaguagacccggcuggccucaaacucagaggucggccugcauguauguaugcgugcugcauguauguaugcgugcugcaugugagccugguucccggaaagccagaacuggaguuagggaggcugagcugcugugugggcgcugggaaccaaucucagcuccuguaggagcuguuaacuucucacugucucucuagaucuugauaaucaagggucugucccacaaacgugaaaauaucgaagucucuucuggaaagucauauaaagcaagcaguggcuucuuagguuugcucugcuuguccuugggucuccgggugucaugcuguuuggccaccugacuaccugagggggaggcuuauuccaguagugacauauuucuaauagaaagugaauacggagggcuaucuggcccaagccucgggaggggugcguuuacagggucucuaugaggagagaauggcuguguuuaguuauuuggugcucagaguaauggacuuagagcugccauugugagcugcuauaauuugauguuuauuccucuucauacuuuaacuuuguaaugcacugcaccucaguuacaccuuaggguccucugagaagcaaaucgugucagaagacaaggagcuuuucaaccuugaaagccgaguugaaauagagaagucuauaaagcagguaacuuuauucuaaauuuacaccuugaaugauuuccugaagugaucagaugaccccacuuagcucuuucacagugagaaagugcucauggccuguuagggagcugagcugugagcugaagcuggaucaacacugaacauauuccacacugagaccaaaaacagcauccuaaaguagaaaugcacccuucagcaaagcaauauuuaaauuguuuucuuuuucaugugucuguguaauuuguguguuuugccuacaugucugcgugugcaccauaugcauucguggugccuguggagguuggaagagggugucagauccccagugaggucucaggauugaacccaggaugucaggcucagcagcagguaccuuuaccugcuaagccaucugugcccuuagucgaauugucuugucugguauagacagcucacugcugaauacuaauguuuccugagacaggcaagauggugaaugcaugugucacuguagauggugggcugugacuaaagcuaagaagauuaucaggaugugucagucacucugcuaacgaguuugguagagcaagcauguuuaugucacauguagcauucagaguggcauggcuuagucuaaucauuaagcugaggaacuaaucaugcucacacgugugucucuccacgccuuuucaucugguagauggaagaaguccugacagcccugcaaaagaagcuacgggaaguugaaucuaaacuguccuuggccagccggggcagcugagcugugucccauccgccaccaugccccacccucauuccuaacaaacucuuucucugccuuuaauuuaggguaagagguaaccguuucccguguuugaauuauaaggccaguuuaugggauuuuaauguuuuaauuuuaauuaaaagaccagggugauuuucugucuucuuuuucuauuaaauuuguuguuuguauguauguaugugcauguauguauauauguauguauuuuuauaucuuuuaaaaacuuuguuacuuuuaauacuuugaguacuuaagaguagagagaaaaaucuuguuuuacccuugaaaauuagugcuuaagccucucuggaaaaauugucaguugacuuguuagaaugauuuaaauuuguguaaaguaucauugugucaugagacccccauuuugcugugugcuacuucaugcuuaaagagucuggaggcuacucaaccgauagugcacucucuggguaagauauuaguggacuguauuuagauuuagauuuucuauaaugcaauaccuuuauaaggaauguauucauuuuuauaauaagagaauaaagaauucaaaagugcuugaacguuca

SEQ ID NO: 8323 - RNA, 1618 nt, Mus musculus
aaguuguccucugaccuccagcauguucauguucccccuuaaauacaugcaaauaaaaaugaacccacaaucuguucaggaagaugcucaaggccucauccauucauuucuccuccugcuuccucuaucuguccuuucuccugucuuuuccuuccccucccuucccaccacaccuaguucagcaaaacaaaacauugguucuagaguguuuggcaacgucugcuauuuccugcauccacuggggaucuuggaacuuuaaaggaaauuuccaggaaagaagaagagacuacaauggcuagcuggaggaucagagcaucagugauguggagagguuggaaguucaaagcccaguaauuugggguuaccuugaguccccuccguggucauuuacuccccucccuuguauguggccauauccuucugacuauuaguuaaauacuuuaauguguacaaacagauuccccagcuuauaaccaaaaugcuaagaguauggccagguagcaucagggucuacagcagggucccacugcuuugcuguaaucugccuauugguguaccuuccaguguauuugcaaagucuguugguuuaugguauucuuugcuccguuccgucuuggcacaccucaagcaggaccacaggauuccuggcgguuaaaggucgauacgccucagggacuuguugaaauagguuccaaaaggagucauuucuuugccucugggcugggcuguuauccuagcaugugggaggcugaagcaggaggaucacugugggugagcuacauaaugaauuccugggcagccuggacaaaaaaaaaaaaaaaaagauucaaaaaacagaaagucaaaaucauauucagagaaggcaaaauagccuuucuaguuuccagccugguaccaccucggucaggucaacgacuuaggauuugaaacuuuuugcuaguggccagagauacgaaaauaggugguaagugugauguaguuuagugaagcgaacuggguagugugacugggggggggggggggggggagggggauaugguggucuuugcguguuguuucuuacugaugcauccaggcuguucgugguggcgcgccuucccucuagccuguggucuuugaaaucaaaagcugacuuucuuuagacugaccguccuucccgcccuggaguagggugaaccauacucugacccagacacacgcccacucuguagccacagcgaugcuguccccuccagcuucucauauuuuuuccuugcagugcuagucucaguaacgcuggguccuugaggcagggggcgucuuuggcucgccacagaccccuguuuuuuucuagauguaggaaagcgggucuccgggagcagacgggcuagaaucagagaugugacuugcaguacaccgcuuggaauuccuggguccacuuucggcuccgugaagaugggucugcuuacccagcacgggcaugcccgcuaacaguguggaggaacuaggugagcugcuacucauuuaauucgaagccuucaacuuucucagcagcggcggaaggagcugaaaugcccgcagauagcaccccagcaccccaguucaccagcuuucgcucaggaagaccgcaggacgcaag

SEQ ID NO: 8324 - RNA, 2581 nt, Mus musculus
uagugaccuccuuuauaagcaccaagcacacacguggugcacacacaugcaugugggcaaagcgcuguguacacauacaaagucacaaagcacauccccagcaccagugauccaaagggcuucugccggguccuaggaaccagggaccaaccuuagcucuauucuuuacauguaccccucucuguucucuugagagccucuggcugaugccucuccaacucaguccacagcgugcucauugcgagacaagcuccaguauauucucucuaccuaggacauugucaccccuuugccugacacugaggcucuggcugccccuuccucucccaccugcugcccagggcugcaccugcccugaagcugccucucucugccucuucacugccuccucccagccuugaguacugcaggcucucuggugccacucacagucuggcccgggccacaguguccucagcucaguucugaaguggacgguagucacccugaaagcagcagcucuuugguuccuucuguggcugugcuggcagggccgccaagguccucaugggguaaccugccaggaggauauugacucaauaguggcgcccaaugcacuuucagaaacaaguagaagcuggagucuuuguuaccauggagauggugaaagaugccuuggaccagcuucgaggugcggucaugaucguuuaucccauggggcugccaccauacgauccuauccggauggaauuugaaaauaaagaagauuugucaggaacucagguauguggggcaggguggggagagcagggugaagggccugcagccaggcuccgggugcugggguaggacgagcauggcuuuccccucaagccccuuccuguguuguauaacugaccacaggcagcccucgaagucauccaggagucggaggcacagcuguggugggccgccaaggagcugagaagaacaaagaagcuuucugacuauguggggaaaaaugagaaaaccaaaaucaucgucaagauccagcaggugagcaccucugcuucccaugucaguacugugggucccucugaccccgcguggaccuuacccuguguccucugaccccgcguggaccuuacccuguguccucugaccccgcguggaccuuacccuguguccucugaccccgcauggaccuuacccuguguccucugaccccguguggacuuuagcccaguuuaaaguagaaauuuccuuucuauguuguuucgaccugaaaagcaggucuacacacagaaauguccucauacugacaaugcagcccaccgggguuauagggcuuuucaggcugcugcuguugugugcagaaaagggugggaggcaaggggagccauucacccaaggugucuagggcacacuccugaaccauuacugcguacuuuggggaacaaggcuuggagauuucuguuuccuaaguuaugacucugaguaucacccugucugugcuggaccaugauauagaugguguccacuacaaauccagggcgccagccauauccaugcccaugcccgaccccacaguggcuuagcagcccaucaucuuagcuguuagcagagacagcuauagaauaaaccuguuacucucugaugucccugcaaagagaaugucuuggcgcccuguugacucugcccuugccuuugcagagagggcagggugccccagcccgggagccugucaucagcagugaagaacacaagcagcugaugcuguucuaccacagaagacaggaggagcucaagguagccauuggguggcaggggcaguggagcugggcacaccgugcaucccgugccucccccacgggccgggcccucuaccauccauccacacagugcuggggaaggccuuccagcucuccaaggcugucuccaguguuagaccgugggggucccacuacuggcaggggcgugcugggguggcaggaagugacccggguccuucccucagucuauaugaacuaccucugaaguguuguccugaguaaggcgcguuuauuuccagaaacuggaagagaaugacgaugacuccugucugaacuccccgugggcugacaacacggcuuugaaaagacauuuucauggcguaaaagacauaaaguggcggcccaggugaagccaacacuugacugucagaaccucaacccaccaaauuccuaccuuccugguuuuccuuuaguuugaauuuuugaaauaagucauucacaguuuuagaacuuaauaaauacacauucaaaagagaauguuuuaggacagcugugucacaucuaaggacuuaacuuguuggugucaugagagccaugucuuuccugucccuuaccuugugugugccuguguuggaguggaucugaguuuccucuguagcaagauagccagcugguccguagcugauguggaacucagccgucauggccacuagaggccgcuggcugcagucuugucauucuccauguggauggguugaauucugaguuggcuuuagguuaagacacuagggcaaugguucucagcccaggguugacccacccuuucacggguguugcauaccaaauguccu

SEQ ID NO: 8325 - RNA, 829 nt, Mus musculus
acagaaaugaccuguuuauugaauacaccaauagauccuugcccacagaugcacuguuuuacuguuacuaguccuugcacaauugcuugagaaggccuuuggaaacauucaccgcgcgcaugcacgccaccugccagccaggcaggcagacguacaaaacccuggcgagguccggcuggggcuucacgcugaguuuugccaagcuccgccggguucugacuccuggagugucuuaccgcacacgguugagcuccaaagcugccauucuacaguccuucuggcuuccggaccuccaguccucacccccacucuccggugccagaagccuugccugccaccgccaccccgggaggauucugcgcaaggacaccgcucuucuuggcagccaggcagaaucgcugccugaaugcuaguaggaaggaaggaaggaaggaaggaaggaaggaagggaaaggaagggggagagccaggaccaaauagggaaccagggaaucggugggaggucugcgcccuggagccccgcgagagucgccccagccgguuuggcacuggcuccuccugggccgccaggcugcggagcaaaggccggcccuuacacgcacccggccuuuugugcaaaggcaacacaaaggagagggaaaaacacgucuuccguuuugaaggaggaggccaacagcucaggacgccuaggcaagccaggaacucccggagcccggccugccgauuagccuaggcaagugaacucuccauucccagggaaggcauauugguccagcugcguguguugguuggaaacgcgucucuagggcccacccaggacacacaggca

SEQ ID NO: 8326 - RNA, 2197 nt, Mus musculus
guaaaaauucaacuguugacguuuuauuuugugauuucuguacaguucaggagggacagaguuagaggucaaauaaaaugccaguuaaauucggcuacugucaacaacccaaaacuuccaacauaaaaaagaaucaaagcaagcuggugaagauuaugcaauaaucuuggguaauuuccuaacgcuagucacaagccaagacgcggcacccacgcgcgcacgcguccacggaguucuucagccgcacugcugugguuaaggaccagccugugaagugccagcgccuucccgccugcagcgcggcggguaggcgguuugggauccucgcccaacuccgcuuacuuuaaugagaacguuaaugaccgaauuuuauaagccugcgcuacgacgugccuugcuaccuauuuuaguaaguccgaacaccgauggcauggaacgugguuggaauuuuguuuucaagcaagcucaaacguugguuaagcuaccuuuagggaaguggagacuaaguaaggguuuuagguuuuaaggagcauaaacugcaacaaaacaccugggcgagccugaaaaacagaacugggaguggagaggaaccucuccacuucgcauccccaaccaccgagcgcgguaaccgagcgcacccgcguaacauccagcucggaaacccugggcuuuccagagcggcccauccguaacacccuugauguuuguaccgguggccugggcuuucuagaccuccuagauccgcaugguuuggcuggagagagcaagggagccugugcgcucaggcccuggacaaggaaaggacgccccucuggguagacacuguuggggagcagcucuuaggccagggagcggaagcaugccaggaaaccaagcugggggcagccuuucgcugcacccagggcaacccccuuauaccgcaccggccggcuaccguccuccccgacuccgcgaugcucacggauacgagaauagcccgcggugguggggguugucaccccugccagugggugaguugugguggggaugcgaagacuucuggcucuaaacaggugggauucaucuagaaucccaagcaacuacaucgcuccuuggaacacccgcuuggguuauuuuaauugccagggagugggggcggggaagaaggcgcccuacagucugucgucugggagagaagucuggaaauguccuccuuucuggggccagcucugccuagauccaggacgcgggggcgcgggaagauuggcugaggucgcgcuccgccccgggcccagccagcccucacuuggagaacugggccugcaccgcugccaagcccaggccggcggggaccagaugcgggaacuugcacaccgcacaggagcagaggccagggcuacccgcgccaccagcugggagagagaacuggccgcacgguggcucgucgagcgcuagagacagguacuugguggggcgcagcguuucggggggucccacggcaccgggugccagcagcacagagcccggcgcggcagccagaagaggcaggccagcgaggagcaggcgcggggcggcgggucccgcaccgucgccgagcgcgcggcgcagcuccugcagcgagcuacccagcagcaggauguaguugcgggcgagcagcagcguggcaaucuuggagagcuugcggcccggcgcgcccuggcagugcgcugccgaguaggguaggauaacuucgcgcagcgcguccauggccaaguucagguccugcaugcgcuuccgcucgcggcuguugaucuugcgccgcagcugcugcugcugcuguuccucuuuggcgucggcccgggcgcccccggacucuggcgcagguccccgagguucagcgagcggagcuucggccuucucgcgcgcaggcuuggggagaagggaugcgguggaagaggaugaggaugaggaugaggagauagguggcugccuguaacccaccagcucauacagcgaggccccgagcugcacgucuccaggccgcuguggccgcaacauggucgcgggagccgcguucacacgcgccugggaaaucgcauaguacaucuggggcgggggcuguggggcgacccggggcgcccuucacuaacgcccaggggugggccggucggcagaucgcccuccccgcggaccugcgugccggcggaugacagugaggggccgugcgcgccugacaccu

SEQ ID NO: 8327 - RNA, 19673 nt, Mus musculus
caggauggcuucuuagugcacuuagcuugaggccgcccucgaggcuccgguccucaguggggcugcgggcggagggagccagaggggaguggccuggccgcccggcggagguuccggaaagggcgcgggcggccgcggggcugccgcacggggccauguccugggcgccgagcguggcgggcuggcuggguggcuuccuucuggugccaggugaggucggcgagcaggggccccgggcgggcaggcuggcaggcuugggaacucggaggcggggcguccccaaggcuuggcccaugggcuccccgaaagggaccugugcggcgcccagcaccaggaaggguaccccucgccauggucggggcggggggugcacacccgcggcgaugcgcugccgcuggcuagauccuggguggacccuucccgagcccgcagcuguuuccaggaugucuagaagguaaaguaaagcggggugcggggacaguuguugacagcgcccccagccugcccccgaaguucuaacugaaaccagauuuucugagcacccccgcaguggcugucugguccuuagggacacacaccggaguccucccaggccccagcacuccuuccucuccccgguccucugcagcgccagcuccccuucaccacaucucccucuucacauguccacacccuaaaaucugaauucugcccuucagcuccccagagagcugcuggggacucuucuccacaacuggcuuuccguuggcugagcucucgggauuccccaacugguucucagugggauucucuuccugagcccaaacuucccaggcagccugguguugaguaauuaccaccacacuucgucucuguuggcaacagcugggugauaagugguuuagaguuuacugcgucaaaacuuaauaagugauuucugcccuuagcccaaagcugcccucuaugcgaccucaggcucacucacccagaggucucucugacaguccuucuugggucuucagggagaccuauucugcugcugacucaagacucccagguucccugccccagcuccagccaggguuccaggggcuucggccagaaauccuucucauuauagcuucaaauaaaaccuagccuccccggcauagcuaacacacacacauacacacacacacacacacacacacacacacacacacacacacacauccacacaacauuugaagacauggaucugagagacccaaauauuggauauagucguuuucuuggauuuaguguuuguuuguuuguuuguuuguuugucugucuguuugguugguuuugguuuuguuuuuuguuuuuuuuuuuuuuuuucguuuuuguuucauuuugauuugguuugguuugggucuugcuuuguuuuuauuuuuguuuuguuuuguuuugcauaaacauugcuaccucucccguccuccuccucaucuuuuucagcucuaggaaugauuccacccccugagaaggucagaaugaauucaguuaauuucaagaacauucuacagugggagguaccugcuuuccccaaaacgaaccugacuuucacagcucaguaugaaagguaggucugggggcuguucuuaagucagaaggccccuccuucuaauuccaggucuugaucugccuacuguguuguuacccaggguaguaugacagaagucacuauguagcccaggcuggccgcaagcugaaguauuugaaaaggaaagcaggugccgcuguuacucccaguuauacaccuagggcuguaaaagucagcccugugcaaagggggggggggggcaccugaaaaugccaagugugcacaccggucaggaaggcacuugcuucguaccaccuacccuccacugcagaccuucuagaccaaucugggaucugccaccaccacugcagggccucuaccuguccuuccugucugcaaguccccauauccggugaagggugcaggccagccuucccuugacagccuguccaccuugccuauuggcuggaugccagguaacacaccagcagcagaaggaggcccagggcccaugaaccagcacaccuggccuggccucucggugacucagaaacguggccagacagacaggccauagagaacaugccuuuccagaucucgguagcccugcccuguuugucccagcugucauuuuacauggaggcugaagggcucuacauauauacauaauauauacuuauuauauaauauauacuauauauacaccauauuauauacuauaaaaaugcuauaucauauaauaaguauauauguauguguguauauauauguguguguguauauauauauauguauauguauauguguauauauauauauaggcucgagcaccuacguugagauuuaccaauauuuagcauuuccuuuuuuuuuuucucccugaacucucugacuuagaaacuguauuaauuucuuuucucguugcugugacaaaaugucugaugaaaggaacgugaggaaggagaggggcuuuguuuguuuguauguuugauugauugguugguugguugguugguugguugguuggguuuauuuuggggggggugggggcuugguaagagguugcaguccagcacaguggcagaagcagcuggucacacacagggcauccaccaggaagcagacagaaagcuggcacucagcuugcucucuccuucuuauuuagucugagaugccaguucaucagaaacugcugcuagcauccaggcauccaggacaucauaaaccuucuugcucuguugaaccuuccucgaagcucucacagaccuacucaggucauuuccuugcugauuuuaaauuccaucagguugacaacgaaaauucagcaucgugcacacauacauuccggucuguguuucauaaaaacaguguguccuguuauaccucaguguaguugccgacaguccagagaccaguguguccuguuguaccucgguguaguugccgacaguccagagacuguaguugauaaaagaccaucugcagcagcccuaggguggugcuccuaugaccucaucuccuugucuucuccacucgggucuggaaagacacagcaauuucacuguggagauuaacucccuucuucuaucaguggcuguugcuguuaugaaaugccugagccugguuacagguaucuagcucuagauggcagaaggacaaaacaaugcagggaggguguccugagugagugacaggacaggacacuccagcaggagcuuaagagggacaaaccaccucucucucucucucucucucucucucucucucucucucucucucucucucucucucugcucuucucugugucuggcuggcuuuccaggguugggugauuccagcugucuguccuugagauggaaaggccugguggcuucuuggaggcagagaacuggaggugguuauuaacuaaggguuaguaccuugccuccaggguuccucuccauagaaccacagauggguacacgguacauaaagaauaugcagccauguccuuaggaaagacacugggccugagcggucagguuguuaugacuuauaugaguccauaagguucgcuuugacuucagcccaggcaggugaaugcugcuuacaaggugcaauaaacccucugcugugugcgaaguuuaccuuugucccuugucacuugggcaacagagggaggcugucauccaggggucagguugucuaaaauaagacacuucaaaggguguguuggugauauuccuacagaaacauccaaaauguaaguaugagagacacuccuaucacacacuuaccagaaaaaaaauacucaucuaugacaaaaaaugaaaagaggaguugcuacaagauguccucugacaugcagcauggucgaccaccaggugugguaacugaauacugcucuacgguagccgaacgauaggcggccagccagaagaguuauucgguuggcaaaauguaaagccugaguuuuucuucccaaccacuuaauucccagcaauaacaacucagagacugauuauugaucaguaaaugccuagcuucagcuuauucuccaacuagcuguuaacuauuaucccuguuauuccaaguucagcuaugugccugguuucuucucuuuaaccuucaggggcaaaucuuccgcaggccucacuauuucccagaauucucucugucccugcuggauaucacgccuccuacucccugccucaguucauuggccauaagcuuuuuuauugacaggcaauacuuauaagagauaugcucuacagcaaaaugugcauauauauuaagugggagaggcagaugguacaagacuggguucucaguaguccuuaccuaccuuuugcaaagcucugggcaccaauaacaauggagugagccacaauguggucccuagagcccuaaaggcaacagaacugaguguauugagggcgcuugcugcuuuugcagagaacucaaguuuaguucccaguaccugugugggguagcuugcaggcaccuguaacuccagccccaggggauucaaugucuuuuucuguccuccaauggcacaugcacacaugcacgugcgugugcacacacacacacacacacacacacacacacacacaaacaaaguaaaccuucuuuaaaagggcaaaggugauccagacacacacacacagaggcauggguuucuugugcucuuuuaaccucagacuuaauauaacuauuugcuucaggcuccuggugccuucuguucccuuccauaacacacugcaaccuggaccugugaacgagaauaaacuuucugccucgaauugacuuugccagaauauuuuaucauagcaacaggggaaaaaaaaaauccaugacagacaaaaaggguggccgagauuggcuuucacaacuagacaggaagguguagugggaaccagucagacagcuccuuacuuacaggaagggagcuccuauuuucuuaggcugggggcagcuaauuacaccucuccaggcugcugugggcgaguuaggaauucuauuugccaagauuccugccaugcuuccugcugcucucauucugaggguggaugaauuguuuuagaauuuguccaggaucuuugcaaugugagucacucuugggaagugauuugaaaucaucuuauuauuuccuaguuaaucuguguaugucaaccauagcccaaucguagcccagcguuuucagaaaugcacacucaggaaggaagcuuucucagucagaaguguugaauauacaaccugggguguggagccaugaaagcuuauuuagauauuaaaguuucugcugcuaagauaccaauuuuuguuuaacucaauuucuccacaaauuacugaguauaggauggauuguauuuuagaugccuugagaucauuaagaucuuagggaacacauaguuuggaagauauuaauuuccucaugcguacuauuuauccaagcuaguggcuacugggcacagugguacacagcugaaaucccaacgucggagauuuuaaaucggcaggaagauuuuuaaaucagaggccaaccugggcaagaggaggagguucucuaaagcaugaaauaaaaacaaagaaggagaaagaugagaagucuuucuuuuaccuuugccauaaaagggaauaaagcaaccaucuucccagaagcagcaaccucacugccuuugucuuucugguuguguaguuacaggucuuuccaagaucacugcaagcgcacugccucgacucagugcgacuucucucaucuuucuaaauacggagacuacacugugagagucagggcugaauuggcggaugaacauucggagugggucaaugucaccuucugccccguggaagacaguaagccaugcauguuuccacuuuguuauaucaagucaucuuaccuugcuucuguccccaucaguaagaauguuuaguaggccuacagaugaaaugguccgugccaugaagcgugggguacagcagggaugcugugucuguaaguucauggauucauggaugaagcagaggaaaauacacaugugcugaauaaaauaaaugaauauaaacuugguggcuucgcuacucacaaauauggcaaauuaaggccagugcuguuaaugagggaauggaaaacucuagaagaaagucagugugagacuaugaauuaagccaagagauaggggccuggaaaauggcucagcgcuuaagagaacuggcugcucuuccagaggacuuggguucaauucccagcacccacaagucuacucacaacaguguauaauuccagucccaugggauuuggcaccgguucuggccgcuuugagcaccugguacacagagcauacauacaggcaaagcaccauacaccuaaacuaaaaauaaaaugcaaaauaaguuuuaaaauaugggagaaguggagagagguagaugcagagagagaaagcccagugcagagagaccacuguccuggagaaggguggaagaaauacacucacugaugguagacucugcugaggcuggcugguaagcuuuggaaagaagauacccugguuagaaguggaggcuagggggacccagagguccugagaugcacauguuuaaaguaucaggaauugaaaaccaguuaagcugccaucaagcaucugggagaauuagagguuacaaaaacaucagggacaaagcucaaauaaggcccucccaggggcaucagagggaauacccgggucugggggccagggcuuauacagguccuuacagguggguucuguagcuuccacagagagaugcucacucagacagaaugaggcgaaagucccuuguucucuuuccaguucugucuuaggacaagcaccaaacuuagaauucugcaccuggaaauggccaguuagucuucuucgcuaaauguuccuuucugaaaacaagggaaggaaaugaccguugcaaaaagacaguucacugagagucaggcucuaaaacuaaaccggucuucagugguuaccaaggguuccugcaaacccaucucgagcagaagauaccauaaaucaagagugcauuuggcacgccuagccugccaugccacacccuccugaucccaugacugauggggagguaacagacuacagccauuuccuugaacugaggggauauagcaauucaaaggucaaaggucaaaggucagucucuguuuccugccaguaucuuucacacaaccauuauaaguuggggaccguuugauagauaaguuuccacuguaguaauuucuuauugggccuggcugguucuaagucuuacauuaugucccagggaagccaguucucuguagacucagaucaaagagcaugacucaagguuacacguguaaaagugagagagcagagacgcugacacaggccccuguggcuuagcaagaggccccccucaggaguggcgauggucagagaggagaacacaggccaaucuuccucagagucuuuuguuauuccuucugugguuauuuuugagcaccuacugugugcgaggcauguucuuagcacugaagcuacaacaacaaacaaaaacaaagucuugcccucaucgagugcucuagacucauaggaagacuggcagcaacccaagaggcagauauuugacgguacagagugaaugcggcucucaaaguggaaaaaucaacaggaaagaggaauauauucuuaccagagagccacaguauacaggcuccccagagugacguuugaauggauggagauggagaaggggugaagggccuagcuacauaagcaaaagaaaaguuguaaacuauauauaguucuagaugauaaauauuuaugaguaaucccuacaguuacagaaauaucauuuguagcuuuaaggcuagaaaaugaaaaagaauccaagccaguagaaggcauaaaacaaagagaaagagaagaauuuaauaaaauaagaaauguaaaaacauauugugugugugugugugugugugugugugugugugugauugugugugaagcauggugauggugacaugccuuuaugucaugucuguaacaacaguguugucaagacuuaggcaggaagaucgaaaguuugaggcuaaccuaggcuacguacugggaugaccccucccuaaaaaugccauuuuuacaaacaauauaaaacaauaggauuggaauaauccuaaauuuauuagauauuacugugaacauaaauggauuuaauucaauuauuacagacaaaggauuuuggaucuuuugaaacaagcaaaaaaaaaaaaaauccauccauccuccugaggcacuguagaugguguaucaagagccagcguuauccuucaguagauaguugcacauauauaugaggaauucguguucgagugaaguguuuaaaaugugguuuuuugauugucauucugguguguucuuauacucagccaucauuggaccuccugagaugcagauagaaucccuugcugagucuuuacaccugcguuucucagccccacaaauugagaaugagccugagacguggaccuugaagaacauuuaugacucaugggcuuacagagugcaauacuggaaaaaugggacuaaugagaagguaaggccgccucucgagugcaucugacaugaguauugugcucuccgcucaguuugguaagcugugaugagagagaggaaugggcacccagggaccacgcggggaaggcucaguggguaaagucuuugcugugcaaacaugagggacagaauuuggauuccccaacacccaaguuuaaagccagggaugcgcagcgguagucacagugcugagagauggggacaggagaauccugggaucucacuggucugcuguuuuaguccuuuggggagauccagauuccgggagagacucuguuucaaaaacaagguggccagugacgcaggaaggcacugaugccaaccucugacgugcacacauacacauauugaugugugcucacaccuaugcauguauacauauacauauugauguauguacauauccaugcaugcaugcauacauacacauauugaugugugcacacauccauguauacauacauacacauauugauguauaugcacauuuccaugcaggcauacauacacauaugggugugugcacacauccaugcaugcacauauacacaaauuggugugcauacaucuaugcaugcacacauauaugacuggucagagucuugcagaguagcagcacuucuuguccagagggacuaaagccugccccucugcaagccaaaagcucuggaaaagacacggggcagacccuuaggacgaaguccacacaacagacuucccucuccuagaaaggaaguugcagaagaaacagggcauugucagcacuuggcugggggaaguuggggucagcagccaugugaccagcugucagcugccaugugaccagcugaaugaccaguuuuucaucccauagcccccacaauagcacaagccagucacuucauggguauagccccucccacuucccaagaugucuaaggacacuguuauuuucuguuacccuuccuauccauuuuuucccguugcucucuucuuuagggagcaauuacuuuacaagaaauuuuauuacauuuauuucuucaugcugaagggcaggccacaguccuugagaucaagucaccaggccuuuccaaaccugagucauuucgccagcucacaggacaauucuuuugaaaucaaagcuuaauaccaaaaagucuggcuggaaucuuuccucugucaccacagugcucugaucacaucgaugaccucggcuucuuuagguccacagagugggcacaagaacccacuucauuugagaaacaggaaguaggugccaguucgcugaacugcgguggcauuugcugacaaaagccaagcuucuccuguuuucuggaacaauaugagacucucuucucuuuauaaagauagaucuauuuauuuuuggucacacucggugcuucugagcugaauaccuaaacuggcauauaugcugauaaaguauuuacaguuaauguuuaucaguuccuucucauaaguccgagaggaagcucacuuguguuuauugucuuaggaugguagaacggcacacacacacacacacacaggagaacgaaacacaaauaucaaguuaauuuuuucacacccccuacacccccccccaaaaaaaaaccuuccacugcuuggagcugugcuguagucuauuccugcugcugugacagaguggauaauuuaugaaugauguucuacaggcagcagaggaauccaaggucaaggcacaguagcagguccagugucccaugaaggcuagcccacuucgcuucuuaggguaauggcugaugcugcacccuuugauggccgaggugaaggacaaagggaugaaccaugccuuggugccucuuucagaagaucauuaaugguguucaugagggcccuuggcaaucuccuccugaagaccccaacucaaacauuuuuuuaaagauuuaauuucuucacuaauguaugcgcaugugugugcgcgugugcgugugcauguguacacaugcuugaacacacguagaacuccaaggacaguugguaggagucuguucaccuuaccacagccuggucuucccuuuuacuaucaucacauugguguauaaaucucaucauaagacacacauauuuagaccaaggcauguaggacaucugccuuggccagagguggcuuugcucacggucgagacuccaagaagaacauaccuaagaggcaaaacaaaauaucuaguuucagaaucacucaccagcgcaacaucccugcccuggaacccaaggacaagaccccauucauuacaccccagggaugaucagcauugucuaauuaaggauccaguuuuguagucacuguggcugagugccucucucaccaggcgugacaugcaaaaccccuguuauauuuagcuccuuaucuagaauacacccacagcccuggcauuugguuacauguccguccuugggcuucacgugaugugcaaaugcuagaaaguccgcugacuccuccuucauuccccacaccguuguauaacacuaccuccuaaagugcuaacaucccucaaaggcugacagaucaguuccacaaacugauagaguggagggcuuuggagaacuccauuguuuuggugggaaaaagcaugaaaacagaucagucaagaaauaaagggacaagagagaggaaacccccaagagauuugagaaggacccucaccucaccuucaaaaucacauuacaagguuugagaggcauugacuaacagaaguaaaaucuagacggugguguuucuuuguugguuuguuuguuucuuuugucuuucauugguggugcuuuguuuaucugggggaguugucagucucuuccuggguucaauagauacaaugcaguucuugccauggauacugacaggcuguuuugguuacugaaacucagaagcguaucauuagcuaugaguuccugguauuggaaacuaguuaaggacgauagucaucagggaagaaugcagggguauccugaagagagcaaaagccugaaucagagcccaccuagacacacauaugaggaaccccaaacagcaagggucacaaacgugcuaugaaccggagcacguggaagccucacugaggagcaggacagggagcacguggaagccucacugaggagcaggacagggagcacguggaagccucacugaggagcaggacagggagcacguggaagccucacugaggagcaggacagggagcacguggaagccucacugaggagcagaacagggagcacuuugaagccucacugugcaugguuccucuuaccucauuaggauuccuauuauaagaauuacaaacuagguagcuccgacacagacauuuauugcccaacacuccuggagccugagaguucaagaucaacaugcugcuccccugaagaugugggauucaugccauaccuuuccuuaacucuugaaagcuugcuuggcuucaaagagugacuuuagauauuggccauuuucuuaacaugacuuucucccugcgggcauacuuaccaauauguccaaacguuuauucuuuuaaaaaaauaucaccuuuaaagcucucucucucucucucucucucucucucucucucucucucucucacucuccuucucucucucucucucucucguguguguguguguguguguguguguguguguguguguguguuggaauuaaaguuaugagacaccaugcucagcaauaaauuuaaauuuuaaaagagcccaccuccaaauaaggucacauuuccagguguaaauacaugcaguuuugugggauguaguucaaccaguuaaaagugauuuuuuuuuuuuuugguuuucuuuuaacugaauguauuaguuaaugaacaacaccauggaaaccccuuugagggcacugcccacuacucguccaggggaucacaauuggggaauauuuaacccucagucaucuggaugagccaauucuccccugccaugucuucaauguaucugcauccaauuuggcaaacccccuccuuuugaacuugcuccuacuaagagucacagccacgugugccuaguguagcauuaguggugaccugaccggugugaauccuagccagugugcccugccacaucccgaaggugucucacacgccugucugacagcaaggauaugaauaucuacuaggaaaucccacuccauguuuccuuagagcaaucuguacagguggcgggugucaccuauccccaaggagaaugcuguuuguaagaauggcacccugggccucauggggagaagagcccggcugcuuuaacuggguacaguaucuuuuuaaagggaagugugaugcuuucgaugccacccaugcaacagaacugaggucacaagaugguuagccugcuucacaguuggucuugcccuauucuuugggauacaacaugugucagaagcuggaaggaguuccagccagggagugccucuuucugauauuccuaaaacacaaagguucauagaacaugaggaaggaaaauaaagagaggggcgacauccuucacugcuaugucugucucccuuccaguuucaaguugugucuccguacgacucugagguccuccggaaccuggagccguggacaacuuacugcauucaaguucaaggguuucuucucgaccagaacagaacaggagaguggagugaacccaucugugaacggacaggcaaugacggugaguagagacggggacagccugucacugccugcucagagcuccgugggcccuagacaccauggcagucagcuccaacugcaccacaggucagagaucagccuucuccuugucugcauggucuccagacccugcuucaugcuccaaacaaggugcccuaugcugaggacgcuggcucucucucgccaguccagggcgcugcaggaugccucgaugaaucuaccuuuacuaugcucuauuguccuuccagcucucugaaguagguuaauugguucucacauggauacccagcagagacugagccuggccacaucuuguuuuuccuucccugcaucuccaguuuugacgacacauaaugacugggaagggggagcuuggaaaacaucagugaccucagauaguaccauuacguacugagaccccuuguaaaacgugguccaggauacaguggucuaccaggguguucuccacacuguguguuaacagaauaguaguuuaggguaugguucagugaucuaucaugugcaucccuggauucuaccccacagaacaacauucugucuccugacaggauccaaacauuuuuauuuuaaaaaaagaaauagaaaagcuguuugacaaacucccauuuuucagggauuuuuaaaaucucauuuagacaucccagggauucagaaaaggaagaccccaagguucuuccgacugcccagagucaccuggcuaguggaggacaaagauggaacugaggacaagcugguauaucuccagaucacaucuuuaacucucugccuacggacuaauuccaaagauagccugacgcguccugauccuuaaaacaaaaauaaaaaaauaaaacguggucugccaauaauaaagucaaacagaucuacagccaggggaauaacuucaggcuccgucaauugcuguguaguucacacacuagaaagcagucucuugcccucacccucuguacuuauccugacgagaauguccccauuagucagguguguccuuacccacaauaccaggaaaacagcuguuuugucccaccacccagaccugagagaucccagcagcacuggcucacccugccacacuagaggaugaguaagagccugaagcuuucucaggaacugaggugaccucauguugucagauucuuccuagcagccacaccagccagcucucuggauccuccauuuaucaggaaaacuacaaacagccucugcugagacagaaaggggcaaagggcugugcagugugaaacaagaucccagggacaggguauaguucuuccaaucugcagacagugagguggguuggucaggagacugguggguguggaaaugccaacacaggaggacauaagagggaaggauggagguggaagaugagacaguuucuucccagacucucacccauacaaaugcucaauccaaccaucagucuauccacccauccauucauccaucagucuacucacccauccauccauccauccaucuaccgauccauccauccguccguacauccaucuguccacccauccaucuaucaucuauccauccauccauccauccauccaucuauccauccaucuucuauccauccauccauccauccacccacccacccauccauccauccacucauccaucuauauccauccauccacccauccacccauccauccauccauccacucauccauccauccauccauccacccauccacccauccacccauccauccauccacccauccauccauccacucauccaucuauauccauccauccauccauccacccacccauccauccauccauccacucauccauccauccauccacccauccauccauccauccauccauccauccgucuauccauccacucauccaucuauccauccauccauccauccauccauccauccauccacccauccauccauccauucgucuaucuuuccauccagagcaggcaggcuucuggcugcucuacaaacagguaaagcaaaccggaucuugcuuaucauccccuucauagcagaaaccacacugugaagaggaugcagaaaaaaggggaaacccaucaaaacgacccuccagccaacagccaugccuuugggccaguguggccagaugggcuugaucugagguuuuguguugggucacguugggugugugaucccuauaacucaaccugugugugcuccaagagucuaaccugccucacuguccccaccagaaauaaccccuuccuggauuguggccaucauccucauagucuccguccugguggucuuccucuuccuccugggcugcuuugucgugcuguggcucauuuauaagaagaccaagcauaccuuccguucugggacgucucuuccacagcaccugaaggagguaggcagaguggaaggaggcaagacuucucuaagguugaggcuguccagcacugggcaacaugaucuccaagagcauacaugauacauguccauaugcuagccuauucccaaaugccaaagcagcaaagguuuguuccagaacucuccaccccugaccuggguagcaccuucuucacugccuggagcaucgaguccuuggguucauagguaaugguucuggcaggaaaagagggagcagaauuugaugugaagaauuagccugcuuagccugcacugagcugcugcagaggguccagccugggcucacagcucuacucucugcuuugagaguguccucaugugauugacuaugaaguuucccugguguuuuucccccgacacauauuuuacagaccugcaggaucacacaugcaucaagcuuaguuagcaugcaggcauugagccguccaccagccugaaggucuggcugcuccacacacaugcugcagggcccguuccacccugugcuccuccugugucagcacccuuugccucucccacaaugugccauauucccacaaguggagucugaugucugagcacccgggaagaucugccaagcagagcacuuccuucucagugugggauagacgagccaucguucgccuucuccaugagacuccucaaacuugucugauauacaguucuuccuagagaagauuccccaacucagugagguuuuauuuauuuauuuauuuauuuauuuauuuauuuaucuauuuuguauuuuuuaauuguaugcuuuauauauuugcauuucaaauauuauccccuuuccaguuuccccucuggaaucucccuaucccauucccccuccccuugcuucuaugaggauguuccccacccacccacucccaccucauggcccucaaauuccucuacauuggggaacugagccuucacaggaccaacagccucuccucccacugauaccagacaaugcuauccucugcugcauaugcagcuggagucaugggucccuccauguguacuccuugguuggugguuuuagucccugggagcccugggaggucugguugguugauauuguuguucuucugauaggguugcaaaccccuucagcuccuucagucuuuucuguguugggguccccgugcacaguccaaugguuggcugggagcaucugucucugugggguuuuaaggaaccccacuaugagcaauuucagcugccagaauuccuagaagcuggggacaugaugaagggaccauagguaauacaggacaguacccacagcuaggaagugggacauaggaagugggaccguagaguuucagagcagagagaauuucuggacagcagugcaagcaaguuucgcagcaccuagggguggagaaucucagggaugcgcuggugugaaguuaguuggagcaaggacaaagagauacaggcccuaggcucuggguaaaggguguuuucuuucccaagaaccagaaaguaaagucuuccccugggauuucuccugcuuggcuaccccaucaaagaaacuggucagacaggaaggaagagcaggugaaagccaggcagguacaggcaaggguccuaugggacugagcccccaccucagaggccagcgggccucacaguagcuagggggauguugggguguagagaaacaugaucaggugaagagaaaggaagcugcagagcaaacuaacaucccccacacccccgcaccccaguccaacucaccaugcagaguacauaacaacuuggcacauucagcuucagggagacugaauuucugaagcuggauggagcuguccaacauggcgcugcugagccagcaccugucucaguauuacaggguuuuacgaaacacaggacauccaaaauaacaucauuucaauauuagaccaauacguuuuugaguuauuaagguauuuuacguuuucucaugcaaaaucuucaugucucucaagacacacuauucacacucacaagacacccuccauucaaaccagccacauguugaauggcuaggagccacacauggcuuguggcuacuguaccagacauuaccagguuaaaggucaaaauggagugccacagagggugccagugaacuuggcccaagagacaugagagauaccaugacacauuuauccauggccugugcacccucuuccccacacauaccuccaccccccucacaccccacacaucugcuuccuagagaaaaugguagccaggagugucccucagccuugggaucaggcuaagaggccaucuuguuuuucaggaagaaguauuagagaguagcaagugagcaguuuacagagaaguuugcccugcccuuuuuaguugugguuaaaaaugcaggcagccuggcauucacaccuuagucacauuucagaccacagcucaguggcaccaagcauccacagagcccguuccacuugcauagcagacaauguucaggaguuaguccucuagaauggagucggggaucacucaggugacuaaucacaccuaagugugugugagaagcaucauucccagcucagccauugcagcuucuacuaaaaaacaaaaacaaaaacaaaaaaccagaauaauauucugcugaagugucugcacauuuguguguccaucccugaauggcacuugccguuuguucuacugucugcccucuguuagcucuaguagaugcgacuugugagccucuucugcaaaccugcuuucguuucccuugagaauauaccuacuacccgugaacauagucucgccaggacuugcuaggucgugugauaacucuuuucaaggagcugccauaauguuacuguugcguuucacaguugcaacuuucuaucccuaagauuuugcauaaaauucuugucagcccagaaaaaggaaggagcacgugggagggggcaggaguggggagguuagcacuuaaguaaccgucuuuucguuuuccugcaguuucugggccacccccaucacagcacguuucugcuguucuccuucccuccccccgaggaggccgagguguucgacaaacuaagcaucaucagcgaagagucugaaggcagcaagcagaguccugaagacaacugugccucagagcccccgucugauccagggccucgggagcuggaguccaaggaugaagcucccucaccuccacacgaugaccccaaacugcucacgucgaccucagaaguaugaccagagagccaccugaaaaaacuccaaaucuagaacuuccugaugcugcacugguacacacaaccaaagagcuagguuuuaaacacucuacuugggaauuugcugccauauaaagacuaauaauuuagggacugaggguguagcucagugacuagagcucuuacuuggcacacaugaaguccuagcuucgauccccaacaccauauaaaccagggaugggggcaccuaccuauaagcccagcacuuuggagguagaggcaggaggaucacagucaucuugaacuauacagggaguucaaggccaagcuggacuagagacccugucuaagagagagagagagaaacuuuaauaauuauuuuuuauggccacugaauguaauuugagcccuuugugcucacuaaaacaaggaucacauuuaacuugugacaaacaaaaauauuuuaaauggggggggggggcauggaaacacuaugaaauuauaagaaugccuauagaccacccgcaucucaaaagugguuggccccaugcgggacagacaugaacauuuuggauucccaaggagcaaagagauuuccuuccuuaccuguguguuuuguauuaauauuaguguucuguaaauauucuauauuuguauauuuguguuagccuacuuccugcuguuguaacgaaauuccuggcguaaacaauuuaaaaggaagaaaggaaauuuag

SEQ ID NO: 8328 - RNA, 25444 nt, Mus musculus
cggagcguggcagggaccucaaaguccccaggccuugacuggaccgcgcccgguacuuuccgagccgcuugcucgcggagagagcguggcgucagcggagaagcugugcuggguggaggggcgggggcguucacggaaggggcggggcgcuggagggggcggggcgucgcggagggccuagcugcccagagguagucuccagcuccgcggugcugcugaggagaaggaggagaaugugagccgccgcccggccucccaagacgaugcucgcugucgugggcgcggcggcccuggugcugguggccggggcgccuugggugcuacccucagcugcaggugagccgaggggccugugcgagggccgggcaccauggagggagagcugggcgcgggugaccagaguccgcgacgcccgcccccugcgccgcucuucagccugaggacgcuacccgggccgagccucagggcugcuggugggcgggagaccagacagcagcagaaaugcgcucccagccuagugcgguuugucccgggcugagaggagugaggugagaggcccccuaaccggcccgaagucaaaaccaggaaaccacugggcuaguuacaucgggagaaugcccacuaaggggagagacaagaguuuucauagugaugugaggaaccuaaaaaagacgaccuagccucacuccuggaggaaaguucugauuccucuuagaaaucuguauaucugggaaguaagugauugccccaagucucaccccgaagauggcccauuucuggcuagacgugcaugauguacaugcaggcaaaguggucacacauauacaguaaaucggaaaaagacuauuaugaacagaauacuguaacugcuacaaaugcucuugggucuuuuguuaaucucaugagcacauuugcugcucuuucugcacagaaucaguaaaucccaacaguuggacuggagaucaagcuaagaggauacggauaacaggauagagucaguuuagggaugacaucaaagacuccguuggugguacuggaaguguggcucagugguagugugcacuuagcauagacagcacugagaaacugacaacucagaguggggagacuugauggauagcuccugguggcugaaaagaaagaaauucagacaucucagaugcauccucuuacauaggauguaacuagaggcaguucuguaacccucuggaguagaagcuugacaggcgacaugacaugauagucugaggcagaaguuuucaaaacaggagauaacaguggagccagacauagcguuaaaggacacuuuuuaaaguuaaagccucguucgggcuggagaggcggcucacagguaagagcacuuauugcucuugcagagggaccuggauugguucccagcacacaguuggugacuugcaaccuucccuaaauccugcuuuguuccaggggauuggaauacacuuuucugacuuccuuggcuauggggcacauguggugcacacacaaaugugcaggcagaacacguauacacauacagaaagucuuuaaaaaacuugccuugauaagcaggcaugguugcaucagugucacacaaaaaggacuuuacaucacauuuuaacacaaaggagugacucugcuuugcagugaaauuaaaaaauuuauucugaaaugugagacauacauguuaaaggaguaagggggccuguucucggaagagucacaggucuauucucuaccuacuuguccuugaaguguuagguuagugucucaguuaggguuuuaccgcugugaacagacaccaugaccaaggcaagucuuauaaaagacaacauuuaauuggagcuggcuuacagguugagagguucaguccauuaucaucaagggaggagcagggcagcaucuaggcagacauggugcaggcagagcugagaguucuacgucuucaucugaaggugguuaauggaagacuggcuuccaggaagcuagggugagggucuuaagcccacgcccacaguuggaagaccacaccuccaaauaaugccacucccugggccaagcauauucaaaccaugacugguagauucaaacgaccagcaguggcacuuguuucugaaggcucuggagcagccuuuuucccaagccuccucgugccugaggugcagaugggccugagcucucacuccuauuggaggaagaagcugucuaacuaugguccuugcuugaaguguccuaucgugauguagcuucuuuggaagugucuaacccacacaauuaaggcuaugagagacaaggcauuauauauuaauaaaggcucgauacagcuagauaaagcaaugacagaggucuguguaccucauguuucagcuguaugccauuugcaguauggugaugaaaccucgcuguccucccugggauggggaucuucccuuuguccaggauguccagauaaccagugaaaucauagagauuauuauauucuagaaacccucuuauuugucuaauaaugucccuugucaccccaacuccacuguaaucacagugugccauauuuauuuuuaucaucuuaucgggccuaucuuguuaaacguugucauaacuguguacauacguacguaggaacgaauccagaucgagcuggacucuuuuuuuuuuuuaagauuuauuuauuuauuauauguaaguacacuguagcugucuucagacacuccagaagagggagucagaucuuguuacagauggcugugagccaccaugugguugcugggauuugaacucugaaccuucggaagaacagucggugcucuuacccucugagccaucucaccagcccggagcuggacucuuuaacugcagucugaggcauccacuggaggucuugggcuacaacucccacgucagagggggcugcuguauacuuuccuauguuugaauaaauucugcccugggucuggagaugguuuagugacuguguaauuacacuugcaaaagaccuggguucaauuccugacacacacacuuggugguucacacccaccuauaagugcaguuguaggagaucugacacccuccccugcccuccauggaguacauagacacaugcaggcaaaacguucucacauaaaacagaacacauacaucuaauuuaaauuuuuaaaaauacaauuguuauuucccgagauuaaaauauauuuaugcuaugucccagguuccuuucuucuuuccacacccucccacauaacacaccacuuccaccaccaacccacucucuuaccaaacucuugcucuguguguguguguguguguguguguguguauguguguguauguguucaucuguauuccuaaauaaaugguuaacaaccuucucagucuguaugcuacuuguguguauguuuccagggcuguccguuugaugcuggauaacugagcucuguguucuuucuucccuggaggagacuauuuuuccugcucucaguugccuguaguccaccgccaccccuacccaccugccaaggauugaggccuccagagguuuucccuuucacauuaacauguuggcuggucgugugcuuauuugguccauggcuaggcagucacauagaugagacuuuauggguauagccucugacauuuccaggagauagagucucacagcaaaauccuuguucuucuggcucuuagagucuuucagccuccuccuccacaaugaucccugagcgguaggugcaggagcugaacuguaggugaaucaguagggacugggcucauauuuucuguucuggucuccaucuguugcaaagagaaguuucuuugaugauguguacuggcuggcuuuguguguuaucuuaacacagcuggaguuaucacagagaaaggagcuucaguugaggaaaugccuccaugagauccagcuguaaggcauuuucucaauuagugaucaaugggggagggcuuauuguggguggugccaucccugggcugguaguccuggguucuauaagaaagcaggcugaacaaaccaggggaagcaagccaguaagaaacaucccuccguggccucugcaucagcuccugcuuccugaccugccugaguuccaguccugacuuccuuuguugauaaacagcaauguggaaguauaagcugaauaaacccuuuccuccccaacuugcuucuuggucaugauguuuuguucaggaauagaaaccccaacuaagacaauguaugagaacuauacuuacuugugggcagaaggaaaaguauuuagaauauuguuagugcuuaugcuggcuuuaguaaagugaaaaugguagguucucuuccaagacuccugcugucaccagccauaggcauuugacaggguuccaauaccagucacaaucucuguccuacugagcagaucuuaagucuagagaacuguaguuaccaagguacaugugccacuauuacccugggguuucuguaccguacuggucauuacugugguuuguaggcaucauagcaggaaaaaaaaaaugaaaugagugcauucagugauguuguugaugugauuaauaacaacuuauaaaauauuuuuacagcauauaaguaauaauuuguugcuuguugguuuuauagguggagaaaaucugaaaccuccugagaauauagacgucuacauuauagaugacaacuacacccuaaaguggagcagccacggagagucaaugggcagugugaccuuuucagcagaauaucgaacguaggugacugauuggcuugcuggaaugauaggugucauaauuuccuuuuaaugugggaagcauuugguuguuuucaaucuaggaaauguuaugucucuugcacauaauguuuguaacuuuaucuccguggagacugagcugagaugaagggcugguggaugaccgagcaaguaaaagugcuugccccacgccugacaggcugaguggauuuccagaacccacauggagagaaagaaccaacuccugcaaguuguccucugaccuccauucauguugugguguauuugugcacgcuugcguguguguguguguguguguguguguguauguaugugugugugucugucugucugucuugaggaggcuugaggagaccuucucuucauggaugucacacauacucuaaauguauagcagcaccucagcugucugcacugagaggagaguccccgagggccaugaugggccuugaaacaggcccccaagcaacugugguuaguuuuccugucauuuccagcacacacagugguuucuuuuucuuuucuaaauuacaaguuuagcucauggacuggagagauggcucaguaguuaagaacacuggcucuucuuccagaaguccugaguucaauucccaauaacuacaugauggcucacaaccaucuguaaugggauccaauucccucuucugguaugcagacauacaugcagacaaagcacucauggacauaaauaaauaaaccuaaaagaaagaaaaaugucaagguuuauuuuauguauguguuuugccuguauguauggauguguaccaucugcauaccuaaugccuguggaggucagaggagggcaucagauucccuggaacuauaguuacagaagguuguaagccaucugugugcugggaacggaacccagggccucugcaagagcagccaucucuccagccccaguguugucagccacaucaguauuguugacccuggauuuccacagacucuuacucaguacugaccuucuacuucccaucuuccaggaggauaggcaggcucacgggaggggcagcccuccaucuccugcuuaguguuggggcuucgucugguccccuguguaggauggagucagcagggaagaaaggaguugugagcacuuuccaagucaggacccagagcugcacccacugguuacuaaacggagauaaugaucuuauagcuuccugagugugucugugcacacccguuuuaccucuagugaguuuucugugugcagguuucaguuuugauaccacuugguuuuugacguagguugggauuuuuuucacccaccagcuggcuuagguagagugaggauauugaagaaacccaugaaguuacccuguaauaaagagcagacagccagaaucucaaccuccuguaagaucagccccagcugcuucccaauuuucugaccucacaaguacccacaguaacuaauguaugcacacccacauacagacacauucaaacauaauuuuaaaaagaaucauugaagacuuaaagaguccagcaaacagacaauaauuggcuuuggaaaggcagaggaaaaguuggccacaaagugcuaaggucugucgcccgaagguuagauagucuauuccuauagguuucaaacaggaauaucagaucaauuccuaaguuuucaauaaggaaauuaaagccuagaaauacagauucauuucccagaagucacacaguuaucauggcucaaggcagccgaaucugcuucugucguauggaucauuuauuucuguuuccuugaaguauuaauguaaccacucagaagauugaagcaaaaacuauuaaaaauuaacuaaauugcuggggcagagggaagugcaugccuuuaauuccagcacucaggagucagaagcagauggaucucugaguuccagaccagccuggugaauagagucagucccacgauagcuaacugucucaaaaaaaaaaaaaauuuaagaaaugucuaaucauucaaguaauaacuuggcucauauguaucaaagaagaaucagagucagaaagauguuaacauggcaucaucucaagcaaaauaaauucucuuaguaugacugccacuguauguuucccagauguuucucuuccgucgucacgaagcugccuccuuaugugggcuguggucuaaagugaccuuccaggucucaggagguggauuccuggcgacccugcaaugaguggcuuagucgcaaugaguggcuuagucccgaagcuucacuuagaccuugaaaggcacuugcuugagacaugucucuaauggcaguggccucuccaguccuccacgugacaaccccuggacacgcacuggacacaguccaugacguaaauuggcugcgcauugucaccagccuguuagaggcaaccauuguucaucugggggaauuuugaccuuucacucagguucgcuccaucagcacagugacacucaccauaggagauacauucuuuuuuuuuuuuaagauuuauuuauuuauuuauuuauuuauuuauuacauguaaguacacuguagcugucuucagacacuccagaagagggagucagaucuuguugcagaugguugugagccaccaugugguugcugggauuugaacucuggaccuuuggaagagcagucgggugcucuuacccacugagccaucucaccagcccaggagauacauucuuaaccuaacuaugauggugaauagaaaacacguuuuaaaagcccauguauacauuugcucauuccgauuuuuuuuuauuauuauuguuauuauuaaaagaaaagacgaggcgaagugguuaaaagugccugaaugucaacauacuacaacgaccaagugugaauucucuuuacuggacacaaauguguauaucaaaacacaguuucgugucagagcagaggaagggaacagcacaucuucguggaaugagguugauccguuuauuccauucuacacagguaagaagccgccauggcuggcuauauuguuccucucuuccucucuaaugagcauuacaagcgcaguucucuggugcagcucccuucugcagaggccucuucccuggccuucuguauuaguggcuuuccccgugugguuaucaagagccuuuuagcagguccauaaagccagggcucuuuuccucggauuucagagauguuauuggcauguucacucggauugucucuuauccacacaauggacauguguguaacuuacugcagaggcugaguaguccacgggaaugaguuuuuuguuuuuaaaguagagcaauuucaugccuucauguuucugggguuuggggguuuguuuguuuguuuguuuuucuuuuuuaaaaguacuuuugccagacugugguuguguaaaccuuuaacccaagccauggggaaacagaguuagguagaccucugaguuccaggacagcaagagaaacccugucucaaaaacaaacaaacaaaaaaguguauauuuuaacgauguacccaguaguuuuuucauucuacucuuguaauggucaaugugcuaaaugugaaaagauagaacccauguaaucagacgcccuucgacagccucagguucucuuuuaagcuuuauuuuuauuuaugcauaugugagauguguaugcuacacauauguggggcugggggaggccagaagaggcucuaacauuugcuggaaguggaguuaggcacagccugacaaaggagcuaggaauugaauguggcuccucugaaggaacagcagaugucuuagcugcugaacugucucucuagcucucagcaucucuguaaagggaaacgcugcccuguccugucugacaacgcagugacaugcauccaauuugucacccccauucgcuucucauugcugccacgucccucccucucacgugcuacagaagucagcagccgugccuccuaauagguucaugcccaggcuucccgcuuggugucucugggcacaccuuugacauggcuccuuucccuugaaacacuuccuggcucaccggggucacugcuugcuccucagucuccugauugcuccguuuguuuuguuuuuuguuuuuuucuuuucuucauucucuucuccaggauauuaaggaugggcagagaagggguggccaugaaacuguuuuugacucccagaauuacaucuccugccccaguccucccucugagcauaagacugguacagucucuauucaguguguaccuucauguuagaagccaucccacaauaaaaauggucaaauggggcacucagucucucccgcagcccucaccuggcugugggaaugacaucagcugguuauuuauucaagcucagacccuggauucaucuuuagccuuuuucuacaccuauaauguauauuuguauauacaccuauaaugaucuggauuagcaugggcucauauauuugaauacuuaguggaacuauuuggaaagacuaggagguauggagguauggccuugguagaacugugucacugggaguuggcuuugauauuucaaaagccaugucauuccuaguccgugcucuuggucucugacuugcuugcccucucucucucucucucucucucucucucucucucugccuccugauuauaggucagguguaaauucucauauacuacucuacuaccaugucugccugccugcuucccuguuccccucccuugauggucacagauucuaccaccaugagccccaguuuucuuugaucaguuguccuggucauggagcuuuggcacagcaauugaaaaguaacucagacaaugccuuggcgcauucugccugacccaucacgugaggauagcagagauggcaccuauguuuuuaccaaggcacuucucuuuacugaucccuugcugaccauccugcuuccucaucccuuggccaggcugaugauucuaaaucugaaugggauuuuggcucuuugccaaccucagccccucccacccacccuauacccuucacuguccuaucuuagagacuucacaugcucuccacagggccugggcugcuuuuccgccaugcguuugcuucuacuaggagguuucagaacagcuuuccugguaacuuaccagaggcagcauuugcugccauugucagaguuaccugguuuucuuuggugcauagaugcaucucucuucagguugcucuugccaggucuucccaaagugugaaaugcacgugggacuuuugucugucuuacuacaccagggaaacauuguuuauuauuaacauuuuggaaugauacuacuguaguuauguaauuguucuuugaugucaacagcucacaugagccccccagaaguacguuuagaagcugaagauaaagccauacuaguccacaucucuccucccggacaagacgggaacaugugggcacuggagaaaccuuccuucaguuacaccauacgaaucuggcagaagucuuccagugacaaaguaaguuucuguuuuuaccuguuugaugugagagaaauagaggugaaagaauucuaaaauuugacuauuuuuaaauuuuuuuuauagaaaacuauuaacucuacguauuauguagaaaagauaccagaacucuugccagagacuacuuacuguuuagaaguuaaagcaauacauccgucacuuaagaaacacagcaauuacagcacugugcaguguauaagcaccacagguaaugaagaaccguguuagauuccguagccgaguacccucagcauuuuaauuggggcauuuucuccucuuaauuccugaacuguuuuauaugauaagguuucacaauggcuuaauagucacuaaagcaaaccacugaguuaggggugugguuggacauuuguccuaguucaauucccaguaccacacaugggagggagggagggagggagggaggagacgggagagaaggugacagcacuuacagaguccaaaaaucacuuuccuggcaauuuuugucucagugcuaugaaauuucuacucaaaaguugauuuuucucauaugguaaaugcuuuuuauuuaccuauaauaccuagcauagcuuuuagcagaguggcuggugucccuccaccccucacccugcgcccuccccuccccaguggacaugaauuuguuaacaaggaacacagccugagacacugcuagccgggacagugauuaaggucagggugggagcuggcccggucauggcuuuaguuauaaauuuaguauguuuuaacucuuaaagucaaauuagauaaauguggcuccguaucacuagcucuaaaauguauguauucuuuggcuucuaguggcaaauaaaaugccugugccaggaaaucuccaaguggaugcccaaggcaagagcuauguccugaaaugggacuacauugcgucugcagacgugcucuucagggcacaguggcuuccguaaguccuccuccaguguuccuuacccagucugccgugugcucacgucacuucuguguuccuuaccuagucugccgugugcucacgucacuucugugcuccuuacccagucugccguguggucacgugacuucuguguuccuuacccagucugccguguggucacgugacuucugugugcagaggcuuccacagaguggcuggcugagagcugagugcggugcguugggaagcacggacuugcauguagguuccuugcuccaggggcugacgggacaacugccagagcagagacagauaccugacggccaccucugaccucugcacauucccgcacaugcacugguacauacaucacauguagcuggaugugcaugugugccucacacacacacgcauacacacgcacacgcauacacacacacacgcacacuggcucaggugcaaagaaaagaaaaauaauguguaacugaggaggaugguuucauacaaacguucuccugcaugguccugagguuguggacagaagccauguccugaagcuguagagaugaggcagcccaucagaggcuguuggaugagacuguccuagagacagucauuacuuauagcucaggccuuagcuuaggcuauuucucauuguauaacuucuuuaacccauuuguucuaaucugaguucugccauguggcccguuaauuacaucuccuuuagucaugguaccuguuucuuccuuggagccuggcuggcaaaucucccagaguuccuuucugccuggaagacccgccuauccuugccugcuuuguuguaggcgauugagcucuuuauuaaaccaguuagaaagggggugggggggugcuggagagauggcucaguuguuaagagcacugacuguucuucugaagguccugaguucaaaucccagcaagaacgugguagcucacaaccauccguaaugagaucugaugcccucuucuggugugucugaagacagcuaugguguacucacauauaacaauagauaaaucuuugggccagagugaucaggccugaaucgagcagggccagagcaagcagagguccugaguucaauucccagcaaccacgugauggcucacaaccaucuguacagcuacaguguacucauauacauaaaauuaaaucuuuuuuuaaaaaaagaaauaaaaugaggggaaagguguuuacaaaacacugagacaggugaugcuucauacacuaacaagaccaaagucucaaaucucuguacucaaaucucugguagagaagucaacauaugaauaauacaaagacagugcacaagacauuaccuuaacauauggccuuuacagcuguguuaggguucagcucagaggucauguccacuacagagacauuaaauuccauucauccaaaaugguggauuggaccauuaagugcugcuucaaacuccccuccucuuuggcagauaaugcacccuagggcagccccuucucuucagguuguguacacucuauggggggaugcuagggagugugccccugaggaggagggaaccugggauguccuagaacagugucugcccugguaggaggguguccugcuagaggaacgggauauuuggacagagagaagcgauuuaaggaaacagaacuuuaagagaacgguugggaaucuugcucuuggaggcaagguggcauggagucuguuggggaagcuauauauggccagucucagguauuguacgcuugcuuugagcugugcucucuggccaagugcucacccuuggugggauguucucuguaauggauggcacagaugagugcuaugggcuccugcagggcugugucagcacagcaagcaucucuccacaagggaacagucccguuuguagugcuagacagcuuuugugacagaaauguucccauuauagccacucugaagcuagcagcuugaagacuuugaccuuggaccuggggugaacgcaugcgcgucaugcgguuagguaguuacuguagcaugugauggcugaauggagcugcaagagcagguacgauguaacuaggaugucucagcuauggucacuauugcugcagugagucacugugaccaaaaccaauuagggaggaaaggguuuauuucacacacacauccaucuuggaguccaucgcugagggaagacaggacaggaacucagaucaaacaggacaggagccuggaggcuggagcugaugcagagccauggugggugcugcuuacugacauggagggugcugcucacugcuggcuccugaggcucagccugcuuuguuacagaguccgaggccaccagcccagggauccccacacccacaguggaccagguccuccccaauaggucaguaauuaacaaaaugcccuaaaggcuugucuacuuagagccuggaugaucggucuggaggcauuuucucagcugagguucccuccucucagaugacuguagcuuguaucagguucacaugaaacuagcuagggcauaggacaaggugaguuuugaauauuuuuaguaacuuauuucugaauuuguauaucagccuuuuaauaauaaccugcuuaaaaaauauguucugcuuugaagagacgacuuagcagcaaaagcaccuaccagagcuaagaucccuagaacccagguaaaaccugcagguguggcagcacccgagacuccagcacuugagagucacacggggaguucuggggcaagcuggcuagcuagacuggucagaucugcaagcugcaagcuggggaagagucugcgucucagucacguggagagcaaucaaggaagaccccugucgucuauuucaugucuucauaccacucacgugcgccugcaaacacagucacacacgcauucacacacacacacacacacacagugaagaacagcuugccacuucacugggaauuccccacacacucuagagcacccguggccuuccuuuguuggggaucugugucuccuccauuguaccaggaguucccuaaguggggaaacugcccucagguccacagugcuuacuacagugucuuagguauuauagagccucaguacauagugaauuaauucaugauuggauuggauuuuguuuuugcuuucuguuuucaaaguggcuauucaaaaagcaguucuggaagccguucagauaaauggaaaccaauaccaaccugugcaaauguccagacuacgcacugugucuuuucucaagauacugucuacacaggaacguucuuucuccauguacaagccucagagggaaaucacacauccuuuuggucugaagagaaguuuauugauucucaaaaacacaguaagccgaguuuucuuugagacagucugacacuguagcccaggcuggccuggaacucacgguguagcccaggguagcuucaaacuuauggcaguccuccugccugagcuccugagagcugagguugugggugugguccaugccugcuguauagcaagcgcuuucuggaguguaauuccucauguagggcgagucccggaagguuguuugaaggugucuuagugugcaauuucuguuugcauucuuccccaguucucccuccuccuccggucauuacugucaccgccaugagugacaccuugcuuguuuaugucaacugucaggacagcacaugugauggacucaauuacgaaaucaucuuuugggaaaacacuuccaauacuaagguaaaaagcuacccaggaacuuugugacuuagccucauaccggugaugaugggaaagaaaguuagugggggagggagggcaagagcaagcagucacagcucuaagguuugggaggccuuuuaaucuugaugguggccugucugcaguagagcgaaugucagccuuuuccauggucugcaugacaguacaggucgccugcaucugggccugacuuuucugugugugaauauacaggagugugugcaagcaugugugugugugugugugugugugugugugugugugugugugugugugugacugugcaugaguaugugaauguauguaugugugaauauauguguguguaugugugaauguacguguguguguaugaguguaugugugugugugaguguaugugugaaugugugggaggaugugugugugugugugugugugugugugugugagugacucuccgugaguaugugaguauauguaugugaaucugugugaaugugugugaggaugugaguguaagugugugugugugugugugaaugacuuugcaugaguauguguguguauauaugugugaauguacguguuugugugugugugugugugugugugugugugugaggaugugaaugugcgugugcgcguguguguugacaauugcuuauguacuauauguucaucacaggacacucauggcggccagacgauaagcuguggaagugagcucucucuccugccuuauaacucccggggauugaauuaagucaucagguuuugcagcaagcauccuuauguacuaggccaucuugauuuucaacuauaucuugagccuccuacugcugaauuagaaccauuauuacacuuucccaaguguucuucuaaggcuaaggcuucucugcacuagagacacuugagccagguaauuccugugcuagaguuguccuuauuuacaggacacuuagcaucacuaggcucuuugagguguccagcacuuccucagaguagugucaaccaagugccuacaagugguguucucaccuguccucagcuggcacucaguggaggcagaauuaauucuuagaagacaaagagggugaugcugguggccagcucuuggaacuaccccagccagucuguggccucgugggaaaaugcugucauagcugcugaauguuuuguuacccagcacugucguugccauggcugaccacuacagaacgaugauucuccuccccuuguaagcacauggagaaauaggugccagugaaaugacucacacaaagcagcaaggcucucugggagcuacugugagcagugcagggccggagggaacccauauucuuaacuguccuccccgguauaacacgauggcaguaaaaacaagccaacccgcuagugccuguagaaugagaaucucaggggugcacuuacgcuuuuuuaacagcagguuuuucacucucugauuugguuauaaugggcuacuuaaaacaaacuuauacugcuuagacaaccaaguaggugagacuuggaagagacuucuugugaauaucaauagaauccagaaaauccauauucuguaucugacuuuaugaggccugaauuugaucacuguuguuacugugucuguagauaagcauggagaaggauggcccagaguucacccucaagaaccugcagccgcugacuguguacuguguccaggccagagugcucuucagggcccugcugaauaagaccagcaacuucagugaaaagcugugugagaaaacacguccaggugagaucuucuagauguuuuuaauacagcugaaagagauaaaaauacugcauuggaauuuacgaagaauuucuucuuugcuucagauaguagaagguuuccuuucugaacuacagggaauccaaagugaaccaagccacagccugcgggaugagggaucacccagcugaggccugcaguauuggggaucacccagccaaggccugugggauggggaauaacccagcugaggccuucgggauuggggauugccgcaggcccucugguccccugugccugcguaggaaagagucucuagaguagaugggcagagauuaggaugaaaaaugacaaaaaucagucaaacacacaagagagguguugaaucugaauguaauguuccagucgagcaucagacuuuuauaauacagaauaaauugcagaacaaggcacauugaauuuuuccaggugcaaaaggagugacuucaaaaggaaccagauaaauguauaacacuagagauuagcacagaugcaaggggagugacuacaaagggaauuuguagggaccagauaaauguuuacauuagagauuagcacuuucugccaggcaagaguuuuacucuuagaguuaauagccccaggguaguuaacucuugacacaccucaagaauaauguagugucacugaccacaaaauucucuaggccucguuaauucuuaucuauaucugaagacuauccauuuucaguauaguauacuaauuugcucuuggcauggaauguagucuguaauacgcauuucuaucucagugagaauauuagacucuauuuucagacacugaauuaauggcuagugcuuuauuagcuacugaauggguuaagcuccuugcugcuaucuggagucuaagaacacugggaaaaggcuuuagcuauguuagaauaaaaucuuaaaaggcauuuacuauaagguaaagcuauauagagugcacguggauccauacacuagacuaaugcgggaauggaaaaauuaauuuuaugguuuauauagauuagggagaaaaugccaggcccccgggaagggaguuuccuugaaacucuuugcuucaugaaccagcuucccagcguucgcuuugucaagcugacuccaccagagucccuggcaggggauugugcuugugcuuggugugguccgugcuuauuguugcuuacuuucucaucuaguguuaaauaauucacugcuacuaguuauugaucauuggugagcagucagagcacucacuuguaaugucuuuaaugaacuugaggaaguggagcugucuguuaagaaggcuuggauacaccugugcucagucuuguuaguaguuuacuuccugguagcaauaggaagaggcuuagacaccaacugucuugccaguucugcucugugcagggcuggggacaccagcuguugggaccucuguucuuacaggucaugucuucaucuccagggucaguucucaggucaucgucaccugugacugucacugaccaccgcagugcaccaagugcccaaaauugguuuucaggccacucugcauuuccucucguauggcugcucucauaagcaaugugcugacgcucauacuguuuguauuuuaggaaguuuuuccacgaucuggauuauaacuggauuagguguuguguucuucucugucaugguccuuuaugcuuugaggagcgucuggaaauaccugugucaugugugcuucccaccacucaagccuccccgcaguauugaugagguauguuuuucucccugucauccacuaggaaauggggagcaaauguuuggauucugcagaugauauuugcuuucuugauauccaaaaaguugucagucuggugugauuguuugugcagaauuucagugacauuagaagccuggugugguagugcaugcuuauaaaacccaggaagcuaagguaggagauuugcagugaguuugaggccaguaugagcugaguagcagauugcaucuccaagaaacaaaagaggcuuaggccagcagggcuagagagcggcccugccccaaaccaggcaugguggugaauugagggucagaggcugcucagugagacccugccucugaaacacgcuugagaauguuaaccagugacuuaaugcagaagagcugguguguucagaaguggucugcagcagcuggagucagccucagggcggacguugaagugugcagcagcaggagugaacguggacagcaggugauacaacaucacucuggcacuuaggaccucuccaggaaauaaccagggagcacuguucauuccggcuuccuguucccacacaggcacuugauacaaggggauagucacuagggaccucggugccuucuugcucuucuccuauguccuggucacagggcuagaaggccagcuugcuccaagacagucagucuuggaggacacuugagauaaacauguuucaaucugagacaaggggccaccuuguucccauagucugcucucagcagcagcacauggcuguuguaaugaaguguauguuacagucugaauaaugucuugucucugccuauuguggcauuuuuuguugccaugucccaucugugagauuuaucauaccauaucauaaauccuaugauccaucugucuucacguggugcccuagaugaagucacagaaacaggaauaacaaaagccaugaguuccuuucauggugcuugcguguuuugcuuaggacuccucugaugauagcaccugaaaugauggcacugaguggggaaggccuugcccuagauccugggagccagggcauaacacugggcaagcucuguaaaagaagcuaggccaugagcuguagaagcccagaguucagaguucagcacaugcuugccgccugcuagaguuuuuaauuccccuuugugcucugauagcuacagcugugacacagguauaaccagccccuuaccaccuaggcaacagggugaccuccgucucucacuugugcuuuugagugcaagagaacugggcugucacuucaaaaugucugugaucccagcaccccuaacccacccuuggcagcacagugccugugugaggauucuucacagguuuacccaaaaauggccuugagcccgguggccugcugugccuucugagccucacagucauucccgggauagcucauaugucgugaugcacacuccgaaaggcuggacauaaaacagaagcuagagcuggagaugcaggguuuauuuuaaacaaccuguuuuccuucccuuuuaccaucaguuuuucucugagccgccuucaaaaaaccuuguacuucugacggcugaggagcacacggaaagaugcuucaucauugagaauacagacacggucgcuguagaaguaaagcacgcgccugaggaggaccucaggaaguacagcucacagaccagccaggacucgggcaacuauuccaacgaagaggaggagagugugggcaccgagagcggccaagcugugcucuccaaagcucccugcggggggccaugcagcgugccuagcccuccugggaccuuggaagacgggaccugcuuccugggaaaugaaaaauaucuucagagcccagcccugaggacagagccagcucuucucugcugacaggugcucggcccaggcugggggccguguggaggagacagacuuaucugaaguggcugccagcuucugcugccagcuggaagcccugggugcuguuugugccacagaugaggcucacugaugucaggcaucuggugguucugucucgguguuuguccucuaggugacauuuagaacauuccgauuuuuaauccugccguagccccucagugugucacagguaccauugucuacagccgcgcuuccuaacccauaccucaccacagccguggcuucugaccagaagucacugaaaccauggagaaaggggacacuaacuggaggagcuggcguuguuuaagaucucaguguggccugggugugcccguuguacucuaguacuugcagaacuagaaaaugccagggacaaaaagcaggcaugaaccauucaguaagagagaagcuagugaaccugauggugaaagaagaccguguccagucaguguuugugugaaggcccugugcugcucucuguagccuucccgugguacuuauaaaaccaggccgaacccuguccucuguccggcacuauucaggucccuucccagcuccagguacuuaaaaaacaaaguguuggguccuggggugagggaacagcuucgacggcacagugcugccugcaggcgccuauaagugaccuuagaugaaugcuccaugagcaucuucgguaggcaggacauccagcagugcugguggcuccagggcagacucaguugcaggccaaaaaggaagagagaggagucauagcccugccccaaucgagcuuguugcucgcugcacugcgccuuuguaaucaaucuugguuuuuuuguuuuguuuuguuuuuuuuaacuuuuaggugauaacauauucucagauauagcacacaagagacacuacacaaauuacgucugaaaguuuugauagaaaagagcuuuugacugggguagacagcuugcuccucacuacuaccuuguaucucagucuccucaacagagagagaaugcagauugauuuucauccugaguuuuauuuucuugcccgguuucuggguucgggugugcuuucaaggcucugaacagcuugucugcccacaggggagcccggagacccagccuuuuggcuaaauguugcagguuccuguacuugaaggacuccagcuccucuguagagggcauggucaucgcggucugcaaucacgcugauacccagaaaaauggccacacaacucaaaucuggugccacgcuuuaauaauucuacccagcacggcccagcccuguucacggcggaaaagcuccuucugccaggacagccugugaagaaacaagaccuccgaggacguggccaaggaaggcccagaugcuagcgggaaguuguuaguuggcacucuuucaucucucaacaacugugacacaggucuucagggugaagcccaaagcagcuaucgguugcagcagcggguaaggagggggcuucaccugagccuggccuucugggcgagcaguucuaccugcacacuucaagacagccuccaugacccuuuucacggcacaccgccugcuuuuggugugaccgggguuuccugugcaggcacauguucuuaaggaaugccaugcacacaggccugaagagcuggcucagcggguagagcacagguugcucuugucugggaucugagcucuguccccagcacccacagagugcuucugguugccucagacuccaggggugcacaaggccauguaagcaaagacauguaagcaaagacaguuguacacagagaagucaaaccuuuuugaaaaaaagaaacaccacgggcuggagagauggcucagugguuaagaacacugaccacucuuccagagguccugaguucaauucccagcaaccacaugguggcucacaaccaucuguaauaggaucugaugcccccuucuggugugucugaagauagcuacaguguauucauauauaaaauaauaaauacauccuuuuuuuucuuuuuuuacuauuggauauuuucuuuauuuacauuucaaauguuauccccuuuccugauuuaccccccucccagaagcccccuaucccauccccccuccccugcuucuaugaggguguucacccacccacccacucccacuucccugcccuugauuccccuacacuggguuauuuaucaagccaucauaggaccaaagaccucuccuuccauugauccaugacaaagccauccucugcaacauaugcagcuugagcuauguguacuucuugguugauggcauagucccugggaguucuggggcagugggggguuggggggagucugguuaguugauauuauucuuccuauugggguugcaaaccccuucaaugccuucagucccuucucuaacuccucuauuagggaccccgagcucaguccagugguuggcugcuaacauccaccucuguauuuguaaggcucuggcagggccucucaagagacagccauaucaggcuccuuucagcauguacuucuuggcacccacaacagugucugguuugguaacgcuguacggcaugaauuccgaggugggacaaucuauggguggccuuucauucagucucugcucuacacuuuaucuccauauuugcuccagugaguauuuuguucuccuucuaagaaggacagaagcacccacacuuugcucguccuucuuauugagcuucauguggucugugaauuguauccugguuauuuggagcuuuggggcuaguauccacuuaucagugaguacauauuguguguguucuuuugugauuggguuaccucacucaggaugauauccuccagauccauccauuugccuaagaauuucaugaauucaucguuuuuaauagcugugcaguacucuguuguggaaaugcaccacguuuucuguauccauuccucuguugaggggcaucuggguucuuuccagcuucuggcuauuagaaauaaggcugcuaugaacauaguggagcauguguccuucuuaccaguuggagcaucuucuggguauaugcccaggaguagcauagcuggguccucagguaauacuauguccaauuuucugaggaccggccaaacugauuuccagagugguuguacgagcuuguauucccaccagcaauggaggaguguuccucuuucuccacauccucaccaacaucugcugucaacagaguuuuuaauuuuagccauucugacuggugugaaauggaaucucagggugguuuugauuuguaauucaccaaugacuaaggauguugaacauuucuuuaggugcuucuuggccauuugauauuccucaguugaaaauucuuuguuuagcucucuaccccauuuuuuaauaggguuauuugguucucuggagucuaacuucuugaguucuuuguauauauuggauauuagcccucuaucggauguaggauugguaaagaucuuuucccaaucuguugguauuguuuuguccuuuugucaguguccuuugccuuacagaagcuuugcaauuuuaugaggucccacuugucgauucuuuuuuuuuuuuuuuuuuuuuuuuuuucgagacaggguuucucuguauagcccuggcuguccuggagcucacuuuguagaccaggcuggccucgaacucagaaauccgccugccucugccucccgagugcugggauuaaaggcgugcaccaccacacccggcuccauuugucgauucuugaucuuacagcauuagccauugguguucuauuaaggaauuuuuuccccuguacccguauguuugaggcucuuuccaaauugcuccucuauaaagagagagagggggagagggagaaggagagagcaaggaaggaagaaaagagaagagacaagacaagaaggaaaaggagagaaaagaaaagagaaaaaagaaaugaaaagaagagaagagaaaagagaaaaaagaaaagaaagaccaugcacuugagggcacuuuguuuauguugauaguucuuggagaagcugagcgccgucuaagauucauguaaaagccucaugagaaaucagugcuuucacagacacauguaaauagcaacaggccugugagcacagcuacacaggggagcuggcugcacuccacuagaauugccacgacguaccuaucacagugacgucuacagugagaaaugcuguucuagacucauuacauauguaaucauuuaaauguaaucauuuagagccugggcagaaaucuauaaccuaugaaaauguucauuuaaaaucaggucaggcacaagugugccuggcuuguucucaucccagcugccuaggaaugugggccaaccucagccacauagcaagagccugucguacacauauguacagguguagagguaugugugcauguauauagguacuauauaaaauacagagcccagagccugugaugcuucagauggccucggacuucucuggagaccuggggaacguguuaacaaagccuucccuaaccccauggaagccgugugucccugugugcauugguccuuugguguuugccucccucuguauugcagaagcucuuugagcagggucucaguuccucccuguggccccccagccccugugacagugcagcgcuggcacagacagugcccacagcuaccgaaugaaugagaucugaaauugaagcagaugacuguucuggcuguuuguguaaugaaauaaccacguuuguguguuucuaugcaucaccuuugugucugcauccuuuuauauuuuugucuggagccccacuguuguauaucgacaaaccuaacacacaccggaaccaggacucuggaucucaggugcugcuccuuuaaacuggaauccgugaggcagaggugccgucuacaacccguuccugacagcaggacuugcauucuggcauucuggauccacacugcugucccuuccaaguguuacugucucucauuccucugucucugagaucccuucugcucuaccucaagagacuaagagggugaacacaguuuguacuuuucaucuuccuuacagagaaggaaauaauaaauucauauuuguucccaagaaau

SEQ ID NO: 8329 - RNA, 12396 nt, Mus musculus
ucucucugacuuccgguuuucaguugcgagcucuccaaagucagguuccugccaagacgugauacaaccaggagaacucgcgccagagcugguggcagugcucuacccuuagcccaccagugccgugggcuaccagacuuucucuuauuaauaaaguuagcccuccccgggcauuuaguuguagcagugcgggacggauaauacaccgugccuggauaaaagagcggacagaaccaagcuugccuguaauagaaggcgggaaccaacucuaaacaucagaggaaagaaacacgccuucuggaacaucuucaggagcacagauguccucuuuaccuguguaccccagguaggaacucuccccacagccgugggucugucugagcacgucuauaagcuuacucagguguguuugagcgcaucuggccuguugucuuuacuuaagggugguggggaaugcccacauucacauuuaucaccugagacgauagagcccucccacaggaagccagacuuuugagauugugauuggaggcaaagaacauccaucaugucagggccuuuaaggguauuccuuugaggugggugacagugggcucugucacucuccagcaagcuaggaacucagcuuggugacaaacuggagagagugacaggugaggcugcccaucccaaggccuguccuuaugucugagccucaaguaaaaaggauuggcugccccagucuggugucagcuauuggggucagagcuauuccauuuguguuugucuuuaaaccagagaugaagaggguuccauuguccucugccuagggugcuggugacaacugacacaccaaggaguccauuuggcccccucauagauugcugacaauucagauagggggaugguagaugucaugaccucagcagacaauguccaaacugccaccaaaagagaaauacgauauugaugauauuccuaagaacagguaaacuguuaguugaccauggggguaccggaaugucccccuccugggcacaugcuccccuuaaucaugccucuuagccugaccugcccucucccucccccauuaaucugagacagagucucacuaugcaguccuggcuggucugggagcaacucucggaacccuucacaacugacuaguguugauaggcuugucccuggaaguaaugucucucccuuugaccauguauggcugcuguucuuuccggguucagcuguagggcugaggucccagcaaauugauggaggcugugacucagaggcucuugccucagaaugaugggccgguccuggcagaagcagguggccagcagcaggcaagcuucucuguguguuuuccauugugcucugacaccucagccuuuccucaauggcuaguucugucagcuugauacaaccucacaguugcugggaagcugggucaccgugagggaaugccuacgucaaucaaacuggccuguggaugugccuggacguccggcuuguuuugcuggccuuaguuggugugagaagacuuagccuaaaaagggggccccgcuuuuccuggguuuggauccugagcugugugagcggagaaagcuaagccugaaaugcauuggugucucugccccugacuaccuacggaagugaugugcuuggcugugucgaguuuccaaugucuacacuucccugugauaacagacuguaauggggaacagagagcugaaauaaauccuuccucugcaaguugccuuuugucaggguguuuaaucacagcacagcaaugaagggccuggagagcugagaagggccgcugagaugaggcuguuuuuacauaagugaaguugccauccccuuuaagauuuuuuguuuuguuuugagacaggguuucucuguguagcccuggcuguccuggaacucacucuguagaucaggcuagccucaaacucagaaaucugccugccucugccucccaagugcuggaauuagaggcgugcaucugaguacacuguagcugucuucagacgcagaagguggucacggaucccaauacuuuuggucgugagccaccaugaugugguugcuggaaauugaacucaggcagugcucuuaauggcugggccaccucuccaggcccugaaguugcccuuuuaaugugaagauugaugucacagucagauguucgaucauccaccaaaaaggucagaagggcccgggcgucagcugggagcgcgcuugccucgcuugugugagacccugguccuagcccagcauuguguaaaccauaaagcugugguaaggcaccugccugugugugcucgcagcaccagggagguaggagcgggaaggccaggaguucaaagucacucuugguuauguggugaaauugaggccagcuuggauuaccucagacugcuucaaacgauaaaagacaguggaggcuggagacguggcucagugguuaagaacacuggcugcucuuccagaggacuuggguucaauucccagcauuccaguggcagcucacaacuguuuauaacuccaggcucaagagagcuacccaccucugggcuccaugggcaucaggcauggguacugugcacacacacauacacacauacacacauacacacacacacacacauacacacauacacacacacacacacacgaaauaggaaaacuagaaggaaaagaaagaaaauagcacaggaauaaaaacgauuuaaaaacccacuuagcuagcgcaaaauguggcgguuguucacgauugcuugguuauagaucaauggaccacagaacaaucauuaagguaauuuuauuaauauagauaucugcagaucaagugaaugguacuaaugaauaguuuuggugaccucacccucucauguauaacacugaagauucuuccacuccauguucacuccagacucucaguuuuaaagcaagcaucacagaauaccaggcucuuacagugaucgggagccagagcucuuagcacaaagccauacuccacgcugcugacaguuuccuuuaguaauacauauaguacuaucagauaacucauuccaacaacaaaaaauuacucauuaugucaaccaauugccccaucgucaaagcagaaagggcccaacuuucuuuugaggauguuggcuucuuugauguuuugaccacugcagacuuuacacaaugacucggccccauguccgugucaggagcuguucugaaacccaucuccacucugcucuggaaauaggucagcuccuuucugcacacuuuggcuuccuucuggggacccgauucugugcccaaagcaauuagccaagccugagagccccggguuuucugaaaggagacucaccgaagaugccaaggaacauauuucagauaccucaucuuagacaaacugccaaagggucucuuuguuguguuccaaagagggauaaguuggggguuaacauuguugaaccaucucuggggagucugcucuaggacaccauggcacuuaagcaagguuuaugggaaccuacaauauagcuggugaccagagaagaaacuacuaacuagugaacuuuuaccuuuguauagcuggugaccagagaagaaacuacuaacuagugaacuuuuaccuuuguauagcuggugaccagagaagaaacuacuaacuagugaacuuuuaccuuuguauagcuggugaccagagaagaaacugcuagugaacuuuuaccuuuguauuguucuuaaggauuuuugcccccuccaaaaguuacaaaaauauaaucaacuuuaacauuuucagaacuucuaaaucaaucaguuuaacugacuucuguggccagugggucacaguuagccuaccuacuugcccuuuucuuuguccagugcccacagggaaggccuuuguaaauacaggagccccagaagucuauuuuuuccugacuuucaguuuuagagcaccuagcagguguuugaaaagccuucccacaguuuuagagcuuuaauaagcucuggaauauaccagaggaaaccugcaaaaacuaccuguugucuggagaucuuuaauuuguuacaugugugugcacaugcguaugugugcacaugugugugugcacacuggaucccuggagcuggaguuacaggcaguugugagccaccugacuaggaugcugguccucugcaggagcagcaaagagcaaagacucucacccucugggcaguuucuccagccccuuucuuuuucauuuccuuucauaucuccuuccuuccuuccuuccuuuguucuuuugagguuuugaauuuucauuuggagaccacaguugguuaaaucucauuacaacuucuucaguucuauaccuuuugguuucauugcugcuuaaguccuuaugguuagaaaagucaaacagcgacuaccuaccuauaaguugcuagugucucagagagcucugagguuucuggaaggcccuaugugggccucgggucugugcuucaguccuagaggccgauaccugaagucuggcgccggagccugcuccuucaggggcagggucugccucuuacuacaucauuacagcagaacucacccaaguuucucaucuaccaccggggugugauuaguucugugaaaacuacaaaggcacacacuucucaggccccuggggcacgacagucaaucuuagguucugcgucugacgucagagcaacucaaaacugaccagaguggaaaaugaucgugaauaacaaaacagucauauuuuaauagauuuccacagauuuagccaguuuagaaagccugccuugacucuggguguuuuugauucuucucccuggcuaacgucaguuugguuuucuucugugacuucguuugcuucuacgaaggccccguacauuucuuggacucugauaauuucuuucugugcgucaaaauggacuuucugccuggucaggaugggaacaauuaaguugaaaucauuaauucgcuuguucagcuuucguaucuuuucuugaaacugcucacacacuugggcccacuguuucugcucugugggugacagaggguuccccagcuucuuccuagacauuaaaagcgcuucucggaguugcucgaugguguccuuaaucuccuucugcaucaggauccacucugguugguauccauuaucuaucaauauucgguucagguugugagucaugggaucaauauaugagcagccagaaaauuucuucagcgguuuuccuuucccgcugagauugucaaagucuccuuuugccauggauuccugaaugagguccuccaccaggcgcucgauggcuugaguuaucuucuguugcuugcucugccguacguccuugacaguuaugcuguuggcgaagaacucccucugaagcuucugccuuugguauuccaucaccugcuccgucgcgcgauccgcccugaacugccuguauuguuucucucgcuggcugggggucccaaagccgacaccuucgaagcuuaaguaaugucggugcugagguguguuguauuugaacuuuccuucuucuucaucuucugcugcaucuucagcuuuauccuguccggcaugcauccguuuuaucgcaugggacagcacauuccuguaagccucuucaaucuuuauaaauguugcagagucagcaucacuagaaccgcugucugggugguacugccuggcgagcuugugaaaagacucccugacgucgucuacagagcauccuucauccagauucagcagccuguaauauucucucagcuucugggauucauggguugauaucauccuggaucuggggucugaaagcauuuuuauaccaggaggaaucaaggaagcguuuguuaggugcagucucaagauccgaguggucuucaugcacacuguguuuaucauuguaucuggaauucuuaacagugaucuacaaaacagcaaagagcaguuggauacacuuguacuaucagucauuuucuuuucaucaauaaccagguaaggguauggguuccauguccuuaguaagcuuugguucuugggggcaagagaauggguugaggugugguucccagcacccacauggcagcuaauaaaugucucucacucugguuccagggggucugacuccuucuggcccacucaggcauuggacacacauggugcacagccauaguguaggcaaaacaccauauguauauaaaaaagaaagucaguucuuuguaacaauguugcuaaacaagaauauauaaguaucuaugacuuuucuuggugcagcuagaaaaugacagugauguuuggcuaucacauagugugacaggaacugaagucuacugcuugaagacaggguuucucucuguguagcucugguuguucuggacucacuuuggagaccaggcuggcuucaaacauagagagauccaccugccccugccuuccauguucugggauuaaagacaugcauaccuccgcccggauccaaugcacagaauuuuagaucuagaaaguuguuaaaacucaucuaaccuaauuuucucauuuuauaagaaaacggguccagaagguuaagcaacucuuaagguuaaccaaagaacuuacauuaccagguacugcaaaugguuagguuuggggcacaguaaagcuuaacugcuuuuugcuuguuuguuuuugagauagggucucucuacauagcccuggcuguccugggacucauuauguagaccaggcuggacuugaacucacagaggucagccugccucugucuccugagugcugggacuaaaggagagcauccaagccccacacuuggcuuagcuauacucagcaaauuacacauuucccugagcacaauuuguguuguuguuuuguuuugcauacaguguagaauggucgucaccauuuccaaguaucuaacuugcugcauaucaaacagggaacauacagaccgguacucagugggacaccagaugggacugagaaucaagaaugcaagcgacuuuaaggucugcaccucgcuauuugcuaggugccagggcaaggaagggcgauaaagggugagagagcuuuugcuguauuuaaaaacgcaugguccuguggaaaaagauacugaacacugacgaaaggcaacggaguacuuacuggaggauuacugauccuuugaauguaaggugcguuuuagaagucaugguagcccgaugucacaauauaggggucaguggauuuuagaguugucugggaugccggugguuaugcucaccguggugaggggugccucagaagagugucgguccgcugcacccccuacucaccuucacagacgugauggggguucagcggcucgaagcucaagcugcgccuuugcgcagcacgcguggcccgcuccgucccugucucggcuacuggacccucugccgcgcuacacugcagagccuuucuucauaccuuacuacgacagguaguuucccucaccagggacagcgaucucuuucuuauaaaaccaucccccacggaacagaggacagacuccccuggacgcuuguuguugugccgggggcgauaggccccgccucuacccgcuuucgagggcaggguucggccgauuuggauugugggaaauguaguucuccggcaggugcagaguagaggcauuagggccuggagaggaguuauggcuugugauagauuugugaccccaacguguauguaauuugaagagcacugaccucaguaaauuguuuuaaauggaggaagauuaggccguuugccucuaugggacaccugcaccgucaguaggcuucuuuaagccuagaaagauggucuuuccuucaaccaaguuuggauuaaaggugugcgccaccacugccuggcccagccaaguuuguuuggguggauggcucuuguuuuuugacacugucucccuuagcccaggcuggccucacacucgcuauguaguaaagagggauuuuggguugcacauccuccaugcuuccguuuuccaggugcugggauuacacaguaaaauugcuacuuguuuauggaauguuggggauauaaaaccaagggcuuaugcaugcaaggcaaguucugucagggcucugcguauuguacgauaccucaccccauugagcaccgcacauagccagggguuggaaaagaagggaaaaaugugucuuugguuuuauuuuauucuuuauuauuuuauuuuuauuaauuauuauuauuugguuuuuuugagacaggguuucucuguguagcccuggcuguccuggaacucacucuguagaccaggcuggccuugaacucagaaauccaccugcuucugccucccaagugcugggauucccugccucuugucucuugaaugguuaaagacaugucaccgcacuccauccuaaagauacaguuuuaaaaaaauuagcggcacacuuuuaaucccagcauauaaaggcagagucagguggaucucugugaguuugaggccagucuagucugaaacucuguagaccaggcuggccuugaacccacuugccucugccucccaagcgcugagaugaaaggugcgugccacaucuggcuuugaaaaucuuauuacaccgguuauguuuuguauguguaguuucguguuuuguaugcuguggucucuacugguggaguugguugucugcuucugucguguggauccugguggucaagcuugaaugaagguagagucuuuacagguugggcuaucucaaucuugaauaacuaauguguauauaguagccgcucacacucaaugugucuaaauaguauucuguugugaccaucaugagagccaagcauugugggaguuuggcugugcugccugaaaaguguuagcccaucgcccgggcuugcugacucagcacaaccuucaucuggguccacugcucccaccuguuguaugcaaaucugccuuaacugccaguggcuggcggaggggcuuggguauauaggccagggaaggcaauucaggaggcuggcuaagcucuguaaggaagccuagugaugucugcccagagugagcuuuggcagaauggcccuggguuugggacccagggagaacggagacaugguuuccucuuccccugggaagggguguggcagcaugcccugccgacuccuccgccuucuauuaucaccucugcuauuuuaaggcguauuuugauuucaggcaaccagacacauggauucuccucuggagaccugguaucagcuacuguagggcaaggcugguacuuaaaaaacggguggaagauuagcuugaaauaaagagcuagagcauuaauguccucuguuguuaaucuugaguaccgaggucaaacugaacauucuaaucuccaggucauggggucaccgagacuucuaguagcugguuucuauguaaguggcuucccuaacccaugggauuuccuucccaccugccaaccgucccuucgaccaugcagggcggcaguguaacacugcagacaguuuuugagacaggguuucucuguguaguccuagcccuggcuguccuggaacucuaucuguagaccaggcuggccucaaacucacagagauccgccugccuccuaugugcugggauuaaaggugugcgccaccacguccuggauugcuuagccucuucuuuuaaggcugcaguuuaaggaucugcuguuguuuugaauuuaaagcuuaagagagguuucaacauggucucuaagugcccucaggugaggaaucccguugugccggcugcuuggcagcucaggguggcuggcuggcuuccggccggguguggucaucgcuugcuugugagugucuggaagcaggaaagcaaggcaagcaggaagcuuggagaucucucgucuggguucguaggugcccaggauguuggcggccuagaacuuuccacuucuggaugucuuaaauaaaugcuagauaaguuuucuuuucaaugaaccuauuuauuuaaaaaauggcagcggguaaggauuaaagucuuuuugccagcagguauuucaguuuggccauggucaugaugaaaaggcacccagcaaggcccugccucucucucagcacugagcccacuccugcaucaggaccggucacugcuccuuggcccaguggaucuugccaucuucucgcagcugcacagccccgcuggccaccagcugaagagcggcaggaaagaucuuauguucugccacuuugacccguucagacagcguugccacagugucaccccuccgcacagggacagcuuccugcaggaugauuuguccggcaucuacaucuuccuggaaaaggaagcaaacguuuucaaccuuuccggccaguguagacggcagccagacgcuagcuaggucaaaagcuugguagggacagacauacucacagcgacaaaguguacgguacacccagugauugugacuccagcuuccaggacuugcucgugggcauuugaacccuuaaaggaagggagcaaggauggguggauguugagcauuuucccuagaaagcaagagagcaggagucagaaaucucagggcccguuuagacuguucaaggaacaagagauaacuaguuacuuagggaaugaacucuggagggaaggcgcccacgaaugugcagaccaaugaccacaccaggcugcagucagagucuuaaggaagagaacagggcuggcaagauggcugacggguacagggugccugccaccgugccugaugacugcguucaaucccuaggacacacauaguggaaggaggcaccuaacccuacaaaguguccucucaccaccacagcaugcugaggugacccacugcuccaugaucacuuaguaaauagagagcaaggagaaaagagacaaagagacuguagauacugcacaguuuuagugacaacgccgugcuugucaucuucuguguauuguucaggagggcauggguuucaagucuuucugugguaccaggaccugaccugacacaugcuagguagguaagugcucuacugcagaacuagccccuggcuacugcuauucucuauucugcaagagcaacaagugcucuugaccacaaaauguccugguuuuugcgacagggucuuggccuugaacugauuccaucaaggcugaucucuguccagcucucccuucaucuugagaucuuccuucuuuuuucucucccguucuuucacucugaguuugagagacuauguccuaaaugaacacacuggccuccugccucagcuucaggaugcugggguuaaagguguagacugagucucacuuuuuguugacuucuugauucuacugacaguaaaaugugucuugcaguaauggagccagggauuagugacagccaguccagcugagugaccacucagucagucugggcacuuccuaccacgucgaccccgugcucgggagaacugcuugcuuaccgucccauuuucugacgaagggcccagagaggauccucaugaacccugcaagacagacgaugucuacagagaacucuuccaggacguggucaacugcauugucaaacucaacacgauuuuuauauaauuugugauuaauuaccuguaacaggaaaaaggcauauagccuauuuucagaggaucagcaguaauuuaaacacaaccuugcagagacuacacuucagcaguaaagauguacccacuuagaggguggcugaggaacgggcaggaugcagcagaaaagcaaacccagcacccaccccuaacugggaagucccaagauuucacaagcaucugcggccucaugagagcagagugugaguuucaguacagccugcagggccuggaggugugggcacagugguacauccucggcuccaggccaagcaucugcccaccaggccuggccugcaggaaggccucuucugcagucacucacccuggugggaauaccagcucgcucagcucggucuaagccggcuacggcggcuuuguuggagaugacaagaacaauaugugaggagcucuugggaucccgggugcuaucuaugagcgccuggagguucgacccugaaaaagcaggaaagcaagugagcugacacuucugagagcucgguccuuugcuuuaucaugaccuugggcuugaaagauguugaaacuguaagagcacccugcagggcagccacagcacuggaccauugucuaaaagacgaugccuccaacaacacacuguucagggcagugcuacucguggcaaaaaccagagcugggugggguggccacccacuaaaucccacacuaggaagucugcggccagaccagcccggguuacuuggcgauucugaaagccaacagcaaagucacuguggugaccaauagaaucaaauguuucccuaccgaggucuuacuuuuaauaaaagacaauuuuaga

SEQ ID NO: 8330 - RNA, 4775 nt, Mus musculus
caaucauuaagguaauuuuauuaauauagauaucugcagaucaagugaaugguacuaaugaauaguuuuggugaccucacccucucauguauaacacugaagauucuuccacuccauguucacuccagacucucaguuuuaaagcaagcaucacagaauaccaggcucuuacagugaucgggagccagagcucuuagcacaaagccauacuccacgcugcugacaguuuccuuuaguaauacauauaguacuaucagauaacucauuccaacaacaaaaaauuacucauuaugucaaccaauugccccaucgucaaagcagaaagggcccaacuuucuuuugaggauguuggcuucuuugauguuuugaccacugcagacuuuacacaaugacucggccccauguccgugucaggagcuguucugaaacccaucuccacucugcucuggaaauaggucagcuccuuucugcacacuuuggcuuccuucuggggacccgauucugugcccaaagcaauuagccaagccugagagccccggguuuucugaaaggagacucaccgaagaugccaaggaacauauuucagauaccucaucuuagacaaacugccaaagggucucuuuguuguguuccaaagagggauaaguuggggguuaacauuguugaaccaucucuggggagucugcucuaggacaccauggcacuuaagcaagguuuaugggaaccuacaauauagcuggugaccagagaagaaacuacuaacuagugaacuuuuaccuuuguauagcuggugaccagagaagaaacuacuaacuagugaacuuuuaccuuuguauagcuggugaccagagaagaaacuacuaacuagugaacuuuuaccuuuguauagcuggugaccagagaagaaacugcuagugaacuuuuaccuuuguauuguucuuaaggauuuuugcccccuccaaaaguuacaaaaauauaaucaacuuuaacauuuucagaacuucuaaaucaaucaguuuaacugacuucuguggccagugggucacaguuagccuaccuacuugcccuuuucuuuguccagugcccacagggaaggccuuuguaaauacaggagccccagaagucuauuuuuuccugacuuucaguuuuagagcaccuagcagguguuugaaaagccuucccacaguuuuagagcuuuaauaagcucuggaauauaccagaggaaaccugcaaaaacuaccuguugucuggagaucuuuaauuuguuacaugugugugcacaugcguaugugugcacaugugugugugcacacuggaucccuggagcuggaguuacaggcaguugugagccaccugacuaggaugcugguccucugcaggagcagcaaagagcaaagacucucacccucugggcaguuucuccagccccuuucuuuuucauuuccuuucauaucuccuuccuuccuuccuuccuuuguucuuuugagguuuugaauuuucauuuggagaccacaguugguuaaaucucauuacaacuucuucaguucuauaccuuuugguuucauugcugcuuaaguccuuaugguuagaaaagucaaacagcgacuaccuaccuauaaguugcuagugucucagagagcucugagguuucuggaaggcccuaugugggccucgggucugugcuucaguccuagaggccgauaccugaagucuggcgccggagccugcuccuucaggggcagggucugccucuuacuacaucauuacagcagaacucacccaaguuucucaucuaccaccggggugugauuaguucugugaaaacuacaaaggcacacacuucucaggccccuggggcacgacagucaaucuuagguucugcgucugacgucagagcaacucaaaacugaccagaguggaaaaugaucgugaauaacaaaacagucauauuuuaauagauuuccacagauuuagccaguuuagaaagccugccuugacucuggguguuuuugauucuucucccuggcuaacgucaguuugguuuucuucugugacuucguuugcuucuacgaaggccccguacauuucuuggacucugauaauuucuuucugugcgucaaaauggacuuucugccuggucaggaugggaacaauuaaguugaaaucauuaauucgcuuguucagcuuucguaucuuuucuugaaacugcucacacacuugggcccacuguuucugcucugugggugacagaggguuccccagcuucuuccuagacauuaaaagcgcuucucggaguugcucgaugguguccuuaaucuccuucugcaucaggauccacucugguugguauccauuaucuaucaauauucgguucagguugugagucaugggaucaauauaugagcagccagaaaauuucuucagcgguuuuccuuucccgcugagauugucaaagucuccuuuugccauggauuccugaaugagguccuccaccaggcgcucgauggcuugaguuaucuucuguugcuugcucugccguacguccuugacaguuaugcuguuggcgaagaacucccucugaagcuucugccuuugguauuccaucaccugcuccgucgcgcgauccgcccugaacugccuguauuguuucucucgcuggcugggggucccaaagccgacaccuucgaagcuuaaguaaugucggugcugagguguguuguauuugaacuuuccuucuucuucaucuucugcugcaucuucagcuuuauccuguccggcaugcauccguuuuaucgcaugggacagcacauuccuguaagccucuucaaucuuuauaaauguugcagagucagcaucacuagaaccgcugucugggugguacugccuggcgagcuugugaaaagacucccugacgucgucuacagagcauccuucauccagauucagcagccuguaauauucucucagcuucugggauucauggguugauaucauccuggaucuggggucugaaagcauuuuuauaccaggaggaaucaaggaagcguuuguuaggugcagucucaagauccgaguggucuucaugcacacuguguuuaucauuguaucuggaauucuuaacagugaucuacaaaacagcaaagagcaguuggauacacuuguacuaucagucauuuucuuuucaucaauaaccagguaaggguauggguuccauguccuuaguaagcuuugguucuugggggcaagagaauggguugaggugugguucccagcacccacauggcagcuaauaaaugucucucacucugguuccagggggucugacuccuucuggcccacucaggcauuggacacacauggugcacagccauaguguaggcaaaacaccauauguauauaaaaaagaaagucaguucuuuguaacaauguugcuaaacaagaauauauaaguaucuaugacuuuucuuggugcagcuagaaaaugacagugauguuuggcuaucacauagugugacaggaacugaagucuacugcuugaagacaggguuucucucuguguagcucugguuguucuggacucacuuuggagaccaggcuggcuucaaacauagagagauccaccugccccugccuuccauguucugggauuaaagacaugcauaccuccgcccggauccaaugcacagaauuuuagaucuagaaaguuguuaaaacucaucuaaccuaauuuucucauuuuauaagaaaacggguccagaagguuaagcaacucuuaagguuaaccaaagaacuuacauuaccagguacugcaaaugguuagguuuggggcacaguaaagcuuaacugcuuuuugcuuguuuguuuuugagauagggucucucuacauagcccuggcuguccugggacucauuauguagaccaggcuggacuugaacucacagaggucagccugccucugucuccugagugcugggacuaaaggagagcauccaagccccacacuuggcuuagcuauacucagcaaauuacacauuucccugagcacaauuuguguuguuguuuuguuuugcauacaguguagaauggucgucaccauuuccaaguaucuaacuugcugcauaucaaacagggaacauacagaccgguacucagugggacaccagaugggacugagaaucaagaaugcaagcgacuuuaaggucugcaccucgcuauuugcuaggugccagggcaaggaagggcgauaaagggugagagagcuuuugcuguauuuaaaaacgcaugguccuguggaaaaagauacugaacacugacgaaaggcaacggaguacuuacuggaggauuacugauccuuugaauguaaggugcguuuuagaagucaugguagcccgaugucacaauauaggggucaguggauuuuagaguugucugggaugccggugguuaugcucaccguggugaggggugccucagaagagugucgguccgcugcacccccuacucaccuucacagacgugauggggguucagcggcucgaagcucaagcugcgccuuugcgcagcacgcguggcccgcuccgucccugucucggcuacuggacccucugccgcgcuacacugcagagccuuucuucauaccuuacuacgacagguaguuucccucaccagggacagcgaucucuuucuuauaaaaccaucccccacggaacagaggacagacuccccuggacgcuuguuguugugccgggggcgauaggccccgccucuacccgcuu

SEQ ID NO: 8331 - RNA, 653 nt, Mus musculus
cugagccuccugugagucaaagugagauuucagagccuauggcaguaccugcuaauuauucaaugucagaaucagaaacuucaauguuagcaucagaggcuguuaugacuguuccagaaccugcacgagagcccgagucuucaguuacaucagcaccaguugagucugcuguaguagcagaacaugaaaugguuccagagagaccgaugacuuacaugguuucugagacuaccaugucagucgagccagcuguguuaacaucagaggcuucuguuauaucagagacaucagaaacauaugauuccaugagaccuucaggacaugcuaucucagagguaacuaugucacucuuggagccagcaguaacuauuucacagccagcagagaacagucuagagcucccauccaugacugucccagcaccuucuacuaugacuaccacagaaucuccaguuguugcugucacagaaauuccuccuguggcugucccagaaccucccauuauggcuguuccagaacuccccaccauggcuguaguaaaaacccccgcuguggcugucccagaaccucuuguggcugcuccagagccuccuaccauggcuacuccagaacuuugcuccuuaucugucucagaaccuccuguggcugucucg

SEQ ID NO: 8332 - RNA, 653 nt, Mus musculus
cgagacagccacaggagguucugagacagauaaggagcaaaguucuggaguagccaugguaggaggcucuggagcagccacaagagguucugggacagccacagcggggguuuuuacuacagccaugguggggaguucuggaacagccauaaugggagguucugggacagccacaggaggaauuucugugacagcaacaacuggagauucugugguagucauaguagaaggugcugggacagucauggaugggagcucuagacuguucucugcuggcugugaaauaguuacugcuggcuccaagagugacauaguuaccucugagauagcauguccugaaggucucauggaaucauauguuucugaugucucugauauaacagaagccucugauguuaacacagcuggcucgacugacaugguagucucagaaaccauguaagucaucggucucucuggaaccauuucauguucugcuacuacagcagacucaacuggugcugauguaacugaagacucgggcucucgugcagguucuggaacagucauaacagccucugaugcuaacauugaaguuucugauucugacauugaauaauuagcagguacugccauaggcucugaaaucucacuuugacucacaggaggcucag

SEQ ID NO: 8333 - RNA, 4533 nt, Mus musculus
ccuuuuucuugcaguucugggauauguagguccgagagaccucaacucuucacuugagguucccuacuuuggccauaaacauuuuccaguaaacacuugcaauucuacaaauaaaucuuaugaaucaaaguaaacaacucaaaucaaacuuuuucaugcaguacuuuccccagagaaauucaaaggcgacauuuucacuguguuuuuuugaccugcggcauuugaaugagugggaacaguucuguaguagcugaaccuaagcgccagugcagcuaguugguuuauaguuaaaggugauggucaguauucacacggaguucaacaacagaagcauacuaucccaucaccagggaggaggagagaagcugguuuggacaguacuuuacaaguuuagugcucauuuacuaauccccaaaucaggcuacgccacaucucaggagggaaagcuaacugacacuuacagcuaacuuaaucuucuuguagaagccggauauaaaccaggugagggcuguacagauuuagauguccugauauaugcacuuuuaguaauuuaguacaacguaagcauugaaacaguuggaaagaacauagccaggcaagaaucuccuauguggccaagacuuaguaauauuguagaauucuuacagauuucccugagagaaugauaacuguugaaccauggggaaagagcuuaguguacagaucaguuauacuuucugaccaagaaaagguaugauuauaauuuaugagugccaucuucagucucaccacucauugaugcuuuagccuuauuucccauuagaaguuagguucucagugaggggcaguguugagagaggauggcaacacugcacagauggaaggcuccccugcucaggugaauaaagcugaugucuuccuugggagaggcgugcgggugagcucggagcugcucaggcagagauuuggacuauagauuuggaguauggaaaggaacugcagaauccugagcuuuuuaagaacaaagggacaaaauugauuugcuuucaaaucuguauuucugugacaguguucaaggugccaaaaaaagcugacaaaugauaauagccaugcuacuuaguugccaucuacggguacuguuuuuguagugcgggugaguacuuagguugacauugcgagcaacgacccuucugauuuuaguagggcuucaaaugagauuuuguuuguuuucugaguaacuuuuuuuuaaaggcaagguaguuuuuagaaaucagucuuuguuguuuuaauaaguauaacugaaguuuauaguucuucagucuugaccguaaaacauuucagcaaagaugacagaauuguaucuucauaaggacuaaguuguccuuguaauuccuaaucccacaacugucuugcacgugagugugcugaugugagcgaauagacacggacggaacugcauaaguccauguuacagaaaaugacucaucagauccuucugccauagcaccgucuuccagaaaccagccaggagcauccucaggaaggagugacuacagaauguucaccugauuugugugaaucugaguuauaaacaaaaaaguuggaaaguauuaaaagaguaguccucaaggacaguucuuuaacaaggucagcgcagggucauuguucagagcauuacaguaguacagaugugcaaguggagugauccgacuguggucagaaccacugauuugggauguacacaugcauuugcuuuagagcugcccagcucuaguuauugcuuggauguuaacaacauuucugucucaagcaguuugucagguuuguauuacuggaucuacuacauccuauuagcuaaaauucucuugaaauuggaagcucuuaguuuaugaaauuuaucagcgguaaaucuuggacagggaugaaaacugcaacugcaucuggaguacaggcucuuggauuagacacuccagaugauguggggcauugacucuuguuucucuagauuuuuauaagcuguuaauccugaauuucucugaagcacuaaggagaaaaauauuaauucauuuagauaaacucaauuaugcuauaaauuuuugaauaauaaaaauauucaugauucauuaaaaaacagugacuuagggauguucuauguugacaugccuuuucauuuugaaguugacagcauguuguauaaccaguccauuuuaauaauuuuguuaaguauuguaaaugcuuuauauguucgaguuguuuuucuuuagguauuuguuagauuuucuuuuauacucuuugaggugacuacaguugccuguguagaaaauaaucuaguuuagccuaucacacuuaacuguuugccuuuagccuuugucugucaaucacugagguucugugaaauucuuacaguacacuuuuuuuauuuauagaaaucacugggcuuaagcaaaguggauauccgaggagaagcaaaagagagccuugugugugugugugugugugugugugugugugugugugauuacaggccaugaaaccagauaacuugacaauaguggcaguuuuuagaggaccugcgagaaaugggauuguuauuaaugugaggggaguagacugagcgguuuccuggguaguaccuagaguagugcuaccacauaguuccuuuacagacgcaucucauacauugggaagcaaggugaccugcucaucuaucaguggaaacagugugguaauauugugacaaaugucuuacagaguuuuuaaaaaaucuccuaguuuguagaacuuuaucuugggacauuuuucauguuuguuuaauaggcugguuaagauuuuaaaacuguuaaauguaacaaucaucagccauuaauuuccugaaauucuaaguucuuagcuguguguguagaucuuuuuuuuucuuuuuuguuuuuagagcuaagugcauuuuuuauggcuuauauuugaaauuggagggucugacuggagugagcagacacauuuucuccagugccuuagaauuuaguuucucccugugcccuaacacccuaucacuuagacuugcaaauuguucuuaaccaaagcaagucuacuaaggccaugggauaguucaugucucauuuggcgguuuggugggauaauuccacuugacaguuuaggugacaucucagggaggccuaggcaacauagauuuugguuugaaauaacuauauucacauugaaaaacccaggaaucacauggagcacauuuuugaguuccgggauuaaaucaacucacaguaaaagcaaaaggugaauacaguguguuggugugauuauauauagguugucuuuaggcuuuaaaaaauauuaggcauggauaauuuacuaagcaaguaagagcuuucauuuaaaguaaauagucuaauaagcacaaaauaugggcuuuuuugaauuuuaugucagaaaaguaugcuuuguagaaaaaugauuuagucagagucuuggauaauuuuaauaaagauaaauaauauauaagggaauuugaaauuggaaaaaaggacacuuaguccuuaugcauaaaauauuauucuuaguccuaauagauuuauuuuucuaggaacuauacacaguauacagugagauuucaucagcuucuauuuaaaaaaaaaaaaagaaagcuauuuuacugauuuauuuguaauuugcauguauuaucuacuauugauucuuugugaaaaaaguaauuuuuuauaucgcauauuuuauaaaaaauuaugugaaauaacuggaaaauacuguuagguuaaaugaugaaaaaaucguguguggguagaacugaguucauguuauaaacaaaacucaaauaauuucacaaggcuuuuggccugugguuaagcuuuuaacaaauccaauagcuaagaauuuccuuuaaggguggcuuuuaaaaguuaaaauuacaucugcuuaccacaagggcuuuguuuccaucuuauaaggaaauuguaaugcugaugaccgaccuaacacacacuaggccacugaacuacaccucaaccuucgccuuagguugaagagguggauugacaguauuugcgaggaggacuuaugguaauaaguguuuguaaauucaaauuaucuaucuacugaauguuuaucaagguuguggguucucaggaccaaaaccuauccaugcccagcucugcucccgugaagcaugguggugagagagccauacagauuguugcggugcucugugugcuuauccacagaucuugcucacuacucuagaaguuacagucauuaucaaguagaguaugaggaauuaguaaagguaaaacuaccaucuuaaaugaaguggcuuguuaguauagaccacaaguuauaaguucauaaugaaacucaacaguuacaguuugauuuguagaaaauacacagaugaaaucagucaacuuaguuuugccucugaauacuugauaacuaacuuaccuuaaaugucuucuauuuuccaggagugcccucuuugccuuuugaaucuucucauuuuccaagaaucuuaauauauagacuauuguuuauuuu

SEQ ID NO: 8334 - RNA, 40160 nt, Mus musculus
agguuucugcucuaugcgugcggagauuuuguuucacgauuuggcgcuuugcucuuuucuaugcgcgacaguagcuaggauacauucaacuaaauugaagguuuugcagaaagagcgugggcacgaaaggcgaaagacacaaagacugaagaaagaugguagggguuacgguuggaaugaggaaggguguggccuuuuacucuaauuugcauaaaacggaacccaucuuggcaacgcccaacuucucccauuuauugguggucccuggggcggcgacucgucucucuacgggaagcagcaugcugggagauguaguuccggguucaguugccauggcguucgucacagccucccccagaucggucauccugcgguagugacgggcagucugaccaauggcaguacuguuuggacccaagaaggcgggcucucugcagaaggacugggaagguggcggcggcgaaggcgcuggcgguugagguugcuccgagccaggugagccagggaagaacgaugugugucucugaaaugggacuuugggcgaaaaauggagaaacgccugaaggagcugucuaacccuggggagacugguacuucgcaucacacgccgaccucagagaugcccuggcucaggccuagcuuggccgaggccgccgaggggcggguaauacuagauuugacggacaguuccugacccuggcuagguuuugauuguagacugaucuuugcuucuuccuccgcguuuauggaggcaaaggucuagaacugccuuucuccuggguugaguccuccccgcccccagcuucucccuaucacuguuucugaugcugucucuauuacuacuucccuugucacccuucuuauccuucucuuugcauuuccaguaagcgguuuccuaaagcaaacaaggguggguguucgcaguaauggggccuugggucaggaauugccugcuucauugagccggccauacuugagccauacuaaagaauuaucccagggucgugaggaggugcagauacugauucuggauuugggccugguggucugcauuugcuuuuuaaaaauuauauauauauaucuauauauggcauuuuaaacaaacugccaaguauagccaguccacaguagcugaguuuugcauugccuguccaggacagauguucuaggcacccagacgcuuuuagauuuccugggagccacauuuggacagugaagagaccacgugaaauuaauuuuacguuucucuuaaaccagcuuauccaaauauuauuucaaccuuuaaagaaaucagauauuuaaaugagacaguguaucuguugugcguuuuacccucgcagcauacccucguacccucauccuaagggcacgccacucacgugcggaguagccaccuguggcuauucgccgcucuccgaauccagaugaugcaagagaccauugcacaaacucagcaguguuagucaugugauugccagcgacaucccuuugcugcuucaguacauggguucagaacuacuuucacaauacgauacugagcuuacaagaauaccagggaaaguaauauuuauuaaaaagccaacuuccguaaugugugcgcuguguacuauacucacucaguccuugcagcagccugcguccuauugcgggguccugucucuugggaguuguaaaucuuaggcaucagccacugcaauguacaauuauuacuggcuuuucuaauuaaugucacccacgcuucugucuccacauguagaaggagaugagguguucauauuugaaacagugcuccccguguaaaaucaagccgcccaaggcuggagagcuggcucaggguagggacacuugguacucucccagaggaccagggcucgccacuguaaccaccucuguuacacuaguuccagcggaucugaagcccucucgugauccaacggcacagggcacacaggcagggugcagacacagauccagcugccuggccuggcguggugguggcccaugccuuugacuagugcuugagaugcaggggcaggcagaucucugugaguucaaggccaccaugguuuacagagcaaguuccacggcuucauagagagaccccaccucaaagaaaccaagauaaagcugccuggcaucugugguaaaauaauugugguaauuuuauaguucuccaugcugcuccauguuaagaagaaaggugcaaaccugauggagauuccugagccucuggaccagaaagaguccugauucacuugugugccucccucaaggaggaggcugggaaaagcuugagaacucggaaaaugacaugguucauuccaagaacacaugggcauucccccuaguggugcaggccuggacucccauccaguggaugggcaguucagggccagccuagacaacuuagugagacugccucaaaguaguaaaaaaaaaaaaagaaugaaagcccacagacacagugucuccugguuguguuuguggcagacucuucuugucucaguagcugguccaggcuggcuggccucagccuccccugcacuguuggcuuacuguagccuuugcagaccuaugacaacacugugcugagaacuguaaauagacaauggcagaguauaaugcuucacaaagugacuuccuuccaguuuuuauauaauauacuuuacgagguuguuuccucuuucaacucuuugucuucugguaaggaagcucaaggacauuuuuauuagaguuuugaaagaaggcaguauaguuuaggugagaauucuggcagccacuaggaggagagccgcaggauaauucacgccuucugaguuaggcauggaauacaaacagagauggcagucccagcagaggacguggccuacugagcugagugaggagcaccagaaaccuucauacuaaaaucaaaauuaucaucuguauuccacaucuaaaugauuccucaggauccuaucaugaacuggcagauaaggucgccauuuacgugaggaugcuguaauguuaacagguagagauuuucuuaccagacaagagggggccgggcuaagagguagagaagacacucaaguaccuaucuccauguucacaucucuccacgcugagugucccagugucacgugaccaggcuaucuuaacggaaaggcuacauucaccauguggcuucugccuuuggcccugguagcccaauucagaaagguaaaugacagauuacgucucuguugcucugcaucguaccauaguaaauggccauguugaguaacagcauuggagauauggccuuccaccuuuccagccaaccucucccacucccgaggguacugacagggaaauaucugauguaagaaauccuaggcauuuuuuauuuuaguuuauuuaagaauguacugucucauuuaaaugucugaaaccuaaaauauacaagcaaaacgagagagacagcucaguggcuaaaugcccugacugcucuucugagaacucuggguucaguuccuagcaccuacguggcaggcuauauguagcuccaguccuaggggauccacauuuuauguauuuuauuuuauuuucuggguguuuugcccucacguauuuaaauauuuaacauuuguguugggugcccucagauaccaaaagaggucaugagcuucucuuagaacuagaauuacagugguugugagccaccaugcaggugccggggauugaaccugaguccuccaggagaguagucaguacucucaaccacugagccaccucuucagcccuaaagccguguacacgcugaggugaaaaucaacuuuauaaaaaucaacgauaauucacauggaggugggugggagaagauauuacauuuuucuuuugugauuucuagaacagguguuugaugggugccucccugcucacugggcaccuguugaaaacaucuuguccagauaaagcaacaguccgacgucucugaacacacacacuaucugcuuguguaacuacacuuuuucugccucucucgcaaucuuuaguucgcaagcugcguaaaguguaggaauuaugccacaauguacacacucuuccgugaugauauucauagagcugcagauggucagccugcugaggucacacaccugucccagcccuugggcgaugaaggcucaagguacaggaguucaaggucauucuuggcuagaaggcaaguuuggaacuagccugaacuacccucucaaaaaauaauaauaaaagaaauugccauuauuagaagagacuuuaaaagccaccugguccccugucccacucaccuggugcuggaaucccuguaauggcauccagccuguuucaguacuucuaaagucaggcauauaggaagcucucugcaaguucaagugcaaccuguuaacguagugaguaucaucaggucauuuagggcuacacagcuagauguugucuuguaaauacuuaaauuauacaagggaagcauucuuacaggggcaggagaggcagcuuggugguuaaguggacugacugcucuucugagaacccugggcuuaggucucagcggcuacauggcaggucccagccauauguaauuccaguccuaggggauccagugcccucuucuggccuccguaggcacugcuuacaaguggcacacuaccagucacucacuuguacaugaauaagaauugcaagaaaucagucuugcuaaaugugguggugcaugccuuuagucccggcauucuggaagcagaggcaggcagaucuuugugaguuccaggccagccagggcuacauagagagacccugucaaguuuuauaaccacacauuaugugcuggacuuucugugauguguccaugaugacaucacuaucagaacaucucugcccguccuguaaaggaaacccacucacucgugcaucuguuggcuuugcgagcguagguaagggcuaaugugcagagguuugcuuacacucauuaguagaugagcucuguggggagucgaggguagcaggaggugagccaguguagcucuuguuguuacaacaaaagugaagccaccaucugagaucucuucccuuggcucuggagaaaucccggcagaggccuaccuuuauuaggaacuaggacuuacaguugggugcuuaguguaugccaaggugucccucuguuugcacagccgaaucuuuuuuguuguuguuguuguuguuuugguuuuuugguuuuuuugaggcaggguuucucuguguagcccuggcuguccuggaacucacucuguagaccaagcuggccucgaacucagaaaucugccugccucugccucccaagugcugggauuaaauguaaaaaugucaaaucugugugcuucucacaacacaucuuagccuacauaccuuuuaaauuuuuuguugaauuauuauuauuuucuuuucaugugucuggguguuuugccugaacguaggucugcgucuuuggagagcaguagaucucuuacaacugugucacagacaguugugagccugaguguggaugcugggcacugaacccagguccucugcaagagcagccagagugcuuaaccacuaaaccaucucuccagccccgccacccuaccuuucuaaacauauuugaugucauugaaaaguuuuauaagcuggaugugguagaucaggaguuucaggccagcuaaggcuccaguucaaguuuagccugggcaacacagggggacucuauuaccaaaacaagagcacauagaaaguuuuaacuguuguauuagggaugugcucaguagugccacacuuacauagcauggaugaggcccuggguucaagccccggcaccacaaauaaauaaauuauguaguguuuuuuugauuuagcaaaguuuauaucgagucauauaauuuuccaaauuauauauaacacucuuagaaaugagagggcacauccucaucuuuaauugagccagaugucuaguuauugucuaugugcaaauaucucuaaguucauuaaaaaucuuagugaacucgagucuuuguuaacccaggccagugccuaagaagccaccugggccuugacuaucacccauucuacaagacguucagugcuuagggcucagaauucccauuuugaugagggguggaaaggaugguagaaauguaaaucgaauacuaucguaugucgaauacuauacuucuugauuuucuuuuaucuuauacugauuuacuuacuuuugaaguaaauaaauaguuaaauaaaccaagccgccccuuuaagggcuggagagcgaggucagcacugagagugccugcugcucuugcaaggcccugagcuccuuccccagcacauggcagggguggggggcucccaaagccuucccuccagcuccggaggacccaguggccucucugccccaugcaggcauucacucacagcauaaucuuucagucacauuuguauuuauuuaccuguaguguguaggcaugcacgagugcacgcgcgggucaggccagcugaggagagucaggucucuccuuccaucuuggggauuauuguaggacugcguugucaugcaugacagcacgugcuuugaccugccgagccguccuccaagacacacagauuauaacaaaagaaaggggguuuuuuggugguggugguggugguggugguguuuuuuguuuuuuguuuuuuuuuuuuuuuuuguuuuucgagacaggguuucucuguauagcccugccaguccuggaacucacucuguagaccaagcuggccucgaacucagaaaucugccugccucugccucccaagugcuggaauuaaaggcaugugccaccacacccagccuacgaaaguauuuuuaaacaauuuuuuuucuuuauguuguagcuuggagaauaguuuugauccuauacaguuguuaauaauuagauuaacuaauccguaccucucccccacccccucucucugaagaagauucuagggggugcggaauugucucccaggucuuugaaacugauacauuauugacccaggccacauguuagcgguucaauaggcugaggaaacaguggcuucuagaacgacaaagggaacuguuuugaacucaggauguuaguauagacuuguaccuggagaaaaggccacagcaguaagucaggacugaauaggagcagagauuuguugaaguaauaaugcuaucccugggcaugugcugcacaccuguaaugccaguacgucggagacagcccggaggauccagaggucaagaccaggcaagaccacaaaucaagacccugccucaaaacaaauaaaccgaagcauagggaaggaauuaaugugccuaaacaauggcuggggaagcucacucgcgaggaagaaaagugaccugggaguguggagcugguggguacacuccucccaccucggguggccugcgagagugggcagguggaguacacuccucccaccuaggguggccugcaagagugggcaggugggguacacuccucccaccuaggguggccugcgagagugggcaggugggguacacuccucccaccuaggguggccugggagugugggcaggugggguacacuccucccaccucggguggccugggagugugggcaggugggguacacuccucccaccucggguggccugggagagugggcggugggugugcuccucccauugugaggcuguacagaggaggaucuggaauguauggauucacucugugcaucaguguguuagugcagcacacucucaaggacugggcugugccuagaaacccuacaguagggccaacuacgugcuaagucaacugacuccaucaaacagguucuugcugagacacuguggguggaauaagguagaacagcgauaugcacucagccuagaaagcugggcagacgcugaaagacgcaagugggagaugcgugcuaugucuguuuaaguucuucuccccucaugguucaaugugugucugcgcgcacacacacacacacacacacugauaaagggcugcuguuagccaugguuuucaccgucuugacauacauacuacauacuuuaaguccaugucuuaaaggcgugccugugguuaguuucugcauuugauuuucucauccuagagagcaguaacuauuacucagcuacucaauacaacucuuuuauagagauccauuuagggccacagagguccuggcacccagagcuggcuucaugagcaugacagcuaugccggucgcugggccucuuguucagaggaccuacgcauggcuugagagcugcuauugugaacucucagaaauuccaguaauuuacaaagaaggcaucccacuucucucucucucucucucucucucucucucucucucucucucucauucucucucuugcucucucucucuuuuucuuuuuggcuuugguaccuacagauuaaaacaacagaucuaucugcaacugaauagucagucccaccggagaaaguuuuguaguuccaggugaguguauccuagcaguagcucaguagaaaaaucacuccugugacaguucuaaguaacgacugccgaggcuccagcccagcugguacugugcgcuuagugacuuaaccccugguacugugugcuuagugacuuaaccccuguaagguacaguuuccaugguuccuguuaccucccugcuagguggauggaggugcagcuuccucauccauucaguaaauguaaaaaggauacacagaaauguucugaacauggcuguugucagccacaagcuguaaacuuucccagcgugaauugcaacauugcuauccugaaguaaauaaacagcggugcgaaagccuagacccggcuaucagcagcaacagcagaguggggcccaggaacaucacaucaggagaaacuaugcaaagacagcaccgugcaaucuccuuucuguguacuucgaaaggagccuguuugucugucuguuaaaauugaggcuguuucauauccuuaggggaaggaaggucacaaccugaccgaggcacuuagagcuucagaagguggggugcggcuccugcugggacaggagcacaugcaugcacucccuccccacugggcgaacucuacuuuaggggucugcacgcgccuguguauauuucuguaaaguuuacacuuuggaaaauucaauggucuaggcaggugggucagaccuguacccuaccucucuaccucucuggaagccaaggcagcggaacccccggaacucaaggccaggaacucagucuuggccacagggaguuccggacccaccugggaugcaguuugcaaaacaacaaagaauugugagauccuuaaagguaguugaagaacuucccaggcuaucaccagcuggaaauauuuccauuaaaaagacugcggagagcgcucagugggcaaagagucugcuguccgagggugaaggcuggagucugggugaagucaucccugggcaggugguccuggguucuauaagagcaggcugagcaagccaugaggagcaagccaguaagcagcaccccuccauggccucugcaucagcuccugccuccagguuccugcccugcuugagucccucagugauggacuaugauauacaaguguaagccagauaaacccuuuccuccccaacaauacagaaugguuaggccauggcuccuggcaaaggaagauagccaaugccauccucuggacacacagacacacacgcaaacucacacaugcaaacaugcaugaacacauaccauguacacauacacugcaaaggggggggggguuauagaggaccuggaggcucagcagugaagugcuucuuuggauccucaacaugcaugugaaaaauaagccaaucauagccacaaacacguguaauugcagcaccagggagacagaaacaggaggagcuacggggguaucuaagucaggauuacggucacuguuaugaaacaccaagaccaaaagcaacuuggggaggaaagaguuuaucuggcuuacacuuguauaucauaguccaucacugagggacucaagcagggcaggaaccuggaggcaggagcugaugcagaggccauggaggggugcugcuuacuggcuugcuccucauggcuugcucagccugcucuuauagaacccaggaccaccugcccaggaaugacuccacccacaaugggcggggccgccccauggaucacuaacuaagaaaaugcccuucaggcuugccuacagccccaucuuauggaagcauuuucuccauugagguuccuuucucuacaguguauccagcacaagggugcucauuggccagcuaguuuagaugaauuggugagcuccagguuugauaagguggcugggcuacaaaccuuuaauuccagaacucauagagcagaagcaaguggaucucugaguucaaagccagccaaagcuuuauaguaagacccugaccccccccccccaaauauaaauaagauggagagaagaagaaacagugucagccuguggccuuugaaugcaugcacacaugugcaugcccauccuuacauauaacacacaugcauauucaaaccaaaacaguuuuuuaauuaaaaaauaaaaggggguacugaggagauggcucagcagugaagagcaauggcugcuuucaggggacccuguguucuucccagcacccacaugguagcuuacaaccaucuguagcuccacucagaggcuccuuuccagccuuuccaggcacaaggcacacagguacuacacauacacguguacaagcacaacacucaucacauaaauaaaccuaaaaacguuucauuaaaaaagaaaaacuagaaaggcuuauaggguuuggacacggcacacccuguaaucccugagucugagaucagcauucaugcuacagugggacuuagauaaacaagaaugccccagaagaaugcagaccacaguuccaccgagcgcaagcgcggcuuggcuguccacucuuacguuaauuguugaccgcauucgauuaccuuugaacacuuuuggccugcuucuguggcccuugugagacauuuuuguuggucuguuuuaaauauacacaacauuuauuauugaauaggaaauggaaauccuucccucccccuuguuuuucuuucuuucucuuuuuaagauuuauuuaauguacaugacacugucccugucuuaagacacaccagcagagggcaucggaucccaucgcagaugguugugagccaccaugugggugcugggaacugaacucaggaucuagccagugcucuuccucacccccuccuaagcccuuucuuuugagacaaagucugaccaucuaacccaggccagcuucacacgugaggcuccccuuagcuacagaaugcacagucuagccugugccaccaugccugaaaccugacccuucagaaagcuccugugacagcuuggggauugauccuaguccgucucugucuacccuucucucccgaagagcaguaaaugcucuuaaccacuaucuucagcccccaagaagacgguuuaaaaagcuuuuaucuuuuuguuuguuuguuuguauagguaacuaugaaaggcuuguauuuucaacagaguucuacaaaugaagaaguaacauuuguauuucaagaaaagguaagaauaauuauuaauugagauaaaauauuuucuuuccauagguaguugccuuuguuuuguuuuguuugcuaagagaaaaugcuuuggcaaaaguaacuugagggagaaaguucuuaucucucgggcccaggcuaaaguuggccgugacagggaagucacagcugcuggggcgugaggcagcuugucagucacauggcaaccugucacguggcagccugucgcaugguguuccgagaaggagaugaguguagcugcugcccagcucucugucccucacgcacacaggacccggccauggaauggcgacaccugcugugggccagccaucaagacaguccccacaggcucacuccugagugucccuggcucccaagcgauucuguucggucaagucaacacuauuaguacuaaccaucacaguaaugacccacuaacaaaaguguguguguguaccuugugaauguauauguguggcuugugagugugcauaugugugugcaugugucuguguguaucuauguguuugugugugugugugugugugugugugugugcaugaaagagacacagagucuucuauaauucccccuuuuucaugugauacgguauguauacauguauaugaaagaaagagagacagagagaaagacagagacaaagaggcagagagacagaggugggugguacacauuccaugacacaugacacaugugguggucagagguccacuguuuugagucgguucucuucuuuuaccuuuauauuggccccaggagccaaacucagauugcugggcuuguugggcaagaaccuuuaccugauggagccauucauggcccccagacucacuuuucaauguguuauuaguuaaauggaacuaaaugaguaaaagcagaagccagccuccccauauauucccccuugauuggugguuuguguuguagugugacuguagucuuaaaggagcugcugcagagcugaggacccaaguuagguucccagcacccaugucaggugucucagaaguccaccuggaaguccaaugccagaggaucugaagcccugucuggccuccgggggcacugcacucaugggcacaaaccacagucacauauacacacaauacuuuuuuuuuuuuuuuuuuuuuuuuuuuuaaagauuuauuuauuuauuauauggaaguacauuguagcugucuucagacacuccagaagagggagucagaucuccuuuacggaugguugugagccaccaugugguugcugggauuugaacucuggaccuucggaagagcagucgggugcucuuacccacugagccaucucaccagccccacaauacuuuuaaaugaagugcuuuuuaaaaggaguugcugaguuggugccgggaaggcggagcaagcuccaagccgaugugguacucuguggccccaggugaauggguggcgcucaguggcacacucuuacgcagcauccacagguucccagcaacaagaacucugugagcacugugcagaggugagguuucagacaugcuaggaaaugucugaguuagugaacaggagagaaaagccuauuuucuauacaaauuuaggggcuuccuaagcuuacuuuucucauuaagcuuuuuuuuuuuuuuaaaguuugugaaggaucacuuucuugcuuuuucuaggguguaguuuccguccuuuuguugguguuuucccuuuauuauccuuugaagggcuggauucguggagagauauugugugaauuuggucucauuaagcuuuuaaugacuuaguggugauuguuagaaagguuugcaucaagccagaucaucucccuguggguuucaggaugaaagcaggggcuggggucucagcugcagucagcuaaccuccagccacagucagcaaaagaaccuaggcuuggcuacaucccaguaaaacucgucucuaggucuaauuaacaaguucaucaguacuaaugccuucauccuugucacuaaagagaaaauuggagaugcaguaaaagugugccccggaugcugaguggcgaaaaaagcacagaggucccugugaugggucacgagccgugcagggucuuuccucacgucacucagggacaugugucaguucacggucuggacuacagaagugacgucacaucacuuagccggacggcucugaaugcuucagucuugccuuggucaccuuauggaaauuccaaauuuuaguaaaaucugucuguuguguguacuguaaagucuuggcagcuuggaguauuuaaguuaaaauacugugucugccuuccuggcuuaugaagcagaguuuguguguauggcaucucugcugguguuuugagugcuucuaaaauaaagauacgaacacuuuuaaaaauuacagccccugauuuuucuuucuccuuuucucaucauguacuguuagguauuucuuugugucuuuuaaacucaggaugcucucgagacuuggcgucaguuucauguuuucaguuguauguggacauucucacaagaugaaccaauguccucuugggauguguaacucgagcuucuguuauuugguuccaggaaaaugucccugucacagaggauaacuuugugagaguucaaguuaaagcuugugcccugagccacauaaacacaaagguacgggugccagcggggacgagggugucacgguguaguuagugucuggugguaacugugugcucagugcuagccaggaaauuacuccuuagaaaaaccgagcuugaagcucgaguguuuccacaccgagguaagugguuugauuuguguuuuauaucguuaugugggaauauuuuauagaauuuauuuuggaagcaucugaaagcauauuauuaaguccuauaggucaaggaagaaacuaccuucacaaguacaauaaaaauagaaaguagaagccgggcaguuguggcacacaccuuuaaucccagcacuugggaggcagaggcaggcggauuucugaguucgaggccagccuggucuacaaagugaguuccaggacagccagggcuauacagagaaacccugucucaaaaaaaaaaaaaaaguaggaacaguuauugaccacgaguuguauguauuguuaguuaacauauuuucagcuaugauuuguauucuugucauguuucugucucacagucuccagucucauaucgcccacaguuaucuuuaguauuggccauaaagcaugugucuuuggugcaggcauggcggcacauaccuuuaaacccauuacccaggaggcacuagcuucugagaggcugaggcaggucuguuccacacggcaaguuccaaguaagaaagggccacacagugagaccuugucguaaaaaacaaguaaacaguuaguagacauaagugaguaaaugugccaucguuaauagugacaguuaagugcaccgugauaaguucucucagguuuuguugucagacagggucucacuguguagcccagggugacccuaaacucauggcccuccugccuuggcuucccaggaacugggauucuagguguguacaaccccacaucgggucuuucuccuguuuguguuuugggggacuuacuguuuguuugauugugggucuuacuugguccuuugacuugaaccacugacacuucuuuuaacccagauuugaaggguagaagccgagaucacugugcaagcaugguugucucggguccauccuucaggguuugaaugagguccuggcuguguccucgugccuuucuucagugugagcugcuucuggugucucgucguccuaguccccaguccugacaguuaggagucuaccccacaacuucacuuacugcugauuaccuucguaaaguccuucuccgugccagucacauugggcacacguuuuauauguccaugacuacaucuggggaaauaucuaaugugucuacuaagaagagaugcuguccaguugcggcuacuauucaacguuacaggaccgcacagauuccaggugugugguguugacucuugaaccuggaccuuguggacaugaggcaagcgcucugccacuaacagaaaaaagugacaaguagcaguugaauaaacugucacgugcugcuaggcagggugucuuucugaagacaguacauuaagguaggaaaaugugcaggcacacaacacacuauacauacaacacaacacacacauauaugcacacauaccacacagccacauaccaccacuccuccccaagcccucuaaccugggaccgaggaaaacaauggugucugcuuuucuuuaagacagaauccauaaauccucagacuggccuuaacauaagaucuugacaccccugcccaccucgguggugcugggauuguaggcuaacagaaaaaagugacaaguagcaguugaauaaacugucacgugcugcuagacaggugucuuucugaagacaguacauuaagguaguacucaggccuugugggacucagggcuuccugcgugcucagcaaggcugccugcugagcagugucucuagcggauccugagggugugaggaggccgcccugucugucugucugucugucugucugucugucugucagcagucucugucugcccucccucaccucacuugaacgggggacagggaagcugugcuuggccaccugagauuguuuggaggugaacgucacuucaucuccacagagaaaauguuacagguguccuggcacccaggacucgguucugugucacgggccucagcagcucaugcuucccacucuggaacgggauuuuuugauguuuuuuguaauuuuuuuauauuuauugucauucugaaggugaauuguauuugcuguucuguggcuuggguuuuuguugucccucuuucucacaugucagaaauagguuuuuauugcuugguuuuguugucauuugguucuugauccacucuguagcccaggcuggccaugagaacucacuguguugcuuagacuacccuccaacuuaaggucuccugccuaucucuccagcaugcugguguuaaggcaagugucgggauuauauaauguguuagcauguaaacccagacucuauuccugacaguaaugugcugacacacucugucaugauuuagcuucuagcagaaaugaagauggaaaaggauuucuucccuguuggaagagaaguuucuggaauuguauuagaggguaaguauuaucuguauuuucuauauaaaagacauuuaggccaggcacugguggcgcaugccuuuaaucccagcacacuagaggcagaggcagguggaucacuaugagucugaagccagccuugucuuccaagcgagcuccaggauggccagaacuacgccaagaaacccugucucagaagaaagaaggaaaguuaauaauagcuaauaagauuaccaacacauaaaauaauauguuuuauaauauaaauuuauuaaaaggucauuuuuaaaagauuuauuuauuuauuauauguaaauacacuguagcugucuucagacacuccagaagagggagucagauuuuguuucggaugguugugagcgaccaugugguugcuguguuuugaacuccggaccuucggaagagcagucgggugcucuuacccacugagccaucucaccagcccuaaaaggucauuuuuaaaaauugaaaguaggauugaguuuaugacugaagaacuuuauacuucaguaaaaucuagguuuugacucauauguaauuguauugaauuuuugugauguggcaccugaaucccagagccuggcuugcuuuugagcuuuuauaaugaucugcuuauuuguguauauguguuuuucuuauugauaacucucaaggcuaggcacggucuuaugaaauguggaauggguaagcaacagauggacugaauggucaucuaauuacacuuuuuaccuauaaucugaccagauuaaaggagcauacgauuauuuagauaaguaaaauuaucauccguguuuaacuaaaaucacaauuaagauucaaauacgggggcuggugagauggcucagcagguaagugcacccgacugcucuuccgaagguccggaguucaaaucccagcaaccacaugguggcucacaaccauccguaacgagaucugacucccucuucuggagugucugaaggcagcuacaguguacuuacauauaauaaauaauaauaauaauaauaauaaaaaagauuuaaauacgguccaccccauaaacuuauucagaaguuaccauugauuggugugugagcggagugugugagcggagugggugaacccuggccaugaaagccucuuagugaguggucgggcucgaccuagaaacacguuacuucagauacucaggcuucuuguucugucuguuaaaaucguuuuuugcuuuaaaaauacuucagggugaugaaaaacgcucacuggucauucucaucagaaagaacaacucugacuuuugcaucuccaggacaaacugcuuggcuuuucccuccuugguguaaagcaaacugaaaacuugauuugaugcaguugcugaugauuauguaugcuuuggucuaaagcuaacugaugcaaguaacuugggcuuguguguaagcauccuacagaaggacgaugcuuggggcugaguguguagcuuggugguaaagugcuugcccagcaugcacaaggccauggguucaguccugagagcuggcagaaaaaaaggaaaauuauuccucaaauauaggagaacaaaagaauguaugaacacagacguguucucagaaagacacaaacaggaggguagaccagagccggcccgucuuuuggugagcauuacaaaugagaucacuagauuacuguuaaagggagugacagaccagucccuaggaagaggauugguagggucagaaaccaacaugaaucaugucacaaaguccauaagcuaaacagugaugacagaagagggacugaccgacggaagcaauagugaggaaaggaagucagcaggaggugauaagcaguuggccucagggcgaugggaagagguuuaugaguaagauacauggcauagccaggugagcucacacuuacacuugcacuugaguucaagaagggcaaugaugaccuaccguguggaauugcuaguguguggaaucacuagugagcagagccugggcugauuuggcaggaugagcacucuaugcagcuaggauuccgucugagagcuguccguguguacacuucaaaaccaaacaagacagaguuagugagcuagggaggcaguagaaacagaggaaccuuuuggaacaccagcgauuaaaggaugguggaagaaagagaaguguggaaggagccagcaaaagcaagcaugugaucccaggagacaggaggaaagguguagugggaugggagccagaagaagugggggugacagcacgggauggguccccagagaaagcgagcaagaggggaugcgaacuuaaacacuuacuaucuugguaccaaaggaugaauugauuaugaggccauuuuacuucguuuuccuuaucuguagacuagaagaauaauaccauauacuacgaggcauacuauaagguauaaggaauacuauaagguauauuguaagacauacuauaagacaugagauaaggcauacuguuuuauaaaguuuauaggaagguucugagcccaaaguauucacaacacugaaguguuuucuucccauuucaucucauagcuccuagaacaaaaauacucaaacgaauugacuguuggcagaggaguguguguguguguguguguguguguguguguguguguguuugcagcuucuguagccucuugugggaggcauucagggccuucaucuguuggcagugacacagagccguauuuccccacagugucaaccccuaugggcaucagauuuucuagagaaacuagacuugacauguucuacccgaugcaacucauaggccacccuauacccacacaguccuggcucuuggauugagugauuuuuaccacccugcgaaugauuucauuucuuuaauuuuaguuggcuauuugucugggggacaggaucucguauagcccaggcugcccuuaacauuugauauguagccaaggaugacccugaccucucgagccucgugacuccaccuccuaagugcugguauucuagguauugcccacuauauuuggcuuuuucauuuguuuucauagucaaauaaaaauuaaauuuagggagcuagagaaaugggucagcaguugagaccaccgguugcucucccagaagacccaguuuugcuucuucccagcaccuacaugguggcucacaacugucuguaaccccaguaucagggaauccaaugcccucuuuggcuuccauggaaccaaacacacacauucuacacagauauacauguugccagaacacacauaauaaaauaagcagguaaauaauuaaaugcaguuuccuugugaugcuaaugccuaccuauuucugcucuuuaguuggcaggaagguaacguucuuucagccagacgacgaaguggucgguaagugguggugcccagguccucaguccucugucgucagcugucuuucuucuguguaaauaguaaugcucacugugaccgcacgucagauaaagacacugucuucgacugggaguguaguacauucaauccucacauuccaaaaguaaagauacucuucugacuuuuggaauuaguccucagauacugacuacugaagaaaacagagagcuuagccucagcagagcacaucaagccugccaggcgcuggccgagcggucacagacaaagccagcaggacgcacccuucccuccauguucugcucuccugccuagucccuacugcuuggucagacugaaauuucuagaaaaagucacaggccugugcuugaagauuguccauggagugagccguagaaccucuguucaccccacaaagcucucugcuguacuuuuacaaaugaaaauuagcuugaagcaaauuuguuauucuuuucuuuuuacuucuucgagacaggguuucucuguauagcccuggcuguccuggaacucacucuguagaccaggcuggccugaacucagaaaucugccugccucugccucccgagugcuuggauuaaaggcgugcgccaccacugcccggcugaauuuguuaauucuuuuuuuuuuuuaaagauuuauuuauuguuauauguaaguacacuguagcugucuucagacacuccagaagagagagucagaucucauuacagaugguuguaagucaccaugugguugcugggauuugaacucaggaccuucggaagagcagucagugcucuuaaccgcugagccaucucuccagcccugaauuuguuauucuuuuuuuuuuaaagauuuauuuauuauauguaaguacacuaaagugcugucuucagacacuccagaagaggguaucagauuucauuacagaugguugugagccaccaugugguugcugggauuugaacucgggaccuucaggagagcaguuggcacucuuaaccacugagccaucucgccagcccccuuguuauucuuaaaucuauaaucacugcaagcauuuugggaacaucugcucaugccugugucccagacaguccugcaacuacgugugaacgccacauucauaacugucuuggucuuccucgucuucauagacggcauccucugagccuugggaaaggccguugaagaucagagggacgggaaagcgugucuccagcuuucacggggccucugacucgaagaacugaugauuguagucuuaguuauccaagcacucaguaauacucuguauugccuacguuuccuuuuguaagagagcagacuuagaacuugaguagccuccagaaacgcaggguucuguucagggcauacugggggaaggaggcucagggaccccagcacuccaggucugcugcaugacaucggccaccuuuacaucaacuucacuguacagaguuuacaugaacguaucucccaggaaaugaguucacucacagacuuccccuuaagcuucuuguuuuaauuuuuaggaauucugccuuuggauuccgaagaccccgggcucugugagguuauucgaguacaugagcauuaccuggguacguggcagucuguccuucagaacuauauaagucuauuccacugagagcauaaccuuuccuuagccaagugauacuucuggcguauguuauuuauaaauuagugcuuagauuaagcauuguguagaccugugagauuuacuaacauugcucauggcuguagaaucuuucacaucagaauuuauaaaugucuugcucuuggcuuauuuguguguguguguacucgaguguguguuguuagagauagaacuuaggaccuccagucugcuaagcaagaacuauaccauugaacucuucauuacugacuaaaacaaacaaacaaaaaaaauguacacaauuuagacaguauuugucaaagcugaaacaggaaaaaauuuuaaaagcuuguauuugguuuuuguugcuaauagacuuugaucaguauucaguuuuauuuuucaugagaaauuacauuuugaacauuucguaaaugcauauacacguccugaaaauaaugaaaagauacuucaucuccugugcaauuggaguagguaaagaacauuuaggaacuagagcugauagguggcccccacuugcuguagaagcugaagccauaaggagagacagcugagcuggagaggcagcucgggcagugaagaacgugcugcacagcccucaggaccugauucggaacuccugaagccacagaaaaucuagggacaguggugcagacccguagcugcagugccgaggacagcagggacagcaggguugccaaaggcuugugggccaggcacccuaaccaacugggggacaccaacuuugaugagagagaucuuauuucaaaaagaaggauugugaaugguugagaagacacgccacauguagcgcuggcuuccacaugccaugugcauggguauguacacccagauacacaugaacacauacauacagccaaauggcuuuuaaaauaccagcaacaagacaaagccccgauaggcagggugaguccuuugagguguuggagauggagccccaaggccucgugcuugcagucaugugcucugccaucaucugcauccccaguccagcaggaaaugagcacugacuuuuggggccuagcuguaauguguucuaaaugaugcucuuuccugguucuguuuauaagucaggaagguggauuauaguccaggagugucggaagucuauggaguagacaagugcugagagucuuugaggacagagcugggauucgauguuuccuuagggguggguggguccucuagugcagcugugguagaacauggcuguguuccuaguacuuaggccagagacaggaucuagaguucaggacccgggcuacaaaccaaggaccuaacucagaacagccucuaagagugaccaccacugggguuagagcgucucaguggugaagaacacgggccucucuuccagagcgccugaguucaguucccagcacccauaucuggcagcucacaaccaucugcaauucagcuucagggggcccgacaccucaggcuuccauggacgugcacauauauggccugcagacacagauacaugcacacauccauauaaaaaaucuuuaaaaaauuaacaaaugaccaccaaaguuaugagcccucggugagcguccuggccacacucacugcagaaugaggcuguucagcuagaagcuguuguuugcagcuccagcuuuuuaugggcagaggcugcuuucaauacauuuccggaaacugcacugggaaaucugagauucaacuugagcgacugugcaguaagacucagcauucagucauugcgauugcguucaccugaaucuuguucuuuuaccaaacccaaguaugugguuccaaacgaccaccagaugugagcaccguuucacaauaucagugacacuucaaaacugggcuccuuccaccuagcuuagacuccuuuuuaaauguucguuuguuuguugucuguauggguggagaggugacgagcaggcagggugcauguguagagcuuagaggaccacuuguagucuguagucgguucucuccuuccuucugcgcguggguuccauggguggaucuuggccgucaggccuggggagaguguguguuagcacggaaccaucgccauagccccagcugcucucagcucucaaggcuuuccgccaagcuuaaaaauaauuucauucacucaaaauugggcauauacuuucaacucuguccuuuauucuuaguguucauguagcgaccauugauccuuauuuuguuuguuagucuuucuaacauaauaagcauugagcaucuaccgucaaagcaaggccccuuaccaguuaguuagaaccucuggaggccagcccuugagagcccuugcugcuuccugaggacugggcuucagagcccaucccccacacucagcagccuucagauuccugucacuccagcagcaaggagcaucucgcccucuuaugggcuccugugguacuugagugcacacauauacauaaauuauaaaaauaaaucuuaaacucuuuuuuuuuuuuuugguuuuucgagacaagguuucucuguguagcccuggcuguccuggaacucacucuguagaccaggcuggucucgaacucagaaauccaccugccucugccucccgagugcugggauuaaagaugugcgccaccaugcccagcuaaaaauaacuuaaaaaaaaaaaacuuuuagauucuuaaauguaguuuuauugcccuuaauguuuuuugaaggacuacaugaaugguguguauauguagaugugugugcacaugcauaugugauuauauauaugcccuguuuuuaucaccucucucucucuuccaagauaaggcuguguacccacagcuggucucagauuugucauucuuuuacaaguguggggauuaugucauaugaauaacauuuugauaaaauauggcagacugaaaucuuaugguggggagauauugccuccccaaaagccauauaaguaaaauaugcguagaugaacaugagaauagauaggucuacuuuagucuuuuucauauauucacuuuauuaccuaugaggccuuagguaaaucaauuacuauucuguacuuaauuuaauaaucagcaaaauuagaaaaauaguauuagguagauaaagaggaaagaaagaaaaaaacaaaaugcacuucuucugcaguguucugaacgugggucacuccugagguggugaccucagaaugcaggggucucucccuauggcaaucacuucuacacuggacacaccagacaugcucuauuccuaucuaagucucuuuaagcuuggugcugucugccuggagauagcagagaugcuacaguuugaggguucagucccacagaagugccuucauuuguggcauggucacuagugugggccuucgggacucugauaagaguucagguuuccacuucaggcuuguuuaguuuguaagaguggcugagugagcgaggacagggaauggagagacagaugcucaguggucaacauguuaaguuuuaagagcacuuguugcucuuacagaagaccuaggucuaauuaccagaacccacauggucguucauaaccgucuguaacucuagguccauccagggaaacuggugcccucuucugaccuccaggagcaccaggcaugcacauggugcaugcacauaaaugcaagcaaacgcugcugcaugaaaugcagaacugcagauaauacauuuacuggcuuacuguaacggagauuaaaggauacaaauaaacaaaugaaauacauaggacaaugucuuuuucucuuggaggucuuugguacuggcgcacgccuuuacucccagcauucgggaggcagaggcaggcagaucucuugagucuaaggccagccuggucuacagaguaaguucuaggacagucagagguacacagauagaagggcggaugauagacagacagacugauagauaaaaauaaaaacugaaggucuucauaucugccagcaggcaaaacaugucauagcuuuauggcuccaagaccagagcagcaagaucagagcacagagagucagggacuuugcucucugaagcuugcuucugaacugacacaccccagcaauaaaaagaucguauuuuaccuucacugagcaggcaaccaaggacaaaagguccaaauucuuugaugaaagauacacuuaucaucauuuagaaaauaagacaggcagugugagauaugaccaggaaccaagggugaaagcagaucuauaaaucaugccugcuccagagagugucauaaagaaacacuccuccuguuucagcccagcauuuucuccagggugggguguaggcuccgccuccccaccaggugguguuagucucuugugcugcauggcugacugcuuugugagcagcucuuauggaaagcgugguuuacagaaaggauugcuuuuagugggaacagcaccacaauuuauuugaacaaggauuaguggaaaugugaagaaacagcuuccugggcaggucauacagaacgcucacuuuuuagacugucauccccguuugaggguuugcggggcagggauguuauuucuuuguuuaauuuagagacagggucucaccauguagccauggugcuuggaacucacuauguagaccagguuggccucaaacucagcgaccugccugccucugccuucccugcacacccuuccccaccagguacugggauuaaguguguaugucaugauacccagcuauauguugagcuuuuaaaacuauauugggaauuucacuguuuuucuaagugcaguggaaggcaucugaaauacaugaaaauaacauacaacaaaaaacaagaaaaugcugagacuucgucacuucauaaaaguacucuagaggcggcaaacaugagaggggggauccucagcauuuuauuagacaggcacaguaagaaugucacauguccaagugaugggcuguggacucggagucaaggauggccagcggcuguucuggcggcaggugcuauugcucagagccacugccugacagcccaagacuguaaacgcguucaccagcuaagaacggacaaauacuuccaauacuucuauguggcccaagccauaaaauaauaaaagugaaagcuccaccacggucuccuaagcaggacagggaaaagcuguuuaaaacucaggggaggugcggccuucagcagcgcacacacucaacaaaccugggccccugcggcucucagagucugaaccaccaucaaagagcaaacacaggcgggaccgaggccuccccgcacauauguggcagaugcagcuugaccuucauguggggcuaucccaaagcuguugccuguauguaggguauauucuacuaccugggcugccuugucuggccucagugggagaggaagugccuagucucgcagagacuugaagucccagggugggggauacucaggggaucucugcucccucagaggagaaggagaaggaggguggaagaugaacuguggaagcggguaacagggagggggccacugagugagagagagggaaagugaauaaguaaaaaaaauuauacagagaaaacccaagguggggcucagggugugcccucugcuguuuguacauacacugugucuuacacauguauucacacauuuuaaauaugaaaugauauaaaaaaaaagaucaagugcagagucaggcagagcugguaacuguugaguggccacgugaugaacggaagguagaagagaaacaggaccugugagagcgagcgagcggggacuggucaggaggaaggcaaugugugugaccuguguguguuuucuggucagccccaccgcugugcuugaccuucugugugcuuccugagugccuguggacagaaacagggacagaagagacaaagggaggacugcagcagcuucggcgcccacggugggacagacgagguacuaauggaacuuauuaaugagcucuuucuucuuguccuuugucauaauaguucauaagccagaaaaggugucauggacggaagcugcuggcgucauccgggacggaguccgagccugcacagcucuguauuaucuuucucaacucucuccuggaaagucugugcugaucauggacggggcaagugugagucccaguugauguuguuuaaaaaaaaaaauuaguccaauauaccauaaacauggggacuguagagaaguugucuacagauguccuucuuuucuuuguuuuuuuuuuuuaaagauuuuuuauucacguaauauaugaguacacuguagcuuucuucagacacaccagaggagggcacuggaugccauuacagaugguugugagccaccaugugguugcugggaauugaacucaggaccccuggaagaacaguuagugcccuuaacugcugagccaucucuccagcccccuguagacguccuucuuugucauuaaaucauuagauuucuuuuccauccuccccuuuuauccuuguagacagcuuuuauaaauaguacguaagaguuagacuuccuguggcuacugcugacuacucugaacucaccaguaaguuuaaaagcaaggcaagauuuuuguuucucucuuguucuuuccaacagagaugaucaccccccaaggcuuacacacuaggccauugcucggccagugggauucgucccagucaggccauuuuauucauuacuguuacucugagugagaguucaugagccuauagagucaucuagaagccuccacaaagucugagcucuaaccccuugauuaugcucaccucguaagagucgugguauccaucagauggaccgcagagaagccagacugggcucacaugaaguguuuuacaugucacagaaaagcccuaagaugcuacauguaugaucaauuuuuaaaaauggggaaaaaaaaaggcagaggcaggcggguuucugaguucgaggccagccuggucuacaaagugaguuccaggacagccagggcuacacagagaaacccugucucaaaaaacaaaacaaaacaaaacaaaaccaaaaccaaaaagcaaaaaacaaaaaacaaaaaacaaaaaaaacggggcuggugagauggcucagugguuaagagcacccgacugcucuuccgaaggucuugagcucaaaucccagcaaccacaugguggcucacaaccaucuguaaagggaucugaugcccucuucuggagugacuuaagacagcuacaguguacucacauauaauaaaauaaaauaaauaaaucuuuaaaaaaaaaaaacaaaaacaaaaacaaaaaaaaaacccacaauuuuaaaaaauggggcagccaggggcuggagauauggcucagugguuaagagcaccgacugcucuuccaagguccugaguucaaaucccaacaaccacauggugacucagaaccaucugucaagggaucugaugcccucuucuggugugucugaagacuucaacaguauacucacauaaauaaaauaaauaaauuuaugugacuuauugugugugguuagucuaaccucgcaguuaggagggaaucagcuugcccuccuaaauuggagcaaauuauuucuuuuuuucuauuauguaauguuuuaaaauauauuaaaguaauacuaaagaauuacauguguuagcugggcaugguagcacacgccuuugaucccagcacuugggaggaaggcagauuucugaguucgaggccagccugaucuacagcaaugaguuccaggacauccagggcuacacagagaaacccugucuagaaaaaccaaaaaaaaaaaaaaaaaaaaaaaaaaaaaaaaaagaaagaaaaaaagaauuacauguguuaaauggucuaugaaguaaauuagcugugcccucucaccuuuaucuuuugauauguauuuccacacaggcauuuggcacaauagccauucaguuagcccaccacagaggagccaagguuaucucaacagcacacagccuggaggacaagcaacaucuugaaaggcuuaggccuucuauaggugaguuacauguugcaauacucaauacagaccauguaagacaugaaauccuacagggaaaccaacgccugcacugguagccagacaugauggcucuugccugcagucccaacacucagcagggugaggcaggagaaucaugaguucaaggccagccuaagguaccauugagauccuucuuuaaaaaggagaggaagaaaaaaaagaggaagaaaggaaggaaggaaggaaggaaggaaggaaggaaggaaggaaggaaggaaggaaaaacuuacacagguaaaacaaaguacagaaucccaaauaaaaauaaacuuuaaaaugcucuuagcaucugagcuagccucagcuuuccucaggugaugccguucacuacugggguuucucauuacuggugucugugcauuugguuucccagggccucaugugugcuggguaagggcacuaccacugagcuacaucuucauccccuauuuaagauucuaaaccuacauuuuuuuucuuauuuuacaucuucaguuuuuuucuuccuuguucuguuauuaccaacuuaaccaaguuuaaaccaagucaacuuugauacaauuuagaaacacagguugucucuauuuuagcugauaaucaauaguucucagccgugaacacugccugccuugugcagaaugcagagaagcagacccauguacacauaaacacaggccagcuacagcugaaaugugcaggucaugguggaggcugguaagcucucggaaagguugaacagaaaagaagaaaaguauugaggcuagggauaguggacagaagaacaaggaaagacuggaaugaagaaaguaacagaaaguaacagagaaaaacaagcagagcaugagggaagggcagucaggaaaagucaugugaaaugugacuuaaagcccuuggcaacuaacagcgcuuucagagucuaacuggcuucuucuagauauaacugagcagugguggguggcacaggccuaucaaucccagcacugggaaggcagaagcagguggaucucugaguucaaggccagccuggucuacugaaugaguucaaugacagccaaugcugggggcuggagagauggcucagaggucaagaacacugacaguucuuccauauauccugaguucaguucccagcacccaccugguggcucacaaccaucuguaaugagaucugaugcccucuucuggugugucugaagacagcuacagugcacuuauauaaauaaaauauuuaaauaaauaaauaaagacagccaaugcuguuacaaagggaaacacugucuggcaaaaccaaaaaggaagaaggaaggaaggaaggaagggagggagggagggagggagggagggagggagggagggagggaaaagauauaaacaagacaaaggacuggacuaagacuuuagucccaaguucuuucuguugcugcuuucugcaucugacaaagauaaacagagauagaagcaagguaauacaggagcuaagggggaaaagcuggagauugaagauguuugagaauaaaacuggggggcagggagauggcacgguggguaaagcagucaccacucaaacaugaaaaccagaguugaaucccagaacccauguccuguagucagcacugggaaguagaggcugauggggucccuggggaagcuggcuacauuagucaggcugaaugacaagacagcgucugugggaaacccuaccucagucaguacacaaguggaugggccaguggguaaagauacaugccaccaaaugccuucccugggacccacguggugggaagagaaaagcuguccucugcuguggcacacacaugagaacuuguacacaugcacacaaugaauguaauacgaaacaguugggguuuuuguuuauuuuguuuacugcagaacaguugaggaucauuuccacuguagacuuugggccuccauccucaagugcauaugagagcauguucaccuauaaacauuugcaaauguucauauacacacaaagagaaaguggaauggaggugccaauuguaguucaguaauagacuccuaccuaucauguaagaaggccuguguuccucucucuggcaugggaagauggggagaaagcuuaggacagagguagauagcuacgacuguguucuugaaaauguuugccuguuggcuaauucucccccuacaggauuacccagcaccuucguguaaaguuuuuguuuacaauuuauuuuauaugcguguauguaugccacaugugugcgggugcuguuccaaaauagggaaccagauccccugaagcuggaguuucagacaguugagaauugugugacaauggcaccaggaaccugggagcugaucucagguccucuggaagagcaguaugugcaguguaagccaucccugcaccccugcuucugcacucucacccugcagcccugcuucugcacucucacccugcaccccugcuucugcacucucacccugcaccccugcuucugcacucucacccugcaccccugcuucugcacucucacccugcagccccugcuucugcacucucacccugcagccccugcuucugcacucucacccugcaccccugcuucugcacucucacccugcaccccugcuucugcacucucacccugcaccccugcuucugcacucucacccugcaccccugcuucugcacucucacccugcagucccugcaccccugcuucugcacucucacccugcagccccguaccccugcuucugcauucucgcccucacccuguagcccugcuucugcacucucaccuucaccccugcuucugcacucucacccucacccugcagccccugcuucugcacucucacccugcaccccugcuucuacacucucacccuacagccccugcuucuacacucucacccugcaccccugucuguacucucaccuucacccugcaccccugcauuccugcacccugcuucugcacucucacccucacccugcaccccauccuugcccuaucuuaccaccaagagucacagauugcuguuagacucugccuguagucugaacagcucugacaaacauuguccucaccgagguacuaagaacaaaaugaaauagaauuauauccucauuaguugaaauucugaaaauuuuuuucaauucucaguauaguucuauuguacuauuaauauaauucauuuuccuauugcuauaguucuuucaagagcuaagaacauagcuccguagaggucugcuuuuuugcaauugauaagguccaggguuuauccauguccuucacuuagcacgcagauacaaaaaaguguguguuugugugcgugugcacacgcacauaugcaauaagugaagccaaucaaaauuagcuugauuuuuacccuaucucuaccaaaaccaaucacauuccuguuccucacauucagggcuguuauccauuccagggagcuagaggagccaggggagguggguccgugagugagaagggaugaaaugaugagugucacaguguacagacacaggacgcaucucugguuccuggggcuggcagacugucccgugcucagagacagcugacucugucacaggccagccucggauguuuucagccuaguggagcugccaacccagauugaauuccuaaagaaacaguuuaagcaggauugacuuuuuccuuuuaauuuaauaauugucgaaacuuacuagcuguuuuuuuuuuccuuccccccaaucuguuuguguugaucgcaaagaaaacaguacaauugcuucauuuccuguccuuuacagcccgugugauugaugugucuaaugggaaaguccauguugcugaaagcuguuuggaggaaacagguggccugggaguagauauugucauagaugcaggagguggguaccugagaaccgagcagaugcaggagguggguuccugagaacugaguagccugugugauauuuuuaguuagauaaauugaagaaaagguuuaacuaggaacuaauuauuacugcacucauaaaguuggauguuuaaggauuuguuuuuaauuaaaaauuauuuaaagucuaacuccuucccugauucccauccucaacgcuguuccucuggaagagagcacagguuuuaagccuuaggcacugaagcuuaaacagaacaggggaacccugugagaaaaccgucaucaggaugagucuccacagagggucgcuacuacuacacgccugcccagcauucccuaggcacggguacugcauggcugcccucuaguggacggcugaccucuguacugcuauagagggaaacaaguuugucccaucucuuugugagcuuuuacauuuaacuugaagccaucucacaccuagucgugcacauguggcggcaucacuccuccugaagagucagcguuaggagccgcacagugacuguacuuguacucuguuguacuguagccauucugugugggccucccugauguuuguuuuccaggauuggaagcugacguaugaagucgucaguggcaguguauacuguacaucagugugcucacuucucacgugugggcuucagugcaugugacucugucaguuaaugagacagcacuucaccccguuguaugaagccaggcugcuuagaauuaucaugagacauaccuugcuugcuuccaaauaaaaauuuauuuugcauuuaauuuuaauuaagucuagaguacauuuugguauaguguaaaaccaacuaaguuugccuuuuccaaagaaaaguguuucuugcuauaaaacugacugauaaauaaaauaaauugucagauuuuuauaaauucucuuuuuucucuuuuuuacuuacucauuuguaagugagauuauauaguaaagaugaugaaccagcuguaaaguuacaucugccacauaagcaugacaucaucacacuucuuggugucggaggccauuggguaacaacagaagaaaaccuucagguauuaucagaaauaguaaagccuugcuauuacaccaagggaaugccauuagcaaagagcagcauaaguucuaauuacacccugggcuuaaaagaauggagcuucuuuucuguguuagguaugcacuggucagauucuauccagcagggaagugguucaguuagaaugaguuacaguuguauuuuuaaauuguauuucauauuacacuuuuaugguuguguacacguguauaugcaagagaggccagagguaaacaucuggucucucccucuauuguucuccacccuaucuuuugagagaggaucucucacugaguuuaaagcuugccaguuuggcuagacuggcuggcaccaagacccaaguauccugucucugccucucuagcucugggaugacagcugugcuacugcaccuggcauuuuacaucugggaugacaggugugcugcugcaccuggccuuuuacaucugggaugacaggugugccucuguaccuggccuuuuacaucugggaugacaggugugccucugcaccuggcauuuuacaucugggaugacaggugugcugcugcaccuggccuuuuacaucugggaugacaggugugccucuguaccuggccuuuuacaucugggaugacaggugugccucugcaccuggcauuuuacaucugggaugacaggugugcugcugcaccuggccuuuuacaucugggaugacagguaugcugcugcaccuggccuuuuacaucugggaugacaggugugcugcugcaccuggccuuuuacaucugggaugacaggugugcugcugcaccugaccuuuuacaucugggaugacagguguguugcugcaccuggccuuuuacaucugggaugacagguguguugcugcaccuggccuuuuacugggugcuagcguccgaccuuggguccuugugucuaugcaacaacuacauugguagcuugagucaucucccagacccuaaaaauuuucuuuccaguaaccuuauaacuguaaugaaauaauuauaaauaauacuaucauaauuuuauaacccaaauugauauuccuguaugucuauauagaugaauuaccucccaaggaaauauuuuucaacagaauucuaauugaauguuuauaucauagcuaauauauaaguacuauaauaauauaccaguccagacaaaggugccugacaguagugggcagaaggcacacagagaagcuaucaaacacauuaccccaucucccccagaugccagaucggcccugcaacugcccuguucuaucuacuucaucacagcauagagaaggaaaccuaagaguuaacuaauggcagguaacuacuggcuguuuaagcuuguagcaagugcuaugcuuccuacaauguuuaauuuguacuaaagacuuuguagucugagcaucuuugugcuguucaacuuaauagugguugcuuugucuuugucucuucuauaaaguuggauccuccagauagccacugccuuuuccucaagggagcaacgguggcuuuccuuaaugaugaaguuuggaauuugucaaaugcacaacagggaaaauaucuuuauauccuuuuuuuguacugacuugaauuugaauugcuagcuuugaauugccuuguacucauaaauucuuucaauguaacaauaagaaaugauaauuagcugugaacuuuccuugagucugucugacagugugacauguaucuuguauucauuuaaacauuaagucuaugaugccugaguaauguagcuccauuucacaggugagaggcuacuguugggugcccaguggugcagggagcaagagacagagucauaaucacaccacagggucuaaccccuucugaaugggagauaaagaaugagacaaguggaaauuuuucuuuugcuuuuaaccuggcauuaccugauaccuaaauugguagcauacuuaacuuuuaugauggugccacugcauaaaauauuccuaaaugcuuacaguuuaauuuuauaaguaucauaauggaacuuuuuuuagaaguuuauuuauuuauuuauguguaugucuguguaccuaguguccaaggagaccaaaagagggugucagguccccugaaacuagaguuacagacacuuauggcucacuugagaacugggaaccaaaccuggguccuuuacaaauacagcaagugaucuuaccaaugagccucucuccagaccuucuuuuuuucuuuuuuuaagauuuauuuauuuauuauauguaaguacacuguagcugucuucagacacaucagaagagggcaucagaucucauuacagauggguuugagccaccaggugguuguugggauuugaacucaggacccuggaagaacagucagugcucucucucucucucucuuuuuuuuuuuuuuuuuuuuuuuuuuuuuuuugguauuucgagacaggguuucucuguauagcccuggcuguccuggaacucacucuguagaccaggcuggccucgaacucagaaauccgccugccucugccuccugagugcugggauuaaaggggugugccaccaccacccggccagucagugcucuuaacugcugagccauuucuccagccccucuccagaucuucuuauuuauuguuauuuuucuuaauauggauauacuauugauugcuaguaacauaguauguuaguuacauuuuuguugcuacggcaagcaccaugaccaaaagcaguuuauggaaggguucaguugggccuacaguuccauaauggcugggaagccuugucaucaagauaggugagagagagggagagagagcgagcaguaagcagggaugaggccaggccauagaccaucaaagccugccccggugaagcgcuuccuccaacaaggaugcaccuucuaaaggcuccauaacuucucuaacaccaaccggggcugauucuucagacucaggaaccggugggggacauuuuucauuaaaacugccacaaauagaugcauauuaacuuguuuuuuuuucucauuuuugaaacaaauaaaagaauuuauggaaacaaguugaaccuguuaccaaccggaucaacugaugaauguuaacucccugugagagcugaaaugcugacuauaccgcgugcauaaugcuuaagugaagaagaccauggcaccccugaccagcuccgugcugacuggcuggcuggcuggcuggcuguccuuaccacucgccuuccagcgcuuguguuccugucacaccucagauacugcuaaucaucccguugcucuagcagugacugacaguuuuaguagcuguggugccacuuugaauuugaaagugcaaagcuauauauaaagaaaaaggaguccugcccagcaucuugaaugguuucuuuaccccucucugcuaaguugaaccuuaacaauccuuccauuuacguaucuuaaaagaugugauggagaaguuaucagcugguguuuucagguaugcuaaaacaaaaaacuaaaucaucauuuuucaauucucaaagacauaaagaguuuguauucauuccaauuuuaugguauaucuaguacuuguauauauuuuuuuuaauucacuguagacaaauagcuguucuuucauguuucucaaaaugugucugcuugugcaccugugaggauugccacagagagaggaucuugugcuuuuucucccccacaccccuacccccauucuguugugugucucuccuuucuccuuccccucuagccaaagaauuugaaauaauucagagcuugacaagguuguuuaaauugggauuuuauaucaauuauaaaguaagaauuagauaaagggacugaguaguauauuuuuucuuucaaaaccuaaacacuuuuagcccaguguuguggcacacagcuguauucaaggcacuuggaaggcuaagagucaugagucugaggccauacugggcuagcuaacaagacaaacccaguuuuaaaaaagaaagaaaaggggggaaauuacuacuucuuuaagccacagaaauauuaaugaaugcauuuguaauuucuguuuggauuuuucuuuuuaagauagcuaucuagcucaggcuggcugaccagcaacuugcagagguucaccugccucugccucgccagugcugggauuaaaggcucgagcugcuuguguuagauaaaggaaaauaagcaaauguguggucuacugcauccugcgugcugugcuccucugugccugugccugacaucucgaaucauuucccuccucaggccucugcucgaugagcccaucccacuguaugaggcaaagguuuccauggaaguuguucagaaaaaucaagaaagaaaaaagcaagucguucaauuuuaauucucuucccugaucucagucggaugcacccacaccagugggggaagccaguuuucuuuggaaauuguugagaaaaaccaaggacgauaaagcaagauuuuauauuuuuaagccuguuuuccugccacaguaagauguuugguuauuugacauauuugaaaaauacuuccaaaauuaaugugcaaacaauccagauaauuuuuuuaccaucugaaggggacauuccaaaagcuucuuuuaguuauuguaucuguacacuuugccucugcuauaaaauucuuuccauuaagaaaacugcuuucagcaaaagcuacacuauucuagcaaauacaucugucacaugcuuuugcuauaccaaacgucauuugauuuuguuaucaacuucauucucaacaccuuccuuaacaaaccguugaugccauuauuuuagcauuuguacuuuccgacuucaaaguaucuaauccacuggcauuuaaaauguuuuuaaauauucauucacucugaauuucuccgagaucauacggaaucauaguaccugguccuguaguagugacggcauuugcauagagggcugcgguggucgggcacuggggacaaggguggaagaguuggccugcggcuagccugaagcuggcggacauuucccccucguggguacuguguugagcucggcccaucaccgucucucucagaaugauauugcggcuucucacggagagaaguaacugcccaucaccaccaaucaauguguuguuugcugugcauucaugcuccguacccggggcugacacuacgcccgcugccgaguugguacuguuaaucccuuuuccgagcccuaccgggugccgcgcgccgccgucgcguucucagcgacgccgaccucgcagcaggagagccgcgagcugcgcgcgcccggccggaag

SEQ ID NO: 8335 - RNA, 4650 nt, Mus musculus
ccaaguugaauaaauaaucuuucagaaacaaacauggaagucaaggagcccagucauguuuucugagaaagaucagauggaacaaacagaggggguagaguaaugaccaaggaaggaagacgugguggaaagggagagcucaaggaaucacaaggucucucagugcacuuugagacugagguugaaggugcccaagacuccucccuguggagggagccugcuucagagacagccugccugagcuccagucgcaccaccccuacuugccuuggucuuugcuuaaaaagcucuugacauucuaaaaagagguuccaguuagguuacagcgcugguacugugcuuguugguugaaauggagucuccuauagcucaggcuaacuucaaagucaucacaugaucuugcuacaguuacaggugugcacugccacaccuaccaugcaugucgcuggagacagagucuagggcuuugugcauggggcuaggcuccaggcccaggccugacaccaccauuugggcuggucuuguuuccucugugaagcaguccaccuucuuuguguggcugugggugucccgcgaugcgcgacacuaagaaguucuuacugcuuacggugcgugccuuuccuuccagguggcccagcagcucaaacgagaagccagaaacggacaacugggauacaugggcggcucagccuucucugaccguaccuagugcuggccaguuacggcagagaucagccuuuaccccagccacagccacuggcuccuccccaucucccguccugggccagguaggggcagcuagcgaagacugagugugaucugcaccuaacguucacaccaacagucccagcagacauuguuggcaaugucauuuacaagcaggcuccuccuacgaggcugggucggcuggcugaaccuaguucagaaaguugagacuuauuauaaaccucccagaguucagagggcuuaaacucuccugccugugucuaucugaauagcuucauugaaaaagugucaucaaagcugcaauguugauagauuaaaaagguaugaaaacugacacggggagagccaggaagugugucaagaauucugggacagccaguccauuuggcugccccaucagucuguacuggaaaaggaaggcugauuucaggcuaauggggaggccugcuaaggaacaguguuucugaaaacacagggguuguuauugugaacauuucuccuuuaauuaauguaaugauaauaaaggaauaaaaucagucaaucaaacaaacagcaaaugcccguccuggaggccccaggaaaucacggggaguuucuguucugaaaaugcuuagauuagaggagcuuccaggcaugugaggaaguggucggcaggaagaucagagccgcugagcagcagugcucccgagggugcucaguguggaagccuagaccccgcugagucccuguguccacaccacagaagaggggagacggagcaggcccgggcccucgggucagaggcucacgugagacagcaggagcccaggagugugcagugagggcgcgugggaggacaacucagcagcagcgccucuccucugccugacucaacacuuaagcacagugaccaaggaggcacuauacgcgaggcacaagaagcguggggacaagaguggguuccagagccugggggagagugaaguggucacgucauccaaacccacuuagggcaaagagaccccuguggauaaggagaaugcuucccuuggugacuugaagggguuggaagugaggucaguccagauggcagugggguaagaggaagcugagcccugagaggccugcugguuugugaggcagagagaacugacacagagugacaaagugaccaucagucugugggugaugagcaagcccucgcgaccuuguuggaagauaggcuuaggaacugccuggggaggagggagggcucccuaggaaacugaauucaguggucucuagcaguacuguccacuggagaccagaggucuugggacuguagccucugaacuguuagugcaguuucagcaaaggcuguguguaggucuuuacugaacaucacugucuucaggagagugccaucucuuugguagauguagaaacugaaaaaucucucaguugcuuaagugucaugaaauuagcaaguggagagccugggauucacccccaguguucuugucugacuucaggcuguuucagaaacccaacccagagaaaggaaagguguugggacacaucccaaaagcuguagaggcacagagcaagucgcuucccuuucagucuggccuggaagucccugaauuaguugaaaaggcuagacaaggcauaaucucugcggacagggcgguggggggcuuggggggagggggguggacagagaauagcaaugcuagggcuaaaauggaggaguccauguucuaggcauaaggagguaaggguccgcgcagagcaagggucaggggucaagagcacacucaugggagcuacuggccaguuaugcuccggcaagugcaggcagcuacagaccaguuguccuugggcauuaacucuuguucuuuauccauuuauggaaaauugaagugggacuugguuuguuuauuucuuuaagucauugucaugaucugaagcagauaauaagcgccucgccugccuuugcagccaugucuccugcuccgccccuuccugagccgaggcugcccacagccccggagccugcuccuccuccuggaccacgugcugugcacucagcgugccaccucagggccuuugccugugcugugccuuuggccuggagcgcccuucugccucccuagcucuccaaacccuucaaggcccagcucaagugccuccuccccugugaaacugucccuggcgucccgaggcagggguuggccuuuucucucugguccugcugggaagcagaaguuuuguauaguguguuucacuccacccaaugauacacgcggcuguuucuaucuguuccuugcacacaaaguuccucacuagagaauauuucuauagcacuucaagguuaauaaaauguuuuauccaaacuauguggagagagcagaaaggacguuuucuucauucuuauaaucccacaguaucuggacuuaugggaaauaaaaaagcacaguccagugcauggccuguuugcacguguccguacagauugaaaugcagucaacuccuaaacugagccgugaccuugaaauacaaaagacuuagagcaaguguggcugcagcagugcagccugacagggcucugggaauggcgaccgguuuuugucuccacuuuugaaaugagcaguugcugagaagccacaaggugacuagcacuccugagcuggggcagcguccucuauggcugugugucugugucugugugugugugugugugcgcgugcaugcgcgcgugcucggcacucgcuguguugguugguagcaagcugcgguguaaucacggauccuuuaugucauuccacauaagggugaaaagguggaagggcuacaagcgcaagcccuguaucccuggagagccaaaaaagacaaccacuuaaauuuuaacaaaagugacgucaucaccguucuggaacagcaagacauguggugguuuggagaaguucaaggucagaaggguugguuccccaagucuuacgugaaacucauuucagggcccguaaggaaauccacaagguauuuuuauuuaccugcuucucuuugaugaaaauaguauuagagauuauugucugugcuaguuaagauucaugcagggggcugcaggcugacugucuucugaaaacuagacuguaugaaugaaaugcagaaagugagccuucucgugagcuguaccuccccuggcagggaagccuuaaaucauguucugcaauuggcuuguagaagaaucccugaacuguuugagaguuuggacucuuuaugcccaguaugguaccaaaaauacauacaaauacuuacaaucaaggucuuugggaaaguaaugaauggauuuggaagaaugaacaaauggcuuucuucaucagugucugcauguagcagagaacccacaagguuguuauucuaacauuuaaagauguccagaaccaccuggggacugugagagguuacagcuaguggacauacccccaugguugcuucuagucaaugcugaggagacuggcacugagcuucuggguccagcauagcaagugggagaaaccccagccugagccugguggcugcuggcacccuccuguguucuaaccccacugcaggugaccgcugcagcugugcacucguagcuuucagagaaggcagcgucuuuuggcauuuucagaugagaacuaaaauacucuucuuuucuccucacagcaucgauacuggcccuacugaaaguccugcuagucuaaagagaguggcuuccccggccgccaagccagccauucccggagaagguaagggccgggguguguggccuccuuagaagguugggggcauucagugcagacuguaaauguuccuaaugacugcauucacuuuaaagaggcugcucauuucccuucagccucccgagcacugagguaaaacagagauugagcaaacuacuuucugaaguccucucaaaca

SEQ ID NO: 8336 - RNA, 11762 nt, Mus musculus
agcaguuaagaauaauguacuuuauuucaguaaacaaaauacugguucuucuaaaaacauauaaaaauccacucugucaaucauuuaaguuaaaggucuaggccagagugcgguccucuucugugacgucuuuguucucucuucucugcuggaguccacccaagcugacauuuaaguaggaaaaucuagaaaggaagggagaccacagcaguaaggcuagcgcuggauagaaaggcucgggcuuugcaugcuccacaccaacugugcuugugcucugagacgccaggggaggcuacugggccugaccuacuaaccggugcaucuggguuuccuccuuuagugcaggcucuggacaagcugcuagccugacagacaggcuagcucccgggucaguucuacguggcugugugcacacucacgcuuguggcccuggcucaaugaaagcguggacauaacaggcaccgaugagcucacacaugaucuucccacccuccucucagcugacaggcauccucugccugcaucauaaaccuagcggacccuucagcucagcugucugcccugcuaaucaccugaaacugcuaaucaccccuccuccaacugaggcuaagcacuuccuccaacugaggcuaagcacuuccuggugguuuuugguuucccaucaauaagacaaauuuugaaaggcaagacuccacggugguaaguuacucugccugguaaguuagucugagggccagcgaguggcagcaagcauggaugaguggcauacaacagugcuccuauggucuccguauugcacguuuuggagguggcacaauuggggagugaguaaggugguucgguucccagaucuguucucuacuguucuuucagccugacaucaccuuggggaguugucaggagggcugaggcaugacaugcacggugaaacgcuugccccagucucgcugucaccaaggagccuacuuuacucgacagcccgagggagcuccggcuuucagaagcauggcaucaggugggcagugccgugacgccagaggcgguucccacggugaccuggagcugagcagacuauauaaaaaucaccugugggauuuucaaagcaccggcugcccagacugaacgguggacccagugcccuuuccugaggcuggggccugggaagcugugcucuuaacaagcaacccaggaauccacacagccgaguauagaaauucugauguucagcuggguucuggaaccagaaucuagaaucugaaauccuugcucaccauauuugaauccugauacuaagaaaggcucggaguucagcuugauacuuugaaauucgcacacacaaguaaauaaucaggcguaucuguggcaaggccuuaagaaaagcucccagggcccuugaguccuccaccccaccccaugcacacagagaggcaccagaugcaguaauacacaagccccaagcuugggcaggagcugccagaaagggcuggcuaggaacacaggggcauaaaggucuccgugaugcagaaaugccaagggagcccagggagaggacuggagacaugggcaggugagggagcacggugagaggacuggagaugugggcaggugagggagcacggggagaggacuggagacgugggcaggugagggaguccggggagaggacuggagaugugggcaggugagguuuggccagaugaugaacagauuggaagggaucauuugccaacagggagccagacaucauccugaagauagcagggcuccuuaauuugaccugucuccaucuccuccuccaccaaacgugcaugucuuaguacaugggcuuuucuggccuguagcuggagucaggguccuaagccaaccccucccacuaagaagcacaacaggcucggcgcagaggacugauacucuaaauggucagagcggggcugaggcucuggcuuugcacccuggcugcagugcccaugugcccucuugcagcgccucagaccaaggaugcagagaucucagggcaccacacccuugguugggcacugaagcccucuggagagguuuuguuugcaaagcccaguaccucuaaugucucuucagcucgcuuucuucucugacugcuuccucuucucugcuugcaguuuuccuuccaggcuucuccuuugguacauuuucacgcccgcaaaggccaggcacaggaucaggguuuuugccgccaggauauacagcagcaggggcacguguucaagaaccucaaggagaaagacacaggcugauugcucuagcagugauguggagucucgguuccuuccuuuugcaaauguuaccgagcaccuacaauguuucaagcugaggcuagacuccuggaccacaaugguguccuaguuagcuuaacugacaacuugauacaaucuauaaucaucugagaggaaagucuagauuggagaugucaggagccaucuaguauaggcuaaggcuagcagguggccuuccuggagguggcccaccauuuuugcauggucugugaugggugagcucaauggcaaggcccagagaaacuucaccucaggauugcuucuugcagcugcucugccuucccugucaucauuaaauuaacagaguaguuucuuggcauugucucacccuauugaucagauuuccggcagaucaacauaaggauaaacuuucaugaauuaaugcuauuuagaugaauuaaugauucuauagacuucuugauuugauucaaauuuuaggaaguuuuaaaagaaggucuuagucacuuugcuagaaagauguaauaaaguuagaaucaagcacggaauguacccacccgucauaauaguaagugaaggcugcauaauaagaaauacaaugaguuuucaucgucacacuaaaaagagaaauaaacuugggacagauuguguguaaggaaaaacguuucaguccaaggauaaagccacaggugugcacuaugauaaggcaaggccaugaaaaaacuguggcuuugaacuuauaaugagcauauuauuaugaaacacugccuugaacuuaauaucaacaucccucuguaacucccauuuuaugauaacauuuuaucuuugagguaauuuucuaaggaacuuuuugucuaaggagguauaaaaagaccagaggaaagagauacaguuguugauuaaaugguuuggcuuggggagcucugccccauccauccauccauccaucuaaccaucuauccauccauccaaaguguauaugucuguuugucuauauguacauguauagguacauguguguaugcauguaagcaugcgcaaacacuuguuguuugugacagacaaucaauggccagagugugucugugcaguguauaaagcaucuuaauucuuuucuuuuccuuccucucugguucacaaagaguuaaccagccuagccagagaggcuucuggcugccuggacagagaggggagugauggcgauacauuuuuuuaauuaaaugcccccgcugcuaggcaacaguguuaaucacccaagccagcguuuuuuaaccacagaauaagcaagaaaguuuuuaggauguuuucagaaguuaucagcaaacacuaaguauagagagcuagaaggccagaaaccaucagucuuuaaaucuaccucuacgucugacacugggucccacuucaaacccuuccaggcugggcuggcucccagcagaagcagcugccuagaccagacuggccuguggguguguccaugggggacugucugcauuuauuaauugguguaggagggcucagccuauugcggguggcaccauucccagguaggcagcccugagauauauaugcuaauguaaggggcugaagaaacggccaggguuagaaugaaaccaguccccagcuccugauuccaauuuauacacauuugugucccuccaauuguaucuaaaccuuuagugacugucucuuccauguugcagauggagcagcaguugcuauauccaggaaagucugugugcccuguguuuucuguggacugucuccuugcgucugcacccagccccauggaggggacagacaguccugacugaacagaugaggacucuaacuacggagagguggcuaacuggugaggagaaagcaagacguaccagacucuccaucgcugaauuucccaguaacacgucuuguccuuccaccugaaucugguuuacaauuucguccugcaagucagcuacaacucagcugaacucaguaccuuagaaacuauuaacuauuaggaauggcuaucugaggauuucugaggaagguugcccugugguagaauaauagagugaggaagaagauauacucuaguuguuuaauuuaacuaagacgguaacuauguccacuuucacccacuacugaagagugaggaucacacagcuuaggugcaguggaggaucauaacgaugucagaacaaacgacaugaugggcauguauccugaugacaggaccugucacgaggcugcuccugagcgcuacuggucaagcuugacuccacacucacaaucuagcugauggggaauguaagcauugcuauaaaccuccuuacgugcccaggcugcccaaggcugagacugccucagaucucgacaggguacugucucauccccacugauauauccugggguccucgcaagaugcagcuaaugucacaggccuugguucuccaugguacaagccucagucagcuuuagcaggggcagggauguguuaucuaaucaggaggguagagaacaaacugaaaaggaauuacagcugacagacauggcuaggugguuccauuauuuacuuucuuaaggggaccagagaggcaagaguuuccaggccggagggcaggggugggagagugaugccagcagagggcagcaaaacugaagaacuaaagagucugccccacucugugccccauccggggcagaaacuggcuucaguuggccucaauuucucgaucaucuccucuuauccuuuguucuggcugguuuugugugucaacacagcuagaguuaucacagggaaaggagcuucaguugaggaagugccuccaugagauacaacuguaaaacauuuucucaauuagugaucaagggggaaaggccccuugugggugggaccaucucugggcugguagucuugguucuauacgagagcaggccgagcaagccaggggaagcaagccaguaagaaacaucccuccauggccucugcaucagcuccugcuuccugaccuguuugaguuccaguccugacuuccuguggugaucaacagcaguguggaaguguaagcugaauaaacccuuuccuccccaacuugcuucuuggucaugauguuugugcaggcauaaaaacccugacuaagacauccuuuaagcuccuuuuaucucucaaaauaugcagaccuguaagggaggaaaugacuacugcuggaacaggugagaucaacugugugugagugcaugaggucaugugugcaugcaugugugugccugugugcgaguauguauguacauauguuuauguaugugaguggggguaugugcauucauucauaugaaugugcaugcaugugugugcacacuuguauguauauguguacacaugcuuaugugugugaguggguauauguguguaugugcuuuugugcacgugugccuguacauguguguguaaguguauguguguguucaaacauguauucaugugcaugaguguguaacuguauuauguauuuguuuaugugcaugcguguacaugugcacaauagugcaagcaugcaugcgugugugcacaaugcucaugugugugugugacugcauauguuaugugugcugguccacaugcuugugccugcaugagcauuguuuuucuuacuugucacugaacauggagcucagcucacgauuucagcuacacuggcuggcuagcaagcuccuaggaucugccugauaucagcugcccuguguagucaaggcuagcccugaacucucucuccaccuaucuguaccuggcucuaucucuaccugauucuuccgucucuacuucccaccuucuggcauuauaggugugcaccuggcuagucagcuggucuuuuaaccaacgccccccaccuuaccucuaggcuuucaggcuuuuaaaugaaugagcccugcccuuucccuugcuuuuacuggcuagugggcuauguaugcucugccugcucccaaccuugguucugacagcuaaaucuaaccaacaguuuauaggaaucucuuuuauucauuucccaagcaguucaacuuguccuuggugcuccuguggguaauuuaugacuuuugaaaggugguuuccaugaaaacugaguugaauucuuugagagaaucaaguguggcuaggaaaaaacccccaaugcucucggcaaacagcuggaugaaaugauggaugaggaccaggaaaacuggaaggucuguaagaucucaguccacuuuccucaccucaggcuugugcaucaaagucauaaagagacacauggaggacgaagucugagagccagugcagcgaggugggaugcuagcgcgggccucuuccaggauaugggacagacuuguguccucacacagcagaaagugggcuaggcaggucuuuggggucuguucuguaagggcacucaaugcuuuacugacuuuucugucacugugauaaagcacccgauaagagccgauuuaggaaggaauauauugugguucccacaacggagauaggccaccacaggcucuggucccaugcgagagggagccacacggccagagguuccaccucuaaauuccaucauacugccucagaagugcuacaacagauuugagaggcacuagcauucaccuguuacaucgacuucaaggaaacaaaagugaggacggcuaagggcagcuuuaaaggccugauuuuugcagaacagugagacagucugagguuaggggaggcauccucagagaaaggccccgccuuccuccggcagucugaagaacaaaugcaaauucacaagucuuacccguuggaaacauuaaaugugauuaccaaggcaugggugugaguaggggcuauggggaguaauggacguucacaggagugggaagagaugaugagagccaggagugaggaccaucagaugcuauacagauaugacauuguuggagaacagauucaauucacuaaaaacuaucacucugcuguacagaguaucuacuccacugaugcagaguaucuacucuauuguugcucuuaccaucuucaaggcuaugauguguguuaaccccugguggugccaccaugaacugcagugaaccuucagagaguggggccuuaugggagguucucaggucacuggaauuauguccgcagagguuuaagggacucuggucuauccuuccgcuuugcuuacuggguucugaagugagaagucuuaccugcuucuauucucccccaaaugccaucugccaccccaccccccccaccacacauuuacagcaaggcuggaauuuccagaucccaugaacucagguguuccccuagugugacagauauuauauguggaaaaacaaaaaacaaaacaaaaaccagacuauacuuuuaaaaacuauucucaccuuccaguucauggcgggccagcugugauucacuucugaccaauguaccuguuacacacaggcaugagaggcagcuggaaagccggacccaaggagcuggaaguucugaucuagggagagagagacagaacuucaauacagagccugcaggguggaccacaauaggaagccacgucuuugauagggagaggccugugaacagagagcaaguagaggagggggggggggggcucugcacaggugaccccguuccuuccucauggcucucugcagcucccugcugaagcaucuguucccaacugacuccucugugcucuuaaagcccacacucaccaaugcuccugacacgaggacaagcuaguuuggggauuaaggaccuucuggacacuaacugugcuuguccuggcugaaaauaaaaacaaaccaaaaacuaucuggagggaaagaaugacaggaaaaaaaagguggggggggggagaaaaaauacaaaaacacaaaaaaaccuguccugagagcuagggacagugcagagacagccagagaacagacgcucugcacaguccugugucucauuagcuauggcaccugccuccacagccaggacacgggugaucuggaugaagcaucugcacaggacauuggcaaccagcuggugcccugcuaguucuggaaccugacuuuauaggaaguugucacagccugacuccacugucugugcuuagaugagcuuagaugagcuaagccagugagucuccauuuuacucccuuuacuuuaaagggggaacacauagggcauaaggacugugcucaggguccucuagugugugaccagaauccgaacccaccuaggaccagaagucucuguuccaaaugggugucucuggguucuugguacuguauuuaaaaaauugaagguggacacaggucagaaagugacaaggaauuuuguucagaagcacagacgugguacaggccagguacucuacaagaggccaacaggcaccuuaagcuggaguggaccagccuguggcuuccuuuuguggguuuaggaggggguagaagcugacuguuaucagugggguguccuuaaguucuaaucgauaugggcuauguaagcuuuaguucgcauccuuucccacgaugcauuucaauuuaauccuaucugcucccaauuacacauagccaaaagagggcaaguagggauuuuuuuuucccucccuaacuguucauuuuaaggucacaguuugccuuacugugcaugcaccccaaaccaguauauguuggaucuagccaugaugccuaguuucaggauauguuuggucaccaaaaggacuuacugagggucauugcuaagaagcuacaguuuggagugcccacaagccucuguuuaaagaggugugugcaugcagcuccacaugggugugggggagauccuggcuugcuuuacugggaaagcacuguguagcucaaucaagcagaccccccagguuucccuuccccuugccuaucuuacauccagucagccaggucugggagcuucagccucagcaagucaccuggguacagauggacugcuucaaacucacuuccuucauaauaacuuaagacuagaauuagaaaugcaacgggaaauuccacacaccuuuagaauggguuuccuuaaguaaagcucaugggagauggcguagaaaaacauuuccaguuguaaaaguaucuaauauauaaaauucaguucucagucuauuucaagguuacagaacuuugaaaaccagcuagcuauuggcacaagauaaccaagcuuugccuuugacuugugcaaagucagauaaaccaagaaguguauaauccaaagcccuauuuaaaugcgauagcggugguugaaggugcccacuaccugcaaguguuugccuuuaaauagcagcagauuccaaccuauguuggaaaaaugagcucuuugcauguuauaaccugcugcuggaauuuacaccuugaacgucuaguaaucuuagggauuagccauacuguauauuaaaacaaaauauuuuuuuuauuuuuauaauuccuucuuaauugaguuguauacauauuauaugguagacgauuuaacuguuucccacaagucaccucugugaauugauaugcccaggauacugacucccaaggucaagggaaacaaaugggcccaagaugcugacaagaggaaauaaaugaaagaaaauaccccggggucuggaggucuggcaaacacauugcacuuagcagcaaugugaccuuggccucucaaagccuccuucaucaguaaauucuccuucagaaguuggccaguaaucgcuaagaagcaugaguaacacacagcaagcauuauugucuugauaaugucucuccuuugcuaaugguccucagauaacaaacagcaauagggcaggauguagucuggacaagaugccaggcaugggauaaagaauaagggcaagaagaaggaggacaggacucuacuccagguggcaguaagggcugagcaugugaccugggaaagccauguggcuccugagccaaagcgcucuugggauaucagcguccaaggaguaagucucccacucuggaauucacaacucucugcucugucuaaugucacaggacaugaugccaaaaagacuagcaaucugaguguuaagagguaagaucucugagaaggaagcagggggcugugggcguggcugagccagagugcuaacgcaaagcucucgguucagcccaaguaacucacaacccaaccuuggugguacaagccuguaacccuagcacuugggagguggaggucaagggaugggaguucaaggucaucuaaggcuacagagaaagacugagcuggaggccaaucucagaugcacagaauccugccaaggaaggagaaagagaagaaaaagagaagaggaagagaaggaggaaaaaguaaaagcaaaggggaaucuguacugcuauggagugggugggguggguagaggagagcgaagggcccagagcagccagguucauuuucacccacuacuuuaaauuucaaggcagcuugcaagcuuucugcaaauggggauaaccaagaaagcuaaacauagcagugagcugucugcucugauaucacggacuccuggugccauucagaagcaagcagcagcuggcagcagagggugagccaaagccacugggguaaggacagcuggaggccauuaaaauauaugaaaugcagggagcuguccaggcuuaacccuuaacgacagaaaauaaaacuguuuguaguuuugaucuuuauugcaaaguauccugccagguuuuauucuagaaacaaagaagacauucacucacuuugauuauaccaauuuaaacgacguggacaauagucugcucacaagcuccgugugcuccuuggcgaggcuaacagagucgagggugcaccuaucucagcauauaaugcacucaccuauccuagcagcuugugucaacugucugaagccguuuucacucccagucucuaccccuuucacuccaauuccucagccaaccauuuaaaguaucgguagguucaaaucgccaugaccccuggaccucacuuagcccacucagcacaggccuugguuuucaagaaacccagaagcaccuuauccggguggguggccagauuccaaauuucaaggcuuuggggagccugugaguuauggugcacuucccuacuagaugaaacgacacgccuuguuuaagcaacuuuggcgccuuugcgaucuggggcaccacaggaucaaacggggauuugcuaucccuggauacuugggagugcccagucccagguucucgcccccaggcauugccuccacgggggugggggguggguagaaggccaggaguuaucaucgcucccuuccugcgucaccaaaacaaggcgacaagacuauuagaguucccaagggcuauguagccguaggcagcaagugucaucaugggagaaacaagaacgcgggaugaccaagggauuccccagagccccaaagacucacacacuuacacucagggcggcggggccuccucgcuugcugcucacaaaccacgacucccacaaucccg

SEQ ID NO: 8337 - RNA, 3757 nt, Mus musculus
ugcuaaucaccccuccuccaacugaggcuaagcacuuccuccaacugaggcuaagcacuuccuggugguuuuugguuucccaucaauaagacaaauuuugaaaggcaagacuccacggugguaaguuacucugccugguaaguuagucugagggccagcgaguggcagcaagcauggaugaguggcauacaacagugcuccuauggucuccguauugcacguuuuggagguggcacaauuggggagugaguaaggugguucgguucccagaucuguucucuacuguucuuucagccugacaucaccuuggggaguugucaggagggcugaggcaugacaugcacggugaaacgcuugccccagucucgcugucaccaaggagccuacuuuacucgacagcccgagggagcuccggcuuucagaagcauggcaucaggugggcagugccgugacgccagaggcgguucccacggugaccuggagcugagcagacuauauaaaaaucaccugugggauuuucaaagcaccggcugcccagacugaacgguggacccagugcccuuuccugaggcuggggccugggaagcugugcucuuaacaagcaacccaggaauccacacagccgaguauagaaauucugauguucagcuggguucuggaaccagaaucuagaaucugaaauccuugcucaccauauuugaauccugauacuaagaaaggcucggaguucagcuugauacuuugaaauucgcacacacaaguaaauaaucaggcguaucuguggcaaggccuuaagaaaagcucccagggcccuugaguccuccaccccaccccaugcacacagagaggcaccagaugcaguaauacacaagccccaagcuugggcaggagcugccagaaagggcuggcuaggaacacaggggcauaaaggucuccgugaugcagaaaugccaagggagcccagggagaggacuggagacaugggcaggugagggagcacggugagaggacuggagaugugggcaggugagggagcacggggagaggacuggagacgugggcaggugagggaguccggggagaggacuggagaugugggcaggugagguuuggccagaugaugaacagauuggaagggaucauuugccaacagggagccagacaucauccugaagauagcagggcuccuuaauuugaccugucuccaucuccuccuccaccaaacgugcaugucuuaguacaugggcuuuucuggccuguagcuggagucaggguccuaagccaaccccucccacuaagaagcacaacaggcucggcgcagaggacugauacucuaaauggucagagcggggcugaggcucuggcuuugcacccuggcugcagugcccaugugcccucuugcagcgccucagaccaaggaugcagagaucucagggcaccacacccuugguugggcacugaagcccucuggagagguuuuguuugcaaagcccaguaccucuaaugucucuucagcucgcuuucuucucugacugcuuccucuucucugcuugcaguuuuccuuccaggcuucuccuuugguacauuuucacgcccgcaaaggccaggcacaggaucaggguuuuugccgccaggauauacagcagcaggggcacguguucaagaaccucaaggagaaagacacaggcugauugcucuagcagugauguggagucucgguuccuuccuuuugcaaauguuaccgagcaccuacaauguuucaagcugaggcuagacuccuggaccacaaugguguccuaguuagcuuaacugacaacuugauacaaucuauaaucaucugagaggaaagucuagauuggagaugucaggagccaucuaguauaggcuaaggcuagcagguggccuuccuggagguggcccaccauuuuugcauggucugugaugggugagcucaauggcaaggcccagagaaacuucaccucaggauugcuucuugcagcugcucugccuucccugucaucauuaaauuaacagaguaguuucuuggcauugucucacccuauugaucagauuuccggcagaucaacauaaggauaaacuuucaugaauuaaugcuauuuagaugaauuaaugauucuauagacuucuugauuugauucaaauuuuaggaaguuuuaaaagaaggucuuagucacuuugcuagaaagauguaauaaaguuagaaucaagcacggaauguacccacccgucauaauaguaagugaaggcugcauaauaagaaauacaaugaguuuucaucgucacacuaaaaagagaaauaaacuugggacagauuguguguaaggaaaaacguuucaguccaaggauaaagccacaggugugcacuaugauaaggcaaggccaugaaaaaacuguggcuuugaacuuauaaugagcauauuauuaugaaacacugccuugaacuuaauaucaacaucccucuguaacucccauuuuaugauaacauuuuaucuuugagguaauuuucuaaggaacuuuuugucuaaggagguauaaaaagaccagaggaaagagauacaguuguugauuaaaugguuuggcuuggggagcucugccccauccauccauccauccaucuaaccaucuauccauccauccaaaguguauaugucuguuugucuauauguacauguauagguacauguguguaugcauguaagcaugcgcaaacacuuguuguuugugacagacaaucaauggccagagugugucugugcaguguauaaagcaucuuaauucuuuucuuuuccuuccucucugguucacaaagaguuaaccagccuagccagagaggcuucuggcugccuggacagagaggggagugauggcgauacauuuuuuuaauuaaaugcccccgcugcuaggcaacaguguuaaucacccaagccagcguuuuuuaaccacagaauaagcaagaaaguuuuuaggauguuuucagaaguuaucagcaaacacuaaguauagagagcuagaaggccagaaaccaucagucuuuaaaucuaccucuacgucugacacugggucccacuucaaacccuuccaggcugggcuggcucccagcagaagcagcugccuagaccagacuggccuguggguguguccaugggggacugucugcauuuauuaauugguguaggagggcucagccuauugcggguggcaccauucccagguaggcagcccugagauauauaugcuaauguaaggggcugaagaaacggccaggguuagaaugaaaccaguccccagcuccugauuccaauuuauacacauuugugucccuccaauuguaucuaaaccuuuagugacugucucuuccauguugcagauggagcagcaguugcuauauccaggaaagucugugugcccuguguuuucuguggacugucuccuugcgucugcacccagccccauggaggggacagacaguccugacugaacagaugaggacucuaacuacggagagguggcuaacuggugaggagaaagcaagacguaccagacucuccaucgcugaauuucccaguaacacgucuuguccuuccaccugaaucugguuuacaauuucguccugcaagucagcuacaacucagcugaacucaguaccuuagaaacuauuaacuauuaggaauggcuaucugaggauuucugaggaagguugcccugugguagaauaauagagugaggaagaagauau

SEQ ID NO: 8338 - RNA, 2400 nt, Mus musculus
agugugcgcagcggcuggagaggagauaguuuucuaaccaaggccucaaagaacucuagacuacaaaaaaaguugaaagcaugggggacucaggccaccccgaacucaugagcucgaauccacccuccagcuccggcgggaguccggagcucuccuucaggcaacgaacccacuccgcuuaagcaauguaggggcaccucccccaccuuguucguccccgcggcgccgagggcauuuucgccgaagagcuuuaagggucuccuuccugcuuggcucgcugccggcuacuguccccagccggagcagcuggccugugcuccggggucccuuacuucucuugggccuugcuuccuccggaacuucuuacuacccacuccauggagcccgcuacuguccacauauugaccgaaccccuccacuuucaucugugcucgggucccuggcugguccccgcgugugucuuccuuccacacgcaucugcgcagccuggguuccguggaagaggaagaagcuguggaggucccggcacggaggccuugucugaaguuugggguggcuucucuugccccaggcggguaggagcuggcggcauggaggaucaggcaggccuuucacggucaugucggggcucagaccggacgccagggggcagcagcggcccucguuaggcguccugggaagcggagcagggcacugggcacgccccgacggcgcgaggaucagucucaccuggagguccuuagggucgaucuugugaguuuggggacagacauuaggaaguggccaccagaacccaccugagcgcccccgucucucagaccggugguagccgguccagcuugcaugggaaucccccggcuggugggucucuacugucgugauccacccaaauuagggucucaucucuucucaaagccucuuugccugggcuccgccuuaugcuaguucaggaccaugaguuccucagguguccagcgauugucagcgaaggcucaacuucuccagccuucuguauuuucccgagugggcccgacuuuccuccuucagcacaaagaucgugacagcagggcaaagcucagugcuccccuggcguuuggggggauccggagcuuugggaagacauuuuuuccuccuugcuuuucuuuuaaaacgaaucuuaaagaagucccaauucaggggucgaaucccgcugccugcgcuccccugccagggccacagcuuccaagugcagccagguucuggugugccguauuuacuggagaguucauggccaguggaagcgagacucccucaaauagcuagcuagacuccccucaaaugcauuuuuugagcagccgacuucagaucuagugcuccuggagccacagccaagcacauccacacagaccaaccgagacagggcaucaucagaacaguguggcagagacaacgcucgaccuugacuccaggggaaagggugucucuccggcccuucaaaagauuaaaggaaucgcguuggggucaaaccucaaacugcgcauggaguuuaggguugucugucuggcagaagccuaggaaagacaguuacaugaacacaggcaccaaguuuggcuuucaagguucgcaccuugagcgcugcucagcugaguuacugcuaguaacucaguuaguucgaagcucgaucaggauaaagcaacgaaaaacugcaaaaauccggccucgggcaucccuggaccuguguggguugucacugagccacuugacacgcacuugaaaaacacagacaaacaaaaucaucgccccgucuuugcugcaaaauagcaaucagcaagcgcgcagcugggacucuaccgaggggcaccaugaacgcgcaguccuugcggcuuuggacagaguucaugcaaguccugcagcgggagagggaaaugaggaauuccuucccacccagagugcgcauuucacugucaaugcacacuuucucucgcuugccucaccaagagcuaaaggaaagguuuacaacuuucacuuccaggcuucccccagagugacacuaaaauuuacaugauuaaaaaaaaaaaaggaaaaaaacugcgagggaaagauuuguuuaagcugcuacugugugacagucugacaaauuuguugcuggggaaguuuaaaagugagcacaacaggauuuggacuuucuaccaugaauuuuaaaaguaguguuugguucagugagaggcaggcaaccauuucaauggagggcggagcgguuuuauugacuuauucuucuacauccuuacgugacuggcuaacuguaaguggucucagaaaacugaaaguuuugugugcuuauucuaugaaaucaucuccaaaauauauaauaguucucuuaaaucaaaauuacccuuccaauauaauacucuaucuaaauca

SEQ ID NO: 8339 - RNA, 6362 nt, Mus musculus
gucagccuugaaguuaauacagccugcguuagucaucagcuuagcagaaguuugggucuccuggaaccccggccugagggaaagaccucgcccaaguccucacaugcacagugcugcaugcuggcugcgugcugaucguaugcuccaccccgucccuggaggcuguaggguuugggggaucaugcccguagaugggguugucucaggcacagugcaugaauagauuucugagggugaggcagguuccagcuaaccauuguagugacuuuuucuguagcuugugugccuccaggacaggaacccuugcugggggccucagcaaaugcugucuugucccuuaggucauuuggauuucucucauggagcugcagcuuugugggcuuccagucauccgaacugaggcagguuuacauuuuccucuggaauuugauagccucuugugggggaagacauuaacaaaauuugacauuaguugggaaccaguuucuuagagcuugggcaaugcacuauggacacaugccugcagacaaggccacagguggguugagguaacuacagaacacaccaagguaucacaacagggcaugcuucauagacucauagcuuuaaaaacauaugcuguuggcucaucccucuggccacuagggagcuucauuugggauauauuaacuucuuaaagcucccaagguaaaugauuucccgagcgugucucuggcugagugaggugaugcaccagagaauggcuauuugagugagucacacgaggugacggagccaccaggcugaacaucaagaggguaugauaggggcagagugucuggcagagugaaguauggaugcgguuagggaggcagagcuuuuaaaggugauguggaaggugacguggaaggcgugcaccauugcucuggugcuguccccaggacaacaggaugagccugagucuggugcugggcaggcauccucucaugagugugucuguguaaagugcugguuccuguuggaagacaguuaauaugaagagucuccccuccccuggcuccauuugucaggaccaacacccguuucguuucugaugccauucacaggaagguugaggucucugcugguuuaugagagugaccugcauugccagccaaggacaggaccuuucacuuuguguuuucuugugccaaaggaugggcacuaaguuccguuccuagguuagcacauggaguucuccagaagccaccgggagagcagugugagcaucguccugugucaaggcccuuagggcauggccgagucacagagaggccaggucauucuccagaauagcuuuuuugcucccuucaucccugggagggagaggcugagacacuguugaguguguaagggcucgccaggaucugcaaggugcagugggauuuacucuguguuuuccuucuaggaacaggaagagggcugaugagcaaagcgucguugcaggugaggacugugucuuuauccuugaggcccaagauggauggugggcuuggugugugugugugcgugcgugcgugugugugugugugugugugugugugugugcgugugcaugcaugcaugcauacggaguuugcucacaucaacuggaucaaaucuguagccacuucucacuuaccaacuggguguauuugguuaggauuauguccaggaaacuuggguuugcuguguagcggacauuggagccuagauuguaugagggaugucggcaguagcugcucuugucagaguggaaacacgaugucaggaggcccuggagccugguccagagccuggcuccaguccuccagcugguuucccuccuggagaguggcguccaugauagaggucaucuccguggacuccuuuuuguuuuuuucugugcuauuuuaaaacauuaaccaguauacaauguucuuaaaaguuacaaauuaauuucuuuauuuuaaaaucacauacacuuaaauuuucaacaaaauuuuuauucugauguuuguauccaaagucuuacccacaggacgcacacuuugcacuacagagcuacagccuagccccuaaguuugauuuuuaaauuccuuaacuuaauuuguuuaaauuuagucuuguaugcaugcuuagccaaaagaaugugcauuucugugcugugauuuuauaaugcuacuuuguuuuuauuuaucauauuuacuacuuugaaguauucaguaccagugagcggugccaugcuagugugugguauuucuacuuuuuauuaggugaaucaucuuuaaaguaaacuauuaguaugugguuuugggaugugccacugcauaugugcagaucagagggcaacuggguguuguugguucucuucuuccacgcucaugugaguucugggcacuccagguuuguaaggcaagcucucuaccccugaguguuucuguuuuucaugacuaucauaacugacuuugcuccaaagcagugcaugggaggugaacuacagcugucccgcauacagcaugugugccgaugugcuuagagcgugaaauggacauugaccauggcuuggcucuuuccucuccuuuuuuuuuuuuuuuugcgguauguggagagauguagguaggucuuuaauguauaguuugauguauauuauacuuauagauacuauaaugagccugcucaagucuuuucucuguugugcuagaagucaaaagcagcuugaggaggcgugaguuauuguccaucacguagggaagucagggcagcagcgauuggcuggaaccugacggcaggaacugaaucagagaccauggaagaaugcuguucccuagggucuugguuuucaugacuugcucagccugcuuuaugguacaauccguccaggguggcaucacccacaguaggaugugucccacccauaugcccacaagucagucagauggaggcagucucucaauucggaccucacugagguagacugucauuuggaaugacacuugaaaagguggauuauuuucacaaugcagcucugacguguagagcuaaugcgcugcgggacuuuacccauccugcugaguucucacuucuccuucagguaucacugguauagaucauaaugccguaaagugggggcgcaacgucagagaaagucugcaggcagccacgugcugcaggguugaggaggaggcugaagccagacagaauacugagaccauccucguuaauauuauuuauaagacauuuaagcacauuuucaauacuuuucuuuaccuucuaaggaagucuugcaagacucuuccgacuccucagaccuguuugagguguguuguguagugaggaaaggagaacauggacagaucccgggaguuuguaugucuguuacuuaguugucuuuuucuguuggcuuccacuucuuuuuuuuuuuuuuugguuuuugguuuuugguuuuuucgagacaggguuucucuguguagcccuggcuguccuggaacucacucuguagaccagguuggccucgaacucagaaauccaccugccucugccucccaagugcugggauuaaaggcgugcaccaccacacucagccuggcuuccacuucuauauguguugugaauauauauacuguaucuuuuggugguuugaauucuuuuucuuuuuuaaaguauuuuuuguuggcugauuuaguuguauagauuugaaccugauucaaagagauucugaguuuuguugaaugcaaugaaaauaugugauauaauaaaaauuaugagacuuagaaaaacaaguuaaaugcugucucacuccgaaagagaagaaccaaggcauaagacacaucaugcucaaucaaagccuaaguccugcauuguaccucuugauucuggagcucgcugucuggcaucuggagcucacucgcgaucuccugggcucugccauccaugaacacccacagcuugucuuguaggcugaggccagcuccacuccacuccugcugcggucccucguggucaccucaugguccuggcauccccaggauacugggaucuccucugcagcugaggcuguaccuucaccaguguccucuccuggccucugacagugccaaacuuguuucuucccauggcccuucagcccuggcauuuccauugcaacagaggcugcaccgucaccagcggccucucuugggucucagugccaagccuuagcuguugcuucagacacuuacguaaacguuguuuacccuguugaugugcagccuuggcucccccacugggccccagccuccgugugcugacccugaggaagugcccccagaagaucugaucuccacgaugcuggucuuugguuaaucagagcuaaucuugaagcccaugcucauccucacugcuuguccugguaaagcugagguuuuacuuccgcaguguucuuccuaaacucugcuuucucuuuggcaaggagggccaggugaugaucucacugccugagagcugucugcucaccacggacacugugauucgaagcucccuagggcccuacauuaagaaguaagugaccacaccucacaccuggugucugccagugcugcucacagcccacgucggcagcacagggcgugaggacccagcucucggcuagccgagaaauacuuaguacgauugaagguuuauucucuuccaggguuguucuugguucagugugaacuguguuuccaagguuuuccaggcugccuaggauguggugcucacccuguccccuauuuacuagaaagugagcaugggaugggaugguguacgugacaaugguguggcuguuuccuucuacccuagaaagcuuggcagaugcuaggccacugucccagguucacccuguuguaccagcuuggcuucuucaccuuugaacagauuugaccuuagggcagagcuuuaguuaggaaugggggaggguaggugcuguagguugagagccacguccugggcaugugguggugagccuugcuuucagagcaucccugaagucagaggagggagagccucagcagaaauuauuucuacguuggguucaaagauggugcugacccuuaacccaaguggauaccccuccaccugcucucuaugaaccccguuaccgccagcucucuauaggccccucccccggcucucuaugaaccccauuaccccucagcucucuauaggcuccuccccuggcucucuaugaaccccauuacccccccucucuauaggccccucccccggcucucuaugaaccccauuacccccccucuauaggcuccucccccggcucucuaugaaccccauuacccccccccucuauaggccccucccccggcucucuaugaaccccauuacccccccucucgauaggccccucccccggcucucuaugaaccccauuaccccccucucuauaggcuccucccccggcucucuaugaaccccauuacccccccucucuauaggccccucccccggcucucuaugaacccuguaccccuggcucucuaugugccugugcaaagugaagaugcucucuggcccuuauucucugagucacucagaucgcaguacagugugugguaacaugggaauuugggcuucgaagaauaacgguaauguuucugagucuguuugugccuuagggacugaauuaugaguaauuauucagcagcuacaugauuuguauuagaaccugggaguuucggauuccacaguucugucuugguggugccguccaguagaacccccagcaaagguguggcugcuuuguucugcacuguccaggagccacagaugccugugcagugacuggaaugggaaugugccuuguguuacuaaacaaugauuccuuuugguuugguuuuuuuuuuuuuuuuuuuuuuuuugguuuuucgagacaggguuucucuguguagcccuggcugugcugaaacucacacuguacaccaggcuguccucgaacucagaaauccgcccgccucugccucccgagugcugggauuaagggcgugcgccaccacacccggcaaagaaugaguaguaguuuaaauugaaauaguuacuugagccagcauucacuguguuggcuggcguggcucuguccuucuacccucuguacccuguguuauuuacccuguguuauuuacccuguguuauuuacccuguguuauuuacccuguguuauuuacccuguguuauuuacccuguguuauuuacccuguguuauuuaccuuuacacgguaaaacucagaagccuucagcaggagaaccaggcuggaaacaagguguuggguuuuuaaacgggagugaaucuuaccugcuagucacggaaguggcggcucgggagaggcacggcccuaggaaagaugccugugucu

SEQ ID NO: 8340 - RNA, 2754 nt, Mus musculus
ugccagaaugaaucagucugucuagcugggucccuaggaccacacggguugggacucagaucagugucuugcuuagccauccucagggaagcugcuucuugcgguagaagggaacuacucaggggacccacagcugagcagugacucuggaacacuccauccuaaaugguggcgucuucaucgacaucuucagagacaacaggaaccacgcacaucagagacgggcagcacaggcccaagcaagauggggucucagcaccgaggaggaacugaacacagccucccugcccacccaaacacaggcuuuccagcugauccacacucccaugugaagguuuguuuucuccaguggagucuccccaggccccgcagcauguggucaauacaaaauguacucgguaguauuuuuguaggucucugucuugguggaggcuuucuuugggcauuuuuguuugucuuacuauccuuuucuuguauauuauguuuucuggcaauuuugugguuuucuggucuuuguguaugugugugugcuuguguguuucuugugcuuuuucuuuuugucauucuguuuucuuguuugcuugccugaugguuuuaaagaaaaggggaaggggaaaagaaauagaucuuggaguugggugagguggaaggugggagggggaccaugaagaauaaaccucaggaacaggugcagucagucaguuacaagcaugggagguggggugggcagucgccugggcccaggaacaggcuaaaaggcagugugcuuguccacgggcugagaaguguguguccacuuuccagugccuccugaugcucuuccgaggauaacugagacugaaaaacggcgaugugcugauggguaaucacagacaggcgcacacuaacaccacucccuuccccacagggacucagccuucuucccuuuuuuuucuuuuugguuuuucgaggcaggguuucucuguguaacccuggcuguccuggaacucacccuguagaccaggcuggccucgaacucagaaaucugccugccucuaccucccgagugcugggcuuaaaggugugcgccaccacugccuagcagccuucuucccuuugugugagcuaggacaacugaaugaauacugaacauggucaaaagaauggcgugaacaaagcuuuggggauggggaggcuccaggagaaaaggcagagggcccuuucccucaaggggcacuuuguucccuggauuguucuuggaggggauucugugccucccgugacaaacauuuacaucccauuuauaggacguguuuauugauguuggauauccuaucguggcuauggaacccagccuggucagugugcccuaaaucagguuaucaccuucugcucugcucuccugcuuacccagguauaaucuaucuauagcacgugccaggcaacugugucaacuggcauguuuugagaaaguucugggaaagggcugcucuguuaauguuuaguaugugcuuacuggugguuuuuuuuuuuuuaaacaggauuuucugaacuccaacaaccucccuugggucacuguuuucucuguuacacuuguguauuagagcacacuggaauagaagcacgguuguccacagcguccucagagccuuggcugaagcaggcguuucuucccaccccuccuccacuuacugugcacgucguccucggcaucugacucuuccagagagaccugagguugggcuuucaccuccagauuucugcugagccagcuuguuuguuccaaggaggagccagcgaugguaccuacagcuuccaggauucucugagugauuuccuggagagccagcagaagcaagacuuaauuaaggagaagaaaagagccggugcauaccacugucugacagguacagggcacgggccaccgcgugagucaccguggcaccaguagacuuucaaugagccacgcugagaggcgaaaagcagcuggggugacagauuuuaguaacagguucucuaccuacaaauauuccaauauaaacaucagcaucacacucugcagcugucuccuacccuggcuggcuuuggacuccuguggguacugcaugcuuacaacgaccaggaucuucucucagcacgugguauuguggcucugcucucuaccagccgacggguaaagucugcaggacugaugggaaaggccggcuuucugguucuccuggauugugguucaugcugguaugaacuaaacacuacaggacaccacuguuacuaagcugcuggacuugagacuuuacaaaguuucguggacugccaggccacaccaacagucggccgagucacucgugcugacuccguguacacuggcaggguggcgaagcuccuucugccuugauccucacauagaagcaagacaacauggacuauccugcugcugccugccugccugcccuccgcucccgagaagcagagccuggggggcagauuuauccuuuagucuuguuccccucagccugucucugucugcagaaccgguggccucugcugagcucaccagaacacuuacuacuuacucucuuuuaugggaugaagcauggccuuauucuagacucacaguagagccagucaagaucuuuauaaacagugcugcgugcuguugugcaugacugaaacgccaacacuugguaggcagggagagggagcguucagccagggcuauacagagagacuguaucuuaaacaaagauaucguuaaaauaaauugcuguaguuuug

SEQ ID NO: 8341 - RNA, 1469 nt, Mus musculus
uaaaaaauaugugacauuauugagaaggucaugguggauaaauuaaccauuacauaauuggaauggaaguuccuacacauucaugaggcuggccucaaucuugcuguguaguuaagguugaccuugaacuccugaucaucuucccauuuccaccuucagaguguugggauuaccaucauaacaaccauucuaggcgucugucacaucgcuaagagagggcgaaggcauugcuguuuuauugacauuuugaaacuccagagccauuuugagauauuugguggggcaggacagcucucaaauauccacugccugggacacucuuauuugguuauauuagaugagucccaaaguuucccaucugcccuauaagaaauguuauauauuuuuuguuuagucuuuaguucaggcuggccuggaacucucuguagcugaggauaaccuuccucuuaggguccucuggagugcugagaucaccggcaggggcuggugacagaaccgcugcuguuggcuaagcgugcaaucagcugccugcgucucuagucccgcuuuucuuucuagaccguaaauuccaggcgggaagaucuguccgaugagcaugugacacugacgcgugguagguaggacgucuugcaucucggguuagcacgucaaagcuggacgagccuggacuccuccgaggcgcgggaaugggauucccagucccgcccaacaggagccacgagccgcgacagccccgcccacgagaaagaaaagagcccagagcuccgcccaccggaagccaaggugccgggagauugcuggccacugggaggagggaugcccuggacccucccauucagagacuuugucuugugacagccccgcccacgcggaggcgggacgccccggaacuccgccccgaggaggcgugaccggaggcguggccugcggcgcgcgggaagcugcgggcuguggcggccccggguggaccgaguuacugcagguagguuugcugauacccggcuuccgcgcuucugaccuggguugggcugcagcuccucaccggggccgugaguucugaucucagcgcgggcgcaggcagaaggcaguucgucccagaccacaguccccaccgggaccgggacucgcgcgccuuccgccaggccggguugggccgcccggacccgcgccccuccccgugaacucccucccuugcugcuccccgggaugauagccaguacuccgguaccggucucugggaccccaccucaacacgaugcucugugcugcccguccucgccuccgucugggguguuugguuucuuucucuuccggaaccguacacugguggaagucucucuaccugcgggagcauuuuagcugaagauugcaggugucugagccgucggcgucgcuaauggcuucugugcucuuuccccggcucgcccuucauguuccagggucgcuguuuaacucuuugcuaacguuuc

SEQ ID NO: 8342 - RNA, 1469 nt, Mus musculus
gaaacguuagcaaagaguuaaacagcgacccuggaacaugaagggcgagccggggaaagagcacagaagccauuagcgacgccgacggcucagacaccugcaaucuucagcuaaaaugcucccgcagguagagagacuuccaccaguguacgguuccggaagagaaagaaaccaaacaccccagacggaggcgaggacgggcagcacagagcaucguguugagguggggucccagagaccgguaccggaguacuggcuaucaucccggggagcagcaagggagggaguucacggggaggggcgcggguccgggcggcccaacccggccuggcggaaggcgcgcgagucccggucccgguggggacuguggucugggacgaacugccuucugccugcgcccgcgcugagaucagaacucacggccccggugaggagcugcagcccaacccaggucagaagcgcggaagccggguaucagcaaaccuaccugcaguaacucgguccacccggggccgccacagcccgcagcuucccgcgcgccgcaggccacgccuccggucacgccuccucggggcggaguuccggggcgucccgccuccgcgugggcggggcugucacaagacaaagucucugaaugggaggguccagggcaucccuccucccaguggccagcaaucucccggcaccuuggcuuccggugggcggagcucugggcucuuuucuuucucgugggcggggcugucgcggcucguggcuccuguugggcgggacugggaaucccauucccgcgccucggaggaguccaggcucguccagcuuugacgugcuaacccgagaugcaagacguccuaccuaccacgcgucagugucacaugcucaucggacagaucuucccgccuggaauuuacggucuagaaagaaaagcgggacuagagacgcaggcagcugauugcacgcuuagccaacagcagcgguucugucaccagccccugccggugaucucagcacuccagaggacccuaagaggaagguuauccucagcuacagagaguuccaggccagccugaacuaaagacuaaacaaaaaauauauaacauuucuuauagggcagaugggaaacuuugggacucaucuaauauaaccaaauaagagugucccaggcaguggauauuugagagcuguccugccccaccaaauaucucaaaauggcucuggaguuucaaaaugucaauaaaacagcaaugccuucgcccucucuuagcgaugugacagacgccuagaaugguuguuaugaugguaaucccaacacucugaagguggaaaugggaagaugaucaggaguucaaggucaaccuuaacuacacagcaagauugaggccagccucaugaauguguaggaacuuccauuccaauuauguaaugguuaauuuauccaccaugaccuucucaauaaugucacauauuuuuua

SEQ ID NO: 8343 - RNA, 256 nt, Mus musculus
caccucacccauguuagguggccaggcaggugccugacacugcuguccucuggggagguguaaaauuuccauuagaaaaaugcaaggaggcuggcccugguggcacaaaccuuaaaucccagcacucaggauggagagaccggcagaucucggaguuucaggcuaguuagaacuacgcaguaagaccccgucucaaaaacaaacaaacgagcaagaagacgaaaaaggaggaggaagagaacuaaggugaggagga

SEQ ID NO: 8344 - RNA, 2702 nt, Mus musculus
gccggcacuacaguccccucgggcgcucaggcggucgcggucgcccgaacccauccacacuccucuuuggagccuaaaucuuccgacgcgggucagaugccauuucccaggcgucuuggaucccagacagagacgcagagaggucucagcgcaguucuuuuugucgucguggaccccguggcucgcuugguggcuguaaaguuauaggaugcagagagucugaccuuggaaacccagugcccgacacgggauuuccauauccuggccacugcuccauuccucucccuccaguccucuuccaagcccgagaaaagcuugcaggccgaccagcuccugguccugcagacuuccccacccgcgccgggggagcugggccuccuaaccacucgcgugaagcagauucuucugucuuuucuggguccccauuugaaaacccgaaguucgaaggccuucgaggaguuguagacugucguggggcuucgggcgguucacaaaccccggcccuucgcgccuuaauuaaaaaaaaaaaaaaaaaaaaaaaacaaaacggaaaaaaccggugcgccagguggcgugaagucgcaccaggcgggagcacggaggugcucacgcuucgcgcuugaguuuggagcucaaguuuggaguuugcuuugaguuuggagcuggguucugcgcuugcaggauuuucuggguccugcaguaguacggugcacguguacggagcacguuugccgguggugcggguacccaaugcccagaccugcagcccuugucgggaguucgguggggcacugugccuuuagccgcuccgggcaaguaagggcugcggagccacccugcuacggcggacccacucuggcgccgcuucgcagaccuccgaggaaugagcccugcacucugcagauacauaggguuuaacgcuucucccacgccccagauucccgacccucaauuauggacucccgagaauuccuccccggcuugaaagggauuacccagaucauagaaacauggcuaaguggaggugagagaaacccggcaagcaacaagaauugaaacuucucaacgaauuucccaguuuguaacaggaaagcgcaucugaacucuugcgacuggauuuucgcaguggaggccguuuugacuuuagggaggagauggcaaacgcuauugaaguggguaugggguagcuccaggcccagcagacaggcuccacauaaguccuucuccaaacaucaaacauugguuaacaccacacuuccccagaacuaggguccccagcgccaccgucuaaaguccaagucucugggcggguaucucaguacuagaggauuugcagcuaggaaggaguuuaagucuauguggaauaaugaagaugggucccuguagucgggaguuggagcaugggguuuucagggcaaggcuccagacauccagucuauuauugcgagacagaauuaauucagcagcuccguuugacauggaaaagaggagagagagagagagagagagagagagacagagagagagagagagacagagagagagagagacagagacagagagagacagagagagacagagagagacagagagagacagagaaggaagaggaggaggaggaggaggaggagaauauguuguaugcauggguauauguaggucacgaggaauccuuauuucagcaagaccaugggcacgugaggcccagccugcccgucugucuccauuccauuucucagugcugacauuauagaaccccugaucccucuucccucuuuacauggguucuggggauucaaacccagauccucauguuguguaguugguauuuuacuuacugaggcaccgugccagacccugaacaaguuuuaauuggcgcugaccauaguuuaguacaucuauuacuugucucugacuccaggacuggagaaagggucugcucacugaagcuaaagcuaagcagcaaacaucagcaccagccuugggcccugggaaagaggcagagcugaagagacccuaggaucucggguaccacuuauaaauuacuggcugguaggagccugcagagggaaggugugaagaagugacccacugauccugcuggcugggcacccagcucucaaucugcaccagaagcccagcccaccagccccaccucuuagaaauuuuccauuaggaaaacuaaucuggaugaaauuugggccccaagaagaaaggggguggggccaggcugccccacaucuguuugaauuuuccgcuucagauguuugggucuguucuugccaagcugcucacccugugccuaccugagcccauccccagcagaaaccaacuuuccgguagaucaaggcccccacagauguuucucccaggauaggcuccgagaaagcuggugcuauaaaagcagaucagagaucagagaucuagccaccaccaaggugugugugaagggggagagcccuccaguuccuggcugucuccagccucuaagugaaauuuaagagcuucaaccuccugagcuaugggaggaaacagaaaaucuugaauccuuggagauuggaaacauucauuucuacgccauuaucugcacaggcaaucggugggaugugcgcugugcgcuuacuucagcaagccuuauucccacccagcuucacagauccaacugucucuaacuggaagucuuuucugguaugaacugccca

SEQ ID NO: 8345 - RNA, 29187 nt, Mus musculus
gccacgccccugcgguuggcacggacucguccgcccggaggauacuggcgguggcgccucagaacaucuggcagcagacgcggcuacagggauggaggaagcggaugacaggaggggacacguuccugcuaucacuuccggaaacccaccuccgaaacgcagccuuucgcgccgcacagcccgacgggaaggcagccuuccuguguaaaaaaaacgcugcgaagcggccucgcccccgccgcggggcacgccgggagaacagagagcacacucccgcguuccggaaguguguguguguguguucgcgcgcgcgcgcgcgcgcgcguguggguuucgugccccuguccgcgcuaagccacgcccugugcccgaaggagggaggugugugagguguggcgcgaaagccggucacgugccaccacugcggaaggcgccggaggggcggguucguagggggcggggcaaccgggucacgaguggccggaaguugcggccuuugcggauaaucugagauggggaccacucuggacaucaagauuaaaagagcgaauaaaguguaucacgccgggguaaguggagggguguugggcuucaagcucugcggucuccagcacggcucgcgcggccccgacgcuagaugggcgugcccugcgguccuguccaguguggggcugggggccggcggcaggcgggcgggcggcgggcucgagcugucgcucugggggugaagagcagaugacaaacgccccuuucugcagaagagcuuucagaacagacaugugugcuccaggcuguggucaauccuaaagcagaguucucuuguaagccucucaccgcggcaggauccauuacccuaguuguagaaugcaaucgcccugucucuaccuccggagacaccagcacagcagccguggagucacagcuagcuucugcacacaguucaguggauacaaaugcagcgugguguugaaagggaaaaacaucccaggugaacaucuuaaauggacgcuaaaggcuagaaaccugauuauuuuaaaaagauuccagugagccaccccacuuccauccucaccacacaggaagcuauauucgugauuugucuaguagacaucauucaaagaccccucccccacaaaacaaaaucccaaacaccaaguugccaucaccccuuauaaaagcgacuguacucuggcaagaugcacuaagaaaguggaaacucacuuaugcuagaucacugcgaaaguauuuaguuaguucauaaaggaaacgaucuauccugccucaguugaggcacacugucaaaccacugccauauuaaagcugucaguuucaugaaaagcaauuggaggccaggggaaguggcucagauuguaaaauaguugccaguaccgcauaaaaucagacgugguggugggugucuguaaucuuaccacuuaagacagggucagaacauuaugaucauccuuagcugcauauugaguuugauacgagcccaggggccauaagauaagggcuggagagaugaauccacugaucuucggaggguccaguucucagcugccaugucagaccauucacaacucccuguaacucccaacugcagggaaucucacacuucuggucugauuggacugcacucacagacacaguguauaacauaauuugaaauaaaucguuuuaaaugguaagucaguaaaauuguugggguuuuuuuuguuuguuuguuuuguuuuuuuccgagacgguuucucuguguaccccuggcuguccuggaacucacucuguagaccaggcuggccucgaacucagaaauucaccugccucugccucacaagugcugggauuaaaggcgugugccaccaugcccggccaguaaaauuguuuaaaaugaaagacacuaaaggcaaggaccagaaugcagugcaaagcguuugucaaacaauugugucuguguugaauuucucggugugucuuagucacaagggagcccuuucauaugcugaccuuugccaugguaaccuuaaccgcuagaugugguguguauaaguuuccgcauguguauacagaacaaaaguaaauguagcaaaauaguaacaguucugaggccaauggaaagcgacaugacuuuuuucuugguuaauaguuuuguaggagggggcuggugagauggcucaguggguaagagcacugacugcucuucggaagguccggaguucaaaucccagcaaccacaugguggcucacaaccaucuguaacaagaucugacucccucuucuggacagcuacaguguacuuacauauaauaaauaaauaaaucuuaaaaaaaaaaauaguuuuguagggauauaauuuauauauacacacagauguuagagauauaauuuggauacagcaaaaaccagcccauuaaaacagcuaaucuagugguuuuaguguauuuauagugcugugcauccauccccacuaaguuuagaagguugucaccaacuccaaaaaagcccccguacuugauagcuguuacuccuccuucccugcccccagccccaggagaucacacauaugccacaggaucugccuguuguagccuuucacaggacaagaguccuccugguuguggcccuuucugacuggcuucuuugacacagcauguuuucaguauccaugacuguuggagcaugcuuguuucuauggcugaauagcucugcuguacccauaggccacacacuguccuugucaggugacgugaaagauggccaagugcuggaugggggugucuguggagugggauguagaaagcuagcuuccuccaggaagagccaucccagcuccgggaucaggaggguuagaaaaugaguccccagugggacugugcaccguuuacguggagaggcuuuagugggcugacuuuguuaucuucuguuuuccuuggcuuaaucuuuuaaaaaccuuuguggcuugacuguuuagcuuauuaaguuucagccuccucuuuaaaauccagacauccccaguaaauguuuuuuaguagugauuuacuccagugcaagcccacgucacucaccaggaucugcuggaaaggucagggacccaggauagggaauggacuggugguaggaggaucagaccacccaccuaaacucugaccuggcguuucuccagggacaugaagagacugcaguucagucaucucuguggacuccagagcaguccuugugucccacauggguuucagaaggauuugcuaaucaaauuuguagauugaacaacuuacaugucuuaugacuucaucaguauuuucuuuuuagggggugaguuuggggauuguuuuguuuuguuuuuagauagggucucuauauagcucugaaccaggcugaccucaaacucacagagcucuaccugccugugcuuccugagugcugggaccaguaugauuuuuuuuuuuaaagauuuauuuauuauauguaaguacacuguagcugucuucagacacuccagaagagggagucagaucucguuauggaugguugugagccaccaugugguugcugggauuugaacuccggaccuucggaagagcaguugggugcucuuacccacugagccaucucaccagcccccugauuuuuuuuuuuuaaacacagguuacuuagaaauaucuaauuuuccccuaauauaauaauuucuaauuuuaauauuuuaaauguuaggaaaauuuuaugagcagaauuacaaugcaggauuuaggaauguuagauuuuugacagcauuagaaaugcuagaaaaaaagacaauaaaaugggaauguuuaugauaauuuagucauagucaauagcuauaaacauacuguacauuuuauaugaccucgguaauucuuuuauugucauaagucuucucugugaaccuacccauugagauauuuaaaaguauugauacacauguguacagguggaggugagagaacauuguggaggagggccucucucccucuguggggaccccagggauggcaugcaggucugaaucaacagccccucuuauguauuuauuuauagcaucuggauccaguagcugcuacuucauaggugcucagaagcuguuaaaugacuugacaagcauuaauucaacaggggaacauguagugcaguguggaguuucuauauaugacaguauucuagauaauagccauucuuaagaggaugauuaaauaugaggguagauauuucagggcuccugugaauaaaguuuucucuguaauucaccaacagagaacauuagaagaacuugucaauuucaccaggucuucaucccuggauguguagccuuaacagcuguguuagcaggcugucuucuaccuaaaagucuuccgauuagguugaaaaccagacuucuaauuccauauuuccagcaacauuuuuaauuuccuuugggaauauguaacuaguacuguuuuauaauagcaugugguagugucccccuucucacaugugcuguucucuuuacaacuucgagagaugacagagcuuagggaaagucagcgacguggcaagacacaaauagagaauguuugaacuugcuuucuucucucucucucucuuuacauuuauuucuauguauguauuucuauacaucucacagacacacacacacacaccgagggacagacaagaagucaguccauucuuuuccuucuaccauguguccuggggguugaauuuggauuuggugcuugguggcagguacuugccuguguuuugagauagggucucacucugucugccauucagguuggucuggaacucacuguugcuguggcuaggcaggcuugaacuugcagcaguccuccuguaguagcaucuugaguguugggauugucgucuggagucaccaucguuuuguucccaaacccaggacucugggucuuaauucucaucuguaggguggaaacaacaucuacucaaaugcuguauuuucagaauggagagcuaguauuuccagacuaagcauaaaugugacccauagucgaggcucggaugcucaguggucaugucguuguauucuccugcaccccauaguugauucacucucagaacuguucugccaugaugcgaauacagcagcauacuccccagacagcagcccaggugcuugcguguuaagcauugcacugucgucagaugccugugugcuguggacgggagggccaagggucagcauccaagggggauacauguucaagcacuuugaaaccccaaggcugagugggauuuugguguuacuuuauuucuguggugcaguaacaugcacaugaauaaaaguguguguacuuacugacuagaagaucccugcaguaaaucucuauaauguaaauauaaugccuuguuuuuaugaauucaggaugcuuuauucauaaaugugaagcauguucucaugaaagugacaccacugaguauuaggguugugaaauacaacagaaauaaacuagcauagucagguuacuaugacaagggacuucuguggcaugggcugauuacuguuaucuacccaccgacccccaaacccucagaacucuucugugcauuuugucuuacaugguguggauauaacuucuucaaaaauaaagagaaaccuuauacacaguagcucauaauuuauaaggaaaaguugcagaacugaacugcuauuuuaaaagugaaagcacggggcuggagagguggcucagagguucagagcacugccugcgcuugcagaagauccugguuugauucccagcaucuacaugguagcuuacaaccagcucacaauuccagucccaugggcucccaugccuucuucugaccuccaagguaccaggcaugcacauggugcacaggcauaaauacagguaaaacauacauguacaggugagaaaagaggcucacuuacaguccuaacugugcuuccuaaaagggucagaacccuccacgugcccuugcacucucucgcacucucuacucuaccuaauacucucuacucauacccuaauacucaauggugucacuuucaugagaacaugcuucagauuuaugaauacaugggaaauaaaaucuuuagaaagaaagaaagccuaacuauacuuuacaugauuguggucguuugaaugagaaugucccccauacgaccacauauuugaaugcuugguacccaguugguauguuagaagauauuugaaccuguuucuacuuaggguguggcucagccuuuagcacacaccuuuaaucccucuggcuggaaugcagacaugcccuuaguacaccccuuuaaucccaaacaaugacgguaaaguuaguguguagaagaaagccccuauguuuggaagaaagugaugucuaacugaguggcaaagugacgaaucagagaaagauuugacaggaugugcccaacucucaggagaagagagaggaaagagaagcuacuuaagggacagacagacagugcaggaagaagagagugcagugcaggguacaguagaguugagagggagaguaaagcagcacagagagggagaaggaggcgguuuuaccaggagaguuuucuagagacagguuguagauacaagcuagacacagguaaagacaaaaugagcaagagaaucaggagccagaagaguuaguaugaggccaagcaaagaauucaggagaggcugagaaagagaagccagauugaaacagucagcuuggagaggaguuuugaggcagaacagcugaguugacuggccagcuaguguucauaaagaacaaggguaagcuuauucaguagcaagucucagagacugaaaacacucuggaccuggagaagcuuguacagaagcuagaagcuuccagggcuaggccuagguuagcagacugaauaaaagugacuuugguggaauuguuugugacggauuagaugugguguuauuggaggaggugugucacugggcuuugaggugucuaaagcccacaccugggccagucucucuagguuucgaaucaaguuguguauguaaccucuuagcuacugcuccaauaccaugccuaucugcugucaugcccuccaugauagucugaaagcauaagcagacucccaaguaaacacugucuuuguaaguugccuugguuauggugccucuucauaacaagagaacaauaaaaacagauguccugcugggaugaucugaagugcugugagaguaugagagauugcagggucacguggaggcuucugacccuuuuaggaagcacaguuaggacuguaagugggccucuuuccucaccuguaccuaaugcuccugaaaagacucgguuccugguucagagccugcuccuuaugcaaugcacgaaaggcauuuugagaauuagcccagccuguuugaaaauuggcgugggguaaaauuguccccaugauucugugguugucacagcugcucucaugcuggccuggacucugaagcuggacaggucuaagcaugccaugaguccugcacaucagggcuccguggacuuccucccugcucagucacugucuuuuccucuccucccuccugcccuagcuuuacccgaauucuguuucaggcugcccgugaagccuguguggccugaacccugcauucuccacccagcugcuguugcuguccuggggcuuccgguccagcuguguggagagccagcccaggaacguuugucaguugguccuuguguuacugacuuccuucucauauugcugacauaaauaugcugacaggcagcuuaagggaacacugcuugguuuuuggcucacaguccuucguggggaauucauggugauagggacuugaggcagcuggucagacugcaucugcagucaggaagcugagagacaacugugagugcuuagcuccuuucccaguuuauucacuccuguuagggugcacuucuggccucaguuaaccuagucagauaaucccucacaggccugcccagaggcuggucuacuaggcgauccuaacaaggugauugauaaucaguaucaccuucaucaccacagcccucuguuguacuguuguccccucggcugacucuucuccacucaguacccuaucagugcccuaucagugccccagacuaagucaguacccugcuggucugucaguggaugucuaaggcacaaugcuuuguggacauucccaguggucugggugcaguccccugugacacucaucccucaauguucuaucucugcccuugacuaccagcugaccucuuagcaaggugggacacuaaaguguccgaggugaaggcacccuucucuuugcucuccaucgucauuucaguuucuguugaguuugcaacaccccacacacauccuccuccccacccagcccccagcuuuccgagaggugguaauguaugcacgccguucuauuuguaaucccuucuucaaccccaggcacuacucugggcuucaacuuguagucaggaaggagaaugacuguuuuuccauuuaacacagacagacagacacacacacacagacacacaggacacaggucagaagagaacuagugaguguuucucuccuagcgugggaaguggggauggaacucaggucaucagguuugguggcaggugcuuuuaccugcugaaccuucuggcagccugaagacggacuuguuuuuuauucucucagauguuacaucccaaccccaguuacccccacccccagcuucuuucccccacuccugcaaccuccccucuccccuagauccagcccacauccuacuacccucagaaaagagcaugucucccagggacaucaaacaaacacagcauuauaagcuacaauaagacccagcacauaccaucacaucuagguuggacaaggcagucccguaggagaaggaucccacaaguaggcaaaagagccagggcaaccucugccugggcccacugucaggagucccacaagaacagcaagcuacccaaccauaacauaugugcagaagcccuaggucagacccccacaggcuuccugaucucugccauaaaauuuccccugagcccuggucagcugauucugugggccauguucucuggggugucccugaccccucugguuccucugauccuuccuuccucucuguccucugcagcacugcccaagcuccaccuaauauuuggcuguggcgcucuguaucugcucccaucaguugcuggauggagucucucucugaugaugauucugcugggcuucaguccuagcacacugcaggcaggaugaaccgcaggucaaaaguguugugacaggguuagugucccaauccuccacuugaggcuccuugucccccauuacuaggagucuuugcugugauuacucucauagauucuguggaguuuccauucuggguuuccaucuugcccaccaaauggcucucaaucccaguuguuuccccuaguauuuucuccuuccaucccuacuaccugaucccuccuguucccaacccuccccacccgcagugcaccucugaaaucuauuguuucccuuccuagaccuccuuguacugagccucucuguggacuuugacuugacagcugaguagccacucauaagugagcacaugcuguguuugucuuucugggucugggcugccucacucaggaugauguuuuuucuaguuccauccauuugccuacaaauuucaugaugucauuguuuuuaauagccaaguaauacuccauuguguaaauguucuuuauccauccuuugguugagggacaucuagguuguuuccaguuucuggcugcuauaaauaaagcugcugugaacauacuugcacaagacagaagaggagguggggaauagcuccccaacacauuggccuaggaaacaacuucguaaaaagaacaccaaugaugcaggcacuaagaucaacaauuaauaaaccucauaaaacugaaaagcuguaagacaaaggacacugucaguaaaacaaaaagacagccuacagaaaaagauuuccaccaaccccacaucugacagagggcugauauccaaaauacauaaagaacucaagaaauuaaacaucaacccacuaaauaauucaauuaaaaaugugguacggaccuaaacagaauuauuaacagaggaaucucucauggcugagaaugcuuaaaguauucaacguccuuagcuauuaggaaaaugcaacucaaaaguuucugagauuccaucuuauaccugucagaauggcuaagauaaaaaccacaggugacagcuucuggcaaggauguggagcaaagggggaucacuccaugcuggcggggugcaaacuugcaaacuugucacuuugggagccaauauggugguuucucagaaaauuggaaauggaucuagcucaagacccagcuauacggcuccugggcauauacucaaacgcugcuacauccuagcauaagauggacuuuuuuuuguauguuuguuuguuuguuuguuuugagacaggguuccuuuguguagcccuggcuguccuggaacucacucuguagaccaggauagcugcaaacucuagaaauccuccugccucugccucccaagugcugggauuaaaggcgugcaccaccacagcccagcaagguggacauuuuauugguaggcugggaagugugaacuguuuucccucccuucucauacaugaggcucuaacuggucuagaagagcagaaacaaacuaguaacuggcagcagcaugcaguggauagaaacacaaaaugcagagcucagagauugguguugucuuguccuguguguuguccagggccaaggaagaccuccguucuguguguggugggagaugagugugcgggcuccgugcucucagucccaguuggucauggcaugacuugguaaagcugcacacugaggucuguggugcacacucagccacugugcagcuugccaagcccagggggcuacugaugagcuuuuccuauuuccuuagcauuuucuagauagcuguuugcagacuacauuuggaagaugaacugcuguucucacauuugcauuguagcuaaaacgauaacaucaaacaguuccauacaugaagaaaaaggugacagcuuucacugauaauauccuccagauauuuucauaccaacauuucuguaaacugcuucugugcaguucaagacaguguaaagauuguuuuguuucacuuuguagcccugggucuccuggaacuuacucuagaauuuuacuugaaaaugaacuuacuaugguaacaggucaucacuucauaugguucaagcauuuugcauuccaggacagguaacauucaccuccuuccgccccauccuucauucccuucucuuaggcaaucagcucuaucaguuucucaacucugucaguuuuccagguacaaggagaauguacaaauaccauuccccaaacacuuuucauaaguggagcaguauacagcuuauaaaauguuuauuacagcucuauucaugacagccaacguauuagcaaccagccuuugugcuuacuggcugaagaacguuaacgacgauguaauguaugcacagugauguucuggugcacuagugagcccaggcugucaagguaacaacaguguaauguaugcacacagcgagguucugguacucugaugaaccccagcugucagggacagaggccaggggccuugggcugccccuccucugcuuguuuccucaucuucagauacugaguucaaauuaugacuuugguaguuuauuucggguaacaagccauuauacaguuuggagugguucuuacauuuuauugacagaguuggaaaggcgucuucucguucuuggucaaugguguuacguuuucgcugugaagaccacaaggcugaggccaggggugaccuggaagcuucugugauguugauugaaggugggcuauggccacuuggcacuuuggcccucugccucaaggaaagguugaguuuuucucaaggucaguggcucugaggcagccaugcugccuacuuugaggaacacuaguuugaauucuacaugggagguaugguguauagccuagaacauucugcccaccuucuauguuuucugcauauguacagcauggagcuacagcucccucauucagguuuuugguuaucucagcuuucuuggguuaagggucaucuucagaugacaaaggcagcucuuuccccugaacaccacacaccugcagggaucucccuaagauuccuagacucgcugccauucuugauucuaagagcagccgcugaagcccugauucccagcugcaggccucugucugcucgcugcgggaaggcacagaugcucucagagcuauaucucgcuucuaaguaagaguggggagaguucuuggguucucauuaguuccaggguucaugucugucccccuuugagaacacuuacauuccacuguccucuggacaacuccuugggcuacaccuggauuaauuauccauccuuuuuuuuuuuuuuuuaagauaagaauuguauagacucguauauguuauaagaaugaucaacaaauuaguaucuugauuuuuuuuucuuuagguuuuucgagacaggguuucucuguguagcccuggcuguccuagaacucacuuuguagaccaggcuggccucgaacucagaaaucugccugccuuugccuccugagugcugggauuaaaggcgugugccaccaugcccggcuauuuuuucuuuuucaagacuggguuuuucuuuauagcccuggcugcucuggaacuagcucuguagaucaggcuggccuugaauucacagagauccuccuacuuccuuagugcugggauuaaaggcaugugccaccaccaccuggcuuaauuuugaauuuucuuuacaguguuguuucuuaauuaaaucaaagaauaauugaguagacccugacucaccaaguacuuucugugcuuucaaaguuguuuacugcuuuccccucaugugcauggggauuaaaggaacaaaagggcaccauggauccgauaauuauaauguggcagucaguggucaaccuagagaccuuuugauguuucccauaagaguaaacaaaaauguuaugauuacaugaggacagaacuauucucaagggcaguggcuaguuuaauuaauuaaugaagucuauagacguauuuuguucaccucucuucuggaguaugcuaguaugagacuggcuuacagguucagaaauucaguccauuaucagcaaggcaggaacauaguggcauccagacaggcauggugcuggagcaggagcugagaguucuacaucuggaucugcaggcagcaaggaggagacugagccacacugggcagaguuuaagcacauuagaccucaaaguccacccccucagugacacacuucauccaacaaagccacaccuucuaguagugccauuucauauggaccaagcauucacacacugucugugggggucaagcccauucaaaucaccacacucaggcuucuacugagaauggagaagauacuuauucaaaacuguuacuugugugauaggacacucggguauguggaggucagagaacaccuuguguaaguugguucucucucgugcggucccaggauuagaacucaggucaucaggcuugacagcaagugucuugagcugcugcaccauccugcuggcccgguuugucuucauuuagauugcugugagaugggcaguggaaaacaaagacuuaguacauuuaauagacacagagucccccagagcacaagaaauggcagacugucuccccugaagcugggaguaaagucagugggcaggcaccagcaccagugccugcgugggcucuucuuccguagucuuacccuggcugucuauguguguugucagcagcuuuuugcugccacaguaccgucugcagaguuugcaaaccagaccucagaugggaucuacaagccaggacugaagguguaucugggggcuggagagauggcucagcgguuaagagcacugacugcucuuccaaagguccugaguucaaaucccagcaaccacauggugacuuacaaccauccauaaugagaucugacacccuccucuggugugucugaagacagcuacaguguacuuacauauaauaauaaauaaaucuucaggccagagagagcagggccggagcaagcggggccuacuggagcgagcagaaguccugaauucaaauucccagcaaccacauaauagcucacaaccaucagugcagcuacaguguacucauauaaauaaauaaauccaucuuuaaaaaaaugauguaccuggaagguggcaugcggaggcccagugcguccuuuguccacugauacaucacuguuguugggcaggguuagggguggggcauugcaacaacugcaucuuaaaucuaguggucgucuucgucagagaguaucugaaucucugaaucaaaaagauuguuccagaaaggugugcugcucugauuggaggcuguuucuuuucccucaggaaaugcucucuggugugguggucaucucuagcaaggacucaguccagcaccagggagucucuuugacaauggaagggacuguaaaccuccagcucagugccaaaaguguggguguguucgaagccuuuuacaacucugugaagguaagagcuagcauagcucucuguggagcuuugcgcuugcccugugacuuguuagcugucucuacuuucauggucuucacacucccagcucuuacagagcaugcguuuguguugcuucuguguccugcuaguagguauuuguauguguaauaucccuggcuggugcuugggauuagaagaaacuuguguugacuugagucauccgagcuucucugaggaaugcuuguggcucgugggccuugccuugcuuuaucagacuugucugcucgcuuuguacacugcuccuguugaacuugacagagguaagacacacuuggagcaaggagcucuuuuauuaugguuuuauuauuuuggguagaguuuauauuuuagaaaguuccccaaauuuagaaaaguuccccaaaucuuuucccugaaggccauacaagcugucugaggaaggcugugaggaagagaacaugaguuuguuuagguuuauuagugucccauguuucugcaucuuucuaauuuuaauccauaggcacuucguuggggugagguuaaaucaaagauauaaaagcaugagagcaucuggaugugguggugcaugcuguagucccaguucucuggaggcugaggcagagggcacgagaaucaggacuuggaggccagucuggacuaugcagggaggcuguaucucaaaauaaagugaaacagagaacauaaaacuuggacugccugagugcuaguccuauuucuuucucuauggagcccacugaggagucucugugggcaccuggagcuugaggagagacagaccugcucugcccacagagcugcggugcugaggcccuggcugagggcugugggagcuggggcagugauguuagagaugccagguaaggaguagccccgggcccgauguuggccaagguggccaggcagcuucagugguaggucugcuuacuuauggugaauauagggcuguuaggacagucuagugagguauuugagcaggaagcaggcauacauggguucaguuccuacuguguacagcgccucagucccugauaugugacaggaccauuauugaaccacugagaugggaccuauacaguucaaggagcagacugacucccacaaguuguccucugacuaguaaaaaaaaaaggauguaaggaaaugaaccauuacugugcagacuuaaagaacagcagcagcagcuugauguuuuuguuuagcaucaguacugugcuaccaagacacaggagagcgggagauuucaugugccugcugcuaguaggacugcagagagagacaggcacagugugugcugauagcugaagcugcuuuguguugacagccgauccagauuaucaacagcaccauagacgugcugaagccaggaaagauucccaguggcaagacugagguccccuuugaguucccacugcuugugaaaggcagcaagguccuguaugagacuuaccacggcguguuugucaacauucaggugagugccuaacuccacuuacuugccgcuuuuguuuucugcugaaaaccagcuugauuauuuuuucucacugaaauaacugaacucaagucuaauaauggauugauuccaagacugcuccugugugugcuguaucguuuucucauuuuguccuaacugcauuuuguguaugacuguuacugguuuugcagagcuagagauuaaaccgugggccucacacaagcugugacauaaagucacgcucugagccccugugacccuuguguugacuaugcacuguggcuauaauuucuuccuuagggguccuuugugcuaccgcauuuuucucaggccacagugacaccaccagggucccagaugugcuucagccucuuucuggcaucagcacuaacuagucuguuuuauucuuaugaguaucucuuuguggaauaaauacccaaaggcugcccauucaacauaggcuguauucuucauugagcaaaccuuguaaaugaggggaaguggauuuaugauuuccugucuaccuuugcuggugagggguggcuuucacaguugcuauugucucaggagcagagcccagucaugacucagccagaggaagaggccccgucccucauucaaugaagagaaagguacuguuguguaguuugcagcgggacagcuuccuugcuaacugagaaaauccugcagucuuaggaugcacagaaagucaggagauuggaaaguugcuugauuugugaauuaaguuuuaguugaucacauuucacuuaguaaauaccaaucauuugcuuaaaaucuagcacauuuuuuaaaaaguuucaaaccauuugggaggguuaauaaagguuuauucuuuuuucuuuucuuuuuuuuuuuuuuuuugguuuucgagacaggguuucucuguguagcccuggcuguccuggaacucacuuuguagaccaggcuguccuugaacucagaaaucugccugccucugccucccaagugcugggauuaaaggcgugcaucaccucacccggcuaaagguuuauucuuacauaaauuucacgaacuguuagaaaccugucaaggugaagaacauggagugcauacucuguggcacagccugcuuuccaugaagacauguuuucaggguuuucucacauaccugcuucaggcagcaacauacaaaagcuaaacacaugaaaaaaaaauauuacaaaaguuucguuagagagcgcucaacagugaagacuccgugcagcucuugaagagacccaaguuugguuccuggcauccacauggggcugcucacagcuaccuggaacucuagcucuggggggcaucuucagguuucuguggcccuguguguguguguguguguguguguguguguguguguaauggaauggaugcuucaugcuaggccugaguucugucucuacaacuugcauggaaggaagaacuuacucccuacguuuuccucugacuucuacaugugcacuaugguacacauuaugcuauccuacacacacacacacacacacacacacacacacacacacacacacacuacacauuaugcuauccuacacacacacacacacacacacacacacacacacacacacacacgcacgcacgcacacacacagcaagcuuauugggauaagauagauuuccuggucauagucucuuuuguuuauugucacugaaaugaugaaacugauucauuuuauugauuuccaguuaaguucaaagucucauccuuuuccagaugcugcuaagaguacagaugcagagugugugccgugauugcguagacuguguaugugcuggaacuccuagucacgaaaguauuagugcguggcuaauucucuagagggguuaaugauccccucgcccaaccuuuuccuuggucaucagauuuuaccacuucaggguugaccucagccacagcaugggucuguaugcaggcccagacagcucagcauuuuguaaagaugcaguuuccucuucgcugagccucagguuuaugugggcucaucaccauucaccauugguuagucucuucccuugcagagcugggguggaaacccagcuggacacaugugagacaugggcucugucacugagcuacauccccagccuugccguucuuugucgucuguguuuacuuucugagucauuucaaaguuagcugcagagccugugugcacuuacuugucuuacuucuuuaguguccauucccacaaacccagaguucuaucauacagcaccauagauaaccgucuuuaucaaaauuaacauaaauccucaaauaauuucuagcucauaugcaaauguuuuauuuucucuugugcaaauauacguaauaaaaacuaggauuauggcuuuuugcucuauuuuauccauccuugcccccuuuguuugacaggucuuuuccuagucuccaugcuugucaguaagcaaaugucauccaugauuuucugugaucccaugucucaucucagcauagggauucccaaggugucguuuaugguacccauuucuggccaugccuucucugaagagcacaugaaugaauaucggugcauuacucagaauagaagcuuuguuguuaaacccuaauacauucucaaauuauauagacacaaugaacuuuuucuuuuauaauugagguaauauuguaauagcauaguguaaaaaaucaugagacaaaauaaggaauuuaaaauguaaccugcauuaaauuucugacuugcaaaagcuuagcuugcuuguuauuucuuacugaguucugcucuuguagccaaacuggcaagauuuuauacuauagcacagaugaauaucaguaucaccauaucugcuaauauugcauauucaaaguuaauuuuuaaaaauucucuucacccuuucuaccguuaaaaauacuguguguguguguguguguguguguguguguguguguguguguuuugcagagaugauucagugguuaaaagcacuuacugcucuugcagaggccagaguucagcugcuaguacucauagugagcaacucacaacuaccuauaacucuugcuccauuccucuggccucugugaguuuccuucauauacacauauccacacagacacacacacuaccaacacauaauuuuaaaccuuaaacaaaaaauccaaccuuguaccuucuggccuccugaugcccucugaccucguccugagcucaccccacauagaucauugcauggggccuaggaaaguuaguuacaaaguaagaagacccaggguuuccccgcaggcagagaugggcucuaguuacuguccaaccagcauacaguauaagaacuugguguagguuuugucaguuuacaucccaccucugugccccacccccagcagccugccugacuuuguugcuagaagauuaguaagagaaucacaugaagagcuaggcacaggccugucacacaguguccucugugaugaacaugaguugaugacuauccuuacaguagccuuguacagccuuggcuguccuggaacucacuacguaggccaggcuggccuugaacucacagagcuccacuugcaucugccucccaagugcuggaguuacaggcaagugccaguaacaacucuuuuaaaaauguuuuuguuugccugcauaugugucugcaccaugugcauggagugcccaugggggccagaagagggugucauauucccuggaacuggaguuaaauagagaugguuuuaacccaccaugugguacugggaaucaagcccagguuccuuuccaagaacagcaagugcuuuugaccacuaagcuaucucuccagcuugauuguaaguuaguugacauuguagaugagagagaauuugacucccucuagaacauaacaggaauuuuagucuccuuguuucaccugcuguuuucccagcagaucccaugaucuauucauuuacagauuauuagucucaagcuuuguauaguccuuucuuucauaaacuguagaguaaacucagauugacaagguccuguaucccagaaccaggaauucuaggccaggcuuagccagauuggagaccagggccccagaauauuugagcuuggcuuuccuguacacuggcuuuguccucaggaaguuaucucccuuauuagagcaaagcuggcugucacugggcaagugcagcuuccaucuugcagacccaagacucaguaaaagagaauucugucuucagucccuuaaaugucacugagagagguagaugguagaggccagacuagggaaaggaucagacuagguaagcuagagagaggaugacuuaccucacugcauaugauguccaggaggugggcaguaccccaacacagauacacacacacacacacacacacacacacacgaccucacugagcuugucugguauggagaaaacagauugcagucucacuagagaauauauauauauauauauauauauauauauaaauuuuaagguucuuucaggcaagaggugauucuuauaaaaauguuuuaucuuccuguacuaucucagauauauaggaacuuauuucauguggaaagguggcucuuaagaguauagcuucuuacaagauucauagcuaugauguaguccuagguaagaaaauuauuucugacacaauuaagucuuuccuauaugauugaagaaacagguaaguugcuuaaaaaggaauuauaugagggccugggguauuauuuaugaugcugagaauggaaccuaggaugaugcacauauuaacaagugccacuuagccauaccccagcugcccaauauuuuuuucugaagucuagcacuaggguugguuucuaagcauccucagcuuauggccagggauuugaggccacaguuccugugccacacccaagggagcuuagcagcuacacuacagugccuuucucagaaggacagggucccucacagcaggaguuccacagugacaagcucaaaaaagccacacauaguccuaaagguaaacaagccaaguguaaagccaguguuuccugugucccacucucuucugcccuuuagcuuuuguucuaaccucuccaugcccuggcuguggaaacaguuguguguguuuuguuuagaaaugcccuuacuuugcacauuaauuuuucuuguguauaucaacuacauggaacacacccauuggccaaagggaccuuaaaauauguugacugcuuguagcuuuagauguugugucuagguaagaacaaaaccuacugagaugacauuugucuccugcuucuccucuaguacacacugcgcugugacaugcggcggucccuguuggccaaggaccugaccaagaccugugaauucaucguucacucugccguaagccucuccucgagacccugggcucucuuguggggugugggauagcaccuguucccaagcccguacguggggucuggcaggaaacacgaggcaccugcugaacccagcaacgugagcacgagcaugggcacugucccuacagcucagugaugcuaccuuaagaggcugagccucacuguagggacccccacuucacaacaacauuaagcaaacuguuguuccaucucugcgaaggagacauccaucuuggcccucaaaguugcugcggcaaacacaccauagagaaauugcucucuuccuuggcacucagugcuccaugugaacacauuagaugcucaggccugugucugucuaaucugcacacuuugugccuuuucagacuaccacugcugcagccccuuguggagggucauagcaaguccuucaaggccuacaugaucacacagaaucaacuaugugauacaucucaguacacucucagaccucacuaggugcagucucacggagggaggcagcugcuccuugccccuugccuucuguuagcaccacucucagcccagcaguggccaguccaucucucuacccaucagacugcugugccuaaggaguucuaggacugaguuagagcacuugugagggaccauggaagaacccucggcuggagagcugccugcgauagcaccagagccaccucaggaacucacucugaggccuucaggaagcugaaaaggcugcuccauaaccucucagggaucuccgaggagcagggcagggguagaguacccgugucagcucaugagcaguucugaccagcuacucaguauguugucaccaucagugcugggcagaggcuaccagaccccagcacugcacucagcaccaaguccuuccagcugcuguucauuucaguugggagggaaaagccguuccacccaugguccuaccuccauugauaggcucacugugguuuuaccuccauuucagccucagaaggggaaguugaccccaaguccuguugacuucacgaucacuccggaaaccuugcagaacgucaaagagguauuugucucucaaucacacuuguguguugcagcuuuccugaugacuugacccagugaccaacuauuguccaguuguucuucaguugagaauugucagggauagagguuucugaugguguuuguauccaagggcuauuugcaaauugauuucaugaugagcucauuaauuacuuagaaaacaaaagauagugaguacuuuuuucaaaagucccucguacgcuuaugaucuguuugcaugcacugaugaugucuugccauauugcucagccaucaacuccgacugcaguucugcaccucuguaccuggcuaaugugcucaacugcaugugugcccugagcuuuacuaccgcugacccagugccugccccuucacuucccuuagugucaugguuggcacagggccuggccucucacucuuuacuuaguuugcagccucucccuggccucucauucagacgcagaacaacaguggacauggugguggacagaaccauggcaguggacaguaaggguauaagugucgcgaagcaccagcagauuccucugcauaagaaccaaggaugcuuggcucuuacuggcucccaugggccucuguaucaggcaguuuguuauuuuggccuagcccaccacuguagccagccuucacucugcuccacuaccagacaccuucuccaguuuugggguuuuuuuguaauugauuuugugucagagcaaguaguguuguuugucuacagcucuuuucuggauaaaaccuggauucuguauucaauucugcauuuuguucaugcucauaauuggguugaaagcaagucuggaagauuuggggcacugcagacauagcugaugucauucauuaucauaaggagccuuuucagaagguucuggaaagaaguagccaucauguccuagggccgggcagauuccccuguaaagugcuuucuccagaccugugucccuccagguccucuuuugcugcagacacaggucccuuacucaugccucacaugucccuccuuauauggauguggcccaugugugguacagaguucucuuucccuugcuucugucuucuucaaauauugguucuugguguauauuugaggaucuuugguguagauuuauuaauaaaacuauccuccaccagccuuugagacggucucauguauuccagaugggccuucagguauuuaguugaaggugacuuugaacuucugaucuuccugccuccacuucuugagugguaagaugguauugugugcuaccaugccugauugaucacgcuagaaaucaaagccagagagagcuccucucugugccaggcaggcacucuucucccuguuauucuugcuugauaacgucuuagauauacuguagacagguuuuaaugugguuaccagaaauuuuuaaauuauacucauaggcaauuacaaauucuaaaugauuuuaaaauuuguggcuuauauuguuucuucuggauagugcaaccuaguagaaaugaagacuccugaagugacuguccaacuauuuuccuccagugcuagggccaguuccccugagccaacuuccugucugcagagaaauagucccaaagcuuuucuucgggcguugagaaaacugcucuuucgguauccuugaaauaaaaauaauuggcaucucaaacuugcuuaauugggaacacuuuaaaacggccuuuuucuuuuucuucuuuugugaccugggguugaggggguggcuguccuuaagcacccuucuaacccugaggcuuuuuacauuucaugucuuucggccugagagagcuuugucagccaguguagguugggagcugauucggagugagcugugauguccguuugucccuaauauguguacagggugguugaugagucagucugguggccacugaaagaugaaauggcuauuauuccuucuuguuuuagaaagaaguuuccaugguuuauagaacaauuacucaacuugguuuucaguucuuauuuguaccagugcaacuggaauaagugacagcccccuuuccuucuguuucugaugucuuugucucuguucuccauagagagcuucacuucccaaauucuucauuagaggacaucugaacuccacuaacugcgcuaucacgcagccccugacaggagagcuggugguggaacacucggaugcugcuauccggagcauagagcuucaguugguccggguggagaccugugguaagacuucuagaguaucuagguaucuacacuuguacugucagccgcuaaaacaccccuuccuguacucuuaacauggcagggcacaucacaucauaacagagcuauucugauggccccuguggccuacucaccccaaaauucccacuugcagauaaucacugaaauacuaauuagguccccagcaccuuaaaucuuggaagcaugguaaaaccaguguggugauguuugagaacaugcaaaguagaagagaagguaacucccaguccugaagaagaaauuggagaagugggugaauguguugauccugguuggcacaguauugggcaguuuggugaccaguuugcuuuggugucaugguguccugaccccaugauguuuccucuuucuccagggugugcagaaggcuaugcacgagaugccacagagauucagaauauucaaaucgcugauggggacauuuguagaaaccuuucuguuccccuguacauggucuuccccagacuguucaccuguccaacacuggagaccaccaacuucaaaguggguaagcaguccaggccuggccuguggagucuaggaagggucugggccacagggaagaagcgccuugcacgcaggcugcagcuuuuuuuuuuuuuuuuugguuuuucgagacaggguuucucuguguagcccuggcuguucuggaauucacuuuguaguccaggcuggccucgaacucagaaauccgccugccucugccuccugagugcugggauuaaaggcgugcgccaccacgccuggcuuagcauucagcuucuugaugacucaaaaaaggguaagaagcugcguaaguagguguguguaggcaguagagccugcugcaaggccccauccagagucaacugugagccaagcagaaauaccgugagucuauaggaaaagccuugacaguugucagguaaguaguaugugaguaaauauccaacaggaaacaacuuaaaggaaggcaggcuuauugugggucacacuucaggaccuauguccauugugguggaaaagccauaacuguaggaggcugcucgcucacaucuggguagaccagguuucagagaaaugcuguuaucagguuugcugucuugauuuuucuuuuuauuccccauggauggugccacccacauucuaggcaggccuucucuccucuguuaaacaucucuagaaauucauuccccugaagauauaccuacagguaugucucuuacaagauuccaaauuuaguuaaggugagaauaagguuaaccacaaguccacucugacaguuugacaccaaaacacaucaugguuuuacaacaauagcauccauuucaacuuaaaaagucccaugaucuuaacaaguuuaacacugguguaaagacuagaguuucucagagacccaacugugagccuuuauaaagacauauagcauacuuucagcauaggcauagaguaaacauucccauucagaaagggagaaacaacagggccaaagccugaaaaaccgaaccaacacaauacuaaaccuagcaggucagagcccucauuuuuucgucaccauguccagcaucugggcuccaguagcuuugggaagucccagccauccaguucuagugcaugcaguaaacauaaucacugucuuugaucagcuuucuugccugcugcuuuucuuggcagaaguuucgcuccuugcaucgccagcauucuggagcuuucccauuccaacuccagguauaacugcagcuucacacaguaccugccucucugcagggaaccugacccugccaugcacugccuggccucagaggcuuucugaaacacuuguacaaauuucagagucacuauaacccuagcugcaacuacuauauguacauaacacuauaacucuagcucugcuacacacugguagccucuaugugccauggugaccgaaccuggagaaauacuucucuaucuguaugggucuguguguacccuaaacucagagcugaguuucuguaguguggugacaggcaccucuuugcccauacuggcaaaaauaaggacagugcucauuuuucuuugggguguuuuccucuucaccuauauccccuguguuuugaucuuuacccauagaaucuaaaagaagaagaagaaaaaaaaacaaaauaaagaaagaaaaaaaaaaggaaauucugucuacaggaauguaaaaaccaaguguuucaauaaaugucuccuuagcuaauuuccaugaacuaacuguuuacuguuuucccuuguuaaauaacaaacccaccaaggucuuguuuuauagccuagaccagauuggaacugaccauuguaguucaggcuggcuguaggcucaauaccuuccuccugccucagcuucucaggugcuggaauuauaggugugggcuacucagccuggcuuaaacuauaugcuauggcuaaagaaugugucucacuuggaauugccggcuguagcacaguucagagccugguacucuauaaagaauuuuaggaaaggcaaaaauacaguaaaggcuauaacuauuugaaaauucauuagaauucucugucugucuaucugucugucugucucacuuuaugagacaggguuucuuuguguagcccuggcuguccuggaagucucuauagagcaggcuagccuuugacucagagauccgccuguuucugccucccgagagcugggauuaaaugugugugccaccaucaccugguucuaggauucucauuagaaaguggaaaguacuguugaguagucccggggugcuccuuuugacuuagugcucuagugauaagacagagaaguuaguagugcagucacugguauggagaccucacuggcucuacagagagugcagggcgacacugccugggucagaagcacagaaucccaagcagcaccuggacacuggcuuacuguuaggacucugguuuccagugcucggugugagugagcaucucucucuucccuacagaguuugaggucaauguggugguccuccuucaugcugaccaccucaucacugagaacuuuccgcugaagcucugucggacauaguccagcugcaggaaggggagagccagaauggccauguggacauugacccagucaucugcucacauggggacgucacacagaccaccugcucacaggcaucacaucagcagcauacaucuucaugucuucucauggccucaaagcuuguucccugcaggugccuuaccucagcccucacgucuggaaugcaacaggauuucuccuguguguugcaagaucacagaaagcguucccaauggcuccagaugugccuguuucuucuuagguucauuaagcagugugucugcacauuaagaugggcugccuagugagaucauggaggcagaagagagcccccaccccucuaucuugcccagacuccugacagcaaagagucagcaaccagcaagcucucugauugagucuguaauccccuccaaggagugacagugacuucaucugggaauacggaguuuucccuucuugacaucuugauaguguuucacuaaagccucuaaauguuuuagggcacuggaaauaaaaaccaacaaauaguccugguucucacagagggagaauggugaacaguggcuguugcuggaguguuugugugugugguacuggcacacaguuaaugcugccauauucccagaauguauugagagacaaggugcuugcauaaggggaagaaugcacauggacuacugguaaguacuagguucugagugacaggacaccgugcugaggaagggcaauggccuuggccugucccugacccccugggucacauggcuuuagccucacacuguaacucauacuguauggaggguauguugcaauacuuugcuuccuuugaaucucgcuguuguucuguugguccagaguuaaugagcgcccuguacaccagcuggccugccuucacagguucuggggggcaggccgaggcaaagcaggcccgacuggcagccuccuggcugcacucccacuguucugaacagcugagggaacuggggcacugcugcuggggccucaccagggaaacugagaagacuuagcugagucaccugacagugaguucccagagaauguacuuuugcuuugucauacuuauccuuguuauauuuaaacaaucuaguacccaaaaaaugugggccguacuuucuagugagucuaaggaaaagucaucuuugauuacauaauuuuuuuaaugaauaaagaaagcuaaacaaguuuuuuaaugguuuggacugcauauuguuauauaacaucuuuaguaaacuuucagaauugugaugaaugug

SEQ ID NO: 8346 - RNA, 125739 nt, Mus musculus
uggcggcggcaaccgcggcggggggauccggggagacugcugccgucgcugcugccgaucgcggcccaggucgggcugagaaagcggacuccccgagcgggggugcgggcgccaccgccgccgccgcuugugcugcuguuccugcugcugcuguuggugccgcugccgcugccgccgccgccgccgccggcgagcgggcgggaccggugugagugugagggagcgugugcgagggcgagugugcgcgcggugagugugcgcgagugucugugcgggaucgggggcgggcgguccgggcucuccuggcggagccgccgccgccgccgccgccgcucgggccccggcgcugcucgcugcgcagcuucggagcgcgcgccauuuugugagauuuacaaaaauccucgucgggaagaagcggccggcagcggccgccacucggcgcccggccucgccgccgccgccgcccuccgcaccgggccgggccgggccccgccgccgacacucgggggcccggggacugcgguauuugccggggaggggcugucgccugccuccccggccgcgggcgccgccggccccgccagcccgacggacccugagccagcgcggcugcggcgcggagccgggacgccgggggcggagagaggcggccggggcggcgcuggcugcggaggccgcggcgggagcgcggcgcgggagcucgaggcugagacucaccggagggagcggcgcgagcgccccgccaucgucccggugaguguccgccccgcccggcgcggcgcggcccagcgcgcggcuucucggggccugcgagccgggcucgccaggccucaagcggagggagggagggaccugccaucuuaggagcgagcgggcgggcgggcgggcggcccggggcccggggaagaaggccucguccccgaggaaaguugcggcgggugggacccgcugccucgggccgggccggcgccagaccuccacuggcugcccgggcgcaggggaggaggcuguucuccuccuccuccuccucuuccuccucauccucugcccccagcuccucccucgucccuccucucgguccccaccggcgugcggagcgccgggguucugggcaaggacaaugcacgggaucagaaaauggggcuggcggccgggaggcgaggacgcaaggcccggccgggccgggccggcgaaggucggcagccugcugccugcgaggcccagugggcccgcgcucgggccuggggaccuggugugcucggaagucgggccgcgagcgcgggccacccagggcaccggaggggccggggugaccugcauagcagcgggaggagacuggaauuagaauggagaccuguguaucgccucaaaacuucaacaucuauuuauaggcucagacccacucaggcuccagaggccccagagcugcugaauaucagcacuaagcuagaggccccucccuaccccgaaauaguuaaaaauggcaaaauucgugagucagugacuccaaugacuugucuugucuuugcccagcccuagauuaugugacuccugucgucgaggugcagcaucguuugcuucuugaguucugccaaaucccaagaaaauauuccuuguaacuguuugcacacucauagauuagugcaaggccuuuuauauauuaccucgaauaaccucccaguuggaaaugcugcccauuuuacagaugagcagacugagccuagaggugggcagugacuaguccaaggucauacagccaguacuccaggaggccuaugucaguuguuagccuggcuuucuguucauuggcuccuaacuuauuauuaaguacuguaugaugacucagggcuguaaccuagacuguuuggguacagguuuugguagaguuaauuuaggguuugcagaaguacaguuuagaugagccccuguaaugaaacuugucaugcccccccccccccagguaaacuagucuguuuuucaguggaagaauugaaaccacuggugcauuuuguucuuugcguuuaacuguuacaguguagaguucuuuuugcguauugauaagucauaaaguuuggugugaaguuauuuuuuauuuaaauacuuacauuucucuuuugacacuguacuuugcacguuaagaauaacuauuagguauuuugauuugagauguuaauguaguggaauuaucuuacuuuuuguuuguuaaauuuuuuuuaauugucuuaaagaauuacauuuuuaaauagacuguaagugggagacaggagcucaaauuucacuugucaagguuucagaggaauagugguuaagaagauuuauuugcauauguggauuuucagggugcuugucuuacagcacccugcccuucggagcuucugcccuagcacggcgguggugucugugguacuguccaaaaaguuaaaacucuugucagcgucuauaccagguacucuguaaaaauggcaacagaaaguuuguauuuaccucagagaggcauaagcucagaaauuguucuagaagggcugcuccugugucuguaaggcaaggacacacauuuuguauuccugguggaugaugaagauuuuguugucuuuugaaggagcagaguugaagggaugguuguuaucuguaaggauaggaaacugacugacugagccaguggagcuucuugaagacacuuuggugugugaccuguuaaaauuguaaccucuaugcucugugcuaugccacugcuaugugcuaggaguugaaaaauaaaauaccauucacgagaacauggauagucaaaaagacccuuggcuagagaagucucacuugagaguucuacucugucacugaguuuucuucguggcuggacuccugugcuugugacucacagaugggagugacugacagugugacaagucugugcugugcagugcagugacugaggguaaagcuaagauggcuuguuucagacauggcaugaauucugucauggguguuauuauguaacugucaaggaaagaaauacuguauguguuuacuuuggguauuacuuuaaaccauuuuuaauagaaauuuaaauagcacagagauguuacagaguuuaugguuggcaaaugucuguuccagaaagaaauuuuguauagaaucuuggaugaccaagaaucauuuuguacugcaggacauagcuacauaguauacauaguuggacuccuagagggagggcgggagggagggagggcuucauuucugaaucucuugcuacuuggggaugcucuuguucgcaccugccagccagugucccucuucccaguaacuucucuucuaccucucaagaaggagcuuagcccucagacccagcaaacaccacaaguuuccagaaagucugucaagaacauggcucagcacuugcagcuguuaguuuuaagaauucugugguauuucuagacaguaacuuggcccuaacacucuauuuuguguugaguguuuugguggguuuccuccauuuguacuugucuacuuucgacuugggaacagaucucuugcuuggacauaacagacagggucaccuguaacuucacaguuugccugucacagcuguaggaccagaguaguaguguauggagugguaugucuucugaaggcagggacccugugcuguccuacccauugucauguuugauggcaagacagucugugggaacucauaacccagugcucgcauagggugggauuacaaaauauggggauuaaaaauugguguuuaauuacuuggaaaaacuuauuaaauuauuuuaaguuaccuaaaguugucccuaaaugaaggaaucuuuugaaauuaugcuucaccucaacuucauaauguuaagcuguugaguguaaagucuucuguuggguacgugagaguugaaugcagguuucauguaacuaaaauaaagguucacauuagcuagugcaggcaaguguuauuuuuaaaauuuuaguucauauugacauauaaaaacaaaauuugacuuggaaguacauuguauuaaacagcuaugcuuuuuaaaguuauauuuuggcuuugaaauucucauuugagcauucuguagugaguuacaguucuugguugagagacaaaccuaacguuggacaucuaaccugcugugggucuaccaaggcagauuugugcugacaaggagccaugcuggauucuuggcaguuaguucugaagagaugccauuuuucucaaggaugauuuuuuauguauguuauuauuguuaauaaacuaaaauuugacaagaaauacuuuuugacuagggauaugugugugugugugugugauaugcaggagucauguaaaagucaugucuugaugagucauuucaucauacaaaauggaaaucucauaauugagacacuuugcuuggugggaaccugcugugaugguuugaagugguaugaaaccagcguagagaaggaaggcaucaacucuucuuuaaacaacauugucauagucacacaaccccuagcuuuuuuucuuccuuuuuuuuuuuuuaaaguugaaaaaaacaaaacaauuucagugaucaguugauuuuuuuacuuagagauauuuagugggauuuauggcuaaggcugugucuugggugugucuggauggguugcugacacugccuuccauuucuccaagagcuuugagacaccggguucagaguccuugaggcuccucaaguacuucuagggcgugaucucaggacucaggcucagcauggguguccuccccugugacagcagguuggcagcugucauguugcugugcagaugauacuucucugcucuucccugucaccuuuucagacacacucacucuucuuccucugcaucauuaccucaggggugccuuuccuguccccacccccuggccccucucccccuuagcugugcacaaaguuaaaucuaggacuuuacacacaugaggcaagcauucucccucagcuuccccacuagagccaagcagggcuuucuccuuccacaaccuuuauugcugaugguuguagggugagucacaacugauuuauauacacuuaguccuuuaauaucugucugucuccucuccauuggacaacagggucuuccccacacaugugcuaguggucagaucuagucaugugaccauacuuagcugcacaggaggcugggauuuguggccuuuggaaggguggcuguuuauuuggcugagaauuugcuucuauagauagguggaaugaaggaaaauuaaacauuacuuguucacuucuaaauauuuuggaagaaaucucuggaaauaaggcaguuuauugaacagucacuguucaguauuggccauuaagcuuugugcuauagugaaaacucagauugcccagauauauuguuggaucuguuuuucuguuuucuuucuuucuaucuaucuaucuaucuaucuaucuaucuaucuguagucuggugagaagaaugaauuuguacaauuuuuuuuuuuuguaguggggccuaauauuuuacugacacuguuuucugagagaaauaaacuuuuuuuuuuuuuuuuuuuugguuuuucgagacaggguuucucuguguagcccuggcuguccuggaacucacuuuguagagcaggcuggccucgaacucagaaaucugccugccucugccucccaagugcugggcuuaaaggcuugugccaccaccgcccagccccagaacaauuuuauauaguuauaguuauauagugauuauaucauguaaauaguaaaauguaaacuuuuggauuuccucuuaauagucugcucugucccaauaguauguguggcccagcaggguagugcuagaccaacauugaguacuggacuaacacugacagcuagagcaacacuugggucuuggggcuuucagugucugagagucacuagugcugaaagaugcuagcagugacuuaggagacagucauuagcugacgccuccucccuggaguccuggcugugagggaaggggagccccagccuuucuuuuagcaggugguagauguagugggaccugggcaggcugaccugcucuccucuggagaacuuggcaggguuuuggaauucccaggcucaggcauuuuuguguaguuuucgaugaccccuggaaggagcuuuguuuauaaggacucuggucauccuguugcagcacagacaucugagaagagcucugagggacuugauucaucucaccuuacagaggaggagugcagagagaccgggugccugaacugcacuagaacgggcugcgcuagcuggggcucuuccgacuccuuguuuguucuuuguggauggacuagaggacaaggguuuauggggcauccacauuuacaggugucugucagucucagagacagcacucuucaugcaaggagcucauuccuagggaaugcuuggugugacuaauuuccuuuuagccucacagaaaaauaguccacauuagaggaauauuuagagguaagaauugagguuuuuguaagguauguuuaguagcaggacucuagugguggugcuggaguggauggguuggugagugagaccuugccgugauuagaugaacacaaggcuugugucccugaauuguuacuuugcuucuuuucugguugcuuacaguuuucacuuguuggaacucacuccauuagcuucucuaaguuaaaauggaaauaggcucagaggacuauccucccuauuaucagguuaacgcuauuucugucauucagcuggcugucauaggaaucagaggucagcacccgcacuaauaggagacuguugaaaugggaggaagaguaugucccauguacuuuuuccugagcaaacauggugucugacagcuucacuuggugggauugucauggguaggguucggagagacuucucugggguuaaaguuggugucuuauaguuucuggggugugguaacgcuuuugggggucaucccauguaggaccuucugggguucuguacuagacagagaaaguaucccugucuccuuagugugugccuuucuagcauggaggguuucuauuuuagcagcauagcaaguaucuaaugcaguucugaucacagaggcaauuguagucuuuaaagaucgacaagggauguacacucugauuuaaaagcuauggaaugcuguccccauucucaugggcccauaggugguaauuacucacaggcuuucuaccugugcacaguuacaucugcauuaaguuuacuaugugcugugcuguagaagugugcuagauacgacccuuccacuggggagucagacgcaggguauugugcacacuucgcaacaucccuagucuuguuuuuaggguuuauaguuguacaucuguguguguauguagugucuaugcauuuaagaaucaaagauauacuaaacauaacagcuuuuugacuuaaacuuuauacuuaucaacugacagucuguccccccaccuguguguaugucugugugucugugucuuugugucucucucuguguguauguguguauugugcgugugcuugagugugacugaacccugaaccaaggauaucaccuguaggccacugagguacguuguccaguccuuucucuugcuaguguuugggagggacuuacuaguguuucuuuagccuugaguucacucuguguuccaggaaggcuuugaacucagaucuuccugcuucagccuuuggaguagcugggguuauaggccuguaucaccuggccuggcuuuuuuuuuuuuaaagauuuauuuauuuuauauuauacuuucuucagacaccccagaagagaguaucagagcccauuacagaugguuguaagccacuaugugguugcugggauuugaacuuaggaccucuggaagagcagucagugcucuuaaccacugagccaucucuccagccugaggccuggcuuuuuuaaauuuauuuuggugauagccucucugguccucucuggucuggaauucauuaugcagcucacacuggcuucaaacucacagcaguccuccugcauucucucaggagcugguguuauaggacugagcugacuuccauguauguguuguuguuuuuuucuuuucuaaguugugugucgugucgaugaaaagguucugcugugugugucuggcuggccuggaauuugcucuauagaccagucuggccucgaacucacagcgaucugccuaucucugccuugggguguuaggauuaacaugugugccaccuucuuuaaaauguuagaguauuuguguguuuguaugaguguaugccacauuuguggaagggcccuugggugccagaagaguguguuggauucuguagagugugggcaguuaugaacagcccagauggaugcugggaaccagacuggguuucucuggaggagcaugaugggcucucauguagcccaggcuaccuugaaauccuucugccucagccccuggaguguuguuauagguauguguccccaugcccacuuuaugccaugcuaggguuaaaucuggggauucauggguuguaggcaaguacacuaccacaggagcugcauuccuggcccuggucagguuugguucuguugguuuuguugauuuuugcuuucauuuugcuugggaacgauuuccuuuuauacauacccuuugguuucuuuaguucucaugaagggauauuaaaauuguugucacuuuugacuguuuuaaacagugcuguucuuauguacacuuagugguauguaaacuugugcucugagcaucugcuguaggauaccuauuuauaaggaagacuguguaccagcuaugagcacacuggaacguauauuguugccaaggugucuucuaaaaugucauaccaguuuauguguuuacaaucagugucugaagagcgcauuuuccucuuuuaaauuuuauuuauuuauuuauuuauuuauuuauuuauuauuuugaggcaggauuucucuguguaacagcccuuggcccuggcuguccuggaacucauucuuuagacuaggcuggcuucaaacucagagaccugcuccccucugccucucugccucucugccucucugccgccucucugccucugccucugccucugccucucagugcugggauuaaaggcgugcgccaccacgcccggcuacagggucuucuuaguugagaaaauaucggcauguccucugugugaggugugagugcagugguggucucuguugauuguaagggggagggggaccugacugcuuuccagagauagguucaagaaaagcugggcgcaggcaccacuuagagguguagucaaggaaaagugagcacaggcaagccuguguucugagagauguggccguguggagaguguggagagcuggugggcgcagaacacaggacggcuagauggcugggcaacucgagugagugaggcucuguaugguaggccagguucccuuggucagguguguuuauggcuuuggagaggagaggcagggcagcuggacacagcgaugaaggggaggaagcaagagcgggacugaggagugagagucaggacgggcugacaggcaggugcagcacagagcauggugugcguguguggggcuacaaacgaaggacaagguagaugauggagggcacaggaacuucuuaccuuacauuucuaguagguagcaaaugcauuucuguguucacagagcaauguggcugagguucuggagguggagagccgggugggguggggaggagggugcuguggggaggguugcauagcucccagugguuuuagugugacgcugagccuccuuccuucuuucugguagaauuaguagaguacuuugugucuuccaugaugcuggguggggacaguuugcagcacugaugaggaugagagagaagguggggcaguggggaaaaggagauuuucaaacugacccccuuuuuuuucuaagacaggguuucucuguguagcuuuggcuguccuggaacucagucagacuggccuagaacucacagagauccuccugccucugcuuccugagugcuggggcuaaagaugugcacuaccacuacccauugaaacugacucuggaaagggaaaaguuguuuccuauuuuauaguuggagaugcagagcaguggaguaugugagcauagucacaccauguucuuaguuuggcuguagaguguauggaugcaguuauacuagguucuuaguguggcagacuguaugagagcagucacaccaaguucuuaguguucucauggaaaucucauguuguauugcuuuguacauguaucuuaauuagaagacugauccugugugcugauagaacuauugauugauuaggcaggaucucacuacacacacacacacacacacacacacacgcacacacacacacgaacacagacauguacaugcauacacacauaucuggcuuggagcucacuauguagaccaggcugaccuugcgcucacucagaguugccucccucugccucuugaguacuaggguuaaaagugugcaccaccauucugguuaaaacuauuuauugaguaccaaagagugccaaacauguaacuggagccuggaaaucaacucuaaaacaagagcuacuguugccuuugccauuauggaauguucuggugggaaaguuauuuuauaguuagaguaggauuaaggauauagucuacaauagccauaaauuaaaucuccauuuaaagggacauaggaugauuguaaaaauauuuuugagggucaaaaaugucuuagaguccuuuugaugguuaauuuugagcuaaacuauauuuagauagaaauagagcucuagucccugagacaaauacugucugcuaagaagguuguugugauuugauaauuuuuuucuuaaaaacugucauuacaguggugauuuuuuugcuuuaucuuuauaucacacacauuccuuuuugauggaucauuccuuuugugauagaaaagauucugaaaguucuucaaaacagcguggauaagaaaaugaguaggaucucauugaguacacucuaacuuuguacauucucugauaguaauccuacagcagaguuaaaaacagugcugagucugcugaguuccugcggggccuggcucgguugcucagcagcagcacaguuagguacagagaggagaaaggaaggaagggaagguuaggaucguggcagauaguuuggagaaggccucguccucugcagggaggcccucuauggagacggcugggaaagggauuccauguggggaggaucccagcaguguggagccagagagcuagcgagggagggacuuguugucaugagaagcagcacuugucuguuauucaaaaacaaaagaaaauuucuggccagauguugugguaucagcuuguggaagccccuggaaacuuugcucaggauccacccaccuucucuuuagagacagucccuuuccucacagaguucacugaugaggugaguguggcuggcccggaaucucuagagcugucucugccugccucugccccugccccugccccugccccugccccugccccugcagcacuggcuuugugggggugugccaccacaccuacuuuguuuuuuuuuuucccaugggugcuaaggucaaacuuggagccuagugcuugcgcaccuauacuuuuagcaaucacauaggugcugggcaucaagcaggaguuacucagugaggcuuuugucucagaacaaacaaaaucaaagaccaaaaagaaaaucuaaacucugcccagagcaaaaccaccccccacccccaaaaacccaaacaaauccaaaaccaaagccuuccuuaaugguguugugacuuguaagguaaagacuaaaggagucauagaaccuguguucuugccuaaguguccugucccaggugacugacucaccccucagcucucucuggaccacauaagugacccuucucugcacuguugucuuggucugggguuauaccuuguuuaguaacuuuuuuccucauucaguuuuuguugagaaaucccuuuguuggggaagcacccccacccccauguuacucuaaguauguaaaauugcaugccuguuuuuuguucauaauacuuuaaaaaaauuaagcacuuuuuaaaaagugucuauuucauuaauccucuguagaaaucagcugaguuuuuuaccuucaguauuuuacaaucauaggcauuccggguaccuaguaccauuuaagcauaaaauaaaugcuuguugaaugaaucaauacaucuuaacuuuuuuaguuagucccaaggacauuugcauguggaauaaagaguagggcagggaguuuggaaaccuagaaaaaggcagaggcgaagcaugguagagauggauucaacuggaauccggauguguuggcacacuuagaccaguuuugagguaggacuguagugaguugaagcuucauagugaguucuggcuagagggugagugagacccuccuuaaaacuacuguauguugggacaaucuacugaauauggaaaguggagagauggggccucuguauuauaagaauagccuaguaguuacuuggaguccauacaauucuuaguggauauuuggagcgguuuuaucgauugacugagacggggagacggggucuuagcaggcagcccaggcuggugacugcauuccgccucagccuccagaggggcacucacuaccuguccuacugggguagacuagcuuagagucugggagcagucagcuuggaaggugaaguuguucguuauuccuuacuccuagccaacagaggaacauucuuucagcuagaacuuagauccagcuuuguaguaggucucgugcacauuuaaaauaugucuagcuuuggaaagugacaaaaaaaugaagagaggagucuagaugccuuguggcuggaauuuccuccauuuucauuguuuggguucagaacaagagugaggcaagguuuacugcaugaagagguuuccaaaaagugagucuugucaccacagugaaagaaaagugaagcuggcauucuugccaggugcaacaauuucuuuuaugcuuuuuuuuuuuuccugagauaaaguaucuuuguguagcucuggcuguccuggaacuagcucuguagaccaugcuaccuccagacucaagagagaucugccugucucugccucucaaguacuguccgccugggauuaaagcugugcaccagcacugcugccuggcugcaguucucugugagcuuggaaggugacauuuaaacagguguuuauucucagugacagcuuccauagucaguauuuggaaaagcaaaaauuuggguaacuuguugaagauguccuuccucccugugccugguuccuugcuggcuucuugggacauggucauggaucagauugauguaacuggucucugcccucauggaacuuuacuauguuguuagagcuuacuggagggaaauguagaaaaaaaaauacagguuauaccuuguauaaauggcuuaugccuuuuuucuugggcuuaguuuugauggugacgcuuuauaacuuaaucucuggcaaggugggaaucaggauggggauggcgugggccacaguaguaagguaagcuccagcuuguuggcacuuugagaccgcucaagcuggcuuaaaauucacgauagauugagcuggccuugacaugaggguccuccugcucagucucucagaugugaagaucacaggcugcuguuaacacuuuauaaugugucacaugguuuucuuuuucaagaagggcucauguaaacugcguucccacuguuuagugggagcaguagccacuauuggucagugcucugcacuaggcaggccauugggcaggcauuuguuaucaggcauuguacccuguucagcagcccuacaguguagcugauauuauuuguauuuuauaaguuaaacaaauggggaugcagggaauuaaucuuguuucacauugcucauagugcucauaugcucaaagugcauaugguccacauagugcuaccagguaaaaggcccaguucagcauuuugagggagggcagcuagccuguagcccauuuaccuaaggaacagagaagcugaguggucaggccuagagcccuguggucaguuuauugaauccucucgccauccaggagaguccaggagcuucccugaauggcacugcagggaagcaaaccgaggcacugcuuggggccacuugguccccaucuuggugcacuugggucacugggguccccauccugcaugugcugucaggcacauuguagaguuguauuuaguggcaguguaucuaucccagaggcagcagugagagacucuaguuguaguguuuaaucuguuuuuauuggugucaggacaagggacagucguugagucuuguguuuucuucauuaaacaggaucuaugguuugauuuuggucagccugacuauacaccuguauagguuuucuaagagugacuuacuuucaggcugugaaagccagugcuaguauaguauaaaccuaugcuagcuaugcuaaggaacacuguccugugguagguagggaguucacggagagucagggcuacagugggaaauccuguuuuaaaagaaaguaauuguggcuacagccugaaguuauuaguugguuuccuugauuugcagaauaguugaaaauaaaagucccaauagcagcagggauggcagaaggaaucaaccuuaauaugcaacaaacaauaguuuucucuugccguguaacuguacccucacagaguuaggauuaggguaaaauggggagucauuaccucaguuucugagucagguucuugggugcauuuuaguugagucucuguucuagagucuuaaaaagaugugcuagauuugauuggggaagaccucuuauaaaguaugcuguugcuagcaauauggagauuggcaacuucaguuucuuucugcuauuugacaaguaucugucuuaaaaucuuacuauacaguucuuuccaacuuagcuauuaacucuaucaaggccagaguaggagccucacuuuacaggcaguugacagucauaucuuaaaaccuuggagauaacaucuauucgauuauuuucuuagauaaagucaaaccucuggcccuguucauguucaaggagaaagcaggugaggugagcacugagagggugaugggagccaggguagucucgccagcaguguagagagguggcaggaagggccucuguacuccuggccuucaggcuuugaguccuagcccugucuuccccagccacagacauacguggcucucucuccucuugagcuuccagccuaagguauugucuuccugcucuguguccuugugaagaaguggaugcagcugaaugagaggccucuucggccucggugugcugcugagucuuuccugcacguuguugauggcaucuucccucucugcauccaaggguuuccuuguccuuacuucagacucacucucuugacguucaugcguagauguguuuguuggccccaccuuuuuuacaguucuuaaaaaugucacaauuuuaugguuccaucuuuuguuagaccaaguugugguuugugcuuucaaggccuaauguacuaguguuuggaauucugacuccuuaaauauuggcugauuaauuguaaggguauauuaaugcaucaugucuuagaauacuuccugcuacucuaugaugcuuuggguucuagagaagucagucccccuaagguaagaugcuagcaacuuaacaagcacuggcaggccuuuucauccucuugucuguggucacugccuucuuucuuguguuuuaaaacaagucccuuaagugauucuuccuugugauccuguugcagguuggugagcaggcggagcucagugugcuuguuuuguuuuccauuguuguccccuuguguccccaccccgagugugugggguguauucucguuuccaguauauaggguuucauggcucuuacugcauggaaugaaaaacacuuuuauuuuuaaacuauucagauucuguuuguaacugaucuaacuugucuuuuuagguuacuuucuguucuccugccuuacuguuuuuauuccauaacuauucugacuaguuuaauuuucuugugugcuagccuuuucuguuccuuuagucuuagcugucccuugagcauguugucugugcuuuuagauugucuauggagcauagaacuggcauguagcagaugcuuauugcguuaaacaaacaacgcuacauugucuaauucaaugcuacucaaacuuuguguuauucauuaucauuuccaaauguuguauuaucucauuuaauugcagcucagcucugccagcgucauucgucuuucauaaaugcuguugagcaaauugcccaagguugcauagcuguugagaugaagguuagacuuaacaagugucugugucuuuuaggcuuaauuuuagcuggcucagguugggaauaaagcagaaaaaucaaguuccuuugagccagcauuaaaaugcguauauuucacccuugauggagugggugugagggaagcuagccuuaguuacucauuuagaugucaucucuaguuuucugugacuuggcaggagggaagcacauuucuuuccugcugcuuucccuaguuucugucuuuguucucauuuuauuacacacacuauaaaguugcugaugcaaaguguuuggggccuuucucaguccguuugugcugcuuugccaggacuuacucagacgaggugagguaguaacacuauugcugcauggccauugagucagagguugagaguccagucaccagcagagucagugcauggugaaggcuugcucucuuuccugccucagguggcagggcaggcagguuauuccaacccaaacacucggcacuuuccaacaagcuccaucuguuuucuuuaauguuaaaaaaaacaaaacaaaacaaaacccaaauuauguguuugugcauucaugugcaugugugagugcaaauacgcacggauuccagaagggggcgcuggauugucuggaucgccugaugugggggccaggaaucaaacucagguccucuggagaugcucucagucacugagacuuagcuccaaccaagccccaacucuucccuaauacugccaaguucuaacaaauuuuggagaagacaccaauauucagaccuuagugcaugcugcuguagugcaaguaguguggacuggaugaaggagcagagauguagucacaagucuuuaggcugagagagccaagauaaacugguagguucauuguucggugaugauguaguaucugcuuccaaaauggccucugacagagagaugaaaugcugaaaaucucuccuccucuaugucuuuaaucuggggucuugacucucuuccuucucaguauuaaccguaugauaugagugaauaucuguugauaugccgaagaaagaaagugugaggaggugggauucacagccucuuuuucaauucggaaagacauuucagaagagggagaauguuccuguuaaacguuuacaaacgaguucauuguaauugucccuauauuuguuaguaaaggaaaugcugaguuccugaacacaguuguaguagcauauagcaacagcacugcuugucuacugaguauucaggucuagacaggauaauuucuauuccaaaugguaucugcuuucacugugcgguccaaguugacucagccuuuacuugucuggugucugucaucgucuuccacauugccuuugcccucccuguuuaggcuuuuucauagauugggauaguugggcuucuuauggaaugacugcuuuccagagguuagacagagagcugccaguuggagccuuccuggaagcaugccacuucccaucuucucuugucuugggucaggucagucucagggucgggacugugcaagguguggauacugcaguggugguugacuugagccaguggacauucucugccauaacaaaaggugacaguuuguguuggcucguucauguuuucauuauauaauauuauuuugugcaucagcuuuuagcuguaaguacauugaaagcacuauauaauaauauaauucucaaaaucaauuaaaugauauauuuaauuuugauaguauucauacacacguaaggacugagcagaagugaugauggguacuuuaaugggcgucucaguuccaucuuacccgucacauuaugagauaaaagccaggcuguguaguuuuucaaauaaaccaccuuuuggaucauguuacaauccauaaaacaccucagauauucccacaguaaccuguggcuguauuuuguacaaggaaaaaaagggccagacauucuaagacugacuguaauuggaacucgcucaagcugugcacauauccaacuucuaaaccgugggccacagcgcuggcuacuugacgggagaccugagagauucuccucagagacacauucaucuccagcuuguccuucagccauagcugucucuuccagggaguaaaccaguuccgcgucugcuccuuuauaguacagguugguggggggaaggguggaagacagcccagugccccacccuguaggccgaaggcaugggauggcugcugacaucuggcguguuggcuuaguucugugcuuugagcuggguacaaauagaacugugucccuaggaguuggugggagcugcuggacaggcauggcagaaguacaagaguacuuuuuaucccuaacacaggguuucucugugcaguccugauuguccuggaacucagucuguagaucaggcugccucaaacagcccaccugccucugccugccaagcgcugagauugaaggugugcaccaguacugcucagcagaagacugauuuuuuuaaaccugcuaucuucuauaagaaaacugccaaaaugucuauaauuucagaaucugguuauaucauaacauugagggcagagggaaggaacagacaguuaagagcagugccugaugguucuugcuucuugcagugcuucuaagucucccuggucugucaguauucuuguguauaaacaccugguuuauaaucuugugaucaguuuuuggcauccagaauuuucuucucaaucuuguacugccuuagaggugcccugugaaggaaguuaguugcacuuggcaucuagacaguagaauauagggccaguggccacacacuguaacagaugcugaaggcaggcgcuagucuuaaggggcugcugggguaguucacucauuuccuguuguguuuugcucucaccugaguggggaaggugcucuggauagggaaguacggggacugggcugcguccacucugcccuucccgaggcuuuagaggguaccuuucacuuucuguuaugggauuaagauagaugggcauagcaccugcauagagaugggaaauucaacaggaaagggucugaccacagaggccagacuagucaaccagcaucucucuauucuugggaggguggggcuuuuuuuuuuuuuuaagauuuauuucauguguaucaguguuucacgugugugcgugaaugugugugugugugugugugugugcgugugugugcgugugugcgcgcgcgcgcgugugugaugccuguagaagucaggagaaggcauuagauucccuggaacuggaacuauggaugguugugagcugccauguggguucugggacuugaaacagucuccucugcaugagaaacaagugcucucaacagcugagccaccucucuagccucaccuuagucaugcauuuuacacaaaguaaaauaguuuggcaaguaguggcuaaaaaugcuaaggauaauguaaugaaagaugugugaaguuaauuagaaauauacaacucaaccaaaccugauuccguguuugccucaggaagaguuguugcaaccuugcuuguacuuagacacauauucagucucucugcaguggagguccucuuccugggagccagcucagaaaaccuuccugagcauuacccaggcucuuggacucuggguucuugucauaaauucccaguuuggccuugugucaagauugccuagggaucuuguucagcaaguaggcucaggcuaugcccucaggagacugaugguucugucucagaaucugaauuuuuaacaagcccccucagggugauuccaauggagcugucaguagugugggaaacacuuccuuagaaaguuggugugucauuugccuuauaggaaagugcuucuuuaccucauaggcugagagaggaugaaaauggguuguauuugaaguuguuucauaaacugaaaaauagcauaaaagcuuuagauagcauuguaaaauugaguaucugccugguuagcccagaaagguaaguuuauuuccugucagaaauaaacugggagguacaggugggaaucuaggcuucuagaguuuugcauacuugagcaggacucaaaaaauguuacccuuucaguuuaacuguucuugaaaacuaaucaugaguagacaguuuugauuuuucacaguuguaggauaguaggugacagcucaaugcccugagugcaacacacugaauauaguaugcauggaagagucugagcuuuggacuguggcaaggccaagcugaguaagauguucccugucugugaggaaguugcaguguauuacagggggcucagaaaucauacuguaaguguuaagaguugcguucuccuuuaaucagaaagagaucaugugagguagucuuugugucaauagucuagcuagagacagcagggaacaguuuguuaggaaguaugagggcccuuugcugugcuguggagcaguaaccagaacccagcagcaaggaaaauggugggaaacuugcagaagcgaaggcugcaccuugcuuccugugggaaggcagaagagcucagauuuggaugcagguuacgugaguggguucuugguauuugcugacuuugccucagcaguaucagagcaggaagagacagauaacuuagugcauacuaagauaguauagguacuguagauaaauaguuuggcauaggggauuuugaaaacccucaagcagcaguuuauaauuguggugccaaaucuggauuguuuguagguauuuaaaauaaauggcuuuucuuggugaggcagcuuccuaagccucauuggguucucugccuugucaguacauuagauuuaguuagguuuugacaaagacaggauugcuucuaacccauugugacaugaaggauagagaucuauggguuuauuaacaagcugaggcacuggcaggggaagagcagcguggaaagccucagcuguugguagugaggcguguucacaggagccagguugcuuccccacugcugacgcgugaugugccauucuuacguugggggcuuguaauggaacaucgugacugauccuguucaagauggugcacacuaguguugaacuucagcgagcacaguggugguagcuuaugcaugccuucauaaagcuggcagggcucacuggaaaguccucugacuggaagucauuccaaauaagcuggaccugcagugccgauuucuacuuaagaccacagagcacccagaucugcuaaugaaugcucuuggagugucuccuaggaggcacuucuagagugaauauauuguauggaaauuugaaagguucuucuuagcuccuuuauuaguuucuuguggccucuguaagaacuuuaugacuuaaagcaacauaaauguguccuguuagcuuuggagcucaacaguccgaaauggcaaccacuaaacugucaucaaagaggcuccaggcuguguucucuugggaagcugugggggagaauccugaccuuuugggcuagcugguggcugcuagcuggcuuuccuuggcuuguggcuacaucauucuggcaucuccuucugaggucacauugccucccugucugcccaugucaugucugcugcuucugucuuaggggacacacguggugguguuuaagacacuugacaguuguggacuuguggacccugugcuucuuaaggucugucacuuaaaccacaggagcuguuuccaaaaucagcuacaguuucuagguuccaggguucaggauaaaaauauccucggagauauucuuguaaaugauuugaaagaguaagaagauugcguuugaaacaguuaacuuuuuggguaguauaucuuguaacuuuucaauguuaguuugaugauccaaauuuggaaucuaaacugggaggcaguucucaaucuguaaggugucauugacagcauugaaucgagcugcuuucugucagugauggaaguuaguucuucuagagcuggcuuaggauggcugacacuuuuauaccagguauuuauuaaaaugagacuauucaggaguuaacaccuguaaaaaugagucuaaauuuagggagguaguacaaaugcuggagccuguuuaggagccuuagaguuugagugacugaaaagaucguagagaguagugagaaauacaugaucaugcuuuuccugaagauuugugcuugaguugaagcgaaaauagguuaucauuguguucucacugugcugccuuuauguaguuaauuuuggugugggcugcuagcuuguuuuaaauaaaguauaaauauauauucaguaguguugaugaucuacacacucgaaagcugagugugguaaagguggcgauauacuuacucacuccgggaguuaacacucuggagacaggagaagugacuuuacaaggucaaggccaccuuuaguuccaggcagcuaggguaagaauaagacccuuucuuaaaacauuuaacaagaaaggugggcacacguggagauggaggugccgguggagggcuuuugcaguuaccuguacuuucuuuuaucugagcauccuacguaauacauguuuugaaguuuucagaucagugaauucuaguuucuucagcaagugaccuaaggcugagguacauguccacccccuaagcuugcaaugugauggauugccugcuaccuuugugauggagaguuugugucaucuugugugugauugccgagcuucugaagguccucuguauuuugaggguguucacaccugccuuuaaguauuuagagucaguguuguuccaaguccuguugcacacaacccuuucccuucuccugugcaggguccggugagugguguugagcaugcuaccugcccuuccuuagguuugcuggggcccagcuucuuacuacugcuuguauuguacaugaaaggcuucugcuuacucuuacuggguucugccuuaggccugcuauuaagcugucaguuucuuaaugaaauuaauaggacaauaaucauuuaugaaaauuuaucuacuuuuucauuuucauuuuuuuaguguagauuugaauuuccauguaguacuucuuuuccuuuagacugaagaacacuuuuuuuuucuuuuagauuuauuuuaucuaugaguaugaguguuuugucuauguguauguuuguguacuguguauguuccucauucccaagaaggucucaacagggugucagauucccaggcacuggaguuacggauguuugugagccaccauguaggugcugagaaucaaacccagguccugugcaagaguaauaugugcucucacccucucaccguugagcaucucuccugccccagaggaacauucuuugacauuucuuguagugcagcucuguuaggauugauguuucuuagucaaacacuuaucuaccagucucuauuucuucuguguuugaaugugaagaguggacguugcuauuuucuuagcacuguggcugcuauccucacucacgggccggugggcgguucugagcacuuagcugcucacucucuagugucacuuucucuugggcugcuuucaagacagugucuguaucucugguuuugagcugugggguauggcuauacuuugagauuugucuggcucacuaucuuugguuucauuuuaugugugauugucaguauuugaugcuucucagaucucuaaggccucuucaucaucuucugucucccuucucuguccuuaagacugaucugucaucggguuuccugagugugugugugugucucucucucucucucucucucucucucucucucucucucucucucugccucucauucugcuuaugugaaugauaccuucaauguguuggugaaucuaucuaguacauuuucuguuuugguuauuauacucuuuuuuuuuuccuuuugguuauuuucuaugguuuuaguuuuucuauugagauacucugucuguuuacacauugaaagccccuauguuuagguaggcacugugauacuggccuugacccuagaacucuagagguagaaguaggauuucugugaguuggggaccaaugugcuucauguggugaguuguaggccagccgaggguacauagugagacccugucucaaaacaagaaacuuuuaaauacuacuaccaccaacaaaaaucguguuuuccucuaaauuucuuaacuucauuuuguccuuuucuuugaguauguaaaauaccugcccuaaaucugcuagaucugcagugggucagcugacuccgaucuucuguccaguugauccccauuccauugacauuuuuucgacuccauuuuuuaaauauuacauuuaauuuuuuccaagcaauauauuuugaucauauuuuuucccucucuaauguucuuccagauucucucuaccuuucagucaacaaacaagcacacagagagcaguagagucugccggcucugucaguggcugcugagcaggaggccugcucuguagugcgcuugauacagccaggaucacccuacuggagaaaaccgaguuucuucucucacuuacaaggagcuucuugguuagagguggaacuuugugcacacuuccucucuugcugggauuuuugucuggaugguauuuguuuaggucuuauguauguuaacacagucucaaugaauucagacggguaucaaguccuguuuggaaaggcccugucuuugggcuuauccaccaccucuggcucuuacaguauuucuaccuucucaucugcuuaguuccucuuugaggaaacagcuucgaggggaagaguuuuauauagacacccauuuagggcugaaugcuucaaugucucugucuacacaucgguaucuggguuaauuaagauuuccugcaauaaguuguuucucugaugagggcuaaacaaugcagcaacaauggguauagcaauguuacuaggaauaguuuuauugcuagguucacuuaguagaauaaguauuauauuuuccccuaggaaauagaagucugucuauucucacguucuuggccucauuaacagugucaugucuguuucaucucauggaaugggccuuaaauucaaucagaaagugguugguugcuccuguaacauugacuacuguuauugcaccuggguauccugcaggcagcuugccgugguugggugcagggcauguaccuggaugagagacauggcuacuuuucucuuccagcgguguguguagcagcgccuuccagcaguauugaugguuguuagaaggaaggccugaagaagcuucuaggugggcaccagcuuggcuucaugaugucuuccaguaaggcuuuacucucguguuguggacacuaaccaauuguguuggcagcagccuguaauguuugcagugaguuaacaagauaacaacacauaccugguaguaagguagcauaugaugucuaguugggccucugccuuucccuguuaaaugguaacucuauuuaaauucuuucuuauauauuuuaggaagcuucuagaauaguagguuuuuauauagcuccccccccccccccgggugucucuguguaguccuaguuguccuggaacuuacuuuguagaccagucuggccucaucgaacucagaaaucugccugucucugcuucccaagugcugggauuuuuugguuuuucgagacaggguuucucuguguagcuuuggcuguccugggacuugcuuuguagaccaggcuggccuagaacucuccuccccauuuagucucuguucuacuuugccucuuuugugacaugaugcuguaaucuccccuuccuuggaagauauccuucuccuccucccuggucccucaccaguuaacugcccuuuguggauguucuaagcaaaacauauacacauaacgauaaaaacuuaaagcuaacaucugcauauaagagaaaacauguaguguuugucuuuguggguuugggcuacucacucagggucuccaucuaucagguuuccuaauagcuaagcaauaacuccauuguguccauguaccauugauuuguucuucauauaucaguugauggacaucuagguuguuuuccauuucugccuguuaggacuagaguagaaguaagcguggaugagcaagugcucucucuguaguggguacagucuucuuaguacaugcccaagaguaggugagcuggauuuuguggcagaucuuucaucuuuucgaggaacuaccacacuaauuuucauagugcuguagcaguuugcauucuaccagcaaugaauaaguguuccucuuuugucacacucuugccagcaucugcugucauuuuuaaaaugaaucuugguuauucugacuaggguaagaugauaucucaaaguagauuuaauuugcauuucccuguggcuaaggauguugaacauuucuuagauauuucuuaaccauuuguauuugaucucaauucuauacucuauguuuaaccagguaauuuuuaauuuuuuuaauguucaggguuuuucuucuucuuugccuagucuagauacugugugucagauguauaaugguaaagguucuucuguuguauguugaugcagaggaguuccuuguaagcagaugcucggucucuggcuaucagaagagaagagcuuugcucucacugugauuccaucugcagaguaugacagucaagggcaggacguaggcucagcucaagagccuuuccugccucagcuuaaagacuuuucuucaacauguaguugugcugacugugucauguacuaggcacauuagcaagaucccauaaguauagugcuuuauuguguacaaacuuuaguuucaagcauaaaguuauaaacaaaguccucuuuaggcuauguuuauaaagaacauuaaaauuguaaauguuaucuuuagacuuuggucccucuaaaaucuggaagucugaaucacuucugguuguaagcauuuuggagcagggauauuggcccuguccaucuuuagugacagaggccucagccaggcugguuugggucaguccagucaauugcucaacgcugcucaccuacugcuagaaucuggccagagaaaugugcuggggcuugaguccugcagaggaggcccaccaucaugagacagccccucacugaucccuuacagcaucgcacaucuuagcuugaccccuagagaacaugggcccugucugccuuuuuguauguugugagugauuauuuggagacacagaguugcuguugugcuuauugaccuagcuuagcauuucaagauucccaccacucauuguucagguuuugaauuuucuuacaaauuuuucuguguagaucuaaaagugaaaauuaugucuuaggaaguuuugaagacuguaagcuuggguccuaccuguuaaguuuuggaacacuuacaucugucagacuuucuuugacagaucuaaaaacguuucuccccuguauuugucagucuaugccagcaguucuccgucugugggugugggggcaccuuucacaggugacccuuucacaggggucacauuggauauuuacauuaggauucauaacauuagcaaaaucauaguuaugaaguaguaacaaaaauaauuguaugguuggggcucauuacaacaggaggaacuguacaaaggggccaagcaucaggaagugugagaacagcugcucuguguuuuuagccuuaucuucagcaugguuugccaucauuuauuagagccgucccugccccuguguguuuuuuuuccacuuuguagucuaaagucugugagggacuguagugacaguaacaguguagaguacugucucugugcuugccuugcuggcugagggacugaaugaccacuuugaaacuuuaucuugucauggcauggcugguuuauaaggaugcuguuuguguguucucuuaugugaugguguuccucuggggucaguaguguacauguaguugggcuguugaaguguguacccaugaguguguagcugggucccaucaguucucccuucugccgggcuauuccccagucccauugguuugaucagaaguucugcugucacuuuuguccaugcccguuugaaugugucuuauugggcggaucgcugaagcaaaguagcaauguagcgugggccugguuguacuuggaugggagaaaaccuguuaaauacagguuuuggcuguuaccuuuuugguaagggcucguguucuaguguuacauacuuaggugaagcagugucgugugaauauucagucacaaugaugaugugagaugccuugauuuuaccauugguuucauaacccucuucaguguuuguauuucuucuuauguuuguauacucauaauuaagggauacagcuuugcuacaucuguuucuagugaaggauugauucaugugcuccccccacccucucccucucucuuucucuugaaacagagucccucuucauagccuuggcucucuugaaacucacugcauagaccaggcuggcauugaacuaaaaaagagccaacugccucugccucccgaaugcugagguuaaagacuuaugccauuauguccagcaaaggauuaauuugaauaucagaauuaacccuuuaacuuuaaaucugacaacucaguauuauuguauaauuaaucugcauuaaauaggugcuauucuguguugagaaaguauggagauaggaaucaaugugacuuuguuuaaggaaaacagaguuuaggggacuggaaauguagcucauuugggagugugcuagccuaacauucucaaaacucuggguuggauccuagggcugaaaaaaccaggugugguauauaucuguaaucucuguuauuauaugauuaaucuguaaacucaggacgggugaggcaagagagguuucaaaacaggucauccuccucucacagguucaaggcuagccugggcuauuuauuauaugaggcggucugaaaacaaacaacagaagggcuugggagaauuguugggaccugcuguguccugcacuaagacuggugacagccaccagcagcacuagugacauuuugucuguagguaaacugagucauagaguguucugaagugauccugaguugccugacauaucugaaagggaaagguuacucuuaacuuccucaacuuugacauucaaaaaaaauuuuuuuuuaacacaauggaugcuuuuuaaaaaguuacagaaauuaaagcuuuagguaaauuuuuguuagugacuuaaaauaauaucucauggaaaauaauuugcuaaggaguuuuugccagagaggaacaagcaccugcucccugcagggguuuuguugaguuggauguuggugagcucuucaugcagugucccgacgacauuuacacuucucuuagcuggcugcuuuuacagucuagucgcuuccuuguuuuugugcuuugaggacuguuguacucucacagcuuacauauucuuuguuuccaucugugugugugugugagugugcaagugugcaaguguguaggugcacaugcauguaacugagcucuuuucuggaagguugaggaaaacuuacaggagcacagucuccucccaucacgugaguuucuggguuccaacccagaguaccagccuuggcagcaagcaguuucaucuaaugaaccaucuugucagcccuaaaauauguuuuagaaaagauaguugcuacuuaaaggaaauuauucccaugcuuuaucugagugcuagcuguuuauauagagggauaaucagaacaauuagucucuacagaggcacuagguuuugugcuguuuguauuggacugaguuacaggacuaagacacagcagacucgacucacucauuguguauuaaaagggaccaacuuacuugugucugcagagcaaacccauguagauggcuuuggagaugaguggguuaauaacuauggcguccacguuguucuagucagucagcagugguugcugaggcugaacuucugggaggugaggugcacaggaccuuugugcugucagugccuuagaugcugugcguacaauuagcucagauaaagguuguaggucacuguaucugugcggugcacugucuuuaggaaugugguggacacccugaggggaaagugcuagugugugugugcuugagugguuguggcaggaaggaguggacaaggaagauuuaugaaauagucagcaaaaaagagguguuuaugggaaggaugguuggauguugguccauuuaacuuaguuguaguagaagauaagacugaaaaaggaaaagguaaaaguaauuaaacugaagcacacaguucauucuugaaggacagugcugugaauuguugugaacugugcaguugaguuuaacaauaaaaugcuugguggcgaccagaagagcuuagauuugauucaaagcaaagccaaaccacaaacaccagaggaguuaggugugugcccuuuuugaucuacaguuuuccucuuuaggucauacgacuguaagaacauaauuauuucaugguauuuaacauagaguauauguaccacaaucugccauaauuucuuugugguaagcacuuauauucuaaauuuuuauuuugauuggugagguuuugcauauaaagugcauauuuucuauggugaaaugaguuucuaaaaguaaauugagccaggcagugguggucccagaguuuaagaacagcugggguuacacagagaaaaccugucuugaaaaguaauaaacagauaagcaaaaggaguagauugcaguuagaacacaggugggcuagggaauggcucaguuggccaagugcuugucaccgugugagcaggaauaccugagguugucuguccuucugcaccuguuuaaaaucugagucugacaagugcacacuugugauagcagugcuggggagguggagacagaaggagccaucuagcugaauuaguuagcuccagagagagagugggguaggggagggagggaggaggugggggaggggagguccuuucucaaaaaguaaagaggaggcugacccaagucugauccccaguauacauucacaucaauacacacgugcauaaauacaaauaaaccuaaagagagugugacacauuugcaugcaacugcacaugcccuggugcgguacacacaugcacuggcgcacacaugcacuggcgcacacauacaccaugcacacagagaacaaaagugggucagugcugcacccaaggacuccagugaaguucuuuuuucacuuacuuguguacacucugugcacuuuagggaucauaaguuagaacaaaacaugagauuugagcagagaauuaacugagauuuaacaagaaugauggcgguauuaauguucacuuggagaugaagcugaagaauagucugucucuaaagagguuugguuggcugggcauagcuuaaaaaaaaaaaacccaaacaagaaaugcaggcagcuugaauuuaaauuggugcagaggaguuggggaggugauuuaugacucaggcuuggggguugguaggauaguuugucaugaauuauucucugaaauggguaaauuccuagugccuguaggauauuugucugcuaaggagagggagugaugguuaugacaucacggaaagcccuucccccacuuccuccguccuuccugccugccucauguguuuuuugucagcugguuucguguggagccuggagaacagucacccugugcugaaggacaucucagaacaaggaagcaaacaccacuuuacaaggagagggcgucacgcuggggagcagugucuguguugcaggacugaaccagcucgcucaaguuugaauauuuagauuaauugaagcuggaggaauuugaagcauggacuugugauauucaacuagugcgugcguguguguguguguguguguguguguguguauugugacaguaccagcucauucccacaauuuucccauugauaguaaaauuacagguaaaagcauuuaaaguauaagauuuuguuuugucagaaaaauucaaaaaaguuuuuugaaaacugagaggacaaagacaauuuuaugccauccucucuuuggaggcaacuguguuuguguauauuaugcugguuccuguauagcaaaauucaagucccacuaccuccccaaccccccagcagaacagcauuuugauuguuauuccacuguuccagucuguucacagaauggcagugggagaccaaguaguacuuugcacauugcagaugucauuuugcugaguuauacaacagucacuggaaccuacugauagauaaugcuuaaucaggccagaagguagugugucuguaacugcaugcagaggagauucgaacaccagcacaggagcuaauauauucuuacccaugaggugugaugucugucagcuguagaagguuaaaucuguauuggagaucauuuguugcugaagauacauguaguaucaugcuugacaaccggggaaaacaggauggguuagaguuaggcuuaguggcauauucuuguaaucagaacacuugggaggcugagacgggagaacugccacaaguuugggcuagccuguguuacacaguguauuugaggucagcagcuccuugucucccaaaccaaacacacacaccgagaaaguagagaaguagucaguggcuggugagguggugcgaucacugcagugcugggaacagaggugcagacuucucacauggaauguggacacagugagcugggggagugggaaggacucgcccagcagcuugcagacugauacuaaguaaaaaguuaagcaggaaacagaauccaaguccuccuuuuggcagggagucuuacagugaaugaauggagggaggggagaguucagggaagcucccacccuuguucagacuaaaaguggaggagaggcagaauagcgaggggcucagggacacaguaguagguauuacaaaagcacacacacagaaaguucuuuaaucauguuuaaggcaguggggcaguuaguuagaucugcagccucugcuccaggagucccaggacuaagcuguuaagugagugaugaccaggaguagagagaugagcuccaggcagcaucacacuggaaaugaguggccaguaauccaaaguuugucuuuggcccacuacaaagagcuuuagauuugaauagagggggggcuggggcaguagguaggaggugugcauauuuaaguggucuugguggaagagugacucacuugauaauuaccucaucugcuauagaagguuguccauccucaggggugaguucgcucuccuggggauggaggguugggaugcugcacuuuucuugggauccaggauaacacaaucggaagcauucccuauauuccucaguugcucuugccucuuccucccccuuugaaggaaugagauaggugaggcauccccagcucugacucugaguuauuauuaaugugucuacaugcacagcugauuagaugacucagaauaaaggagacagcuguaagacaaaggcagagagauacauagucaccuuguagagccagguggggacucaguccuauuuaacagaaggaacuuccaaagugccuguuacaguagcauuucucuguaaaaguuuugugugggaaguaaauuacacucucgguaaugguuuguuagcaguguaaguggcaaacaacuguguuuuuguuauuucuggaccuuguuguuuuuucuccauuucuucaauccuaaaauaauuaaaagcaaugguuuauuaaaauuauacacaauuacauguguauaaaaguauauagcuaacuaagcauauguauacaugcauacucugauauaaauuguauguaacuuuuauauaaaauauaugugaaguguuguacuuuuagaccucuuuauuuaggaaaaccagugcaaucagaacgguagagaggggccggucuuuaugccugucucagaaauuggguuucagaaaagcuuucagguuacuuacugagugaauauguucuuucuaaugcuuuaugccugauaggcagcgcuuuguuuagggcauagacacaagugguuacccuaggugcuccgauuagggagagaaaucuaacaauauauugugugaaauccucagucugaaccguguuugaauacagaccacugcaggccgccugccaccuccuaaguuuccagaucuagaaucugagagaaaaugugagcgcauaguuuguagguggugucuguagaugagcaagccauuggaaggggcuuacaauucuuagcccuguguguuaugcucauaucaccauuaauuccuguuagcagaucaguagagggagguaccaaguuucagaauuuuauaguagugaaaaaauggaaaccacccacacaguguucagugggugcuugcuacagugcacucaggucuguucaggggagcacugucagccuguugauaccaugcaagugcagucuguaaacuuuucaaguucaccuuuaccuuuugaguguuugagucugucuguguuuguguuguguauuugccaugugugccuggugccuguggaaaccagaagagggugucagaugcccugagucggugcuggggacuaaaccuagggccuuugcaggaggagcuggcguguagucuuuacugcuggggcauuucuccagcucuguaaggaaaauucugauguaaaguuauacaaguuuuccaaaagaaucaaaaauugcacgaccacuguagacagucaaacuuuaugugaguuuuaguuuccuuuuuguauuuaauaccuuuuuaaauccaaguaauuuuaaaaguuauuauuauuuuauauaaaaugguagaaacauugggaguuuuaaauuucaaauagaggguagacucauuuuuaaguaguuuuacaguguaauuaugcuuggugggguuagucuugaugacagggcuggcuuuugaggacucuaguugggaugagaauaggcuauugcaggucagaagaggcaagcagugagucugaggaaugagagccauggccaggguggaaggccucgcucgcucucaggcugaaggcugccgaggagauuauggaaugugccggaagggauaggacagaguccugggagauaagaacuuugguuugagauacugggcuggugaugaccuccauuaacccagguggagaauaccggaggagauggguuucuucccuguccucccuuguuuuugagaaaggcaagugaugggaaauuguaaacucaguuuaauaugggggcaagaguagugguuuugaguaugaaacuuauuaucguuuccaugcuuguauuugacuuggggugacuuacuuuuuuuugggccuuaguuuucucauguguaacaauagacaugauaaugugauuuauguaacuaauuaguagaggcuaagagacuuaaaaagaugcuucaugcagugaguuauaacagggaaauuuuaguucacugggucauugagaaucuugaucucuggagagauaugaguuggaagagacuaaggacuuagacccaggacuucuauaugugcucauggcagaguguuucccuggcaucuuuuuauauacuucggaaucuguguucugaugugguuacugaggcaaccucacacuucucuccuuacauacacuuuaguugcuucccguggcuaguccccauucuagggugugaguguacccaugcuuagagcacuuggggauugucugguugucauuggcuucuuaaccccuccccaucuuucucauuugauggaauuuuuuucuuucuuucuuucuuuucuuuuuuugauagagggaauauguagcaaucuguuaaauguuugaaucagaaauuucuuaauuugggauaguuagcauuccauuugccuaagguuuuuuuuuugcauacuaauuuuguuuguuuguuuguuuguuuugagacuggguuucucuguguaucccuggccuggaacucacucuguagauaggcuggccuugaacucagaaauccgccugccucugccucccaagugcugggauuaaagacaugugccaccacuguccagcauacuaauuuauuacuuaggucuuuuguucuuccauguuggagauacauucuuguaucuuuguaauuuucucagucaauuuaugacuuccgggaaccauccugagguguagagaacuuuaguaucugacuggaguucauaauuaauuaguggguggggccuuugaccuguuagucuccugacccugacuuuccacaccuaugaagaaagggaggcugcuuccuuguagggcugcuacaggauuaaauaugucagcauuuaccaagugugugagcugagugguggggugaguagugugugucagaaugggcuuuuccuugcaccuuacuaauaauguuggcauggcagcacaugcuacaguuuuugcaguuuuguuuuuuuaaaaaaggcugugauuguuuucuggagguuuugauaaauguucuuguuuuuuggggauuuuacuugaagucuccuguugguguaauugcuuuuccuauaauaccacuugaucaucuuauugggaauuagagaaauggauuauuuucucuucugugauuaguaucagaacaaugaaauuuuuucuuuuucuucuuaaucacucaccuacugugauuuuggaaaauuuacuuguaaaaugacauggaaaagacuauuuucuucugccacuucuuuuaucugucauguaacugagcacagaguuacuagccacacugucauuuuuagauaauuauagcuuuaguuuaugaauuuuuugauauuuuuuuucuuacguguauuaauuuuuacauguaugaguguucugcauauauguuuauaugccacguuuugcuuggagcuguuggaaguuagcagaggcagucagaucaccuggauuacagauggcugugagucucagcuuaggugcugggaacugaacccagauucucugaaagaaaaagugugcuuagcugcuuaagcaucucucuggccccuacuuguagguguucuauauuuaacugguuuugcuuguuuucaguuggugucuuuugagccaccugaauuguccuuuugaauuccauggugcaucauauuuuuucauauagacaaaaauuauuuaugaaguauauauaaagcacagguacaauuagagaacaauaggaaacuguauauuugcacucaguuuaauaaaaugguaccuaauuaaucuuugaagcuccuugucucacugucugcuuuuguuguuaugaccaggccuuauuguaaagcuccagguagccuggaauucauagagagcuacuugcuguuccuucugugugcugggcuuaggguguccaccaucugccuuuuguagcagguucccauugccuagcacugaguuagagacacuuuguagcuuggugugauuacaagccguugugacauuagugaaagcuuuaucccugaguuugaguacauuggccccaccagagcaugcacucacuucuccuugcagucacagucuugccaugcuggccagggcugccuuuguaaacacuagcaagugggcucuguuuacuagucucccucuacacaccaugugcuccucagccuguugacauucugaagauaaguuauagguuaauuuuaaucuacuuauuucucagacaacuaaaaaacaguuugcaaguuuagccuuagaaaagcacuuaaguuuaguucuugaauuguucauagacuauuaauagccuuuggcagaaugugagcuaaaauaugcugaaagauuuugagacccaggagagguuccuucuguaggaucauacaugguuuucauuagugccuacuguuacccuccacagucugugagugauuccauuuaugagggaaaugaacaaauugacuauauauguuuuucagaaauuaaaaaaauauggcugucuaauguuguaaggcucuucacaaagacaaucauauccaaagcaagccugcaggagcagcccauugcugcuuggaacacucuguuugcagugaagucuuaggcuacagauucuuagcucuuucuuucuuccuuccuuucuuucuuucuuccuuccuuccuuccuuccuuccuuccuuccuuccuuccuuccuuucuuucuuucuuucuuucuuucuuucuuucuuucuuucuuucuuuccuuccuuccuuccuuccuuccuuccuuccuuccuuccuuccuuccuuccuuccuucuuucuuucuuucuuucuuucuuucuuucaagauuuauuuauuuauuuuauguaugugaguacauuauagcugucaucagccacaccagaagagggcaucgaucccauuacagaugguugugagccacuuugugguugcugggaauugaacucaggaccucuggaagagcacugagugagugcucuuaaccagcugagccaucuccagcccaacuuuuccuuuuuuagugaacucuacugacgccguugggagggguuauuagacaguuuguuuaaaguaacacagggucuagauuucuagugcuaacugugcugcuaaccucagugugugaugguuagguaguacauaacccaggagcauguugugugucuuguagacacguguuauccuuugcugagggcugcuuuucacgaguagugaugaaugcauggugcuucuaaaaggugucaaaauuuuauuuuaccuuucauuauuuaaaucagcacugaguauuuuaauaaaaagaauacuggaggcuggaaagaugacucagcaguuaagagcacuugauggauguucuuacagaggauccagguucaauucccagcacccauauaguagcucacaacuugcuguauguaaccucuucuggccucccggcacaagacaugcacaugaugcacagauacacaugcaggcaacacacacacacaucaaacauuaaaaaaguaagaaaaucaaaagaauacugagagcuuguuugauccagucuuuugaggacuuugcugucaccuguuuaguugagaccauucaguuuguaaguagcaguaugaauguuacaggcaaauaguaugaagcagagaugaauacagcuguuucuauggcucagagcuagagacugaauugauacuuugucuguaguucuuaguauccaugccaggagacagacauuacugaagcaaagauggcaugaaguaaacagacguaccuaauggcacugguuccguuguuuuaaaagcaaaacugucaugaugguuccuuuauugcucauggacucgccucuucaugcacuuggugacucauccgaaauggcuguccucuagcaggaggucaggaauagaggcagugacuucagaacaggcaguuugcaauuuaaaaauaauccacaaauuucagucccuguccaaagcagaucgcuuacccgguagagugaaaguuacuucuguuaggagggcagagcuggaacucaaacguucagaaguaggaggaauaauuaaagaacaaaauauuuggcaauaauaaauaauggagaucucugauauauaucacuugcugaagggcuuaguuuucuuauuauuuuguagcacuauuuggauuucuaguaauaagcuauaaauaguagagcucuguuauagucguugaugcagcuguuuuagucuagauuuguuuuuguuuuuguuuuuguuuuuuacuuuuuugguggcuuaucugaaauggacuacuuuuggggugacuugaguauagaauaaguuggagaaaggagaugcuugggaggaugcuguuauguaaaguguagggaaucacagggcuuggaaugcagacaguagaacagaaggacagaaggacagaagagagauugccuagaugauuuagcuuacauagguuuugucuuuucuuucuuacagucuguaauacccaugacuaccaagaucuuuguguuuguugguuuguuccuuugcagguuacuuucuuuaaaaagaaacaaaaccaacaaaaccaaaaacuuuuauguggucaagaccacuggcuggucuucuagaggacucagguucaauuauauggcagcuucccacugucuguaucuuaaguuccaagggauccggcacucucacacagacaaaaagaugcacacaaaauaaaaauaaaucauuaaaguuucuuuuuuuuuaaagauuuauauauuuuacauauaugaguacacuguagcuaucuucaaacacaccagaagggggcaucaggucucauuacagaugguugugagccaccauauggcugcugggaauugaacucaggaccucuggagaaacaggcagugcucuuaaccacugagccaucucuccagcccccaucauuaaagaauuuacauugaaaacuuuuuuuaaagguuaguauguaagcucaacuaucuuaggaaucaccaaguuuugcgccuucaccccccuccccaccugccugccugccuaucaucugucugucuuucuguuuauuuauguauucaucuauucauucauucauucauucauucauucauucagcuugaccaacauaaacaacugcuuucuuuggaaugcucacugaauuucauaguauagcuuaaaaauaauuuuuuugaaaguuacauuauagccuauuugccuuugcuucucucuuguuacuauucuucuuguauucuugcuugcuagcugugagauuguccucaguuuuguaucagccaucauggugggcucagcagcccugaaguggaaguaauaaacaggaggggcugugagaaaagugagguggaccaguuggagaacaagggagggguuuaugguaguaugugaaaaaugucucugaacuuuaucuacaaacaguaugguaucuuauacgcagucuuuccuacagguaauuuuuauuaccuaggccuugauaaucacugugaaaagugaacuaaaauucuuaugguuugugcaaauuguauaagaucauaaaaagcaguuuauuuccuuagauaaauuauauaaaacuugacaguuucaugcuuacuugaugccuagaaaugccugaaauguguauuggucauaggcacauuuuaaaacuuuuuuucuuuuccacaauaaaugucuacauauauuuucauuugcucuaagugaauagagauuauuuaaauacguguaaauguuaguaauuuaaauugacaaauuugaaauaauuuaucaguguuuugggguuguaguuauauuagauacuccucaguuaggggaaauugucuuacaccaucauaucuuaucguaauuuguuuuucuucacacaguguuauaguuuugccgcuggacucuucccucccuucccccaccccaucaggaugauaugagacuugaaagaagacgaugcauacaggugacucaaguuuugaaauacaguagagcuauggcuguaagacaauguggggaccacugagaguguaccugggggggacuucagauaacauugaguggcgggaauuacuuaggcaaguaugcagagguggaagauacugaaagugaaucugggucucaguuucauacucaguuuuaauagugaugugaacaguaagaguaauuccuaguaguugaacuuuuaaaagcuggcucauacuuuuaaaguugaaauaauuuguuuuaaaaauuaauagcauuuacucuagugguuaaauauaugucucccuguauuccugugagaacguaacagaucuuccaugggaaugcguguuaagaugauuucagcccgacaaguaagagugguuaugguuagcacagcacugcguccguugcagacgugcuggcuguggagguuguauuuuguguuccuuuucucccuauauuauuguuaauguaguuuccugccucuuucauccccguggcauuugaguuucuugauggaaaagaguaugguguugucugaggcuuauguuucuuacuucauaguuaacuaaggcaucuuauugguauugagaaggcagaggccccuccauuaccaggguggcugugucuauuagacucuaaaaaagacaguagccaguggguaagaugugacaaucaugguaaauccgguagaugggagacauuuuacaaaaugaaguuaucuuuacugguacaugugaauuuuuauuccauuguauuguaaauuaauaucugagaaugauuuuucacuggaaggaagccuuguuuugguguccgguauuaauugguagaacuggugcugauuuuuauuuuuugugguccaauaauuuucucuuuuguuuuagaaugaaauuuuagaugucauuuuuucauugacaaaauguaguugaauacaacauuuauaaauuauauggugugggaaagcaaguuaacauguauuuacaugagggacuguucauuuucucugagguacuugucacaugagcaugcagacuucccacauguguuugccuagacacacacacuauugccaguguucuggggauacauuguccccagugguuggcugcuaaaucaccuagguacuaacgcugagcgccucagccgucaucaaggaagaaucaacaggaguguuuacagaaacgcugccuuuagcuuuauaaacuuggccuuuuguugcaugaaggguuugucagccagcacuguugguuccuagauggacccuuggcugcagucgauagcacccgggcugugccuagcacacauggucugcucugcaguggagggcaggagagcagaguggcucuggucguucccuagguaccugugacuuacagauggcagagguguucuuccaugagguuuucaguuuguaaauaaucaaagauacagugcguuuccaaguuacuguuugucuuaaaagcuuuauggucucaguggaaucaaauaacuggagaguaaaucuugcuuuaauaagauacacaauuuacuuguuguauugcgguacaagagaauucuauggacuuagauuugugauauaaaccagucuuuuggcuuuuuggaacuuacugaguuauauugccuuacaaaagaaauaacccagaaagcuuuuuauuguuuuauuguuuacauuguugguauauuucucauucacaguuugaaaacuaauuguuuuuugaucaaaaaaaucaacagcucccugaucaauuaauaugcuccuuuccucuaauauaacacacaugugcuuauacuuuagaugauacaacacauauaagcuuaugaggaguuuuuaaaugaagauuuaugcagugucuacacauauuugaaagugaauucugcuugccccuggcucauggacuggccuuguaguguugguuaaguggaaugguaacuuauuugcccaucccaugguuuucauggcaacuaugugaggugauggcuguguuaaucuucuugauuuuuuuuuucuguuuuguaauuacuuugcuguuguauacauacauaacguaucaugcaguauaccauagguuuguacacuuguuuuuuaguuauauuccagugaggcugaggagaaaggaagaaagagacaaggaaagaguuauugaacacuaagccagucaaaccugugugucuccagcacagguguguucugguugccugugccauacaugguaaagucaggcuccuuuuguuguguuaaauggaaccagaacuuggaauuaaguaguccauuucuuuugaaguuuggaagaauacauguaaaacauuuauuuggcuaaaacuuguuuugaaacagguacuguaauagguguugugccucuaacuggguauguauuuagggucauauuuccuuuagagcaaagggguauaagaacauaagucauggaaugggugugugucauacauuuuagcauuuacccauugaguucaaaccuacagcaaaaauagcauguucucaggcuucauccgacagcucagugcccauguuacaaagaugagucuagggucaaugaagugucccaguggguaaggcugacagugggcaugaguguaaacuaaauggauguucucaacgguuuuuacuuaguugugugugccucagugugccuacuguggaagucaguucucucuguccuccauauggguccugagauugaauucaggacugcagguuccuuuacccacugaaucacccagucccucacuugcagaugucuguuugguuucgguguacucaucccgacugccagcuuuagacucaagugacugccuccugguugucucuccuacauaacuccuucuucccauucagaaaacauuuuaaugauaggauguaacaucccacuugggggcacuuguaauccaagggccuacaaguaaccacauugaguugauuuggauacuggaucauuccuuagauauggggcuggaaggaagcaaacuucucagaguccuggugcacguuaacaaagccucuugccgaaggagcccgugaggccagcagacuucaguguguguuaucaaaggauacccuuuauauuuugauuuuuacucauuuacauccuauagaucauuauuuuggaaaacuuguuccuuaugacaguugguucugcucuguuuuaacggauuucuuuaucaaaguaguuuuuuguuuguuuguauguuuguuuuuaaaaagcacauuaauagugacaugcuagucacuuagaaaauuguaguggugguggaggaaugcuucauuuggcaaggugcuugcuuucccagcccugggcaaauggagacaggaagauuucuagaacuuauuuuccacccagcccagcugaaucaguccuguccuguccuguccuguccuguccuguccuguccuguccuguccuguccuguccuguccuguccuuuccuuuccuuuccuuuccuuuccuuuccuuuccuuuccuuuccuuuccuuuccuuuccuuuccuuuccuuuccuucuuucgugugugugugugugugggggggguagaggccaguagaagacaccugauguugauuauuugcugcugugaccacacccacaccccuaagagaucauuugaaguaguuucagagcgcaugccccauuuuacaccaccucccugcaaaacagggugucuuguagcugagaucggccucacucugagcuuccuggauucuacaggaaagaaagcagguugagcaggcagcacucuuccauggcuucugcuucaguucuucucuugagcuccugcucugacuucucucagugaucaagugaccugggagugacucuuuccuccuaaguugcuuuggucaugaucauaacaacagaacugucuucugucuuuugaacuauggcacauucccaucagucccugugucccgucucccccccucccccagugcacccccuccucccagccucugccagugucaguugagaucauauugaauacauuuaugauggugagcuuggguagcaugcguuugauguuacuauugacuacugucccaucauugagugaccuacugucacuuugugagguacaaccaauuuaagcuuaucccugacuagcuuauaaauaaaugagacucagacuauagcuauuuuauuuggcuuuugacaauuacuagggggguaaccucuaauguucucuucuaacugcuggccuggcuaccuccccagcagugaaucccagacacuuguuguuucuccuggcccugugcucaugguuccucuccccucauggcggcuuccuccuucuacccuguccuuuucccuccuccuccuuccucucucucccccccgccaggucacuccaaacucaccuaccucuaguaaccccaguaauuggcuauggccaauuuuauuuaacuaauaguuuuaaaucaaaacaaaaaauuguaagcaugagaacucccucgcaagccuagaucuuuggguauagaauuuagcauuacaauacauagcagacaaaccaaaucucaccaacuuugucacguggguaggucuagauuacuuggaaauaacuuaaauggucuuagggauggauuaguuguggcaugugcuucuuugaaccuuuuuuauuuaucaugugcauuuccuaguuuaaguucgauauugcuuauucacaguuucccccuaccccaccuuuuugggucaggguuguuuuguuauauagcccuagccaucuggaacgucauuuguagaccaggauuggucuaguacucacagacauccccuucccaccccuccccugccucugccuuuggaguuccggaauuacauauuugucaccaugcuuagcuguucuuuagauuuauuucauauguaugaguguucugccugcaugugugccucuguaccaucuguaugccuggucaguucagaggacagaagaggacauuggauccccugggacuggaguuacaggugguugugaaccacuauuugggugcugggaaucaaaucugggcccugugcaagaaaaacaaguguucuuaaccacugagcuaacucugcagccuccagcuguuuuuuaaauuaauauucucaguuuuacaaaugacuaacagguauugaagagcauguagcucaggucaugugauuuggaacacucuaaagcucucacuaauguaagucacauaagcucucacuuuccagcauuaggcuuuccuggggucucugguggcaguguuguugcagggagugcuguaucggguuggcagggagagcacugucuggagcaugaggugcagcgucugcucagcuguuucagauacacagaaggugaaaagucauggcggcuccuuuuccugcguuacaggccagggcugugcuuagaacccuuugcuccacgugugucugcagggucuccaggagagcugccaucuuaccagaguucaugcacaagccgcucucauggucugcugcaugcacucuucagggucugguccucauuauuugccauuucuuuucaggucuuguuuugugauuuuagcuuuuauuuucuaagcagaagcaaugcugauugugucaugugcauacacaguauaaaguuuuuuaugaaauauaguauaaaauaaaaauaugagggcuggagauauggaucagugguuaagagcucugacugcucuuccaaagguccugaguucaaaucccagcaaccacaugguggcucacaaccaucuguaaugagaucugacgcccucuucuggugugucugaagacagcuacaguguacuuacauauaauaaauaaaucuuuaaaaauaucugaacacagacacguaguaagaccucuacuaaauuuagaaaaaagcagauguuuacuuucauuacauguuuaaaaugacguuaucuauguguggguaugcucuucugccacagugugcccguggacgucagaagaucacgugccuuagccaguucuucacuacaguguggguuuuggggaaauuccauuuuacugguccuuauagcguuuuauuuuuauuuuaaggccaauuuguaaaugucugucuaguuaggugucuucuuuuuuuugugauaaaauaugaugaccaaaaggagcuuggggaggaaugagcuuauuuuagcuuacaguuucacaucguagucuaucaaugaaggaagucaggaaccaccugaagcagaagcaguggugaaaugugcuugcugcuguacuuguuuaguuugcuuucuuaagccauccaggaugaccucccuagggguggccccacccacagugggcuaggucccccuccuucagucaguaaucaagacaguacuccacagauuggucuuuuagaccagucuuacagaggcauuuucuauauuagcauccccucuucucagauaugucugguuguaucaaguugacaaauaccgaccagcccauuguacaccuaagagagugagggccuggcgaagugaguccgcucuuugagaaggcacuggugugauucccacccagagcuccaguucuaguggaucuggcacuucaucuggccuugguaggcaccagacacacaugaauaugcacauacacauacaaaauacugugaggguucuacagaguuacagcuuaacauagguacuuccuuuuuccucuaaaagugggcagaaaacaccuagauggguaaaaccuccaaugccauaaacgcaucuacgauacuugguggaaaacaguagagagaaguggguaggagcaauguaguaacuaucacaguggugugguaucaggguuugugcagaagaaaggaagcacagugggcuuaauaagaaucccaagaguuccaaguuuaccagcaaagacucccacagaagcauaucaugcgagucugagaauaucagagaagccaacaaaguguguaugcguuuccugauucccaaaaccaguuaaagcugccuuucuggccaaagcagagacuauuguaaauagacuccaauugagcaguuguggaaucaucuuggacaaaagaaaggaaaauuggggaagaugaaaauacaggagaucuuauuuauuuuaaucuauauuuugaccuccuuccugagaacaggagagagagagaaugcuuccugaggacagaaucccagccucccgggaguguuuuacgucugcuguguggaggucagaggacagcggucaggaguagguucucuacugccaccuugugggaugcagggaucaaacucagaugguuugcacucacugagccaucucgcuguucccucauagcaguacauuuuauauaacgcuguauagauuuaccguuuucgcaaagauuaucagacaaguaugcagauuccucacugguguagaggucagcgucggcacugccaccuuuguugcugcugcuuuuguuguuguuguuguuguuauuguuauuuugacguagguuuuugauugcauccaagcucaggauggcuuggaaccccaaaucuucagccuugguaugugaagugcuggauuuaucgaugcuagcugucaugcugacugcagagaugcuuagugcuuaagagcacauaaugaauuggcugcagcccacaacacccacacgacagcucacaaucacuuuaacuguaauuccagaaccuacauggacaucaggcacauacaugguauacauacauacauacauacaugcagacaaaacacucauauauauaaaauaaaauaaaaauaaucuuuaaaaccguuuaaaaaggaaaaacugaauaacagagcauuacguagauaguuaaaaaaaacacagcagaaaaaaaugccugcugaccugaugucuuagagaaagcccagagaaucuguaggauugauggaggaaagaaaagagggaaaacccccaccuaggugcuggagguuuaggugaguugacagagugacugcucauugugagugaggcugcgcugcgcugugcccagcaggccagccgagcugugcuggagcacuuggaggagcaggcaagaagagcagagggccagaagccugucauccucagccaaccugggaugcacgguacccugugucagggaaacagaugaaaaagucccugccucgaauaaauaaauggugcaaaaaagagguuugaacuuuagaaugaaaauuucuuuagauaagcagguaguuaauugcaugcagaaaaauguuacaacucaacaaaacuaaauuucaaaguauauacccuaaacauuccagagaaaguaauaguuacugaagaaaggcagagaaguuucaucauacagcaacaagaauaaugcaaggauauuuccugaaguggaacaguuuugccuguguaucaggggguauaguggcuauuccugguugucaacuugaguacauccagaaugaacugcaauccagaauuggaaggcucaccugugauccugaucuugaggcugggagauagaagcuucugaccuggaucuuggcacggagaucuugaggcacaguggcuaugaaucccagaagacuaaggcaaggagaucucugaguucaaggucaucugggacaaagcaagucacagauccaggcauggugguacacaccuuuaaccugggccacaccuuuugcuggagaccuacaugaggucauuggaagaaggaagauucacucaagaauucuucugcuugcauuuacuugccagcacaucuguuggaaucuaccagcugaaacaaguagccuugagggacugaguaacugguagacgauuggacuuccuauccacagcugcccauuauucguuggacuacagacuaagcagaauuaccguaaucagagaaacucugcgaggacuaagagaacagcuucuucacuuguuuguugaacaggaagcagagaugucggaacagaaaguuuuaaauacuacccaccugacuuugacccaucaaagaucccaaaacucaaguuacccaaggaccggcaguaugugguauggcugauggcccccuucaacaugagguguaagacauguggaaaagacaucuacaaggggaagaaguucagugcacaaaaggaaacaguccagaaugaggcacuguuggaguuuaucaaaagacccuuacucacaggaucacagagaccgccgccauugcugcaaaaugcaugaggauuuuuauugauccaacauguuggggacuccucuuucaucacacaggccagaggagagacccaaaacagagaaagaacacacuuuuuauaccuuuguaaggggcagauuugagcaacaagguucucauugguguagcaaguaacccuuucaggcauugguugguuuguauagugacucaguaacccuuuggccuagucccucacuuugcuugcccccaacguggguuauuaugauuuggucagcaaaguaauaguacauuuugaacuuaugaaucagcuauuaacgucacagcuauuaacgucacagcuauuaacgucacagcuauuaacgucacagcuauuaacgucagggggaugucggggauucucgcaacaaggucuuugucagaauucagugugggguggggggcaggagaauugcuaaucuuguuaugguuauuucuuugagaauagcuaauauuauuuugguagcugcagguuuaaucauuuugacugcuaaaacuauguuuuuacauuuguuuagucagccagcuuccuuaucuggcccugcacuuggccugcuaguacaguuuggaaaguccuuuucgaagggggaauguacuggguggucuugaauucauuucggauauuacagcacaggcuuccauucucugcuguagagaggaacaggauggggaguuuguucagagagaagaaauaaagucuugacugccauguaguuauugacaaggaguaaaagagugucacuucaauuuagaugcagguggggcagguuuuuauuguuuuucuguggggaauucuuaggccauaugugucccucagacacauaagaaacaaaagaaauagacaggauucgguguaggaauaguaaaaccaugcagugauagccauggaaaccagagugcgaaaguugacacugacagaauaauguaacagugacccaggcucagcagugcacagucccugagagcaccaccuagggagggagggcccuguauuaauuaaugguuuuuauggccccucccaguaggcccugugcuaccuauucacauauggggcuagcaguuucuuaaauuucuccccccccauagccccacaaaagauacucuuuaaucaccauccccccaguuccauccuaccaaauaguauccuugucugagucaccuuaaauuucuuguuuguaugagaaacugauagaucuugucaaauuacauauagugcucuacauuuuauucuucauguuuccaguucaaaaucaugucauguacguaacugggaguuuuugauaaacuguagcugucacauuagcagugaaguuugcauggacugcuguguacucggcaggcacugaagcucugcucccucagcccgagcucugugcuugugcccguaccuguggcuugggauuggaaugccgauuuauuaauugaggguuuauaaggcaaaaaaaugacugggugaagacuuuuuggaacaaagcugaaaaguuagcauguuguuuugaaugccaaugcacuugaacugcuuuuuuggcauucauuuuggaaugaauaaaacaaagauauuuugaguuaugagaauuuuuaguugacauauacuuaaaauaaauacuugaugcuaugccuggcuucauaaagugaaccaucuuugugacuguaaauuccuuaucuucuugaggggaagcugcugcuuguugcuguuuuacuuuaaacuuaucaucuggaauacauuguaugagcauaaaaguaacauuugugacuuguacacuugcugaucucauaaguucuuauguccuggugcaccuguaaucacgcuacaccaguuggauguguuccauuaagaaccauuucaguucaggcuggacuuggauauaaagaguucacccaugccccucacauacagaguguauggucuuacuguuugguggcuguguuaucacuugcucuauaugcauugaaccauuacuguauaucaagaacuauuauuuguuuauuauuuauguaguagccuauuuucucuuguuagcucacaccaggucucacgcuggcacacaggcugggcugaccugcuucugaccgcaugcuggguuacuuguuccccuggguauuuaccugccgguuguuuucauggcgccacacugccugggagcuuuaugcucuuucuuucuuuuuccuggaauggauaaggucccgcaauaacagcugaacauaacagguuuacaggucuguugaacaaauuagaauaaaaccauuagcaaucuguugauggugaugacauuuuauuuucccuaauauauuuucucauguaaagagaucucuaagcagcuggccagugcuggaguaugccuuuaaucccaacacuugggaggcagagguagguagaucucugugaguuccaagacagccagggcuauacaguaaacuuuuugggguggguugggggcagagggaaucccugaggcuuuauaacuauuuuuugaugugauaagguacaguagcuugccaguuuggcuuuuuguuuuuuguuuuguuuuguuuuuguuuuuuuguuuucuucgagacaggguuucucuguguaucccuggcuguccuggaacucacucuguagaccaggcuggccucgaacucagaaauucgccugccucugccuccugagcgcuuggauuaaaggcgugcgccaccaucgcccggccucaguuuggcuuuuguucguagaaauaaucacuguuugaaacaggaacauguuuucuuaaauagucaaaucagaguuugcauuauuaacagugauuuaaaugcuugacugaauugaaauaauaugcuuguuucugaaaauaauuuugcguuuaugcuuuauguuuuuagaaaauauuauagauuugacuauuguuuaaaauguuuuaaauuuuaauucaacaaauaaaacagaaaacccauaccaagaaaccugaugucgauaaucccuuaaaagauaaaauggaagauuucacuuuugucaaagauuuacccugucuuuuaccuagacuucaaggaaaguguagagauccauguucccaguggcucgguguuagagagacuaguaguuuuauuaucauuuuggccugauugguuuuugucagcugggcauacaguagaguuaucugggaagaugaaccuucauugagaaaaugccaucaucagauuggcuuauaggcaagucuguagggcauugucuugauugauggcugaggugugagcuccagcccacugugggcgugcuguuguagaagauagcauuuuaagcaagccagcaagcagaguuccuccguggucucugcuuuagcuccugccuccagguucuuguguuaacuuuucuguauaucaagaacuauuauuuguuuggaugaugagaucuguaagccaagcaaacgucuucuuauucagauugcuuuuggucacguaucacaggacuagaaaccuaagacacaauucuacaaauuacaaaucaucuacaaggaauuuauuguaaauuuuucuuuuaaaacagaugugccacauauaguaauuuuaaaacauggcugauaauuaaaaguggaguaauucccuccuuguaguguggucaggugguuauuuuguuuuguuuuguuuuguuuuuguuuuuuguuuuucugagacaggguuucucuguguaucccuggcuguccuggaacucacucuguagaccaggcuggccucgaacucagaaauccaccugccucccaacacccggcuguguggucaguuuuaauaaccuuuuggcgggggggggggggggugguguuaaagauuuauuuauuucuuauguguaaguacauuguagcugucuugagacacuccagaagagggcgucaucucguuuuacagaugguugugagucaccauguaguugcugggauuugaacuuaggucuuucagaaaagcagucagugcucuuaaccucugagccagccaccccccccccccuuuaaaaauguuuauuuauuuuuacuuauaugaguacacucuaguuguuuucaaacacaccagaagcgggcaucagaucccauuacagaugguugugagccaucuuguaguugcugggaauugaacucaggaccucugguagagcaguuggugcucuuaacugcugagccaucucuccagccccuaguaacuuuucuaauggacauacuaagcaaugccacugcugccugguucucuuuuugucucugaauauuaaucucucugucucucuuaauguucagccuugaaaucugggcuuaauguugagaggaagccaaaugagcucaugagaaaaccuccuguagaugacuggcuagguccucagcucuggauccuagccagcguaagcugcuggcuuaugagugagcagguuccccgugguccucacuccuuucaaggcacuaacacugagugugggagugauucccccugccauaugcuggugguuugaauaugcuuggccuagggaguuggcacgguuaggagguguggccuuauugggaggaagugugucacuaugggagugggcuuggaaacccucauagcuaucggugagauagacuucuguuugucuccaaacaagauguagaacucucagcuccuccuacagagccaugccugccuggauggugccauguuuccugcuaugaugauaauggacugaaccucugaacccaauuaaguguuguccuuuauaaguggugucuuuucacgguggaaaccuaacuaaggcacauauccuacccaaagugcaguuuuauaugcaaaauaaacauaauaaaugguugaguguugccuugcugugaagucagacagcagcuguguccagggcuguuuuccaguuguguucugagagugucaccaugaagucugacccagggucacugcugagaccccacaguugaugccauagaggcaggacaccccaguuagugacaggcuaccuaggagaaugugcaccauucauugguggggccuaauucaagacaggaggcugagacacaugacugaauccagggaggacucaguauugucuuccugugcacccacccccuuucacuuuccucacuuaggauuuguccuucacugcugguaccacuccaggcacucugugacuuccacacguguacguaagcaguugcugauagaccuuccuguccucuuuuugauuggguuggaaguuggauggacggagggguuugcucaguacuucaucagugcuggcacugcauggaaagcuacgagcaguuaaguugguguugugccuguaacguguuaguuguaaccagugcucacauccuacaaucauggucacuuaggccaugcucagcccgugugcuaaauucaggcuuucguuucccuuuuuuuuuuuuuguuuuuuguuuuuuguuuuuuuuuuguuuuuuuuuaauaauuaauuuauuuauuauauguaaguacacuguugcugucuucagacacuccagaagagggagucagauuuuguuacggaugguugugagccaccaugugguugcugggauuugaacuccuuuuuugcugggauuugaacuugaccuucggaagagcagucgggugcucuuacccacugagccaucucaccagcccccucguuucccuuuuugauaugcuuuaaggucgucauuucuaugccugcuuagaaaccuccaagguuuagugcccuuuggagauagagacaaaagggaauuuguuuuucuuuuucuuguucacauuuuuaggaguaacuccuuuaauuucuuuaacuuuaaaguucuuucuugauuacuuacaugauuucuuagauacagugaugguuuauugcuguguuuuuauauucagaaaacuacugacagucugccaggaagacagaguaacucucucuuauaccgucccuucuugccaugcucuacuagggcucagcuuaaaguuuuuaguuaauuaacauucuauacaauucguuucugacucauggauuuuuagacagucuuccuccccaagauaagagcaaccaaacucauuugcagugccuagcccaccagauguguaugcuguggcacagguauauaaacuuguagccauuuucaaaguuauagcuacagcucguuguuuugucuuuaaaaaccugaugacuagagccuacuauuuaaaauaacuuauaaggucagugaaagggaagguuugccuccucacucacuguauuuguuauggccacaaagaacauguuagcccugggguugaaagaguuuuguggcaggcaauaaugucucuaacagauuccuuugugugggacauagucacccaucgcauaguguguuugcugcucuuuaaucuuagaugcagaguaaguguucuuggucaugugugccuuugccuuuguuuuauaguguuuuagugauaaacacuuugaacccucauggcccagucaggagccagagcuuacugucugccucuugugcauuucuuccaaaggagaggaagaagacagguguccauuggcugucuguggaugaauguagugagggugaauugaagcuuugggaagaaaaauacuuuauuaaauugccagcuugaggaggcccuucggaggaguaaggccaguccugcccaguccuuaaucaugcuauguaguguccauagucauggcucuucucaggcuuggccuggugugaggccuucuuuguaugcugcuuggugccauagaugcuuucuuaagagugaugaaggagucccugccuuuccaguucuccucucuacccagacagcaugguggggcuguuggauacacacagacuugugcacaugcacagaguagguggggugggguggucccucugugcugcuucauggccgcacugccacuugugcugauuguggcuuuggcucuaguguuuccauggagaugguuuugcucuuagacuuguagaaagcucuuagaaauaguuugcucacugacaggucacuacaccauuuuaauugauccuugcuugugauuauuacuauucuguuggguguuuuguuuuguuuaagauguaaacaaguaugcuuagauuuuucuagauuuuuuuccuuaggguugucuuuucccccaaacuuacagaacuaaguuuucgauguccuuuggcuccucuaguucucagggcuccacugucugggcugguucuuccugcccucagagaagcucuggcugugcugggaaguagauggcgagccuagccucaggccacacugccugcugugagcagccagaggaugccacgucaaguugccccagggaaagccacucugggagcuccaccugucuucagcccugucucugacguuugaauugggaucucuuugcacguugucuucugucuuguuuccucccugcauagacucaagggcucucucuucuugcuucugaggcuucagcugccuagagaaugacagagcauguguucuuuuaggugcccaccccagguuucucagaaguaaaauaucauacuguucggaaaaacgaaauaggguaaacuuccucuuuuaauuuguucagucugggaauggauagguggauuucugugagugugaggccaccgugaauuucagguuggucgagaucacaaaugaaacuauauuuccaguacaagcaaacaagcccccaucagcaaccaauacaaaaaguuucaauucuucucagaugaacagugacuaacaggcagucacuuaauguauuuggguacauuagaguacuuaaaaaugaggaugcuguugaauaaguauaguucagaaguauuuuuuaaaccauaaaaccaguuuuuaagucuuuuguuuuuaaagcauauuauuaauuucguuaacuuuaagcuaaauaaaaacuucuggucugauguucaauuuccuuaauacccgacugagaaaaaguacauuuacuguauaauggugaauuuggaagagaacacuccuaaacauggaucagacccccgagaguaagacaguccgguauuuguagcuuccugucugcaguguggauggaugcaguuaacaaguggaucuguuagccuuuuaagaaguaggaguagggucagggcagcucuaaggcuggagaacacaagccuuuuguaaaagaugcccagcaugcacugcuguagcuagcagcuacuauaaagauucccagcaugcacugcugcagcuagcagcuacuauaaagaugaccagcaugcacugcugcagcuagcagcuacuauaaagagggagguauuaaaaccggucaacauagucacuuacaguuuuugacuauuuuuuucuaaguagauauuuucaaaacuguaaaguugacuguuuauuggaguggagcaugacauaucucuggagcucguaggagaguggacagcaaugccaugcuuccaagucaagugucuugugugugaaaggagagcuguugcuucugcuuguugaacauguuugcaguaguugagaaauuaccgccugguuguucuaaucuaguucuuccuacaguggaggaaccugacugaaagugcuggcuuuuuaaaaguuaaugauuaauugucuacuuagcaaaccuuaguauuuccuuuccuagaaauccuagugcugcucaugugguaaggagucuaauuuagugagugaaccgcuuuugagcauuuuaagucuuuaauuuguuucuaaaacuaguacuuacauuuuccuaaauucuacuuuuuaauugcuuugaaaagaaaugauguuacgcuacagacauuuaaauguaggcugcuuuaccccagagcaucugccaccaggcagaggauguuuccuuaugucucagaccuugaagagacugccguaguaccgaggcuuuauuggucaccccuuucagugauaagggaaguucugugguauguacagugcuuguaagguaugcuggagaccgccuuguguacgugcaaagugcucuuguugcugcagauuggaaacuaggcugaguuagggaucugagugaaggagacuuuagagcuuuggcugaaguaugaaaguaugaaugugauuagauuuuuuuuuuuuuuuugcuucgugccuuuauaauugagaauuaaagggggcucaauaaacuugcaaguauuuuaaaaacaggccaaaugauacugaaguuggauguaugagugugagcuaucuaaggguuaaugagugaguuuuagcucucaguagauguuguuaguaugguguaguguguguagguguuagugugguguaguguguguagauguuagugagguguaguguguguagauguuagugagguguaguguguguagauguuagugagguguaguguguguagauguuagugagguguaguguguguggauguuagugagguguaguguguguagauguuagugagguguaguguguguagauguuagugagguguaguguguguagauguuagugagguguaguguguguagauguuagugagguguaguguguguagauguuagugagguguaguguguguagauguuagugagguguaguguguguguagauguuagugagguguaguguguguagauguuagugagguguaguguguguguauguuagugagguguaguguguguagauguuagugagguguaguguguguggauguuagugagguguagugaguguugauguuagugagguguaguguauguagauguuagugagguguaguguguguagauguuagugugguguaguguguguugauguuaguguggggaugauucugggcucacaccuuauuuguaucaacuacugagauacaaaauuacuuuaauauaaaagguauuuuuguuuuuccuauagacaggagaaauuauuguugauucaccaauacuauuuagaagaugguuugggaaggcuuagauuuuuuuuuuaucuguaggauuuuuguuauggacuaacauucaaaaaaugcaguugguaggaugaaaaguuaguacucaguagccuuuagguuuucuuccagcuugaaaguucuguuauugaaaccucugcaccuugcaagaaaccugcuguuucuaucuugguaccuguggacuuugaaugcuuuauuuuauuuuuauuuuuauuuuuuuauuuuucaagucaaaaauccuugaguagagagagaacaugggaagaaauuaggggacaggagugaguaguggguguuggggcuaggcuggagauggugaagagugacuuuaauuuucaguguuuguuuauaguugcuuuugauuuuuuuuguaguuuuccagaaccacuguuugaguguggcagucucuacucgcuggcugcugcccugugcuuagcuccuccaggcccuucccuuccuccucuacacagcggcagccuuaggcaucgaauccacucacuuucccuaagcuuaaaguguucugugucuuccuaggaaauauuuuuacaaaugaugcgagucuuucuggagacauauacuggcucuguagaaaauuauuuaaaaguaauaacuucucaacguugugggacaaaucuacauuccauuuaggugaggauaauugcuaggaauggugacauaaguucauguauuuuaaaaugugucuuugugagguacaagugauaacugucucuuugacauauuuuaaaguaugugauauuaaagaaauucccucaaccacaagauugucagaacacugauuuaaaaaaauaaacaaaacccaaaaacaacugucgucguagcuauuaaaauguauuaacagaguucgacgguguacauauaguaucuaaauuguggcuacaauuguaguugaaugccauucucagcuaggagaaugacuugcaugguuccagccugcauguacuaaaccuuaugugauuaacacuucuuacauuuuauucuuugugaaguuauguacauaauaaacgguuaacaggauuacauauuaaaaguuaccauaauaaaagauaaaauacuacuuuuuccuaaccccaaaauacuuccuugagcuuuguuaauauucaccucaacuauaguuuuaugaagauuaaaaugguauguaggguuuuccuaaaguguaacguuucagaaucucuguaaauguauagaaagucauuuaaacaauaccuaaauauugaaggcugcagguguuagaaaaacaaaugucuaugaaguaaaaaguuaaaaauuuaacagauaacugcuuuuaacaauauuccccauguguuagcaucuguuuguuuuuguaguacaaaguagauuaagaucuaauccuuuauaguugcuguuaauuuuguucuaaaccugaaaguguuaacagcaacuugaaaaugugacaaagcucaauuucauuucuuguuuauugcauguuuuccuauuggacaauuggaaguagcucuacccuggcaacuaaaauagucuauuugcauaaccuaguuugauuggcuagcauucugacuaacagcuccaaucauauggucccgguuuagugguaggcuaugcuaauuagcugcuguugcugggguucaggaugcuuucugugugcuuuucugcauuguguugccugcagagagacauugauaaacgcgagauuaaugaucugcagcaguucccacucacugcgggcaggcggacuuuagaagacaaguggaaauaaggauuuaauugcucuguuuaauguuuguaccaaauaaguguauuaaauuauagaagugaaguuguaaaucuugauuaauuaaauauaacauaaaaggcacuuuugcuuugucuuuugauaucacucugagguaccagcacuauguaaagauuuuucuaaaacuguuuaguaaaucgauccuuuugagacuagaaauaguaccaguuugcagucaguggcauauauggcucuuuucacaaucgugauuuccugcaguaauaccuguguguaguauauuacuguaaacucucggauagaauuuaucuuguauuccaugucaucuagcagauaagagaaugaugaacuuugguucccuguccauguucuucucuucaguuugaaaaucacguuguauucauuuacugcugucauuuuccuaauugaaaccauugacuguuuaagacacugcuuuacugcuccuuaucuuugguugacaacaaaucuacaaggguauggcuagguggauaguucuguggaaaucagaaaggucaaagccuuguugaugagauauaagagcugagacagaaacauacaccuuguuagacgagaaugcaaagugaccacagcagagugccaccaccauggcagaguaccaccaccacggcagagugccacuggguuaauuugaaugauuugaugggguggucucuagcauuauuuuuaaaacugaacuugaacccaacguucauauuuauuuugcuuccugacugugcuuguguuuucgucaguuucugggccuuaguaaggcaucgaggaagccugaccugcccccccccccccccccccacacacacacacacauagcgcauaccacacagagcccccugggcccugccgccugaccugcucuuggaaggacuuuacccucagugugccuggacacacccacaccauagguggauucuggugauuucccaugaagguacacaguccuauugacagauuuaagacggcugaauuuuguuggaggcuauguuguuggggaaccuauaucaaauggugugucaaucccuggaccauucucaguguugcuucagaagcucuggaaggacucagggcucuccagagcuccaucagaggaucugcuugcuccacaccucuccuguguuccuuacaccaagaacagcagaccagcacugccccccccccccccccccccagucauccugcagaucacacuccucugauuggcugcacuguaaacagaacagacacagagaagagacaagccaccaucccucagcccuaggacuuuugaccaagggaugaaagaaugucuagucugagcaaauguuaacaacacagcccuuaauacugugguuugguaaaguauggcguacagaugaaauagcugggcgaguuauaggaaugaagaauuuuacuuaggauguggaucuaaugaauaaaacagcauuuuggugaguaaguacaggugcuuauccugaucaagguuucuaguguuuaaucauuuuaucgucugagauuccaaacuggcuggugucauccagugucucagaaucagagcuaucaucuuacuguucagcuaguguuccuggcguuuuucuuccuuguuuguuuguuuguuuguuugugguuagcagugcuuugcauuuucugagucuauuaacauagggcacuuuuaaacuuuuuuuauuuucuuguuuggcccuaagcccuugaaacacccaaaauggucugaacuuguuugucuucaguuuucuaaaauacuuacccauuuaacuguucuguccauuuauuaaagaacuaguuaggucagggggacaggauaauuggauaguucugcagacuugugaagagugaaaauaaaaccaaacuaacuugauuauuaguuauauuuuucuuuagccauguauuaugaagauauuuuagaaaauaaucuuauuauuuauuauaaccuguuuuauuuauucucagugucaaagcggcuugaacuuaaguuagaguuuaauggaaaggaugugauuugacuuacagggcagggcagggcagggcagggcagggcagggcagggcagggagagcucuggacugggacuggacaaucacugccuuuucuugcaguggcgauugguuuuugagacaagaguuucucuguguccugguuguacuggaacuugcuuuguagaccaggcuagccuugaacucagauucaucuauuugccucugucuggcuuagacaagcauugugaguggaaguagcaucuguguggucuggagguagugcugugaggucucagaauguggaugauggcucaucaaaugcagggaaguagauugauaauguaguugaggguuuggagagcgaugguggucuggauacagugacucaugucugcguccuagcguucaggaggcugaaguaggaaguagguuugagaucaacuuggacuacauaaagaguuaauuccaauccauacuuaaugaaagaugcuuuaucccuuaacaaauagaagcaagaaugauuaaucucaauucaaauaucaucuagugaaaaugugggcauuuugguuucuuugcagaauugguuuuacaauuaagauaucuuaauuguguuauauuacauaucaguaguuuauuucugucuuuuuuuauuuuauuuuacuuuuuuuuucagauucuuauuuuguuguuaccacagcuuacacauuugucuauuguaagcuuuuaucuuuucacaguuuugacguuacaaaugaaagucucuaugaguaucaugaagacugucuuaaauggccgugcuuuaauuucuuggguagagugagaugauagcauguaagagauuuacacagaacuuuuaggggcugugggcugucugaaucacuuugcauucuuagcagcacagcauggaaccggccuuccaugcugcaccaugccuuccuagugcacagaacuuguggucuguuagaauuugauggugcaccgugaugacucacucagcuuccugggaauugucaaaggugaacacauuugugcgagcuuauuuguccuuccaguggaaaauauuuaccuuuuucuuguuuuuuaaaaauaaucuuuaauaaaacaacugguuguuuucuuacugagcuucaaaaguuucugguuuauuuuagucuuuuguuuuuaucuguauauggguuuucaggaauuuccucuuauuccauggcuuauuuuucauuaagugucuuuuagauuaaauguuuaaaauuuuuaugaagucuaauaacuugauucuuuuaaaaauuguccauuugcaaaaucuugaccuaaaugcucugagauugagaagguucuccugugguuuuuccuuccuagauucauaguuccauuaagucagggcuucauuuugaguuaguguuugguagugucucgaagcauaggucaguuguuaucauuguuuguugaguguguguacccgugcgcaugugcaugccuacccacaugagugugcaccaccugagauuugcuaacugcugagcccugccacauuuacaacaaaacccaaaagcccaaacccuaagggcugugcugcaggacccuuuguugaaaucacuguuuuuuugagaguuaccgucacaaaguguuuuuauaaucaucucucaauaucuguguuucucugugaccuucacaguuuuuguuccaugaaugugucuuuuuuuguuuguuuguuuuuuuguuguuuuuuuguuuuuuuucgagacaggguuucucuguauaacucuggcuguccuggaacucacucuguagaccaggcuggccucgaacucagaaaucugccugccucugccucccgagugcugggauuaaaggugugcaccaccacgcccggcuacaugaaugugucuuaauucugccaucuuuuuucucuuagcacuguugugagguaaugucaaucauacaguuuucuucuuuaaaguuguuaucaccuuuauguuucuguuugaauuucuaagaguuuguuguuguuuuuguuguuguuaauuucuuuaaaaaaaagcuuucuagaacacggaauuagauagacuguguuaaaucuauaguaauuuuggaggaauuuuaaacuauugauucuuuguuuguuuguuucuuuuuuuguuuuugagacaggguuucucuguguaggccugguuaucaauaguauugauucuuuuggcucagugcacauacuuacuuuacuuaaugucuccaguuuaagauuguuugauuuuauaaaucuuucauauauauauauguauauauguaaucauuuaugacaaaaaucuuacaauuuucauguuauaaauucauuuauacuucagauccugacuauguguguguguguggacuuuuccuuguuguuaacugggauagguuguugguuuauguuuucaguuuuuugagacagggucuuuauagauugcucagcuauucuggaacuuucucuguagaucaguggcuuuggguuuacagggaucugccugccucugucuucugagugcuggaguuaaagaugugugccaccacgcccgacuuaguagguuuuuugaugguaaauuauuuuccuucagcuagaauggccuguuguugagacaguucuccuauuugguugcuuguauuuguuuuccuuacuuuauuauauugacuggagucuccauggacuguauuuacagaacauacuuacaaaacauauucucagaagacagaacauagcauugaauagaaaugcagaaaaacagcauuauuucuucuuccuugguucagaaggaggaauguuuuaaauuuuuacuuuugguugucagauguaggugggguuuuucuuccuuuugccaguauuuaucaccugaggagaauauuuuucuauucauaguuaauuaaaaaauuuuuuucuugaguaacuugaaucucauugcuaaacugacucuggauuugaaauaaaggcuacagucuuugucuguuugaacugauuguuguauuccauuuauuagaguuuaguuugauaauuuggccucuuuuugacccacagaguguuaaggggcucacugauuuccacuacguagcacuguggaguuuguucccucuuacuauuuauagagcagaaccacucacuguuuugagaauuuuugcgcuuucuaauaaaaauuggucagugguacuagcccagccccgaccccaauauuaguccuaucaaaccuugcauuucccuucuuuuccauccagaacgcguuguggcuugagcucucucuuggcuguggcugcucagaacggguacugacgggccgcacauacuugaggugcugcugcuucccagcucacuuuuacugucuagagcguuugugcagugcggccccuuuguuggguucauuuccucgugaagugguguuuuggguaaaugugcucugucaaugacaagugagcucugcuguuacccuguuuugauagaaugcucuuuugaugucaguuagguuuuguugauagugcuguuguuauaugcuguccuuacugaauuuuuuuuuuuuuacucuguauucugauacugagagaauauugaaauguugauguagcugugucuauccuucuuccugccauuucuaacuccauguguuuuaaugcuauauuaauaggucauaacuaugucuucucgauauuugauacuuuuguuauaauuguugaucguuacuucuuauuacuguuaaaagaacauacccuuucccacacuuuugucuuuuaauugucaguguuauuauaguugcgguccuucucacaggcagcagagauggagccucgggcgcuggacuugguucugucuguuugcuuguuuaaugcaguuacugguggucggguuugcaggauccccagcuugugacugaacuucuccuguguucucuugacccuucaccuggcucuccccucccccagcuuauguagauuauuaaaccuguuuauggcuuaauucguuuguuauguuauuaauuuuaacuuaaacuugcuguucuuugucagagacuacuccuuaacaauacuacucauuucuuucaucugaaauacaggcuauuggcuuccccacaggguacuugcauuucuccuuugccagcuugcuuaccacuuuuucaaggauuuucuuuuuacauugguuaccaaccucaaguacauuacuauucuuuaacaaucaaauuacaguacccuccaaucaaauuuuguuacaaacaauauuacuauucuuuaaccaucaaauuauaguuacucucuguauuugucucuuuaucccugguuccuuuauccucgaauuaaagguuuuguagugugacucuguucacaguuacugugucugaagcuuuccuaagcucuuuacugugcaucgguguguuggcuggagagaucugaagaugcccuuggacugguagcugcuuauccucacucuucuuuccuuacugcuuuguagggaguuuuguuuguugguauuuuaaagauuuucuucugcuuaucauuaauuuugugcaauuucuauaugguuuguauaauaguuuuuaucagguuuugaaaaaaguuuguguaucuccuuucuuuuccugcucuuuuuuuuuuuuugaauguagggucucauggccuggccuugaccucaccaagauccacucgccucugccuccagaggcuggcauuuuccuuccuggucacuugcuacauguagcauuggguuucucugucaagucucagaaggaucacuccaguguccacuggggagagaauaauccucuaggaaacguucugugccuggaugcuucccgucaaugaccggaaaguauugcuuguggcuuuggguaguuugcuagccuuguggaucucuuugcuucugcuuucucagucugauugcuguguaugguccuccauagucucgaucucuguggcauaggcaccagucaaauuguauuagugucuauccugugacgucauguucaccgacugcaucucuugccagacuguuuccacagaaacuuguguucugagguacugcaggcucguguguugcaugguaaguuuagagaaggcauaguucaccuugcagccccuucuccaacagcgucuccugcacuugugcuaaggcggucucagguucuugucacugaugcucuguucuugguguggcgugcuccucuucuccucucuuugccuugucugaaagccauuugccagucaaaaguguuugagaaguuugcagugauaccaucucacaaauaacccaucuuguaccagcacuugcuuacaacagugaugaaaauuggggaggacucuuuugggcauuuugugguuacagaggucaccagugaauugauauguacaugaauauaccugaggagacaggcuguaugaaugagauguuuuagcaaggaauaguaucaggaaggccuaggaguuuagauaugaagccagggaauuuaauuuggagggcauuuguaguuaggugaguugagcacacugaauggagagcccaucacauuagaccagugaaguuuuauaauacaccucugugugaugauuuguaugugcuugacccagggaguggcacuguuggaagguguggucuuguuggaguagguguggccuuguggguaugggccuuaauacucauguccuagcugucuggaagucaguauucugcuagcagccuucagaugaagauguagcacucucagcuucuccugaaccaggccugccuggaugcugccauguugccgauuugaugauacuggacuguaccucugaaccuauaagccagucccaauuaaauguuguccuuguaagaguugccuuggucauggagucuguucucagcauuaaaaccauaagacagaaguugguaucagggaccgggguauugcuuugauaggccugaccaugcuuuuguuuggaagaaugugaauuuaggaacuuuggauuuggaaagccauggaaugccuuaaguaggacuuaaugggccaaccuaguaggaauauggaagacaguggugcugagggugauuugaaauguguaggccuacuggcccaaaagguuucaguggagaacuuaaauauguggccaagagacugcuuuugugauguuuuugugaagaacaugccugcuuuuugccacugucugaagagacugccuaaggcuaagguaaagagauuuauauuaauuguaucaagaaaagacaucucaaaaaagcccaacagagacuuuguucucugguuaagucugagaagaacauuuuaaacaaacauagcaagcugagaaaggaaaaacauaaaauaugugguucgaguauuaaagggauaccgauggagcugaauccuguguucaaggauauuaaauugaauuaagaaaauagugaccuuguggcaagaucccacccagcuaguuuagguucaggcaagguacaagucuuuaauaccaggaagcaaagacaagcagaucucugaguuuaaggccaaccuagaucagagcaaguuguaggugaagaaaaaguuuaaguccaggcuugguggaccacaccuuuaaucccaguggaaaauaggccugcagaugaaaagaacucaguuuacggggcaaguucuaggacagccaagcuuaggcagugaaggaguuggaaagcagaaagcuggugaugaugcaauagaacaagggggccauguuccaauccugcaagcagccugacucggcagcuucggccauguggcucuggcuuuugaguccagaauagaagggacuacuggaacaauugaugcugguuagcuggagcuaagauaucaguggugauuaagaagagaccuauaucacugaggugaaaucuucugggaagugcguucugagaacacagacagagaagcuguguuccaaagauggccaagguuguaucuccugcugcuguuggacuugguaauauguaagagucacucaggugguacugguuuugaagacaugaggggucaugcagagcagcugagguugacaccaugaagagagccuaugaaaggcuauuggugaagccuaguugcagcggaaaaccccagcauauuguagaugccagaaccaugggaugaccaccaagaacagcaguugcaguggaguggaucuaccugagcuuagagugauacagagugcagagcuggagaagucacaccagcccuuuggaggagccuagaagaggucaugugugaccccagacauugaaauaagaagcuuuaugaaguugccuugaagaccccaagauguuggagaugugagaguugugggcugucugcugagcaaagcugcuaacagaguggaaccagcccaggagaaagcaguuuguugcagucaaccaagaugagaaaagaguuggagaucugaagagcacugacaucagccauggagaggcagaguguggacuuugcugguuuucuccugucuuguuuuggggguuacaguuaagggauugaaugggucucagaugagaccuugaacuuuggacuuuuaacauuguuuauacuacuauagaguuugggaacucuagaaguuggacuaaauguauuuugcauuaugcuaaguuucgguauggcccccauagacccguauguuugaacaaaccugugggggcugggaguggaaugugauggcuuguaugugcuuggccuagggaguggcauuguuggaagguguggucuuguuggaguagguguggacuuguguggguaugggcuuuaauacucuuauccuagcugucugggaguuaguauucugcuagcagccuucagaugaagauguagaacucucagcuccuccugcaccaugccugccuggaugcugucauguuccccacuugaugauacuggacugaaccucugaaccuguaagccaguccccaauuaaauguuguccauguaagaguugccuuggucauggugucuguucacagcaguaaaacccuaacuaacagguacaagcuuguuuugugguuucuguaguuucuuuugugacuucugguuuuauuuuaguggugaguugaguuguuugcacucugguuucuguaguaguuggucauaguugugcauaagauccugggaaccucuucuuguuuccugggcaacuuuacaguuucuccuaggugggggaagcuuaacacuucuccauagaggagccuggaaacuccuuagaaagucuagacacuguuaauuuucauguccacguuagcaugucucuuguuguccuuguucagcuuguguuagguggucauguuggugagaucuuauggguguagcuucugacauucccuccuucccucccuccuaucauaacccaccaaguuuaguuugugcugacuguauacuuguagguguggggauauccacuggagcaugguugaccuaccagaguuuguuaaagaagauuaacccuuccucuucccuaggggauuaacuaucaguagcuccuuguuuagggaugagaacucaggaacccucccuccuccaguuagaauguugaccaguuugcucuuguguagacagccacagcugcugugagucuaacaguccugucaugaaaaagacauuguuugcucuggucauucucaaccucugguucaugucuuucugccaucucuuccauagugaucccuuagccuuggguacuaguggucauaucuguauuccauuuguagcugagcacucuaugcaguuguuuuuguuuuuguuuuuuuccuuucuuucucugagaugggguuucucuguguagcccuggcugucuuggaacucacucuguagaccaggcuggccuugaacucagaaaucugccugccucugccuuccaagugcugggauuaaaggcaugccccaccaccgcccagcacaguuuauuuuuaaugugucugguauuuuuccucucaggacagauagaucauugccugaagcaacaguuccauccucaaguguugauugauugauugauugacugacugacugaaguuggagaggaagaguuaauagcagauaaauacaaauagaaaucuaugguguuuuguauugcauaaaaauacauaggaugggagagagcuccaucgccuuacaaauaugagagaacuaaauucuguucucaaauccauguuuuuuguuuuguuuuguuuuguuuuaaagcugagcugguuuggugguucauacagggaggcaaauacugaagaggcugugacaggaggggcaugaguuugaggacagccuggcuaccugugacaagguguauaguauacacuuguaaacuggagaagcagagaucaauggauccuucaauggauccuuggggcucacugcccagccaguuuagcuauuagaaagccccaggucagugagacucugccuaaaaacaaauaccaagcaaacaauaauaauagcaacaaaaucaccagggugggcugcaccugaggaacacuauuugaggcuguccuuuggccuccacaggaguaugcacucaccuccaaccccuugucacauuguucucugucacccaggagcucucaaacauaaaaaugcagagcaaaagugaugcucuuuuaagucuguauugguagauacaagguguguauauacagacacauacuuacuaacacacauggauuuaaaaaaagaaaaaaaagaaaaaaagaaaaagaaaagaaaaggaaagaaauucagaauuccaagauuucagaucuagcuucugcugauuuuuuguaaaaaguuuuauuggugauacagcugugcucauuggguuuuacagcaguuucugggugucuuagucaggguuucuauuccugcacaaaaaucaugaccaggaagcacuuggggaggaaaggguuuauucagcuuacacuuucauauugcuguuuaucaccaaggaagucaggacuggaacucaagcaggucaggaagccgcagcugaugcagaggccauggagggauguucuuuacugacuugcucagccugcucucuuauagaacccaagacugccagcccagagauggucccacccacaaggggcccuucccccuugaucacuaauugagaaaaaugcuuuauaguuggaucucauggaggcauuuccucaauugaagcuccuuucucugugauaacuccagcugugucaaguugacacaaaacuagccaguacaccgggcaacaauggcaggagugggugauugcaaguagaggcuguaucacucggccuggcaggugaucaagcccagguguuucauccuaaagcacaggagcaacacucagagacucagcauaugugugugugugugugugcgugcgugcgugcgcgcgugcgugcgugcgugcguguguguguguguguguguguguguguauguacuaauagcaguuaaacucagaaacucagcauguguacaugugugcagauguguacauguguauguauuagcagcuaaacucagagacucagcacauguguauauguauauguacuaauagcaauuaaacucagacacucagcauauauguacauguguauguacuaauagcaguuaaaggaggagggagugggaggacacaggaagaguuagaggggggaaggauugaaauuauguaaacaaaguacucaugaaugaaagugucaaaaaacaauuaaaauuuuaaaaauuguuaauuucugucugaggcuuugccaaccaauuuuacaaaaggcaugauccagguuuagagcuagaaaauuaagcuuagucuuaggagccacaggaagugaugugcuuagaccugaacuucaguggacaacucccaucucuugguacagcaucaugaugugauguggccauaaccagcuuugacucugaacugacaaaucuacuuuuccccuaaguguuucuagauaugaauuuaugaauuaauagaaguauuuguaaacuagacaaaauugcucuucaagcccccugcuucaaggaagucgagauagggauuuuccucugaguuuuaccuucuagauuggacuuuuaacaauaauucuauuuaauaauuuagaaacaugcuucauuuuaggccauauuccuucacauuuuaacccuucaauuacuuggguucccagaaacacagugaggauuauugguuauguuacuguaaauaauuuaggcaggauuaagagaaucuccugucagcuaaaaaaaguugaugcucugaauuuuuuauguuaugcaaaauguuaccuugucuguccguccauccaucucccuagcguuaguaucuugcugucuuguacaccaggcuggcuuggaaaucacucuguaaccaagaaugacaugacacugaugauccugccucacccuccagagugcugucacuccacacgugugucgcuguuguuuauuguuguuuuaaguuaaacaguaccuucacaggaauucuugucauagacucccgagagaccuugggaaaaugugaaugucugacacuacauagcugugggugucuggcguguuucagaagcgugccccccccccccaaucuuugggauaaauacgcaucuuuauaaccugaccuugcuauuguaaugaaaauggaaagauuuaaaacaaguaauggaggcaugcccuagucuucugaugcaaaucauaacuuacugugguuaaccccaguaggcuuccuugaauucaaauauugaaugaggcaggcguauguacaguaaauugagauuaugcagcuugacuugaagaugcacuccagcuuuguucuugccugcuuccccacuguguguuuguguacuucuucaggaaacaagcuaccaucucagcuccagaagcauguuucuugaggacuuaggaucagucuagguucuuaccugcugugcccuugacuggugucuucaagaaacacagacugacaucucugggaaguguauugagauugguauuucuguguucucgguguuagccaacugguauaauccaugugccguuccauuggcuguuaaauaacucaguuuuacaguuacagagcaaaauguggacaucuuguagcaaaaaaaguaccugcaggugauacugggcuuuggaagccagucauugaaugugaaaagagugcagaguaacccaaagcaagguuuuauaagcagguccuggucugccacucuguaauuguaugguauucuauuggcuggauuuugucauauggccaagcugggaauguagucuuauugcaacagucaagaaaaauaaguacuauugucuauccugguaucuugauggauaucaucaccacagaugucuuaauuaaggugucuauugugauaaaauucuauaaccaacacaguuugggaaggaaggcuuauuucaucuuaaaacuuguaguuuaucacuuagagaagucagggcaagaacugacgcguaggccauggaggagugcuuacuuaugggcuugcuuugccugcuuucuuacaguacccaugacugccagccuagggguggcucugcucacggugagcugagccuccuacucagucaucaaucaagaaaaugcccacaggccaaccgaguggggccauuuuuucaguugaucuuuccuuuuccaaaaugacacgggcuugugucaaguugacauuagcucuucucugauuagcuuuuauuucaugcuuucuuucuuucuuucuuucuuucuuucuuucuuucuuucuuucuuucuuucuuucuuucuuucuuucuuucuaauguaguuccuaaaacuccuucccuaauacuauauuuaaccuuugaggagugguuuccaauuacucaauuuauauaugauauaguccugucucagggauacaacagaaacucagccccugagccagaaaugaguuuaagggcaaguuacaaaucaggccacagagcagauuggagcucuggagacugugaagaggcuguaagugccugacguggauuggcucugcagcgccuccuguaaagccuuguuuucagggaggaacaaaugggaagacgcaggaacuaaaagagagguauagugagaagggcaugcccaugaugcccuugcagaagcuuccggaacccacuuccuucccuuucucuuccuuuucuugcuguguuaggcacagcugugaucugucugccaugugcucccaccgugaaacaccaccacagguccuaagaacugaggcuaaaauguucagaaaccuuuaagacugucaaucaauaaagaaacucuuuucagguucaaaguguuaggcaauagaaaagacugggucaagccacgggacaggcagcuuaggaugccacaucuggcucugucuccguacuccuuguaacucuggcuuugguaaugaacaaacgguaaacagucugguguuucugguaagaauuuagagguuuggauagauauuccucuaacacgcacacacagauaaaauacuugaguugguaugagaaaauucaggaccaucugucacucaaugaagaaguaagugcccuguguggcaugcuuagcugauaaauccuguuccucuauuguaggcauggcuuuccuucccuccuucccaccuuuuggcucuacaagaaggguguccagauuccaaauagccccauaugauagcaucuguaugcgaguguuuucuauaggccaaguaugcugggcuauaagauggggacugcucuagucugcauuugccguugaccuuuuuauauacguuugcaagguucucuacaucacagcuuucccuuuacagugaugucagcacaucuacucauucagggacugucccuaagaguggguaugacaguccuugcauaggaaucuaugugagcagagaaguugugcaauguuuuuggugugcaguguuuauaucacuagccuagggaaguguaggauucccccaaggagugcccuauucagcccaagucugcacaucaugggcagggagccacaguugcucuuucuuucacucauuagcucauugucaccuuuaaggccuugcucuuuuguaguuccaaaaugcagagacaaauaacuguuaucauccuuccuucaaggguucugauucuauuucaagagcauaaugaugacuuuaguacgcuugcucugggagcugagaacaguguccuaagggaaggaugguacugaguuauuuaguaagguucuaggagaaguuuucuuaggauaacaucuaauucgggucucaauuuuuuuuuuuuuuaaagacaggguuucucuguguagcccuggcuguccuggagcucacucuguagaucaggcuggccuugaacucagacauccgccugccuccaccucccaggugcugggauuaaaggcuugcaccaccacucccuggcucaaauuuugaguucaaaauuuuuggaguagaaaagggagcaggcugcauauucaagacguguccugccagacgcuguugcagagcagcaagaaggucagugugguugagacagaagugcugggagauagaacagagaggaauggugggaaguggggugggagaggcgugagcacuuagccugcaggcucugggggcuccagguggugagauuuugagacuucugagaacaucaauuuugauagcaauccugagaagcaacugggggcauggagccuggguagaagcaguuuggaccccacuguuccagauaagguuuugacagagaugauagaaguaagcuggaugaggaaugagagagagagagagagagagagagagagagagagagagagagagagagagagagaagagagacuguguguguguguguguguguguguguguguguguguguguguuggguagaaggaaaagacugaaaaagaccccucacuuggaugguggauggaggccauuuauagaacugggucaaacuuggcuuuccugcuugcuuuugagucccugaagacucaguuaaauauaguaugccaugccuugcagcucaggcuggaguuugcuuuggaagcucugcuguagccccagacagccccuaccaaugcacugaguuguacuaaaggaagaccuguuugucuuuaguguagauuguggagaagacaagagaagggaaaugcuagcacucguucucgcuacuguaccugucugguuucuugugaacagccagcccuugggaucugauaacuuugauuugcacaccucccacucacacagagggacaugcagacuuucuggaggcccaggcuuugcucaccaccuucacaguuauaccacuaaugauagaccuuugccuacaacaacaguguccacguagcaagcaaucgcauuuuaaaauuaauaauaaauuaaaauuaauuuuaauaauaauuauauaguuuacccaguauauuuaaaauauauuauuuuaauaucuaaucaacuuuaagauguuaaggaguaaugaaguuaaagaaguuaaugaaguuuuacauuuauaacuuaucuuggucugaauagccacacagacugugagcuauugggcagugcugagugucuggcucagggcuuagugaaugaacuguucaguagaguuugcuacaaagauuccaugucauuccgggauguuugcuuucauugugaagcaguugaauguuuugcuguacuuaaguaguaguuauauguuccugggagcucccaggauccaguacugacugcgagaggaaguccugggggguugugcaggaacgacacagggucugcaguugcugccuuccuucugaugaggacauacaugcuucaguuacauuguaagagaauccacaguccaggcuguuggcauaaacacauuguuuuuguugucauuggguuuuguuguugauuuuucaagacaggguuucucuguguaauccacccuggcuguccuugaacucacucuguaaaccuaggcuggccuccaacucagauccaccugccucugcuguucagccaacaaaucguaacuacuccuugagaacauuuuauauauguacaguauuuaaauaguugaggauuuaauuuuugaagguuuuaaaauugaguaaggggcagaauucuuagugguuagaguagcugcaaagcccuggguacaaaucccagagcuccuccugaaaggcaagacuguucacgagaaaaacuaccuuuuaaccugggaaguagaaaaguuggguuuggugugugccagaauuuuuauauuaguuaucauucagcuggaaagaaagauuuuauguauuaaagauuaauuuacugaaucugaauuuuagaauuuacuauauuugauacuauauaacaugcauuugaauaaaagugagauaaucuuucaaaaauuaucccuuagucuuugcacacuucaguaauuaugucuugugugguuccucauauacuugauauaaauugcugugaaucaguuugacuaacaauuucucuuuaagaauaacacaggcccacaauaucccaauauccucuuccuccuccucuucuuccucuuccucucccuccuuccuccucuuucccuuucaagaucugggauuagaggagcaugcugccaagccuacucaugaucacuuauuugaucauaagcuuccaguggaucaaauggauuuguagaaaagugauacaaagacuucacaaaucuuugagauuagugaguucauauuuccaggugcuacuguaaaugaaacucaagaccaauauuggaagcuuuguuguaauaagugggaauugugagggccauagaguuaauugaaaacaucggguuuguuuguuuguuugucugucugucuguuuuguagcuggcaacugaauucaggcccucugcaacaccagugcauguccuagcuucugaguccucugacugucucccuuauugugguacugaaaucuucuugguguuuuguuuuaacaguuuuaacugucuuagacuagaaaauguggaaacugcuaugcauaucagaaaguggucuuugaauuucgggucaggauacaucuugggaaacaccauuacguaguggaguuguuuucugacuugugcuaaucaccauuguuuucuagguagucugggcucagagguguguccuguugaugcacucaggcugucaaguggacuugaucgacuuucaugcaucuccccuuuucugcacuacuagccuuacacuuauuugcagucucacgcuucgguuguugaauuaaaacacaaauucucucuguuuucuuaccaaacccuuuaagcucaucguuucuguuauuuuagucagaaacagggauguuuagaugcuguuaacuuauuagcccauuucucagaugggaaaagguggcgaggaucuagcugacuuacccaguguuacccaguugcuaacuaauaaguuggcacauugacuccagacaccugagcguugggaugcuugugugcaucuuccugugcguggucucucgcccgcuuuaacaauccucgcuccguacucuuugcccccaauccuuuucccggcaugcccuguauuguagacugaacuucaggaucucauguguauguuacguccagcuccaccacuaagcuauacccaagccaccuugcaucuccagcccggaacuguucuguguuuaagaugcugcuuaaaagaaaggcagcugcaggugcagccugaggcuggcugggaagcacuuuggaguucuguguucuucacaggacagugagcugaucagaagauucaggacuauuaaauaaggccuuuuaucuuuauuuuuuaaaugugcuuucugaaacgugugaaugcugucuugcuugaaugcuuuuuuaaaucucucuccuauggccacagcuacccacauagguuuugucuagagcagaugcucuguugacagucugucugucugucuccuuccucuaccgugacucaguaacuccuccauuucuuugcagauccagcagcccucuucucuuuggaggaaucuguaggauuucucaagaacuuucccagcaguauuuuuaaggcaugguagagacugagggcucuguaaauagucuugcucugccucccuaggaggugcugccaagggacuugcuucuuaguucucaccuagagauggagcugcagcugagccuucacaggacugcucugguucuguggcucaugacacaguuuggcaaaaguuagaguuuaguaagugcuuuuacauuuuauucuuugcuuuaauucuugauagcugugcacagagcugugguaaagugucauagaaacccauguuuuccguucuuuuguuaucaagaguaaucuuaguauguagaaaugugccucuugagagggaaaggacacuugguuguuacagacuuaacuuagaucaagcaguuccacuugcuuccccucucgugugguuuucagugguguccaguuaagagcggggagaccauguuagugacuuuacuuguaucuguauuuaggauaguaugcagccuuuggacagcaguaguuucuagauuaauugcacgcagcguuaacugcuuuuguguaaugaaugugaagagggugacauuuauuacacagauagacuuuuagugaguggcuuuuauucugaaaauaguaaaagcauuauugugcaauuaauuugguugguuauguuuauuauuuauuuauuuauuuagaugggucucacuguguauaucccuggcuggccucagacucuguagaccaggcuugccucagacuaaaagagacccacuugccucuaccucccaagugcugggauuagaggagccugccgucaaguccacucaugauuaacuuuuaaauuaucuuuguucagagaaauaaccuugucuuuugaaugguuugugauagaaauucuguaaaugcacagguuuuaauuugaaucguuaucccaaaugauugccucauuggauaauuuuaaguguuaagcuauaauucaauaaagacacaaauacucaacuggcuuaaaauacauuguuuauuuaacaccuguuuaguuagaacuaaacaagaguuaaaaguaugcacauagcuccauuuguccuugggaugaagaaggaggcauuguuccccccuuccccucuccuccccuccccuccccucuccuccccuucuuuucuagaaaugagcaugcuguuugccaccaaaagauggugagcacuuaguuaggaaguaaggaaacuugaaaaaaaguauucauacauuucuuggaagccuaaggcuuacuucguuaagacaauaagcaucauaaagccacugcuacaggggcuggugagauggcucaguaaguaagguccugaguucaaaucccagcaaccacaugguggcucacaaccaucuguaaugagaucucaugcccucuucuggugugucugaagacagcuacgguguacuuuacauauaauaaauacauuaauuaauuaauuaauuaauaaaaaaacccacugguacacaguguaacuauuuuucuuuuauuacauuuaccucaaauuuaaaacaugauuauauaaguggacauuauuccaauuggcuggcuuuguuuuuuuuguuuuuguuuuuugaaaugggaacuauuucuaguauuguuuuccuaaacucugaggccugucagucagucccacuuguuaccauggaaaggagccucccuuucaugcuguugucuucaggccggggacaugcaggggccucuguggcugucauucccgagcuaccgugcagacagaauggagaggugcugcuugcugagcugcacagcagagcugcauugguucuggucaggccucucagagaggcuggggaauucuguuugguagguuguuuuguuuuuccucagacaguuucuauguaucuuugucuaucuuggaacucauucuuuagaccaaguuggccucacacucauagauccaccugccucugcuaggacugagcgugugcaccaccaccugacaaagucugucuaucagccuuaaucuguuuaccuaucuaucuacuugacuaccucucucucccugccugccugccugucuaucuauucaucccuaucugucugucugucugucugucugucuaucuaucuaucuaucuaucuaucuaucugucggcagugauggaacuccuucaaagcuuacccagagacauggcguuucuuggucugccugucuuugauucccauaucuccugcccuuuucauuccuagugggugcagacuuuuacaugguuuuauuucucagauguuuuuagaaguauagcuaucaucagaaaacauuuucauuucuccacuuggaguauucagugcuaucaacaucuauaaaaugucugcugggagcuggagagauggcucagugguuaagagcacagauugcucucccagagguccugguagcucacaaccaucuguacugggaucugaugccugcuuccggaggaguguccaaacaagugaauaaaucuuaaaaauaaauaaauaaauaaaaagacugcugcuauuaccugccuuauauuuuugcuauuuaaaaauacuuuuagcauguuauagaaaacacagguuugcacaugugaguucugacaguacaguaauuaaaaauuaaguucuuggggcuggcgagauggcucagugguuaagagcaccgacugcucuuccgaagguccuggguucaaaucccagcaaccacaugguggcucacaaccaucuguaauaagaucugaugcccuuuucuggugugucugaagacagcuacaguguacuuacauauaacaauaaauaaaucuuuuuuuaaaaaauuaaguucuuggcuuccaaucucagcaguaaggaccuaguuuccccuuuucaggagguaaaauuccuuuagucaugaggcuaaauaaauuuuucuguuguuuagcuuuuaguauccuacagugucucagaauuaaguacaagugaaauaagcaguaaauuaaaugcagacauuugcaugcuggccucagaguaucaagacugucgucugccucccgucuuugcagcugucgucucagcugcucuggggcucagcacacgcacugcucagcuguacucuggggucugcuccuggcucaucccugggccaugaccgcugugcacuuuauauagauggaaugagcucuauagaauguuauuuuugcucacacaguugucuuuuagaaguauuuuucuggcguacuuaauauuuccauguggaucuuaguuucugucuagucauuuuccuucuaugaaccucccuaaacauuuuuaguguauguuugauguugacaaauuguuuuguuuacuggaaaacuauuuugcugucauuguuaugaggauauuuucacugaauuauaaauguguuggcugcaggucucuuucuuugguugccuugaucguuuccuuucucuugacggggcgugguuuuccauaagucagugguuuaggaacaucucuggcuacuuuaaugguuuguuuucuucauaauuuauuucaacaguuugguuccauguucuuuguauuugcuuuucccauuaauuuucuuuuuuacuucuucauuugauaaguuucuguuaccaucaucaucauccuuuucuucauuggucuucccuagugucugaucaauaucagaugacuaaauucuucauuucuagaguuuccaugugguccuuucauaggucccaugacucaaggaagauacacuguuuacaguagcaguuuguguguauuguuuuuaucauuucuuguuaauagaugcuuaugccucuuacaguuuccuguguuuuuuggccugguagauuugauuaaugugacaguguauauguugggcuguugagcaucuagauuuugcaguccuuguugaguaagauuugugucuucauccuuuuagauuuguuuucuguguuaagaaggucaagccuuuauuuuaugaucgaaccaggugaagccuaaaccuacaaaacaugguggucuggcuucuguuggcuaucugugguuguuuaucucgguuaauucacucuaggugagacacagugucaagcuggucugugagauucuucugauauuguuuagcucacagcucuuacagacuuuuguugccuagcuguacgccauucuccauuguuguguagcuuggcuaagaugagagucuaggaugaugacccauagucaucgucuugaguucuugauugugcugcacagcucaacagugcugccauauuuuauuugcaucugacacugcucucucuguagguuccugcagauaggacagagugacugugagacucaagaucaguucuuuucuuucaaugaucagagacuuuuccaacacaucugaaaaccaauuagguguguguuggcugguucuguugucauucaugaugaaugaguucucugguaacagggaucugaaaguggucagaaauuggagucugagguguaggcuuucguuacaucccacgguuacugaggacuuggucuuugguucaugagugucucauacuaauaaucacaggcuuugcaauggucucauaagugauuuugucguuucugugcacagcugcauguccauguguguauggaugugaaucauauacaacaugcauuggccauuguaagucaguucauaugucuuuaagauugcuuuuguuaaauaauccuuguuacuagauucagcaaagccgcagucgcuguauaguguaaucuuaauauagauuucccuaacaccagcagcugcagagcuaacuagaccuugagcuguacuggccuggagagcagagcaggagcugacgcgacggucugacagccucucuccuagaagccugcuccuuacucugacucuugagcugcauuuguagcguaacuaacuccuucacccuuacccuucuucucucccuccccuucucagcuacuucuuuguagauccaguuugugguagacucagucauugaaaaacugcuuaguaaaugcaagacauguaccacacagcauguuugauggaaaacuaaccaguagacucgcccuggacuuacagucaccacccacuuacucccagaccuucauuucuagccauugaaagcacagcuggcugcucugacauguuuccuacuuaacauuuuguuagcauuaauuuuguaggauauuccaugcaaacuuggcuguuccugguguuuauuaagcauuuuguguuacaccuuagcuucagagauuccauauuugugugcucuaauuuggguuaauuugaauuacguucauuuauuuguucuguaguauuguucucagguuagcuauacauagucuaaucuaauguagaacaaugcagucacuagucuucuaucugcacauuaguaguagagaccuucagggucacugaguauggugugcaucagacacugauuaggcaugucagugucugaggcaggugucugcuuguucccuuuacacucacucaggucuuuuccaggcucugugcuugggucuguuugugggucugccuuggugagucagaccacauucagccccacagucugccaauggacuguuguacacagccaguguugcuuuucaugagggaccugcuccguagccaccggagcucugccuugaacacaucgacugacacuuaguuuucaagcuguuaauuugacaauaaaagcuuaauggaguuuugaaaguuaaaacuugcuuuugugguaaaaaucaauuaacaauucagaaggauuugaaagguucucaaauaggaucuuauauauguucuucacuugcuuuugugguaaaaaucaauuaacaauucagaaagauuugaaagguucaaauaggaucuuauauauguucuucaguaauuuaaaaugaacuuugaauaacaaugugaagaauuaaauauuacaacuuuaucagguaacgauaucauuugauaugcuaauauauuguuguuauuagacuaaaauaguauaguuacuuguucguuuaaugggaugaggaucacuuguuaugauaaguauugaguugaaucauacaaaauugagcccaaaggaagcuaaauaccaacaauuuucuaugguucaaccuaguuuuucauuaucauauuguguccgcuaaaagaugagcaguguucacuuuaacuugacaucugaguguaaauggaugguacagacguuagggagaacacacauggugauuggcucguucagucggguugagagaagugucuguacccgcuugucugggauucuuacagcaagaaaggaauagugaauggaugccuuaaauaguucuugugaauguuggauauucauuuuagaggagacacaaguaucugagggcuagaauucauugcccuggguuucaugucugccuuuucuaauuacaaauuuggcuggagauaagguuguuuuguuuuguuuuguuuuuaaggaaguauaaccuuucgguuagucagcggacuccaguguucauuuuccuuuucugcuguggaaauuagaaucaugguuucuagcuuaccugagcagugaaugcugacuguucuguucccuguucucuccuucccuccuucccucccucccuucccaaauugccagaccugaguuuuguuggggcaauauuggaagaguguagggaaucuagcauccuugaauuaaguucaguuagguauuugaguaucucuuugcucagcucuuggguagccagugaugcuaguugcuagcacugugcuuucuccgauuuguacuugaggacccaauuaguuggcaaggcucuucccaagaauucauacuauaugacuuaggguucuugaauguugagaauuucaugugugaaaauaaguauuaaaacuuguuacuuuuggauuggugagaugacucaguggugccaaaucugauggcaugaguuugaacccuagacucacauggcacaaggagagaaccugaccucuguagguugccuucuacucccuggguacacugggcacaggcaugcacaaccacaaagggaaaacaguaaauaaguguaauauuuaaguugcuacugcuuguuauaaaaagcuuuuuagaggauuuucucaaaagaaauuuauacucauuuuuaauccauguuuucuacuauuuuacauauauaacauagcuauuauguugaaugaccauacuuuuuggucauuacuaaggcuuuuaauauuauugaauuuuguaaagcacuaguuuaaguggcuaagguacaucugaugacacguaugucaggcugugagcacuaucugaacuugcuguguguucccaggaggagagacuucagcaugcaaaccuucaucuguccggcuugcaccgucguucucauuccaugcugcuggccuucagauggcugcacagaugccccacucacaccaguacagugaccgucgccagccgagcauaagugaccagcaggugucugccuuaccauauucugaccagauucagcaaccucuaacuaaccagguaauuucauuauuaucagaaaugauguugaaauuacaacuuagcccuuugaaaauacuagauuaguaaaacagcuucaguuuuacaugcuaaguagaaauaucuguagacaaaacaugaugcucagaaguuuuauuuaaguuugcugauucuccccaccccuugaacaugaguguuucauuucauugaaagauacucauucuggaauaaagaaauuauuuuuaaagaagaaauguuuaaaauaagaaaacauuugugggaagucauaggaaaguaagaaucacuacuaauuuaguguaaaaaaucugcauuuguaaaauuacagaggaaagacucaaaggagaauauguaaauauuaagcaugcuauuuauucuaauauucagacuacagauugaccaauuuuucauaaauugaggaucuagaaagaaugcugaaaucucugugaacacauuaaacgcauaccuguggguaagccuuacaggcuugaauucacccugcccgaccguagccgcuguuuuggggcagucuacucacuggucauguuguguugucguugugcugaguaaggaacacaacuguugugaacagauuuaggauuugguuggcauggcuuucucagaucccugaguauagcaagugguuccuacgcggaugaguuaggugagaugugcuuucucuucucgagcagcuugugguggcaaugaguaguuggcugugguugcaugucuguggugugggcauccuuugccagaggccucucgcaguacgcuugcaaagcaccgagugugaacagcagcauugugacaggguuuagaguugguuucaggcagucagcugcuuuagaaguuaaguccauguguuagaauugaagucguucaucagcacugcuguucaaguuuagaaagcucuugcucaugucccagagagaaacagaaagugagggaaguacagaguacacggucaaccugaagugugcgccgaagaaccagggugcucagggcuagucucccacuugcuucaaaucagugggucacacagacauugcuuucaauacacuuucaguugaagagacagaauuuccguuuuugacuucuugauguaugugcauggugguaggcuuuagaguccaguccugugugcuuccuguuuagaugcagcacucuuggauuuauaucggucgucauuuacagagagucagaaaaaaauuccuauaacauuauuuuuuauccauauaucaugauuguuuauaaucuacuuagcagaguaucuguuuucauauucagcuuacaucuuuaaucauuuaaaauauauuuuauuauuucugauuuaagccauaaaauacuuuuaaagauucaugugauguaaaaagacuauuaaguagaggcgaggaguauugcacaugcuuuuagucccagcauuugggaugcagaggcaagcagaucucuaagucugagcccagcuuugucuacauagugaguucuaaaacagccaggacuacaagaacauacacaaaagcuuauuaauaaauaauucaguauuccuuucaaaguccagaagcuucugaaucuaaugaagaagguagauucuuuaggacuaaugugggguggcuuaccaagagguauauaaugggcucaagaucugcuugcaggacuagaguuaaauacacacggacaccucaugucugacagguucuugaaugugaaauuaggaccuaauucuagaccuucuuagauaucuucuagcugucaucuucuguaaauuucauaaugugauucauaugcuucuuaucauuuugccacaaaaugaaucuuauugugcaauuaccuugaaaggaacaaaguuaagauuuauuucuagucauuaauuuuucucaugaguauguuggguauaaaauauaaaagguuauauuugaaaaugaaaauuagaauaaaacugagcagagaugagugucccucacauuggauccuagagcuguaggcuagcccagcccgcaugcuauccuuuggcauccugagcuacagcagugcccugaaugucauuguaagugcuguucuguccaccucuugcuugcucugagaaaagcagaaaggcagaaaaugcucucuguuccuuauggauggaaguaggaguaauguaaagugaaugaaauagacacuaguguuugaguagaucucaccacaccugcccagucugugcgaugugccuugugugugugccuugagggcugagcauucggcauuggguaaccaauccuuccacuucgagcacuccuuagcugcuuguggugcuuuuuggagguuuccccauucugugugucacaugcauuggugguguccuuguucggcugcacuugcucuagagcauugauugaggcagcacuccauauucucacuuauaaauggugacaggaauaguucacuuauuuuuauaagauuauuacaaaguaugcaugcuuaaaauuguuuucaguagauaucugcuguuaguauuguuuuacuguuuuguuauuaaauuggcuuuccgguaauaccaacuuuuucauauaguaguaauagaccauuucagugguguguguguguguguguguguguacucaaaucgaggcugcauuuuaucaguucaagauagagacucuuaaacauaaguuacuuuugugaaacaauuccaggaacuuaaaagggaagaaaaaaaacccuauuaauuaaaccuaauuaaagcuuuuucauuacuuuaaaugcuuauagcauuaguuuacaugaaagaauugacauguuuauuacuagaauugucuacucaacaaauuaaguucccaaggaauggguuuuuugaguuauuuuuuuucccuuuuauauuuuaagaaauaaaacauuugggaaguuaauuaagucuuguuaauuaugaagcugguggaguugaguaguuacagucacugugguuagcuccuguuagguuuccuuauugagaaagaugaccagucgcucaguucacugagguuaccgcuuagauggcaaagguuuaggaacuugagcauguggggacuggugaguggcugucaguaaagcacuugccuugaagcacugguuuaguccuggcauucauauagaagugguggagugagcuugucccagugcuggguagacugagaaacauggggcucccugaggcuucuuggcuagcugcuaaguacacccuaacuaaugagcuccaggccaggacaguugaaaggagguagaccauacucuuaccugaggcucucccuugucuaccacaugugaauuuguucuuucuauaaaaggagcagguacuuagggaacuuagacccauacuuccuuagcacccacaacugcaguuuuagagucagcuagguuaagaaguuacaggcuggggcuggugagauggcucaguggguaagagcacccgacuccucuucugaagguccugaguucaaaucccagcaaccacaugguggcucacaaccaucuguaauaagaucugacucccucuucuggagugucugaagacagcuacaacucacauauaauaaauaaauuuuuuaaaaaaagaagaaguuacaggcugguucagugguuagguguguuuuuaucugccugcuggaaaccagucaagccuuugaaauaauucagaaaaagaaauugucauaggacuaauuguaguagagaaaguaugugggucaguaucacaugucuacaagauuguggauguaccuauaauucaacuguuuggggaaaugguccaaacauagauauccaggcauauuaucuaauuuuauuuauuugcucuagaaguuguuucccuuagaauccauauaaaagaaauaacuuugagaauguauaauuuaauacaaauguguuuuuuugauacauuaagucaacuugaauugaucuugguagaagaagcuuuacuggguuaugguagauuggauuugacuacuagauuaugguagugggaacuugacuaggcugugguaguggguguucaauacugacugcaguguaguuaaacugcuagucucucugucuauuuaaggugaugccugacauugucauguuacagaggcggaugccccaaaccuuccgugauccagcaacugcuccucugagaaaacucucuguggacuugaucaaaacauacaagcauauuaaugagguaagaguauugauuugcuauaguaucuuuauuuucaauagaucaaggggugaguuuuuugaugccccucuagacaacuaaauguguuuuauuucuaauuaucauugaauuauauuauucauauaauucauaauuauucagauaauuauucauaggacuaauuguaguagagaagguaugugguucaauaucacaugucuuuaggauuguagauguaccuauaauucagcugcuugaagaaacaggaucuuucguaguuauccaggcauauuaucucccaauuucauuuauuugcuccagaaguucuuuuccuuagaauccagauaaaagaaauaacuuugaaaauguaaguguauuuuuuggaaggagcuuugaguuuuuaugaauauuauaaauucuaauaagucaaugauuuauagguaauuacaacaauaaaaaauguauuagcaaaggccacagauuagaaaguuguggcuaacuuccuuuucaaaggcauauuuaucacacugagcuauuucuaaugcuuuccucagggcaagaaagaaggacuaauaauuacaaaaaaguacuuuugcuuaaauuuaaaauucugacaucauugaauguuaaguuaaaaggacccgcuuuauuucaucuaaucaaaaauucugucaugucucuuacacuuuucuaaaaaagaaaaauauuuccuuauuuuaagacaggaucucaauguguagccuaggcugaucuugaacucacagcaguccuccugccucagccugcuggauuacagguagaagccaccaugcuugacuguauguguucuuuuauccaugucuuuccaugguaagauaucaaaaaaauuauauuggcaaauaucaaaaaagaguuguacauugaauuauuucuauuguaacuuggcuuguugccacuaaauuauuuucuguugcaguguuuggaccuuaucuguuucauuggcauuugcuucuggucaacucuaguuuuauaacuaaguguuaagugagaguuuuccaaaagagcguagacaaugcccugccuccccacuggagccagugugcuagagagaugguggugguguguagaagcacucgcugcagcagcucaguuccauucagccugcuguuucagcagugugucaagagaaaguuagaaagccucaagagugcuccugagguagauguauacauacuuguuuauuauaccuugugauuaucuggaaguaucugggacauuguuucucacagcgugucaaugucaguuuguuaacaugugaugaauuguuaucaaacuaaguuaaaguguuguuaauagcauucuugcugaggcucauuuaucagcagucuucacaguguaucaagauaccaguuucuuggaauguuauuguugucaccccauuagcuuucauaacuaagcuauaagaaaaacuugcuuuucaauugaccacaaaggcuuaaggcugggaaguaugaagacagaauagguaugguuuuuauucauuauuacauucuucugcacauagaaauuagaugauuuuaguaaaauaucaauugauugacauuuaaaaguuguauuuuaaaaaaaucuuuuacuguaagauaaaauaucaaauuaccauuaccuggagaagagggcaagaaagaccuugaacauugaguucaacuuugagggaaugaaauguuacuucuuuuguuuggggguuccuuguguuucuaagaucuguguaaucccacuguaugcaaguuaugccauacacuaacaaaaguaugagguacuuugauucuucauuaauggaauacauuagaccagucacuuaguauaucuuaucuauaaguacaucugcaguauagcgcuacauuucauuauaaacaugucccuauugguuauguuuuuguauucagauaucaacuguugaaggucuuuauuuuguuucucauuuuuuauuuaaaaagaaugguuuauccauuucauauugauuuguugggaguauacuuguaaaauacauccucaauagugauuuaacucauaguuaacuuuguauauauuuauuacagguuuacuaugcaaaaaagaagcgaagacaccaacagggccagggggacgauuccagucauaagaaggagcggaagguuuacaaugaugguuacgaugaugauaacuaugauuauauuguaaaaaacggggaaaaguggauggaucgguaugaaaucgacuccuuaauaggcaaagguucauuuggacagguaagucuaucaguuguucauuguuuuagauggaugccuucugggcucugggcucugggcucugggcucuggguuuuaccaugcuuccggugucuccuuccuguccccagagcacagcauugauuuuccucugcaugggugacggcaguggguuuggcuuuucucuucauucucugaacccaguguuuuccugucuucaucuaaacaccuagacuccgugcucucccacaagugcucauucccucuuuugucuccauuggaagcggucugcacaggccuuguuccuucuucagcuuucuuaguguuagauggcagcaagcugccacuucuugcacuuguguaaagguuucuggcuagucagugccacccugccccaguuacuaagcuguugauguuagaggccuggauuauuguuaccgccauuguuuagguaauuacaugugaucuaaauguacuucuuacggaguacaguaaaguggagguuaaagugacgucucaugaggcuccccugugcuggugucgaucaaaaaccaacuguacagcugguguagaaacccaagauagacuuacagucaugcuccguugaggcuccugcaguacucgagaccaugucagaagacagacgcacaccuaugagucugagugugauuacguaguagccuugagggaaagcaaaauauauucuucagcgagugaggugauauucacgugucacacauaauugugcuaagggcaaaaguacauuguugguccuagcagucauagacugaaacuuaggagagggcuggaaacacagaggcagcucugcccucaccauugagaccuccagcacugugcagcaagaccagagucuuagggcacguguguaucugcuccuuucuacaccaugaagaagucugucaccuuuuucuucugagucaagguuuucauaauauuuuaguaaucccucuuuaucaauuuuucuugaccgucagaagucuucacuuuucuauaaaacccuuaggaaaacacuguugcggccugccucuuaacgaggguugggaaccccugcaaauggaaggagugcgguccccacucugggaacugcuccagcaucugcacaucugcuccuaguaggaccuccuccucugcuccuaguaggaccuccuccucugcuccuaguaggaccuccuccucugcuccuaguaggaccuccuccucugcucccucugccgugggagcucuggcucugcugcucccucugaccccgcagcgccaggccgguucuuuccucucuagcuuagccugcuugucucucucucucucagagcagaggagcacaguguggaagcgugcacacauuuguucuguuuaccugacacgcagagauauguacugguguauguucauagcuaggaccuggcgcucaccauacggaugcuaccaaauuuaucuaaauuuucaguuggggucugucaaguaaaggacuuuucuuacuucuuuuagccauuguuuauuaguccuaacuacacauugaacauuuccagaacuacauuuguuccauagaccuuuggcuacucaccugcugcuguuacuaaacucggcauaguuguugccaaaauaaaagaauaucagcacugcuuggucacguguuuaaaggcguagcuucugacauaaaaaaggaagcagguacaauguucagaauugagucaguuuccacucagcuguguaggacaucauuuccaguguauuugaccuugagugauugcgauuguggagcagacuccucuuugcugauacagugguugucagacuucacuuuggggccuuuuuagguucuuuuaccuccagacuuuuugaaauguagucagauguauuuaggaccauggccuauucagccuacugugcugcagauggguaauguguucgucaggucuaaccuuuguguuugaguagaagaguuuuaaaacaucuucuaauuacgacauucccucagaguacuuuacugguaacuuuuucauaagcuaauucucuuacgucguuguuuuuguguaugagaaucuaaaauuagaaaauuauuugcuuucuaagaaacaucagaaccuuuuuuuuuauucuuaggacuaaauaaaaauuuuuuuacauuaaaagaauaguugaacuggaaguggcaguagauagcaguaaacccagaacuggagagacaaaggcaggaagauaugugacuuugacuccagccuggucuucauacugaguucuaggccauccagggucaaacagagagacacugucucaauaauaaaaaaaacccaauagccgaguaaguuguuuuauuuaaaaagauacacauagaugcacacacacauacaugcacacacacacacacacacacacuuugauuuuaguaagaaaaagugaagguucaacucagccuucaucaggcagcagucauuuuguuuucgagggaagaaaacaguuuccauuuuguuaaguuaugugaauaguuagaaauacugcaggaaggauacaagaggacauucaauuaaacaaaauggauuuagcugccuugugguaaaguagaugaucuguugaggagaagcagcagcugcagaaacaucagaaugcaguuaggugagaguaaaguagacucgaggacggaggaggauguaaacagugaggcuguuccuagugaaacugaugauaacuuguuuuguuuuguagguugugaaagcuuaugacagaguggagcaagaaugggucgccauuaaaaucaucaagaacaagaaagcguuucugaaucaagcccagauagaagugcggcugcuugagcucaugaacaaacacgacacugaaaugaaguacuacauagguaagggcucaucacgaugccuugauuucagugggccugaccuguugaagaacauaagccguuucagucugugggugcuuugcagggugucuggggggacuguuugaugguuucccaugucacaacucacaggugcccauuguuugcucucaugugucuuuguccagggagccacugucaggugacuugcuagugcacugugagugccuaagacuuuuuaaaaucugucugaacuucccaaacuuuguuagugagguauuggccucauuauagccaggccacauugagagcacaccacaacacacucacccuaucuccccugcugcuuuacuucuggucuucccacaggaaggugaccugagccuuagauuagagaaaaauuccuuucagugguaaacauaaauggucuuggggcucuguagcuggcaucugcaucagcuccugcagaguccuaucucaguguuuauuccauugucaugccaucuucccacaggaaacaaaacagccggagaauuaagacuauugggaacuuaagagagcaguugguuuacagacaaaacuccuucuaauauauguuuccuacuuuauuucuguguacauacauacauauauacacacauguguacaaguauugugaggagcaacuguaguggcuguggggacaggugugaaaggacaggguagagacagaguucugcucucacaguacagaugcaccacagcaguccugaugacaaggaaggauucugucuucuuauagagaugguauuguugggaaguguguagacugccuguuaggcugacuuuaggacuauuucaucauguaaaucauuucagugccucucuuuuauaauaguggugccuaaacuaaugacuuucauugucccugaaguuuagucucauugucccaaacacuuccaaauaguguaaauggggaaaaaaaccugcacuacacacaaauacauuguuuccacagcaaauguugaagggcccaauuuaccacaaauuuuguggcaauuuuaauguucagcugcuguaauaaguuacugagcaucauuaauauugagugcagaguaugugcgcgaagaggagcagcagcguugaaguugauaaguaaugcuccaaugggaaauucagugucagagguaaaacuggguucaaguaaugggcaucauuaaagaagccaugagucugugucauggcucccagagcugucugacugacuguagccucagacaauucacacugugcccauggugacaauucacacuguacccuuagugacaauucacacuguaccuuggugagauucauauagcaugaaugauauccaaacagcuacagaaugugggcugcucuaggcagucuguccaguacugugucaagacuccucacacaguggcuguuugaauacuguacuauuuuucuguagagagaguucuuuuugagauaccaugagaccauagugaggaguccucuuaccauuguuagccugacaucaagcugacuuacaggcacuugcuggugugugugagagagagugcgugagugcgucucugggugacguuaucugacccugaugugcuugagcacagucugguuucuuacugaccucagagagggcagaagccguugcugcuuaccugucuguccuucacggguuuuucuaaaauuuuuacucuuauagacgauuuuucuuuuuucaauuuacugaauaugauaaauacauagguuauggauucccaagaacacagucuucaccaagucuucaugauuuccagauacuugcuguguuuuccuaaaacacaaaaguaugcugcugucuguaggcaguagcccuucuacacacagcuuauacauucaucaaagccggugggcagggcgguuagaugcagugcugucauaagucaaucuuagcacaugagguuuauaaggugguacuuuguuaccuuaugggcuguuuguuuguuuguuuguuguuuucugagacagguuucucuguguagcccuggcuguccuggaacucucucuguagaccaggcuggccucagacucagagauccucuaucucagaagugcugagauuaagggugugugccaccuuaugcauuuuuuauuuuuuauuuuuuuggauagacugcacuucuuuaacuuggaagagugguuuagauccucuuagucagcagaagaacgggcuguuacuguuaggggcugaccugcagacuaacccgcuuuccacucugcaccaaauggugcggugcuggggauggagaacauaccaaguauauacuaacuaaugcuugucuuaccagcguguguaacuuaggugaaauuuucuuuucucuuucagugcauuugaaacgccacuuuauguuucgaaaccaucucuguuuaguguuugaaaugcuguccuauaaucucuaugauuuguugagaaacaccaacuuccgaggggucucuuugaaccuaacacgaaaguuugcgcaacagaugugcacagcauugcuuuuucuugcgacuccagaacuuaguaucauucacugugacuuaaagccugagaacauccuucuguguaaccccaaacggagugcaaucaagauuguugauuuuggcagcucuugucaguuggggcagaggguaaguauuccuuuaggacuugugacuuaccauagaauuagguagaauggcgugaaugauguguuuacaguuggaggcgguugguggaugcuguucaucuuggacagguagcuuaugcuucacacccugcugaugucuguuuaaaauccagauagcaauacuugaauugggagaguuuuuaaguggauauuuaaaauuauguuuaaugcuagaaaauuuuaaagaaagagauaaaagaaugaaauauuaggugauuuauagcucucaaauggagcuuuuaauauaaaauuugaguaauucuaacuuaaacuaggaucuugacuagaaauuacuuuuccuuaagucaccaagauaaauguuccuuaaacaaaacaccaagaaguacacacaaaugguuuugguacuuacagcauaggugguauaccuguuuguuuugauaaauaaguuuaagucuucuuaccuuaccccacuaaguuggaauugcuauagauugaacacaucagaacugguuuucuuuacacuguuaagaacagacgugucuauugugauugaauucaccuggcucagggaagcagccucucccugcuguaguuuguagcauuaggacaucuguagcaaugguguguugugcaugcagacagaagccuguggucuucuggaauggggucagggaugcuucuguuagugcucgauucauucuuaaugccuuuucuauuuacauaaagguauuggaauuauuuuaaucuaacauuguaguguuacuauuuuuaauauuggcauccacaguucuugcuuuccaagcuuguaaagcuucuaucuuguucagcuuguaucuagguuuuaaguagagcaaaguguguagucaguuuaguuagcagacuuagcuuuugucauucugcaaauuaucuuauaauagcaaaguuauauaauuuuggagguaauuuuuaaauugaauuugaaggcaaaguguacaguuucagaugcugcugaaaagccuagaguugccugagcaagcacacuguauagagacacaugcccacugcgacaacgcuggcaguagauuuuucaguuagcaauuuuuuccaucaauuuaaacuaaaucauauguucaguccuaacaucaaacacuauuauuucugucuagacaaacugagauaacuuauccuuuucagccauuaaguuuuuaacugucgacguguauugguguugcaugugaacuauuuuugagauccauggauguauuguacugggucagagucagaaggugucaggaagagaaguguaugcaugggagagggcccucagggauuugguuuaaaaccugcuugaccaaaaaguagucagguaggugacuuccuucaccuagaaucucucagaaacauagugugguuugaacacucuauguccaaaauguuuccaacuaagguauuuguagucucgaucuuuacugggaaucaaacccaaguccucacccacgcugcucucuaccgcugaggcaugccccagagcaugcaggguaaugacuugguucacuauuucuccugauuacugacuggacuacaugaaaggaucugaauccucaaccaacuucuuguuugguuauuccuuugaaauguuuaguuguuucaccauguuuauagugugauguuuaacuuuucuguugcuguaaguaguuuucuuaacccaauauugaauauaacuauaaauaaggcauauugaauuaauacuacuuugaaauauguuucagauauaccaguauauucagagucgcuuuuaucggucuccagaggugcuacugggaaugccuuaugaccuugcuaucgacauguggucccuuggauguaucuugguugaaaugcacacuggagagccucuguucaguggugccaaugagguagguaaaggguacucuguagugacagugucaucucaaagcuguccucauaggaagaugucuucuuaagagcuugaucauuucucuaaggucaguugaucuuauuuuacauucuuuuaauuuuucuucuuugucaguuauguaaugguaggcuucugaacuaguaauuaagauacuuaauauguuacugaaggaaaacagaaaacuaaccagaaaguggcauuucauagacauuuucagguuuacguacaauaauagcuuaacuauguggugaagaaaugaggccacccuagcacuagucagugcugugaacccugauuaaaacccagaugcugggauuuaguccuucaaaagcagugcacagugcagucguagaugcugccugaguuguuugagaucuacuaggauucugggcauuagagagacugcacaucugcaggcuacuuuguguuccuaagauuccgaagcugagaacagaagcuggaggguuuuuggaagaguaaagggaauugcugcccuugcugucagcugagcuuguuugcuuuuuguggaaaaguugaucauugaggaucuuaaucuaaauuuugaguuauaugagagaaaagaaagacuaaaugacuuaacucuggaucuuauuuuuguuaaguugagauuuuuguaaguugucauguuaccugggcuggcccucaacucugggacucuaguggucuucaaacuuaaucuuugaaauaacugaucagaugcacaccaucuccagucaccaucuucuucucugcauuuaauuuuaacuucagcucacgaacaagguggaagcagcuucauauuuguuuuuauuugaacuuaaguaauuguaucuuauaacugguaacuuccuuaggauuaaacagauaaucaucugagaauccaguggcuucccaauuuucucauugucagagccaaaguccucuuuuguguuuggcauucuccucuucacucugugcaggggucucugcagugucuccucuccucuguuccuuugcuucugacucaucacugucuucucuugcugcagcuccuugaacacuaaccaccaacccugcuuggccccuacacuguucucccugucuugaagugcugccucccagauggcacugcacacugcucucagucagcuuuccauggagccuuugugccaccugugcaaccuuccccuagccccuucucaucucccaugcauggagacgccguuuuuguggucucucugcccccuuuaggcucuucaucuuugaguucaacgaaaaauaauuguuuaaaguauugcauauguauagguagagaagugauuggucaaaaacuacuccaggcaaaucuuuucauguuuagaauuuaucugugagacaauagaguacaaauaucuaaauuuaaguuuuauuaaacuugagauuaguuaugucuuaauguugaaauacagucuuuagguuaauugaaucgcaguguaacuguuacugguguaaacugaauccaucauaguaggaauuuuaccuguccuaaacauguucugguccuuucccuguguaaggauuuucuaaacaguauaauguaaugacuuuuuuuuuuuuuuuuuuuuaagauuuauuuuauuaauauauguaaguacacuguagcugucuucagacacuccagaagagggagucagaucuuguugcggauggucgugagccaccaugugguugcugggauuugaacuuuagaccuucggaagagcagucgggugcucuuacccacugagccaucucaccagcccccguaaugacuuuuucuaguauuuguaauuauaagaaaccuagaaaagaucucaaguaugaaagaaugcacacaaauuauuuacagauauuauuuuuguauaagagauuugaacaccuguggauuugugcauccauaggguuggggcuaauccugcucagaaccaguuccuugaggaggcuugacuauguuuguaguuagccuuuuccaaaacaggcucuuccucuguuuacccugcuguauuaugucaguaagcaugguuucuagccuuaugguaguugcacuguagcaugaaugcauaguuuucacuuaaacuguaauuuaauuaaugucuguaaguuaguaagacauuuuuauugguucuuuaaaacuugaaaaacugacccuuaaaauuuccuuccuuucuaucucaguguuuuccauuguauuugaggucccaagguacacuauggaucuguauucuuauuugcugauucucuaccuucccuucuguugagugugcagaaugugagggcaaaauguauuauaucuguugguuuuaguguauccucaagaguccacaguguauccauccucagcgcccacaguguauccauccucaguguacacaguguauccauccuuagcguacacaguguauccauccucagcgcccacaguguauccauccucaguguacacaguguauccauccucagcgcccacaguguauccauccucagcgcccacaguguauccauccucagcgcccacaguguauccauccucagugcccacaguguauccauccucagugcccacaguguauccauccucaguguacacaguguauccauccucagcgcccacaguguauccauccucagcgcccacaguguauccauccucagugcccacaguguauccauccucagugcccacaguguauccauccucaguguacacaguguauccauccucagcacccacaguguauccauccuuagcguauacaguguauccauccucagcgcccacaguguauccauccacaguguccacaguguauccauccucaguguacacaguguauccauccucagcgcccacaguguauccauccacaguguccacaguguauucauccucagcgcccacaguguauccauccucaguguacacaguguauccauccacaguguccacaguguauccauccucagcgcccacaguguauccauccucaguguacacaguguauccauccucagcgcccacaguguauccauccucaguguacacaguguauccauccucagcgcccacaguguauccauccucagcgcccacaguguauccauccuuagcguacacaguguauccauccucagcgcccacaauguauccauccacaguguccacaguguauccauccucaguguacacaguguauccauccucagcguccacaguguauccauccucaguguacacaguguauccauccucagcgcccacaguguauccauccucagcgcccacaguguauccauccucagcgcccacaguguauccauccucagcgcccacaguguauccauccuuagcguacacaguguauccauccucagcgcccacaauguauccauccacaguguccacaguguauccauccucaguguacacaguguauccauccucagcguccacaguguauccauccucaguguacacaguguauccauccucagcgcccacaguguauccauccucaguguacacaguguauccauccucagcgcccacaguguauccauccucaguguacacaguguauccauccucagcgcccacaguguauccauccucagcgcccacaguguauccauccacaguguccacaguguauccauccucaguguacacaguguauccauccucagcguccacaguguauccauccucaguguacacaguguauccauccucagcacccacaguguauccauccucagugcccacaguguauccaucuucagcaaacacaguguauccauccaguuuccacaguguguccauccucaguguacacacacagccuuacacagauaugugcacucuaucuaggagagaguugacaagcagaaguggaugaguuuacaguugaaauuacagguuuuuuuuuuguuuguuuguuuuuaauacaggucgaucagaugaauaaaauaguggaagucuugggcaucccaccugcucauauucuugaccaagcaccgaaagcaagaaaguucuuugagaaguugcccgauggcacuuggagcuuaaagaagaccaaagauggaaaacggguaaaaugggggugcacuuauucuugguggagacuucccuuccccuuuucucccucucccaucacccuuuuuucucuuuuauuguuuccucaucagagcuguuuguucauaguuccuuugaauuuucuugccaacuguauuauaguuaucaauuuuaagaaaguauuuuguucaaaaguugauuguaguugagcugacugugcacugggccaguguuugcuuaauggucagaguuguuuggguuucaguaaaagcaaauggacuacuaccugccuguguuuggagauagcugauaaagccuguauacuucaauaccgaaucagucagucucaaagcuuguacauaggagugaagccauagcuguagacagaaguuauaauuguagucaguuacuaaauuuuuuaaguaggaagaugauuuuuaaauuucagcaguucaugauacuuuuuuuuaggauaccagucaaugcuggagucuucugacagguuuccgauuccuugcucagugaccaaguuaacagggggcuuucaucuucuaaugcaauuguauuaauuuauuagaguaaacaauacaaaauuugcgucuugauuuuaugucucugcaauuugccaaacauugucugguuuaguuugggcuuuauuaaauagaagaacacacgggugacauaauuggagauggugugcauuuguuaccuuauaguuguagucugcauuuucaacauugaagagaaguuuuuucuuuaguuauuuuauccuguauuuuagugaugcugccaccaggugccauuucagggaacuagggguacuguuucuuugcuuuaauucacauuuacuuaguuguagagucuuucaaugucuaaagguucuuguuuugcuucuuuuuuuaaagauuuauuuuuuauucauguguguauuuguauguauauaugugcauacccgaaagagaccacaaaggagugucaggucccuuggggacuggaguaauauguuaacuacccaguguacaugcuggaaaccaaacucugguucucuugaagagcagcaaguacuuuuacccaucaagacauuguuucagcuguacuuucuuugcuuugaccuuuuuguuuguuuuguuuucuaacauuuuuuuguaacccaggcugguuuuaacuugcuguauaagugaggugcucagcaagaacccccaagugaacuauaacccagcugcucagagaaugacucuguguaguuaguaucuccuuuauaccugcuuuguaaugucucgcaguccuccauacuauaauuguaggccacacaauucccaguuccuaauuauaccugugacuauaguccuauguagaagcugcggcaccuccugagucaauauugaaauuaggcauacuggcuccaaguuuaggcugauagcagucugcugagggguaccugcuuacugacacucugagucucucugucgcaugcacauaguuuaucagucacagcccauuuuccuguugaaccaaagcucaguggaaaauucucagguuucuucagugguguucuagguagagccagccauucugaguuagcauugagggaugagagcugcuuucuaucuucuguagaauagucaguuuccacuuugucuuaaguguaaguucucucuccuuaaaugaacauccauccacccagguuuccacaucucugucuuuccagagugaaaucaaaucaagcuauaauuauuacuguuuauugauuauugggggcauuucagaaauuaguaagucuuuuuucuuuuuuaauuaaaucuuaacauauacuuacuacccauuaauuaaguacagugagauuucccauaguuaagcuuaguggcugacuuauuucucuuuuagcaaaacaaaauugcagcaaaaauaaauccucaaucaauugaucacgcuguaugagcagagauacaaaaaaaaaaaaaaaagcaggcacugucauugacuguguaguuuauuuucuuagaaguuuuaacuuuuuacauuucagaagcccauaugcaaagcuuuuaaaacuauuuguuuguuuauuuagugugaguaugcuaucacuagucagacacaccagaagagagggcuuugcauaccauuacagaugauuguaagccaccaugugguugcugggaauugaacucaggaccucugaaaaaacaaugagugcucuuaacugcugagcuaucucuacagcccucauauucaagguuuuaaugaaauauguauuaguuuuguuguuguuguugugugauaaaaacagcaugaccagagcagcuuauaaaagggauguuaguuuggcuuuaagguucagaggaauguugccaguaauggcuggggcagaguggcaguagauggcagacaaugguagcuggagcagagagcagggguggggagcuggggggacucggguagaucacaacuggaaauggcauguggcuuuaaccuugaagccuggccccaauaacauacuuuguccagcaagaccaguccugcuaaauccacucaagcauuucuaccacuugaccacgcacucagacauauguguucacuuugcauccaaugucuaacacaagauacagagcauuuccaccaagcucucucggccuuccuuucugacucuguucuguuugucugcuuucuaccgcaaguggaugugaucaccagcugcacuucauaaaaaugauaaucucugggguuaccauuuucaugggugccacaagacaccugacaagagcagcuggcagaggagaagggucucagcugcguuugcaguguauagguacaggaggaccaagaacuggcugucccuuguccuugcagucaggaagcagagacgggcugcugcugucugcuccuuguccuuccuugggugacagugcugcccacccacacucggugcuuccaccucagggaaccagugcagguccucucuagcugacagugaagacuaaguaucaccuuuauuuaaaaacaguauuugggagauuuuauauuguuuuguaucccaggacuuaauuuauuuuauugcuucaugguauuucauugaguaugcuguaauuuauuaucugucagugaacuuuuuugucuauaucuaauuagggacuaauugauuaaggcuagaaagaauaccgcaggucuuuuuuuuuucuaguggcauugucugagaauugccagguccuauguguguuuaucaucauuggaaaagagcuuuuucaguguuucugauguuuugagaggugccuuacuuaaugcuggcugcuacuugucaguacuuuuuccuguucaggaaaucauggucucugggugccagggaacuuguaauguuaguaagauaucauuaauauuagacagucaaaccuguggggcuucccccucuccccgccuuuaauucccaaguauguaaggauuuguuuucuccugagcagaucacguugcauucauucuugagcuugggauaaugugguggguggggcugaccuuugcuuguuggcaguugccuuucucuguaggucugaucucaugcuuguuuauugaacuagcucaccuucuguguuugcaagcuuggacucccacugcucugucugcaaucuagcagcaaguguuaguggcgcacauucuaggucuuucaccucuacucgaguaucaaguccugcuagaacuugcagugauacaugccuugccacaagccuuuccugcaucuucagagaugauggucauguggcccucaccccuuguuauauagagauuuuuggcauauuuaccauaaccugugaugaagcacacuuggcccugccauuuuauauagcacugaguuaaacuugcuggucuguuaagagugguauucugaaguguuccucauuguagcuuaugguuuugguuuuuuuuuuccuuuaacaauuaucuugagucuuguuucauuauuucaaaauauuugagaauuuucuacauauccuaauucaucucuagcuaaauagcacuguuuucuaagugugaugucauucauuuaaaauguguagagugugcuuuuauagucuagaaugcgauccgcuuggugauucuuugaugugugucugauaacaauggaacuuuauugucguguucuagagaugugugugucugucugucugucuguguggcuguguauggcugugugucuuuuucucuuuguuucugucaguaucugaggggcauuuugaccuucaguaguguacuaguugcuuuucuugucacugaagccuggacaagaagcgacuuaguagggaagagcuuuucuucagcucacagucaggagcacuaccucaguucuucagguagaugugguucacugcuugccagagugugaggcugcuugcucauguauuuauuaaccaggaagcagagguaggcauagaacuaucuaucccuccagugaguugcuuccaucuuggcccugccuccuaaaggcucuuuagccuccccaggcugagccaauagcuagggaccacguauucaacgcaugguccaaucacuuugaaaccauuacaaacccuaguaguuaugucggguuaucuuuaguugugucgugguuuuuaaagcuuuguuaguaauuuuguugugauuucugauaaguugacccuugucaugaaauguccuauaauguauuagugcugugccauggcaggcuguguguguguguguugugucucuucuuuuuaaguguggcuuguaugcaguguauagguagggcauguuuuaaaaucugcuuuuccuuuacagugaauauuuauucauagcaguggguuugagguuugucuucuguuuuuuguuuguuuaguuugucuguuucucuuuguugcuguguauagagcuguugaguacuccggagacuuguuucuucagcuuacuucucaguugugguauaauguuuaguguuguuugacaauaugcauuuuuaugucagguuacccuuagauacugucauaucacuuguauguuguaacucccuucugucucuuaagugcuuguauguaaacaucacuucugcauguguuagaauccucagaacacgucaacuguuuaccucaaggaaaggaaagugcuguaggcgcacugagugcgggguccuggccauccgacaucuaugcucaccauagaugagcccagcuccuucuuucucaguguacaccaugagcuuaugauuggagcaucuccugccugaggagagcacuagucgcugucugucuuaaacucucuccugugguuccuucucagcugcacuguaaggagagucaggguuucuucuuagcaguucucaccuguggugugguuuuccuucccuuucagggugcuuaaacaguuuaucuucauacuugguuauaauguaccuaugcuuuuuguuuaauuuuucuuuuguguucgcagaggugauugaaauucuuggauuugugaacugauguauuuguagguccucaacuguuaucaauacuuacucuguccagucuucucguucuccaguugcaugcaugguucugccgugcucaguauugccccgagguccucagagcgucaguggggagugcaguagcaccugccuugccuuuaugucuugaauuuguauacuucuuuuugcucuguguuuuuggucaguguuuuguugguuaaucuggcuucccaacauucuagaucuguucugcuguuagaaguauucagcagacuagagaggugcgugucaguuacgugcuucaacuuuugacaacaaaaccauaggccaguccuuaaagauccaccuaaaugggauguuguguguuugucuuuccagugcuggguaggggagaugggagacagccuggggcuuacugacacccucugaccuacucuuugaguuccaggccagugagagaugcugucuaaagaaaggaaaaagaugucacuagagcuuguucacaauacacagauggagcgcagguucuccacuuaguauuuuaguuuaagaauuuguauuuguccuuauuuuuuacaguuuccccuuuucugaaguuccaucuauucacauguguucccuaccuuuuauuauuaaacuauauaacuuacacauuuauuuauuaguuuaaaaauacuugccugccaguuccacugccugggccauuuauuaguauggauugauaacucauuuuccccugcuaaguuacagacaccguuauuuuuucuguaauuauauauaaaagcggucgaucuuucuguacuugagaaugggugagcugugucauuuuccaugagaagcaggugaaaagcuucucguacuaucaggccaggacggucugauucugggcguuuaguguuugccucaggaguuuuaccaucugaggaggccccuucaagcauuguuuguucaugaccgaaggaggcucuagagcucuacacauugccacccacagcacccggacauuuuccuuuaacucuuuugcugccuuuguguggcuauuacuauguggucagaacuaggcugaauuauccuugcuugggucuagcaugguggccccuccuccccuuacagggcccuucuaaucugcuaguaguuguuuggggcuggggauguggucaguggaagaccacuugcugaauaugcacagcugugauuuguccuacuuccggacuuuaaacaacugucaccaaaacuccaguacugcuguggagacuuguagaaagacaacauuguuccugguuacuaaugaguaucuaucagucccauccugugguuaagcagcugacgaaccauuuuguaagugaaccgaucccuuuacuuugagugcauacauagcuuuaaugagccacuguuagguaggcagugcagcauauucuccagugcaagccuggcauuguggugcacaccuuuaaucccaguugucgcacucggcaggcagaggcaggcagagcuuugugagcuugaagccagccuguucuauguguagugaguugcaagucagccaagacuacgcaguaagacccuaccuaucucaaaacagacauuacuuacagagagaggcaggucagaauccauucugcucugcucuguagaagcugucauaguaauuguuuuauauuuguggauuuucugugucacacucuuuguuuacuugcuugcuuguuucacaaccuugaaaauaagaaauguguuccugggugaaacuguaccaacccagcuucaggcugggccagugucugcuugcugcugagcucuacugaucuucagaguacuuuuuuucucucccaaaacuguauuggacuucuuaaacacaugcuuaaguguuaugugcagagugaggugggguggggguggggucuagcuauuuuaauaacugucuuucuucacaaagccuuguacauuuggaguaaaucauguuaccucuccuaccaaacuuugagacaauuucuguucucucuucuuuaauaggaguacaaaccaccaggaacccguaaacuucauaauauucuuggaguagaaacaggaggaccuggcgggcggcgugcuggggaaucgggucauacuguagcugacuacuugaaguucaaagaccucauuuuaaggaugcuugauuaugaccccaaaacucggauucaaccuuauuaugcccugcagcacaguuuuuucaagaaaacagcugaugaagguaccaacacaaguaacagugugucuaccagcccugcgauggagcagucucagucuucaggcaccaccuccagcaccuccuccagcucagguccgccacggcgcagcgcggcccgcucgcuugugcaugcuuucucucugcuuacucgggugggaggcuuuuucccccuccuuuuugguuuuuugaggcagguuuucucuguguagcccuggcuauccuggacgcccccuugguaugcuagucuggccucaaacucagagaucgccuccugccucugccuucagagugcugggauuuaagacacauguucccacugcccaacuccaauguggaauucuuucagaguauuuauauauauauauauauauauuuuuuuuuuaauuagguauuuuccucauuuacauuuccaaugcuaucccaaaagucccccauacccuccccccccaccccacugcccaccccagaguguuuauuauaaacuaauuuuuugaauuuuguaaauggguagcaagggauuauuuuacuucaauauguucuuaguguguguggcucugaauucaguacccucaaacacaccuccccaccuguaugguuaguagcaaauuuaauugucagauguguucguuauaauugucugccugacaguuagaaacaaagcuacuuauagccaaaaauuuaaaugguuuuaaauggaguuauuuuuccacguccuuaaguuuuuacuugacugaggagaaccuggcuguauuagcaguugaugugggaagacaucuaagacuccaauuacuuugugguauauuucaaguuaauaccauagcuugaaaguuuuaugugucuguauauguguuaaguagugcauauaccuaaccgugcauaugugugcaccuaaggucacaugugggucuugacacugugucuucccucacugucuuccuuauuacuuggaaauaagagucccagugccccagaggccugcuguuguauccaggcugccugccuggcuagugaggucuugggauuggcacucccucacccaagucccgggguucagucagcccaggauuuuauacagaggcuggagaugcacacacaguccuagcucugcuccugcucuuacugcguacucucucuaccccaugcuugaguggguacaaugcagucuuagaguucuaacucgagcaaaauuagcuuuaaacucacaaguuuuuccauguccugauauuaaagguggauccucgggaacgaguaacagugggagagccaggucggauccgacgcaccagcaucgacacagcgguggacacuucgcugcugcuguccaggccauggacugugagacacacaguccccaggugaguguuccuagugcuccugccauggccuugcuagcuuuagcuuuguuggaugccagucaggacgaccaugucuguguccucuuuucuaaaggugugugguauccucacugcuuaggaaauaaaaacuccacuccuuguuagaaaugagagcauguguuggguacacacaccaccgucuuucuagccaucuacuccagguuuauuuuucauuugccacagcaguuuccucccugccucucagugggugccgagaccucuagaugcacuaauucucugugagcugugcagucugggcccuacguuacuucuuguggccuccagcauucccacccugauucugaaucaguuuguguuggauuuuuaaacuuguaauauuaaaguaauuuuuaaaguuaguguagaacaugugguaggauagaaauguggagaugccauccuagcuauauuucauugcugugguaauacccagacagaagcaguguaaggaugacaggguauacucuggcucacaguucaaaaggaaaugauaccuugugucagggaagaugggauggcaggcagggaaaagcagagugguagggucaggaggccucugcauuuaagaaacaggaaauggguggggcugugcugagcuauagagccucaaggccuacucuauaagccagccuccugcaguagggccuucaccccugccccuggcugccagcuggggaccaaguauucaagcacaggaggaagguguuuacuguuuagacaaaaccauaagaccucagugagacauuuccucugcguugugggcuacauuuuggcucugagcgugccaaucgguuauuugauagaguaaggaaaaccugagcuagauuggugcucauuccuuaauugugacugggccacuugguuuugcuggagaaauugucacauuguucuguccucacuguuaguauucaccagucucaggcggccauccucagaggaccccuucuccuuccuauugucugugaauuacuuccaacuuguccacucguaggcagaggccugugacucucucuucugugugcaaucuucagacugcacugcuguagacgggcuuucucacagcucgccucucucugcuuucacugggcuucuuguugaaggccaggcccaugucuccugucuucaugggcucuggcuccuucuguugaacagcacugagucuuugaucguucuagccugugguaacucucccucaccacacugucauuccuagaguuucacacuugucuucagcagcccagcagcucagugcaccuaacuccuggucccaguugcaggcccugugucagccacaguccucacugauaguccagaggacuccccuguuuuccuuugucguugccugguaguauuuggcaggguugacuuaauccacauacacugaauuaccucugguuucuuuggcagcaugugucugguucuccauuucuuuguucccccucccuuaacugucuuuuggggggcaguguuccuguccaccaugccuugagaugaccucacaugcuuucugcuuggucucaccccuuacugccagucauuacagucaccauuuuuaaagcauuccuuccuacuuaccucugacuacacugaccucuggguuguguugggcuuacuguaaaugccauucugcaaguuugagcaguaagaagacucuuaacuguaccuguugcuuuguaacaaugguccuauuuucacuuacuuacugucauagauucagguccaggauguuagucuccagguuagugaggugugaauucugauuuuauguauauauaauuagcccuuccacugcaggaaccauguguguccugucuuccacuaaagcacacucuuuccugugcccugacuaagugcuuaucagccugaggaaacucugcagaugcuugaaccucgcuacuccaggcuaguuuauuuccccugcuuuucauagcccuuguuucccuuguaccuggaccuaacuaacguguagaaccucuugucuuugugcucugccccuacccaggccuuucuuuauucucugcacucagaaugcacacacugagaucuuucacucugaggguugugccaugcugggccucccacgcuuuccucauuccuccugcguuggcuuaguggcacacuucacacuuaguaaauuuuuuuggaccauccucuguuccucucuuucauguauguauauggucuauguacuacaaacauacauagaaauucccagaaaaacacaguuguauaucccaccuaccuuacagaagucauugaucugccuguucacuuuagguguccaacaggacagccccaacuggcauuucuggcucaugaucaucgcucuccuuccucuagguaguuggaguuacagacaugcuucauucauuguacccagcagagguguuuagcuguuuauuuauacugaguguauguuugugggugcaugcgaacucauaguaugccuauggaagucagaggacaacuucuaggagucaucucuucguguguauuggggacagaggggagcuggacaauuaaacucuaagacugucaggguuauuggcaaaugccuuuaccugcuuagccauuggcuggccagguuuuaauaauugaugcagucauguaguaagaagaaacacaccacagaguuugugagaagcccucuucuucaugucagcugguguaauacaaacuaguauuuauagcuuuuauaucuuugaaaagauguucuuuauggaaaaguaaaucuaguuauauauuaucagauaauauauauuaaucagguacuauuuaauaugaagacacaauauuuauauacauucaaacuccuuucccaagcauauuauauacucuagccucucuauaaacacugacauauacaguuuuauaucugucuuucuucauuuggcauagauuuaguauucuuccuauaucaaaauaaagcucuauuuuaaacuguuugcaguauuacauuuaacuauuccauagcuuaguuuauucaugggcauuucucugaucugcagucaacuucacuauaauaucauagucaaaaccuuuauguacaccagucccacaugcguacuuugucuucuaaauuccuggaaacaguuggaaguaaaauugcucagucagagugaaguaacaaggaauuauggucaugaugacuagguugucuucuguaugauuugacaacucagaaaguugaguuuugccagcuuggaguguugugguagaacauugccuggagcacgcagugcccuggcuagauagucuccagcagcauguagaugcacacacuccugcucuucccccaaagaagaaaggaagaaaggaagaaaaaggaugcuuucaaguuccuuuaucuguguuugauuucauuguugauaucuacuauggccugaaaauaccaaacaaagaaccauuguaucuuuauaaaauugugauuaaaauucugaauaacaggaugagaucuuaucccauucugcucugucccgaguuuagcuuugucuauaccuuauacacagccuaccuguuagucacuuaggagagaggcauccucauuguuagauuacuuucuuuacaaccacuaugauugugucagugacugucguaauuuaagauguuauaauuaacugugugguaauggguucaggcaagaguagaaugcuguccacucaggucugucagagagcacggaggcgcaguuaggucucuguauucuaccguguggaucucuucucucggccuaggguuauaggugggcagcaggaguuggcccuaccccauggcagcagagcccuuccaucauguagugugguuugcaguaucaaguauuucuuaucugagacacaaacguuggagucauaaggguuucgauuucaguucuuuuagauuuugguuuaguuauucaccuuuuacucguugaauaucuuuaaucugaaauuguacuaugaguggcuggccuguguuuucuuuaugagaucgucugccaguuuuguuuucccuacuggauuuucaggaguuucaauuccauacaauuuuuauugaauauguacuuuaaccauuugugcuagacucuagugguagagacagccuuugccuuuccagagcucacagugacacagcaagcacacuaggcuuggggugccccucugagguagguauugccugcauuggguugguaaaguucugugcuagaccccagcacagucggcccagcaguccagagucaugugacugagaaggacuuuuguuagauugaagcauauugagugaaguaaacuaaacgcacacuaucugaaugaggcaccugagagaauucgggaguuuucccuccccaugagugcaacagugaaguagguguugagguuauuggucauuugugcccggacuccuagcagcuugugacguagcagcagacaggcuuagugagaccuagacagguuuauuccauuuccauccacagucuugcugguggccaagagaauaucaaguggggagagggaagggcagugaggguggcacagcaucagccuuugccacaggcgcuuaggacugugucaggaacugcacugaucuuuaaaaagauguccaagcaaagauuagaaacagaggaaagagugagugcagaugccuagaagugucuguccaggugaaggggugggaggaagaccugggcuuauuggagcuuacauaaguaaagaaauguuggagaaauagcuguggaagguugggcgauggugucaggauuuaggaauacuuuaugugcacuaggauacacugaaggauucuggaugggaagcacucugcuuuggaaggauauacugcuccucucaguggguugaagaagggaauauaccuacccaugagugagugagcgagcacugguguacaugucaggcauggcuuaagcuuggagacagugcugauaacccuuucacaaugcccccacaggugcgccagcaguuuccggcuccucugggauggucaggcacugaagcuccuacacaagucacuguugaaacucauccuguucaagagacaaccuuucauguagccccccagcagaacgcauugcaucaucaccauggaaacaguucccaucaccaccaccaccaccaucaccaccaccaccaccauggacagcaagccuuggguaaccggaccaggccaagggucuacaauucuccaacaaauagcuccucuacccaggauucuauggagguuggccacagucaccacuccaugacaucccugucuuccucaacaacuucuuccucgacaucuuccuccucuacugguaaucaaggcaaucaggccuaucagaaccgcccaguggcugcuaacaccuuggacuuuggacagaauggagcuauggacguuaauuugaccgucuacuccaauccccgccaagagacuggcauagcuggacauccaacauaccaauuuucugcuaauacagguccugcacauuacaugacugaaggacaucuggcgaugagacaaggggcugauagagaagagucucccaugacaggaguuugugugcaacagaguccuguagcuagcucgugacuacauugaaacuugaguuuguuucuuguguguuuuuauagaagugguguuuuuuucccaaaaaacaaaagugcaaagcugcuugaaucagaaggagauuaacacacugaaccgcuacaagagggcaaagcugacuuuuuuuuuuaacuugaaaagauugcaaagggacaaugaaguuuuuaagagccauguccacccaucuucacggagagcucagaguguccucuuucugccucccccauuuaacuuccaucuccuggucacaguggguuuugucuuucuauccaacaagaguuaauguucagcuguuggucuuggucauuugccaacuaauuuuaaaauaaaaaggcacugcacauaauuugcauaaagggccccauaaggguguuuuguuuuguuuucauuuuuauuuuuucccuuuuucccuuguuuuguuuuguuucauuuugggcuggggguggggugggaaauuuggguuuuuuauguccucuacacacuugggcacggaaaugcaguacuguaaggaagagggaccucuagcacacacaaacaucaucuucagcugugugaaagggacgauuguguugacauuuguaaggcacauuaagcaugcuaaguggcggggaucaggacucuccuaucugagccuacugaggagcaaagcagccauugcaugggauccugugggucuccugcuggagaggccacaggaggauaggauggaacgugacuggucggucuccuuaccaaggcgcacugagaagcaaucagcgggucgguuguggccaguccuggggaggucugaguggugguccuugggauaaccuuuggccuuacggauuuggacucggaguuagaagagcccaccauuucagaugcaaucacuuguggacaugcguuugcagacaguccuuaaugcugaaaacacagagaauggguaauucaagaggccuuucuuuuaaaauagacuuuugugacccacuaauuguaagguauugcaaggucacuuugcgugugucauaaagcugacucccuucuugguugaaggccacagagguagugguuugcuuugauggaaauagcuacagcugugucccuuccugcuuuucccuuuucuuuggcuuuuucucggcacguggugucuccaccauuucuucugcacaaagacgucuucuguucacccugaacauuuuaaaaugcagaauuuuaugugacugcuuuuuugccucacaauuaugcugugaauuuuacaaaaauuuauuuucuuuuuugauaauuuauuguaccaaagcuguuuuuauagcacauagaugucuguaaccaauaaugucgcaggccugcacuuugacacagguguaacgagaccguuuuaaacgucaguugaaaugauggcuguacuauugcuuaaacaaaacuggaacuguuguugaauccauagccaauacauuuacagcaaucuuguacuggacagaauagauugacaucuaauucaagauuacaacaccugucacauucuaaauguguucaggcuucugaagggaaagggacacuggauccagaagcuauggagccagcaguugaucuuguauuccugauuaacuuccuuguaaacuugaacuugagaccuugauugaaccgacagguccacaguaggaacaggaagcaggcagagcucugagcaugaccugaaggaagcaggcuggcacuagcaguugccuugucuggagaugcugcugccuucaaguagcacagucuggcaguggcuaaaucuguguucccauugaaauugagcaauuuuaggguguuauacucugaagcaguugaauugggagaaugaagauagaguaauuucccuguccaggaucaaaagaagccuagaaagaagcagugaucuaccucugccaauaacccuguuggaagcaacgcagcagaacaccacgguacuuuuuauugcuuaauuccacguggcugacuaggucaagguuuguuugguguuuuuuuuuuuuuuuuuuguuucugagcaaaagcagguuuuuuuuuguuuuuuauauguaaacaaaagaaaggccuaagcucugugagugcaaguggagacucagagagccccguuucuauaaacacagacacuucagguguuaaucaggaaacccauauugauuuuguaauuaaaugucaagccuguggauuguuuugagcuugguaguugaugagcauuuccguacagaggccucaccuugagcacagcacugucaggagggcgcagcgccuguggcugcggagccccaggugccacacacccaccccacguggcucaggucauucuuuuuuucuuucugugcugguugccacauuuuagcaagcaccaaaaaagaaagcaguuuuuaaagcuauauuuacguaaagagagccacacaauccagugcuucugcauaccgugucacguuacaguccaguuuugugugcuuuacuacacaguuugguuacaggacuucugugcauuguaaacauaaacagcauggagagguuaaauaccuguguucagauuguaagaucuaguccagacuugcuguguauauuguaacguuaaaugaaaaaagaccccccuuuguauuauagucaugcggucuuauguaugauaaacaguugaauaauuuguccucagagucuuuacuaugcuuuuuuaaaaauuaacuuaaggaaaaauguaaacaguaaaaaaacaaucuucgugugcagugaagcggguccgggugugguagguaaagcaggcacaauccugucgccuauguaaagggaaaagacuugugagacagagacauuggcugcaagugucuuugaaaguaaaaauuggagguuuaacagauaauuugguuuuuaaaauggauucuuuaccugagugauuaucauguugauuugugcuccccugugguacugucucuguguugagagcacgugggggccuguccuguggggaugaaggacagaacugagugccaucucccugagucugcucugucccuuuccugugcagagcccggaauccugccgugcggaggcaguuucuaacccacagcccucucuuuucagugcuagccugcacagggucuguugaguggccuucagaagguaagaaacuuagguagaaaagaaacaaaugugauucuggacacugugcucauagucagagcuuguguaccagagcagaacugccuuuugucaugggcuacaggacucugcuuuaguuagguaacaagcauauuuugugauauuggacaacauacccaagaguuacuuauaccuaauaaauaguagaacuacu

SEQ ID NO: 8347 - RNA, 11532 nt, Mus musculus
cugaggggaugcgguuugcugguuuguucugaagcucagcuuacuagauuuuuuuguucuuguuuuguuuuguggagagagccuuuugggguaccgcuuggcaggaaucugucauuaggcccugacugagaaauaaguccaggcaggaaucugacaucaggccaugacaaagagguaaguccaggcagggaccugccauuggccaaggacaaggaaguaagaaucugguuuuaggguagaacaaagaaguaggcucagauaucuugaucauccuuagaaacagcgucacuggagugaucuuggggcuguguguucauugucuugcuuguuccuugacuauugucuugcuuaauccuucauuguacugcucgcccuaaauaccugcauguaauuaaaaugguauaaaagugaauugggaaaaauuaaaccugccaucagucucagaauugacaggggucaugcuacaauguugucugucuuuuuucuuuuuaaucuucacucccacauuggagaaccuguugacugacugagugggcuuaguuuugauuuuguuuuguuguucaaggcagaauuucucugucugaugcuggcuguccugggacucuguagaccaaggcuggucucaaacucagaaacucgucugcuucugccccacaggugcugggguuaaaggccugugccuccagccaucacaccuggcauuaacuagauugcuuauucauccccaaaccaccugcuccagaaaugguuugcuccacagugggcugagcuucauacaucaauuaacaaucaagauauagucagccugaccuaggcaaucccucaguugagauuacaaggugggucaaguucacagauuaagcuagccaggaaaggaaggucuguccuuguuuuauuggaagguauaauaaguucaugggaucuuuccucacagcuaaaaugguugcccccccccucucucucucucucucacacacacacacacacacacacacacacacacacacacgcaaccauccccccaaaaugagaacaucuuguuacugaauucugcuuuccagauacacuacuauugcaauauaugaaugaauucuuuagcucacauuuauguuuagcauucugcacaccaggaucuauuguggauagacaggacaaagcccccguccucacucuuaggaagccaggcagguggaagaauagaaaacagggacaagcaagugacaucuugguaauuggcuaugaggaaucccuugguuucaggcagcuuaagaaucuacuauugacuaaauucccccaagacuggagucugggagaggccgagcguuggcugaucggugagggcgccagcaugagcaaaugagcuguuuaaggcaagcagcucaucuuaccugguauuaggguuggcuuuagugucaacaugccaaaauuaggaucaccuaaguaggggccucaccugaaguacugucccgguugccucgauccacaugggaagaccaccguguauggguugcaguacagacuucuuaaaaagcacauggcagaaagaagauggcucauucucugcuugcuuggccuucccucuugcaacugagauggccugcugcugcugcugcugcugcugcugaccacgaugaugguggugauuccaccccugauagcagaauuuacuuuuacaggcucccauugugaacuaaggaacuuccagguuuuuaaucacagauuggagauuccugaggcauccaggaauuuuguggacaaaauaauggcuggguuuucaacuucccugucaugacagucacuauagggcuacuccaacuucuggggaacacagacucugggaucaaggaacggcugguuucucagccucuccagugugagaccauuguuauuauuuuaaugaaagugacucaacacacacacacagauacacacagacacacacacacagagacaccucacuggguucugucuuucuggagaacccugaacaauagaauuggccaaggacauuauugagucccgcaugcuaucaucugucuagugucuaauguccaguguucuuacagaauuguccaagggaacccugagucccaggacaacugaaaugaaagacaguucuacugcauggggaagagggugcucaugggaagagagagaggccagagcuggcucccaaggcacauuggcuauuagaggucaaagcgaagagggauuuaaguccugcuuuguuugagauuccagcgaucucuugauccagucagccagacacucacaaagggaggcgagacagcugugaugcugauauugauuuuauugucuuaugagaccuaagggcucagggagcauugcagaggcccucaaucuacagggaaugaaggaaguggcaucuaugcugagaccugggauggggacacuccgcccccacagugcugaugaagagcaaguagugggguacaugcuuucugggcagagagcaccaugagacagguuagaggaagcaaugcagacagcugugugugguacagagggacugagggucaggaagaguguugggcaagaaggugacuuugaaccucuucuuuuacacaggagacacaaaggagucacuugguggccauaggaguuaccuggguuguguuuuagaagcuccacuggcuuuagaguggaggaaggacucgcagugaaaguggauguaagaaggcuccugagggaccuuugcagaguuccaauagucaugagugcccugucuauuccuuggugguguuucagaaaaacauaugaggaacauauaagacauaguaugaagcaggguaugguggcacaugccuuuaaucgcaguacucaggaggcagaggcagguggaucucuaugaguucgaggcuagucuuagucugggguacauagggauuccaugacagccagggcaauguggaggaacccugucucaaaacaauaacaaaaacaaagaagaaaaugaagaaggaggaggaggagaaggagaaggacaagaggaggaagaggaggaggaggaaguagaggaggagaaaagaaaagaaaacaaaagaagauaaauaguguguauagcugaguugucaaggguaugggugucagagcagaaagaaccuuccucugguugucauggacacaggaguagcuggguggcccaugugcaccaaaaugcuacagcugugugcugugccuaaccagaaggaucugggugaauggccaggaggaauugagcaaaauacuaacaaacaaaauauugaaaggucauugauccaggcacccaauauccaaagaacgaggagagagcucacagaagguuaacguguguguaacuuuuaaguuugucacuuuugcuugccugugcuuuuuaaaauucccacagugugaacuauuuuuucaaucaauuaaagcuauuuuuaaagugaaguaugugguagucaguaaaauaaaaggggggaaggaagugauggagagggugguguguauauggggugugaaaguaguggggaucccaggggcccccggggacccagcuaaggacacacacuugcugcagacagacaugcgccucccugagccaccuaggcaucauauccaugcggcgguuccuuuucugaaguucaacccaugucaugcucacaaucuagauacauuacugcaaugguuaacacagacuguccacucgacagaaucugcaugcucugugcagucccagaugucauugugucugacaacgugcccaggccaccccuguccagucauagagaagagaaaacuccucaacagggacagcaugaggcaaaagagaaaggcaaaggucuauaggaaauggcggacgaggaagcgcuauagcaaaagugcagguccaggugagaaaggcaaggagcaccuugccgggaaugaagcuuacagaggggcagcccgcgggcuccacucuuuccuguuucacugccuguaagccugggugguacugaugaguucauuuucagugagagauaaaccaucaggugacauuuuaccacugauguguuuguaaaaagauagagaggggauaaguuuuauggaugugucggugaggugugggggaaaggcgugccuuggcgggcccauguggaggcaucccuuccccauaagggaccagacacacgguauaguacagaauagaguuuauucagagcauggggaggggaguugagaggauaguagaggcagagaaagggggggggcggaggugggggggagggagagggggagggggagggggagagggagagggagagagggagagggagagagggagagggaguggaauagaggaguagaggccggccaugagcacguggauagagaugggguuuuggucgagaggauagagcaggagcaggaaggcaagagcaagagagcaagagaggagcaagagagcaaggagggggggcaagcagccccuauuauagugagucaggcauaucuggcuguugccagguaacuguggggcagagcauaccugacuguugccaccagguaacuguggggcggagcuaaccacuaccaacuagaggcagauguacugaugaauacaacaugucauucaccgguagcuugaaaucagagccauuagacuaucggaacccauugucuaucgcuaucagcugagaccguaacuucacaagcuuugugcuguccaggacccacacugcaccagugacaccgccuucucccuagauucauauuuccgaagcguugucuauugagcaagacuuuaggugaggugguucuccugcacuucagacagggaaauuuaaaaaaaugaaccucaauucaaacaucucaaaguaggaggucgcuguacuuugaaggugucuccagcacaaacugaucuuuuauguguuucuuccugcuaagcaaaggguuaaaugaacggaggcaucugucugccaggcuuccaaccccaacgaaaggaaggcuggugguuggaagguggccuccaugcuucaggcaggagauggcuucacguguagaacaguuaucgggcagccagaggccugaggucugccgccugccaaggccagcaauuacacuuuuguaguuuccccgauuaaaaaguguuuaagcaccugcuacuuaaacgauacuuaaaaagcaauaaauuagaggccaggagcgcagggccugggaacaugaacagagaaaugaagggucuauauaaaucgagaagccguauuuuuccauuucugaaaggaccccucaaugauuuaaaaauaagcaccaacucagguauccaagauguaaaauaaauccgaauaagcuuaaugagaaucgggcagucauccacaaggaaaccaaaucuccgggcccucuucuuucucaccauuugaguuggccguacaggacuuuuagcaacaggaacauuaccuggccucguugaggaaagaacuugggcugaagucacaguugagcacgcacacacacacacacacacacacacacacacacacauccauacacucuuacacacacacaugaacaugcacacacacacucacugggaacauggaaaacugcacauauagaauauuaucaggcucagugacacugaaagccuucgacagacuaggguggagauugagacccuaggacagacugccuauccagcuccagguucaaugagacacccugacucaagggaauauggcagagaguacacaagagcacaugcauuuucagauacacauguguagaacauauacacacucacacacacucauaacacauacauauucacacauaccuucucauacacauacacacucaaacacacucuuauacacucacagucacacacacaggcacacacauauacucaaacacacuuacccaaacacacacacucauacauacacacagacacacacgcauucacacacucauccauacacucuuacacauacacaggacacauacauaucucauauacauacauaaauagucacacacucacaugcacauuugcuaauauucuguaacuugcuaaagauuuaucauacuuagcaaugacugugucuuggcuauaucacauuuagguucauuuucaucccuauuaaaauuuaguuuucccuuuacuuuaaccuacagaacgcaagagucuacucccugucauucuccauaguugcuuuuacccauaaucaacuucucuguaaagauaacaaauaagaauuucuaaaagucgccagaugugguggcuugugcccuuaauuccagcaaucaggaagcuucgugaaaugucucuucuuugcuggcauugugauucagugucuacuugugaagaauaaaaggaacacaucacucacucugcccugcagucagccaagcuuggugauaugcacuugcaauccugcuggggaggccaagacagcaggaucccugguguuucuggacagugagagacccugccucaggggauaagacugaaacuucugacaucaacuucugaccucuacauguacccguaugcaugugugcacauaccuguauacauacacacugaaaaauaaaaccauuuacuuaggaacaggaguacuggcucagcaguuaagagcauagugcugcucugagagagaacugaguuuuguuucccagcguccauaucaagugugccucacaaccaacuguaagcccaguuccaggggaaauccaaaauaguuuggcuucugagagagccuguaugcaugcggugcaugugagcucacacaugcacacacaucacacacucucucacacacauacacaaauacacacucauaauacagauacaaauacacacacaugcucaaacacacacacauacacacaggcacaugcaugcucauguaugcauacucacauaggcacacacgcaugcacaaacacacacucucucacacacacaugcacaaacucacauacauacaagcacacacacaugauacacguacacacacauucaugaauacacacacauaugaauacacacacacaugcaugaacacacaugcaugaacccauacacacaugcacaaacacacacauauacaaauaaacacucucacacacauauacacaaacacucucucacacaaucacaaacucacaugugauaugaacacacaugaauacacacauacacauauaugaauacacacaugcaugaacacacacauacacgaauauacacacaugcauggaacucacacaugcacuaacacacacucauacacauacauacacacacaugcacacacacuuuuuuuaauaauuaaaaccuauuuuuaaagaagugccaaaagucacauguaguggacagccucucucuugucauagcuguaauucaacuagcaaauucacuguuucugaaugaucuguucucuguaccacggaacugugccagagagguaaucaacacuugcugccucccuggacauuauaauagcauaaaaaccucaugaaauguacauaaucuuuaaauaaccucagcucagcuuuugcuuugcaaaggcauuuugcuuuccaaacuuucccuucuccggcuuccucuucggcaugcaugaauuuauagauguggaaggcaaucagccccuccagcgccaacgaaccgguucccuguggcagccaaauuugcauauggcaauaggcagcuggaggagugacaguugaacagagugugacacccagggucacagggucacacagucacacggugucucaaugucuuacccaucuuagugcagaagggacgccguucaucagacagagaucuccaucagagaauaccagauugagaagccuaaggcgggcccuccaaaucgcugaccaauucuugauuuuaaagaguaaaacugccaggacccaacaaggcacaaucccaauguuaaccaagucacauuaaacaauuuuaucugguugggucuucucugucccuguguugaaccagacaccccuuggaagucaauaaaugcaaaaacgauauaaugaugaauucacccaggguguguguguguguguguguguguguguguguguguguguguguguaagaucauucuacucucaaccaacacaaagaaaauaaguugaaaauaaaauacaacuucacucuuuagggaucuccccuuccccgauggccagguccagcccaaagucuaucagucaaggccaaacucuugacucuaugaagagucucaugugcaggggaaauauuuauagaauccuuacuuccaucaacacuugcaaaugaccccuaauugaugacacagucagacauaagcaugagcccccaaaugcucacacccuccuaggucugucucccaagacccucagaggccucagaggagaccacacgcccacggcuuuuuguuuaguuuuguuuucauaucuauuuuuguuuguuuuuuuuauuaaguaaggcugcucaaggaagcaaauaaagaugaaaaaaaaaauccaccacagaugaccaaauuaaacaauuaaacaggaugagccagucuagcuacagacccaagagucuuaaaagucuaggcagcaaucaggccuagggugcugaguugauuuauggccgaucacagaggagcaacucugcccgugacggugccucucgagcuucaugcacgugaugaaggacucgggaaggaacugacaaacauucccuagugcuaacucuuaggaagguucuaggacuuuagcucagguccuugugcuuauguggcaagcauuuuccugaaccauggcccuacguccaaaaagcaauacuucuucagggccuguuccacuuuuaagcugauuaggucuugcuaggaaccuccuguuggcaggauuucugggguucgccccacgaacacgccaguggcugguucaagagcagaggacaugauuccucccucauuccuuaagcaggagcaucauucguucaacaugaacacgcacgccuggcucuuuggcaucuguugacagagugauguguucggaaauauauuuuccacagcaucuguucaacuggccacuguagauuaaugagaucaagaaugguuguucacaagguucuccugucccuauaccucucaugguuuggcauuugcaccaauaggcagugagcaaauucauucaagaggaacuuaggguugcuguggcuaagccagcaccauagcagagcuguugacuuccaagaucagagcaguaacugggccuucagaaaucagcgcaguacuuugugagcuacauggcccugaaagcauaaccucuauuccacagcuacccuggaggccucaucuccugggacguacacgaaagccaaacagggcugacuggagccuuccucacuaaaauguaugcuuaaauuugguccccauuaucagacugacauacuaccuagugugcacauacuaccuacuaugcuaaauuguuccuaucuaaaggaaaugcagggacaaaaaaaauggagcagagacugaaggaaaggccauccagagacuaccccagcuagggauccaucccaucugcagacaccaaacccugacacuauugcugaugccaagaagugcuugcugacaggagccugguguggcuguucccugagagguucuaacagcaccugacuaauacagaugcagguacucacagccaaccaucaaccugagcauggggaccccaauggaaaagcuaggugaaggacugaaggagcugacagggauugcaaccccaugggcagaaugauaucagcuauucagaccaccagagcucccagggacuaaaccaccaaccaaagaguagacaaugagggauccuuggcuccagcugcauauccuccagcagaggauggccuuuucugacaucaguggaaggggagacccuugguccuguggaggcugaauagaugucccagcauagggggaugccagggcaguaaggugagaaugaguggguggguguguagaggcaaaagggagggggaugggauggggucuuuuggagaggagaccagggaggggauaucauuugaaauauaaauuaauaaaaugauugaugaaaaacauuugguccccauugugggauagcaggaggugagacggucagaaccuuuaagacaugagugagucaucgaucgagguucuguucauucacagauuaaccaaagaaugaucucgcuaucacaggguggccuggcaauggacucagcucuccguucacuugcugccuccagauacccagugcucgcugcccugcuaugauacagcaggaaggcuucuuugucagagacugaacauaaaaaaugauugcaaauuccaagguuuaaaauaaucuuucgccgggcguggcgcacgccuuuaaucccagcacuugggaggcagaggcaggcggauuucugaguucgaggccagccuggucuacaaagugaguuccaggacagccagggcuacauggagaaacccugucucgaaaaaaacaaaaacaaaaacaaaaacaaaaaaaucuuuccucucuggaaagccucuacuauucuagaacccaauggcugcuaagccaggugguucuggccccggggucucuaaagagcucaguucugacgucagagcuuccgcuucaguuuuucuggagacucgguuggagucaggaggucagcgacaucacguggcccagggaaaacucugaguuccagaaccaggagcuaaaauacacccccuuccuugaugaauuacccaggcuugguuauuuuugccacagcaacagacaauagacuaagacaagaaguaaugagacagguagaaauuacuuuguggcuuccaaguccagcccacaaaagguauugcagauucugucuuucucccucagauuucucugucuagcugagggaagccaccagaacauacugagagaccacuccagccaccacgacccuacggagagacccacaaagacaguccuggaaucuucuugccaauagcagcacagacuuguggagaacguaaggaagacaucauagaaacucucuggugucagccaaguuccagaaaacagcucauuggacagaacugggcccuuagaagacauuaagccagagcuaccaggcuaaaccauggcugagcuuuugacuccguucagccuaaucaaccucuuucaagcacaaaugcugggccaaggaagcugggccugagacagcuacauagcaaacaauguagcugagcaucaaauggaacucguuccuucuauguaaagacaaaaaucuccuaagaugaaggaaaucugaaauacccaguuccauuacucugcuugauccagaaguuugcacgccuucugcuggaaaugcucuugauuccacaugcaaugggauaccucagccuugucaugaggcagguuguccugaguacaugccaugucuccuaauguauccugcaagaacacacucacacacagucacacacucacacacagacacacacacacacacacacacacacacacacacacucucucucucucucucucucucucucucuc

SEQ ID NO: 8348 - RNA, 1151 nt, Mus musculus
ggaggagcgagcgcgaggccggcgugggaggagagcgcgcucuggcagcggcggauccacgcugcucccgggcccuucucugcgacccugcagcucgcugucgccugccugcuggccccugcuccuggagcccgguucgggcguuaugcccaggagguccagcuagaaaggcagggccguauccgcccgcguuaggcugucugcagguccgagcugggggcccuguuggcacuuggguugggugguuaggcuucugcgguggagccugcccugugcuuggagcuacguguggguccugauuucugguccuucgucgugaaagacucauacgugggguuagggagucgcaaagugggcggguggcggagucgcgaguggaagagcagaacguggcgcagccgcuugccucuggagaggccccuccuacugccucggugcggauggcgcccccuagggcugagccgagucucagcgccgacuuggccgagcacuuaggcgccaucuauuauuagucuuaguaaauccuucaaggcuacuacuguguucuacuuaacauggucuacgaggucaacuacaugucaaguccagcgugacucucccaaacucauggucaaaacacaagccaaagagugguuuccuuuuuggucagaaggcguugaguccaugguuggaaaccugugggauucauccguaggcacagguguacguugaauauuauuucguuccuucucaaguuuagguuguuaccagagauggcauaugaaauugcaaauggcaagcucaggcaaggccacgggacugacgauugguacauuacaaggacagccuugccgggaagggaguggaagaccccagcuucucugguaccgcaggguuccugguuuccauggcaacuccccaucugaaauuauugccaaucaagauacuauuacaccugauacuucucuccaguguaucaccuuugcaggagucaaggccuaauccacuaagcuaaaacagcuagguccagagggaauugauauuuccucauggcuucucaguguguauucagguccagaccagagaacccaggucaaggaggaacuccauaaauagaagaaagagucccugucccguuaccauggagacacggaacagcauaugcuaacuua

SEQ ID NO: 8349 - RNA, 2658 nt, Mus musculus
uaaauguaaaggagaguuuaauauuuguagaacccgaagauagaauauauagguguccucagguagcaauguuauuuuauguacaguagucaaauuggaaacugacaaaauuaaaauuucagaauugcuccagaaaagauaacugauaauguuacgagauaaauagacaaaaccacaaauugggacaaauacuuaaaaaguuugcguuuguguauauaaagcacuauugaaguggaguaauagaaagucguucccuuuucaaaaugggaaagcaucugccagucaccucacuaguaaagacacauagauaggaaaucacacuuugaagaugcuggccaucucaucucgguagucagaugcugaauguccuguguucuucagugccaacauccggagcccuagucuguucugggcaugguggcugucagccucacaaguccucuuuagaaauaccuugguaaauauaaggauuuggaagcuaggcuugguguugcauaucugcaaucccaggaaggucaggaguucaaagccauucuucaguacagagugaguuggaggccaguccaacacaugcuaccuucucucaaaagcccuuuguggcuuguuuauuaaaugugccuugcuuucuaggucuuauuuaauugcauuucuucuaauuacuugaguuccuuagguguacugucuuguugggaugauguagcaguuuugugugucauacagccuauagcaucaagauuuucuuuucccuugaccaucuaggagacaucuuaugaucagagugaagguucuuguucuucagaagaugacgaguggagaaaugacagaagaagugguagugacagcgacagcucaagguaccacgagugucugucccugccucagacaaagacacgugcuccacuagcucaggacuggacaggacaccacacccuacaaugcuuugugucuuaguaaagcaugcuaacacuaauuauuugaaggccauuuaaaaugagcauucaaagugugugggcaaccuuuucauguauuuauuaacuuuuuaaaugucuuuaguuaggaucuagguuucaauaugaugagaaugugagccugcaucuuuuucauauugcuucccuccacagaaaugacaugaccauccccagaagcuuucuccauguccguagugcacaggccaucucgccuuugcugucuuucuguggugcucucggucuccuuugcucuguugugacugguuccugacuguugucccaaagcauaagauugugcacuauucucuuaagaagguuuuuugaguugugcaaugcucaugacauaaaugcugaucacacugugaagaucuugagagaugaaugaucaaaucaccaauaguggccacagcugacaccugaucccuugauguguggugaagcuucauugugggcaagaacuucccauacagucuuuccucagugugacuuguaucuguugcugcuuuccugcauucacuuuaagcuuucucuuugggaugaguugcuucccuugggcucacuugguggcugcauuggugguuggugaugcagguagauuuaugaaucaguaucuaccagugucauggaggugauggggcucuuccuaggguucucuaguacuucucaguaacuauguucugcuuucugagagggaaguuacugcuuggcuguaggccugacuuugaccagcugucauuugucccagccugcgggacaguuggacagggucugaggaacuaccuguggagagaauggggaggugagaaacacaaggacggacagcaagucugauugaucaagugucuuuuaugcccacagaagcaggguauggggagggggaugacgcagaaucgcucuuuguuucugggagaacucaccuguucccaaaagcaggauauuggcuagguaaaaaguucagcaggagaaacagaacagaauggguugcuagguaccuguccacaagaucuuuagcuauuuguucuuaacuggggauaguacuuucccacagaggccucacuuuucccacagaaaucucaacuaagcuaguacuuuuccacugaggcuaagacuuuguaaguaagcacuuauggcggacaaggcaguuaacauucaaacagggucgguugcucccaacagucauuuagaggguacuugacagaagaaggggcuggagcuguggcucugauuguagagcaccugccugcugcgcacaggguugugggcuagaccuccagugccacggaacgcaagaagcuccuuccuuuagcuuggguuaaacaaacaccccacauuaccuucuuuccagugauggugaagaguucuuuguuucuuuauucauuucauguauaugaguguuuugccugaauguagucugugcccuaugugcaugucuguugcccaaagccagaagaccugaaguuccugacaguuguggcccagcccuggaagagcagcugaugcucucucucaccuugagcugagcuguguuuucagcccuggggaagauuucuuucuccaucuuugucaugaucuguaaccugugggucuuagcugguaguauaagaaggauguucaaguuaagccgaagcucucaucuuucucucuccauguucacccucuuauuccucugggguucuauuuggaacucgcu

SEQ ID NO: 8350 - RNA, 12682 nt, Mus musculus
cagugcgcaggcguaggcgagcgcggaggcgcggucaccauggcgcugucguagcggugcaggugccugggauccagcaugagcgcguccgagacggaccgcugggcguggcugcugguguugagcuucguguucggguguaacuugcugcgcauccuccugccgucccuguccucguuuguaaguagcugccgggggcggggagcggccgagcgcggggccuugcgcgguccaugcugcaagcucucuuccuccaggugccuccgagcuucucacagaucgcgagguugcaaccagcucuggagggugggaggucccaagccacgcuucgcgacagaggagcagccccggcccagcauccucacaggugccuggcuccggagcggcugauccccggcuacagggagcccccuucuguucuguccgugggaacaaggaacacuacagagcaaucuaaacaggccauaccguucuugcacauucagguuucuguuuauguaugggggguguuuuuccugcguguguaucugugcacugugugcuuucauugccagcagaguccagaagagagcgcuggaugcucuggaauuggaguuacagacauuaguuaucugccacguggguccugggaacagaacccaggcccucuauaguaguauccagugcucuuauccacugagccaucuccagccccaacauacuuuccauauuuuacucaugccuguauaaugaagucugcacacaguucuccaaaggacuggaugcagaaagguuuagaaggacuuuucuguguacuggaagagggauuggggacuacuaacuggggauggauguccccacacucaaugaccugucugcaaaguucucuucaucuguccugcuaucuguagccuuuaaaccauuuaaaaaaaacuauuuguuaugugagaguuucgcuugcauguauguaagugcaucacacguaugcagugcuuuugaguccagaaggggcauugauucccugacacuggagucaaggacuccaugugagccacuaugugagugugcucuugaccacugagcuaucucuccacccucuuaaucuguagccauuaaagauuuuauguguguguguguguguguguguucugaguguauguauaugcaccaugugaacgagguugccugaggaggccagaagaggcagucacauucucuggaacugacuuauagauggugugagcagccacaugcaugcugggaacugaaccuggauccucugaaagagccacaagugugcuuaacccccaacacaucucucuaaccuguaucuauagccuuggaaaacauguucuguaauaaaccagugggcaagauuuuugcucugaguuucgugagcuggucuagcaaauuggugaagccugaagaggggucaagggaacucugacuuguagcugggcugugugauuugugagugagacccccccuccccaucugugggauuugacacucucugcagaauggggaauaccuagcaugugaacccacacauuugggaucacugcagucaucuguguuguggacgguugguaggagagacugaacaugauaccuucaucaucugucuuucuggagaggcaucuaguccuucaccccuguaaucuuuuuguuaguuucagugguuaaaguugcuuguguguuuggcuagcaaucccuugugguuauguguguucucauucugcuuucuuguguguuuuauuuuuccaccguguguguguguguguguguguguguguguauguguguaaggcugaggucaguuggugucaaggauagcccuuggccacucuucugccuuauucauugaggcagggucucucaguaaaacccagaguacacugacugggcuagcuugcuguggggacccuggcucccucccuaucuacacucaccuuucaggugguuccuugugcuuguauagcaggaguuuuagcuccugagccggauccuuaccuugaggguuccacguccuccuguccugugucuuguucccuuucaccucacagucgagcuaagggaauggaacucagauguuuagggaggcuguguugggccauccuccucacugagucaugaguuuccaguagcuagcagggcgggaggagauagagauccugugaucgacucaggguccuccaguacacgaugaccagacuugggcguguucuguauuagucccuccucacaaaggaugggcacuguagcuuacuuguaucaguuuaggaguucuauaaaaucaugauaaggaauuaggaaauuaucaguuccucuauacagcauugcuacaugagcuucuaacaguggcaggaaugcauaccagcagcgggaagcgauucuggaaugaagucucugagaauccugccucucagagugcacccauugcagccaugcaaaaaugguggaccaucuucaggaaacucagcugcuugccauaggcuuuccuagauggcuucugucagcuggagugggucuggugccugugguuguccuggauggaauuuucccgaggguccuucccuuuaggucggucacgacaugcguagucgagaccguguaauuuauaaaguaagggauccaauguugucuuaggagaaggggacacuggacacaccgugugcucauacaugggagguacgcugcucuggugccccugaaaugacgaguacaggugggugaggcucuugugaguuuugcagaauucccaggacuggcauggccguccuggacuugcagugugcuggugcccaugcuaaguuccugacagacccugcucugcugucagucacaugugcacacaugcuucaggggccuggcugguguagccagcuucucgagguguguucagcaguuuugaaguuacccuuugcuuugugcuccaagccuuagguacucgcuuuccacagaccagacucugagcaaagcccuuguuuggaauguuauuuauuuauuuauuuuuugagauagaguuuccuagcuaucuugaaacucacucucuagaccaggcuggccugaaacucagagauugccugccucauauuuaugagguuaaaugauuuuaaaggcaugcaccaccaugccugguugggacaggauuuuguauggcuuccaaguguuaggaugacauagcaaccuacaggguguacuccuggggccuugacggagagguguguucuggguguugggcagaaugcugggccagcagggccccguaggguacacaggcgggggggggggggcaggcauuucaggagggauugguccugccuagggaguugugcuagaugacccuggugcuagucagggucugugcagguuucugggcuuucuguguucagguuuuggucucuucauacuggugaccuggguuggucauuuuugagcuugccugaggaauccagaagggaggagcccggcagugcaugcuaugcugcuagcuuucagaucugucggccccugggucaucagugacaguguggccaccgguucaguccuggacaaguuugucuauuggcagagggcauccuggccaaacaggacugaagcccuggaggcaggagcacaguauacuucccugcaggcagcuaacgucugucugcagggugggaagaaggaagcugagcuccuguccuuugcuccgcuugagucaucuggguuaaaaauuucacaaacguagugccucugauugugaguaauucuguucccagggccuuugugaguuugaaucaucuguuuuuucuucugagauguaccuacuguggccaucauguuggguugcagguggcuggcuuugaaccucuccagcuucccaaaugauggggugaccagagcaucuccaggcuacuucccccuggcccuguggggcuggggguguggcaggaauccauggagccauagggugccggccuggaacaagagugggguccggguguguccagacccgagaugaguaggaguaagauugcucccacccucugccccucagaggagguuacggagcccagcaaccacaaugggcuucaucuccuuauaagguuacauccagcaauaucugaaauuccucucugugcuugaggcagccgcaacaucccggccccagccaaugacgugcauucucccugaagaccccugcacacucccuaaagguuuaauaauagccuauguucucccaauuaaacaagcugucuuauugaagccugucucccgagagucuguucucuccuccugaggucuccuucccugacugugccucucacacccacccccacgcuccaccucaggaucugcugguugugaccacaggucauguugcuaugggguggggaagcagagcccuaaugacauguuuccuguuuaagcauccuuuauaggggcccugauuuuuuaaauucaaagcuuuuguauuuauguauguauuuaaugugcacugguguuuugccugcauguaugucugugugugucagauucccuggaacugggaaucuaguugugagcugccaugugggugcugggaauugaaccuaggucuuuuggaagagcagccaucuuaaccacugaaccaucucuccagccuccccucccccugauuuuucuuuuuuuuuuuucuuuuuugcaaccccacaaaagaaaaacaaaaacuuguggagauuguagcguguugcgcaguauacccuuuguccacacgucuuugccagcgaacacuguaaauguucguugcaaugagucauuacucugguuugaggccucuggcuucugcucuccgucauuggguccucaccuggacuccucugguguccuguccuugcccugugucauggagaugcugcagcuuuggaucugcaggaucagccacuucaugugcucccagaguucauggauuguguagauguugggaugggugggcaagcucgaauuccuggaucugggccuuggggguagcugagucggucggccugccagcucuccugcacccauaccaccagggcagggucuccaauacugaccuggcuagccuuccugagugcuacagguggcaaggagcagggccaacuccaggcagcaagggauguggagggggagggagguugguucucugauuuugaaugauagcucugugacuuuuuaaaaauguuggccuuuaaaaauacuuauuuuuuuauguggaugguguuuggccugcaugugugauguaugucuguguaucaucugccugcauguaugauguauaucuguguaucaccugcauucauguauguaugucuguguaucaccugccugcauguaugauguauaucuguguaucaccugcaugcauauauguaugucuguguaucaccuaucugcauguaugauguaugucuguguaucaccugccugcaugugugauguaugucuguguaucaccugccugcaugugugguguaugucugugcaucaccugcaugccugguguccauggauucagaagaaguuguuggauccccuagaacuggaguuauagaugguugugaaccaccaugugggugcugggauugcaccccaauccucuaaaaacaagcacucuuagcugcugugaacguuagagacuuugguccauuccuauuuuuuuuuucuccaggguggaccagauuggaauaacucucccuuugaguggagaacagugggcauuagagaggaagguuugcaaacccuguuccuuguccacugugcagccuucagggugacucacagugcuggccccagcccaggggcuuuaacugcgaguuccuuauggggccucggcuugugugccuggacugucugccgacacugccagggucaaggguguggcucuggcuguuacugagguugccuuucuuuguggcaagcagagggguccucugagcuggggguggugccauugcuaugggccagcuaaacuuuacauacucccucuuuucaucuuuaaaaccagcagagcuauuuuaaagauugggcaaacagcaguuuucccccugaacccuugaagguaaguugacagcccucugcuguucuguacuuugugagugagcaaaggucuuggcuguaauacuggugacaaacgugucacugacguccaguuugaaggccugcuuugguguccccucaugagaagagggcucuuuccagcagugcuguguuuggaggguccuggacaaugcuguguuacugcucauccauuuguuggugaggcuugucucuggcgauuucugccacuggccuggccugcaccuuucugcaccagggugugaccaccuaguccugggacccugacaagcccugacagguggugggcgccaccugguggccgcuguggcauguauccggaacacacaccgaugccggccuccucccugccagauuuccagggugcugcagaaggaugcagagcaggagucacagaugagggcagagauccagggcaugaagcaggagcuguccaccgucaacaugauggacgaguuugccagauacgccaggcuggaaaggaagaucaacaagaugacggacaagcucaaaacgcacgguacucgucuugcagccaugauggagggaggggcgggugggagcagggggggugucuuuguguguggauuugagguacauguguuacuucucguuugcugguaaacccuuugcuuucuuucuuguuuuucgagacaggguuucucuguagcccuggcuguccuggaacucacuuuguagaccaggcuggccucgaacucagaaauccuccugccucugcuucccaagugcugggauuaaaggcgugugccaccaugcccagcuaacccuucuauauccagaaauccuuguagacuuuucuucagagccaauuuguccucugcagauuuuaacucuugagacuggcacuuugcugagggcaguccagacaaagaacacacagugaguccucaggguacuuggcacucucaggagcagcuccugugugaguagaggacugugcacacuugagucccaguauucugaggcagagucaggcagcucacuagccagggcuucauagugagguccugucuaucuguuugucucuucuuucuccuccagagagcaaugugucccgaaagccccugcugggcuguguaagguggagcaggcugugcagaacacaggcuugggagggcugggcuccuguaggaggcucagagauggugcagguuagaaaaugugggugauguuuagcucugucgaugagugagcggcaagugcguuggggaagagucucucaggcuacagugacuucaagaugcaggcugagugggugucuacucaaacaauagcauagccacccaacuugaaauuucguaaauuggcaacagaguaagagauuuauuacacacacuguuguccuguuugauguuucugaguguguugguuaucaaucagcgauuagagagagcgcguuuagugagggaaaugucacuuccgaguguucagguguguucucaguuuugcaggauugacuccuguuucaccgugguuuuguuucccuuucagugaaggcacggacagcucaguuggccaagaucaagugguuuauaaguguugcuuucuacauacuacaagugagugucgccugggcucugacugcacggcugugauuauuuucccuuugccugcuuguguaugugcacauguguguaggcaucuuccugugugugcaggugcacacgcguguacagaggccagagggggauguggugucuuucuugacugcucggcucuccauccucuaucccagggcagguucuuucacgucaauguaaaacuugccuugcgaucuagucaguuugcuuaggccagccugcgucuaccuccccagugcugggauuaaaagcgugcaccgacuugacaauugccuuucuuuucuuuuccucuuuaaguuuauucauuucugugggcggguguuuugcuugcauaaauguuugcacaccauguauguaccugguguccuuaggagucagaagaggauauuagauucccugggacuggagucagagacagaugugagucaccgggugggugcugggauuugaaccuggaucuucuggaagagcaggcagugcucagcagagccagccaucuuguccgcuucccgcucucccccauuuuucucacuaccggggugggguuggggugggguuguguucuuugccuucuggaugcugcuuccgguacugcacagagacucauccacaaagccucgggcauccauccugcccuccucaguccgagcguuucagcacagccuucaggaccacagaaggugcuucugggaaaggagaagaggugaaacauuaguugucaccagcuuggagcugacuugggugacagagggauuguggaauccuggcugcuuuuauacugacuggggcagacucagcucacuuaaauaaauaaauaguggauguguggcaucuauauuaaaacagggaaaugccaguucccacaagaaggcccacccccacccccccugucaccagugugagauguuuuugucuggaguugugugugugugugugugugugugugugugugugugugcacguucgcguacacucgagugauggaguugugaggcccccacucaccgcaggcuucuuccaggcagcgcugaugaucucgcucauuuggaaguauuacuccgucccuguggcuguggugcccagcaaguggaucaccccacuagaccgccugguagccuuuccuacucgaguagcagguaauuguuuucuggaaauacggugguggugggagauuagaugaucugacuucauccuugcuguccccucagcaagccgcaccucuugucccagccuucuguggucuggagaagcuacuugccaggggcagaguuacauccccgguacccagaggccacuucucccggugucucccucucugaguagcuugcuuaucuuggcuguugccuuugaguuuugaaaguuccuuuggauguuaaagguuauucaugucauugaagaaugaguagacauguaggaauauuuuuucggguuggguuuucuugagacagggucucacuguguggcccugauuggcuuggaacuagauuuguagaccaggcuagccccaaacucacagacaucuauuuaccuuccccaguuccuaguacugggguuaaaggcaugcuccuccaugcccuggcaacauaggaacuauuuuuuuaaaccaugccaguuggcauacuuucagucuagcacuuaggaggcaagcaggaggaucucugaguuuuaggccuucccucuuggucuacauagggaguuucaagccagcugugcuucaaaaaaaaaaaaaaaaggcacuccgccuacaaaauccauuugguuacagacaaacccuuaauguuucuguuucuuccagccuuucuugcugucuguuuugaaguggucaaggucaccugauguuuuaucccuuuucccucgauguugcaagcccacucaggaaaauaccacagugggcggcuuaaacacacagaccggggaucacuaggacccauuuugugguucauaaguggcacccucucaggggcccuuggguaggaggaggaaagucaggcugcaccguggaggcuucuuccuaaggcucugugaucucagucucucucagagcccggccuaccaccguccccaggguaggauagcuuaugaauuaggguccauacuugcaggucacagcacucaguagcugcuugucaucugaauuuuccugugaggacacuuucuuggguccugaucuuaacuaguagaaauaaaacugcugggugugguggcucaugccuguaaucccagcccugggggaggaggaggaggagaaagaggguggauugcuccaacuucaagaccauuguggacgacaguguaaaagccuguaaaaaccaaccugcauauucucgccaguccuggguucugauguguggugaauauuguucauacuguagugaaauucgucauuaaaagagagcgguugcaaggaccuacagcuuagcugugccgcguuucccucucccccggccccauugggcucaggccugaggagcagccugcuggccugcuggccaccuugggcagcucucugcugagcugcuggccucacagccugggcagggaggaugggaauggggauaccuucacaugaggccucagaagacaggaauuuauuuguagugcuuuuuugagacaugugaaagaaauaguggcucaggguguucuuacagccuguugguagaccagggacuucucugucaggagaugcauagugcagcccugucuggcccugccgaaggggcuccuucucuugccccuugguacuggcaucuccucccuguagguggaugguaacuaaggcuuggcugcugcgccucugacuugaguuucucucuuuucagguggaauuggaaucaccuguuggauuuuagucuguaacaaaguuguggcuaucguucuccacccuuucagcugaggggaaggccagcuacaagucuuuacaaaaggauucugauaggguaaagagcggauugcacacaaguccacagauucuuguguuuuauguuuuggaacauuugcuuuugugugucaccugggauucuuguugaagucaggauuuucuacacccgccauugagccagaaagaccaguuacggcacucccauaucgucugauguaggucuggauucauaccaacugggaaccaccacguggcaucugcugaugcuuguuucugggcauggcuugggucuguugccagcugcagagucagacuuguaacaacuccguuagugcuguuuuaauuuuagaaaaacccacacuuucguaccacuacuaaaccuccuuuuuaucucaguuacagaaagugacgcacacuagugauguagcuguacuugucuccugaaaugucacacauaaguguguggaaaguaucgcuguaugucuaaguuuguucauuuuuuauagugcuuccuacauguguucaugagacgacguguauuuuuauuuaaagcauuucaaaugaagucugucuuuaaagcauuggguguuuaugcugugcgcagaauaggguuaaacaaggugcggucugauccaguucaucugagacuccuuaggcucaugaaguuacuaggcagaaaucugccaagucuguuuuuuuuuguuuguuuuguuuuuuuguuuuuuuuuuuuuuuuuuuguuuugagacaaggucucucaguguagcugcagcucuccugaaauuauguagaccaggcuugucucaaacccacagagauccaccucccucuaucucccagaugauaggauuaaaggcguaugccgcuacuguuuuuguauaugccgucaagacuguuuuugaagcacuuucccuaguuacaguauuugccagugcuagugugacugucccaccagccuuacagcaggagcugggcucacugccugcgcugcaagcugcgguauucgccccuggggaaccauagcacagaaaagcucccugacagcacugcaggucucugcacagcucuggcuguccuggaaucacuauguagaccaggcugaccuggaauuuauaggaauccucucgucucugccucauagcugcugggauuaaaggcguagcacuggguuugaaggaucauauuuauacuccaguguuuccuaaugaucuccuaaguagcucuuuguuuuccugacuguacugugaacaggcccagugugcggcccuuggauugguuguagaccgagugccaccagagcaggcuugagaguccauugauuuaaacuccgcagaugcugcagauagauccacguggcaccaagauuacuuggcuguauuuguugugggcacaaacggaacauaguaguaggcauagccaacauugccaggaggaccugcccacuagcuccagcaugcucaucacgaaggaagcacguggucuacacaagauuauuuugggaccugaggagguuggcugcagaaucuggguucccucuggguauucagcccucggggugagggagggugugcgcuuuccucuuuuuugcagugagccauagucugcaauggcgcuuuuugcccacaucguuuagguagccugggucagcaucccaaggccacuuggaagggcaaucagaagugcccagaacagaugccucucaugauuucagcugaccugaaggaacaaaugacuuaguguucccauguguguaauguggaugucagcgcuuccacaugcauaauguauguaagacuguuaguguucccauguguguaguguauguaacaccgcaaguaggggacagcuguguuuuuauccccaaauuguauuuguuuauuaauggguaauaaacauugaguuaaaaagggacuggguacuguggaaagcgugcuucuguccccucccgccuuggcaguuucccaggcucaggguuaccugcuuuauaggguuguccaagguggucuguguuuaggaaugcuggucuguguuuaggaaugcuggucuguaugcauuuaaagccuuuaacauuuuuuuuauaaaaguaaacaucuaaaaaaucuucagcuuuuuaaauuucaauuuaaauuuuuuugagauagggu

SEQ ID NO: 8351 - RNA, 2111 nt, Mus musculus
gcaugagcgcguccgagacggaccgcugggcguggcugcugguguugagcuucguguucggguguaacuugcugcgcauccuccugccgucccuguccucguuuguaaguagcugccgggggcggggagcggccgagcgcggggccuugcgcgguccaugcugcaagcucucuuccuccaggugccuccgagcuucucacagaucgcgagguugcaaccagcucuggagggugggaggucccaagccacgcuucgcgacagaggagcagccccggcccagcauccucacaggugccuggcuccggagcggcugauccccggcuacagggagcccccuucuguucuguccgugggaacaaggaacacuacagagcaaucuaaacaggccauaccguucuugcacauucagguuucuguuuauguaugggggguguuuuuccugcguguguaucugugcacugugugcuuucauugccagcagaguccagaagagagcgcuggaugcucuggaauuggaguuacagacauuaguuaucugccacguggguccugggaacagaacccaggcccucuauaguaguauccagugcucuuauccacugagccaucuccagccccaacauacuuuccauauuuuacucaugccuguauaaugaagucugcacacaguucuccaaaggacuggaugcagaaagguuuagaaggacuuuucuguguacuggaagagggauuggggacuacuaacuggggauggauguccccacacucaaugaccugucugcaaaguucucuucaucuguccugcuaucuguagccuuuaaaccauuuaaaaaaaacuauuuguuaugugagaguuucgcuugcauguauguaagugcaucacacguaugcagugcuuuugaguccagaaggggcauugauucccugacacuggagucaaggacuccaugugagccacuaugugagugugcucuugaccacugagcuaucucuccacccucuuaaucuguagccauuaaagauuuuauguguguguguguguguguguguucugaguguauguauaugcaccaugugaacgagguugccugaggaggccagaagaggcagucacauucucuggaacugacuuauagauggugugagcagccacaugcaugcugggaacugaaccuggauccucugaaagagccacaagugugcuuaacccccaacacaucucucuaaccuguaucuauagccuuggaaaacauguucuguaauaaaccagugggcaagauuuuugcucugaguuucgugagcuggucuagcaaauuggugaagccugaagaggggucaagggaacucugacuuguagcugggcugugugauuugugagugagacccccccuccccaucugugggauuugacacucucugcagaauggggaauaccuagcaugugaacccacacauuugggaucacugcagucaucuguguuguggacgguugguaggagagacugaacaugauaccuucaucaucugucuuucuggagaggcaucuaguccuucaccccuguaaucuuuuuguuaguuucagugguuaaaguugcuuguguguuuggcuagcaaucccuugugguuauguguguucucauucugcuuucuuguguguuuuauuuuuccaccguguguguguguguguguguguguguguguauguguguaaggcugaggucaguuggugucaaggauagcccuuggccacucuucugccuuauucauugaggcagggucucucaguaaaacccagaguacacugacugggcuagcuugcuguggggacccuggcucccucccuaucuacacucaccuuucaggugguuccuugugcuuguauagcaggaguuuuagcuccugagccggauccuuaccuugaggguuccacguccuccuguccugugucuuguucccuuucaccucacagucgagcuaagggaauggaacucagauguuuagggaggcuguguugggccauccuccucacugagucaugaguuuccaguagcuagcagggcgggaggagauagagauccugugaucgacucaggguccuccaguacacgaug

SEQ ID NO: 8352 - RNA, 2111 nt, Mus musculus
caucguguacuggaggacccugagucgaucacaggaucucuaucuccucccgcccugcuagcuacuggaaacucaugacucagugaggaggauggcccaacacagccucccuaaacaucugaguuccauucccuuagcucgacugugaggugaaagggaacaagacacaggacaggaggacguggaacccucaagguaaggauccggcucaggagcuaaaacuccugcuauacaagcacaaggaaccaccugaaaggugaguguagauagggagggagccaggguccccacagcaagcuagcccagucaguguacucuggguuuuacugagagacccugccucaaugaauaaggcagaagaguggccaagggcuauccuugacaccaacugaccucagccuuacacacauacacacacacacacacacacacacacacacgguggaaaaauaaaacacacaagaaagcagaaugagaacacacauaaccacaagggauugcuagccaaacacacaagcaacuuuaaccacugaaacuaacaaaaagauuacaggggugaaggacuagaugccucuccagaaagacagaugaugaagguaucauguucagucucuccuaccaaccguccacaacacagaugacugcagugaucccaaauguguggguucacaugcuagguauuccccauucugcagagagugucaaaucccacagauggggagggggggucucacucacaaaucacacagcccagcuacaagucagaguucccuugaccccucuucaggcuucaccaauuugcuagaccagcucacgaaacucagagcaaaaaucuugcccacugguuuauuacagaacauguuuuccaaggcuauagauacagguuagagagauguguuggggguuaagcacacuuguggcucuuucagaggauccagguucaguucccagcaugcauguggcugcucacaccaucuauaagucaguuccagagaaugugacugccucuucuggccuccucaggcaaccucguucacauggugcauauacauacacucagaacacacacacacacacacacacauaaaaucuuuaauggcuacagauuaagaggguggagagauagcucaguggucaagagcacacucacauaguggcucacauggaguccuugacuccagugucagggaaucaaugccccuucuggacucaaaagcacugcauacgugugaugcacuuacauacaugcaagcgaaacucucacauaacaaauaguuuuuuuuaaaugguuuaaaggcuacagauagcaggacagaugaagagaacuuugcagacaggucauugaguguggggacauccauccccaguuaguaguccccaaucccucuuccaguacacagaaaaguccuucuaaaccuuucugcauccaguccuuuggagaacugugugcagacuucauuauacaggcaugaguaaaauauggaaaguauguuggggcuggagauggcucaguggauaagagcacuggauacuacuauagagggccuggguucuguucccaggacccacguggcagauaacuaaugucuguaacuccaauuccagagcauccagcgcucucuucuggacucugcuggcaaugaaagcacacagugcacagauacacacgcaggaaaaacaccccccauacauaaacagaaaccugaaugugcaagaacgguauggccuguuuagauugcucuguaguguuccuuguucccacggacagaacagaagggggcucccuguagccggggaucagccgcuccggagccaggcaccugugaggaugcugggccggggcugcuccucugucgcgaagcguggcuugggaccucccacccuccagagcugguugcaaccucgcgaucugugagaagcucggaggcaccuggaggaagagagcuugcagcauggaccgcgcaaggccccgcgcucggccgcuccccgcccccggcagcuacuuacaaacgaggacagggacggcaggaggaugcgcagcaaguuacacccgaacacgaagcucaacaccagcagccacgcccagcgguccgucucggacgcgcucaugc

SEQ ID NO: 8353 - RNA, 2950 nt, Mus musculus
cccaaguaggaaguguuauuuauucauacugagucagacaucucgcuucuuuucagugguauauaucuuagcaggguggacaaguacaaaaauaagauuauucuagaaaacuccagguuggagggccuagcaaccauguggccauuugugaggagcuacucuguggcacgaaugccucucuguuuugcacaguauucuaaucacaauuugauuugaaaucaguucagugcccuggaaauggagggagauucccccaagaaaacauuaaccaguuagaagcaucuucagaaauacaauugccacucaagaacccuguagaaaaaaaaaaaaaacaaaaaaacaaaaauacacuguauaaaacacuacuuucugccucuuuuagaauucaguagauggcuuggaucauuuauuuauuuguguauuuacuuacucaccaucaaggucuuaucauguaauucugggugguauggaacuguguacagaaggcauuguagagaucuacaucugccuuccaagugcugggauuaaaagcaugugccacuaugccuggugcauggcuuagagcucucccagcagaaccgaaaccuuacaugccugagaagcaggagacaugaguagcccuuucagugccuagaggagagcaucuuaaaccuuaaggguacucaaguguguagaugaacagaggcaguaggaaacaagcuguuuuacacuccaaacuucagcuuuuacuugcacgugagaaccccaccuacgcugugggucuggacugagucaucgcuaaagagaccagccuucagcuccucacugguaagaaugcaugauccugcagcaaaggaggaauugaugaggcagcauuuuauacuccgggggccaaaggacaagaguucgcaaagcuacgaagacauuucccuuccucacguccucccaccuuccuuuucguauuaggguuuugugaaugcuaggcaagaacuauacaagugaacuucacuccuaaccccaagaaauuguacuucuugugauuuuuacuacggauuaauaaagccuuaacuagcuauguuuuuuguuuuguuuuuuaaucucagaaggagauuacccaaugcucucuuaacacuucauucuucauucagcagaacccauccugacaacguggagccccugugagaguuuucuuccccugauaggaugccacagcuuuacuuaucucagaagguucuaguaguguccacacagaacaaggagcagcagaaaucagcaagccaggucccacucagaucugugcaucuguuacaaauacaaacuaucuaauuuccaccccaccagagaagacacagcaguguuaaaucagguagggcugcacagaaagcgcaggugucaguggucucuuuuuacagacaccaaugugauucacagcugugcuuagcuuaagagagggcugauugugccucuaccagcuguaauuaugaagcauauggguaaaaauucauauuggcugugugcucuacucugaugagugagggacaugccaugugcuacagcuuaucucacacaaacauuucuccaguuguaaaugggggugugugcgucuggcacuuuccugacacugacuauuccuuaauaaaugauuuaauaucauacacuucugguugucacugggaugcaaauguuacccaagguuugaucaaaaaacaaaacaaaacaaacaagcaaacaaaacacuacaaguccuaauagggauuugaacuuacagucuagccuucaucuacuaucuucuccuuaagaauaaaaauaauagggcacaguuaaauuuagaaacauagggcaucugggugugacaucugauacuaaauccauaggaagcuuguguggugggagggaggaaaaaucacuguccuuugaauuugauauuaugaguacucacucgcccacuccuaaugaacuccucauucgugggcuuuguagacacaugggugccaccaggaggcucaguuugguuuucaaaaucuuuagcaacaugacaauugcuucaguuuacucucugacccagugcagucaaccagacuauaauucagaugccugauucugaaugagacuggguacuuauggacccuaagacccaugagacccacuucuacaggaagaucagagccacugaagacagggcagagauuugaggcugacaacaggguggguaagugguccaacaaggcugguuaucaugggacuguccagcucuggcugucaauaguccuuccuggguacacaguccccaaaagaaacuuggccaagucaguguggcccaaguaacuuucccuugcccagugaacuccccagcacauagccuugaaccugcagccucagacccggguccugcuccugaacucaaggaauucuggucuuacuggaauaggcaucuucuaaacaaaacaaaucgucuucugcugaaugucugcucaguggccagugaccaauucgagggcuucucuuuggagauuccaaaaauguaggccaugcuaaaaacacuggaguaaauuggguugccuacacuguucagggauaucuugacucuccagaacacugaaacugcaggcugaggugggggacauaccucuccuuuucccccucgaagaguuuagcauuuauuaacucccagggauccuaaacucuuugcugauggaauugcccaaucucuguuuggcucaggcaacaugcaggcuaccugucucccacauguccucuaugccaacauugacuucagugcucaaacauucuugaaauuggguggaggggaguuauagcucuguaaaauaaaaaugacaccuccaacacaguaggcuaacuggaggaugaaagaaagcuaaugcccagauggaagaagcauuuuccaaaucgcuaacucugcuuauucugggaccuugcuuuauacccaauaugaguuucuuaccccacccca

SEQ ID NO: 8354 - RNA, 2823 nt, Mus musculus
aucauuuccagauaaucuuuaaucagaauaacucaucgagggaagcaacaaccauuuaacaguuuguaucauaaaugagcagaaagaggcaugugaaaauccugcauuguguauagaguuucugauccuuguuugcuaagggaaauaucuguaacaucuuuuuugcugcacgaaggcuucucugaguuggagcacaccagaugcugucugccacaucccuggagcuuacauuccucaaucgauagcaggagaugggaaggaggaaggaaaacuauugggggcuuuuacagugauggggcuuuuauaaugcugauguuaugauuucauuaaguagaauaaccaaugauaucacugcuccugggagcaggcuugugauuguuuaaagaaagauuguuuaaagaaagaugacucgagcuauucagugccacuugguugaaaggucuaacagguagucagaguccucacuuuugcggagaccacacaucugucuucagguuccagaaccccaccagagauggacuccagcacuuuucacagcacaguuaucuacaaauacagaaaauaauacauaccugagagacaauauauaaauguaaacaaugugguaaagccuuugcauguagcaguagucuuacaaaucaugagaaaaagucaaacugcagagaaacuccauaagcacagacagugugguaaaguuuugugcuuccugggaucuucauacaagaguaaaaccuuuaguguguaaucaaucuguuaaagccuuugcauaucucaguagucuuugaaguccuaaaagaacucauacagaagggagucuauaacuauauaagauuuuaucacugcacacacaaaagauuaauugagagaaaucucuuuaauggcagcauguauuuagcucuggcuaaugcucaaagaagauccagcugggaauagauuuuaauuuccaccuaugcugucacccuuaagccccuuuuagguucaggucccagguuaauuuuugaacaauuuaaauauggacuggagacugcaugucuaaccaauuagacagacacacagcaaauauagucccagaauuacuucuuaaguacaccaguguccugaaacaacaucagugacagguuccuaaguacaaagucccagaggaugaaaaagacaugaaaaguagaaggcagaaaguuacaaaagcugggguggggaggccuugcagaagccucuguguaugaauguuuagcuucccagugaggaagauguguuggcuaaccauagugcuccacuggguuuguuaucugguuccuguuugccuuccaggguucacauacuuaccagcugaaaaguagcugcaguuuaccuaagcccagcaugaaggacucaacccaagugaaauuagaguauuuggggguuuauuuggggguagcucucuaguggauucagugaucccaaggaaccagagaguucacuagucccaaggaggucagagaaguuaugggaugggaguauaaggagcagagguggggagaaggagcuagcaaggcaugcaggggggagggagauggagagggaaguggagggaggagggggaagggcaggagaaggaggaaggaggaggcagagagagagagagagagagagagagagagagagaaugaaacagagagacaaagaguacaaacugucaggauuauauaggaagaucuucuggagacaggaaagcucaggguacaagguggggucugccaacuuugcuauguaacagguggagacugaggagagcugggagaaccuggagguucagcuguaaccuucccagccuugagcaggcuaagcagaccuugaacauucaucuugacaggccuuaucaagcuggauagagacaugugucuuggcugcaguugcagguucccaugggaacuuagcuguuuuggcugccugugcugaccuuguucuacaacauauuccagcuaaagaaggggauggguuuugugguuuuucccuuuauaaacguaaagccuauuauuaaacuuugagucuugaucagaaucuuugucuugacuucauucuucucucgcguaccccccacccccaucuuuucauuuccagcaccccuuucagguaaacucaguucucccgcggcugcuggauggcuccacccagccagcuuugguguguuaaauauaugcagaucagaagcuggucccgggucugaaucccaaccgcaacaaaacuauuguuuccccaaaucucuuuuuaaucguuaauauccugggcacccuuccgcuuguaggacagauugauaacuccacugcaaguugagcuaugcaagcuaacuaccuugauuccaggaggaaggcaaacagucuacugagugaggaaagcucaggcugaaaagucaaggacuugcugagcacggggucaacuguucacauaggggaggagcaagcggcugagcagugauaggugcaguggugguuccucccuggggcugugcggggagacagaaggguaggcuauuggaggaccggcacaaguauuacagaaaugaaaaucccuguagaucuggaaaaggucgucccuggauuugaagcuuggucugagaacuucuacacuguguggcuucagcacacucuaacucuaagggaggugcucgacucacucaagacuuacuggccaaucagagccuccaggcagaccugcgugucagaagagaaggcggguuuuccgggugcgguggugucgguuucgcuuccugguugagugcuugaaugguucugugugccgugcuccguuuccugcgguuggaugcuguggauugugcacaggcaagcu

SEQ ID NO: 8355 - RNA, 2823 nt, Mus musculus
agcuugccugugcacaauccacagcauccaaccgcaggaaacggagcacggcacacagaaccauucaagcacucaaccaggaagcgaaaccgacaccaccgcacccggaaaacccgccuucucuucugacacgcaggucugccuggaggcucugauuggccaguaagucuugagugagucgagcaccucccuuagaguuagagugugcugaagccacacaguguagaaguucucagaccaagcuucaaauccagggacgaccuuuuccagaucuacagggauuuucauuucuguaauacuugugccgguccuccaauagccuacccuucugucuccccgcacagccccagggaggaaccaccacugcaccuaucacugcucagccgcuugcuccuccccuaugugaacaguugaccccgugcucagcaaguccuugacuuuucagccugagcuuuccucacucaguagacuguuugccuuccuccuggaaucaagguaguuagcuugcauagcucaacuugcaguggaguuaucaaucuguccuacaagcggaagggugcccaggauauuaacgauuaaaaagagauuuggggaaacaauaguuuuguugcgguugggauucagacccgggaccagcuucugaucugcauauauuuaacacaccaaagcuggcuggguggagccauccagcagccgcgggagaacugaguuuaccugaaaggggugcuggaaaugaaaagaugggggugggggguacgcgagagaagaaugaagucaagacaaagauucugaucaagacucaaaguuuaauaauaggcuuuacguuuauaaagggaaaaaccacaaaacccauccccuucuuuagcuggaauauguuguagaacaaggucagcacaggcagccaaaacagcuaaguucccaugggaaccugcaacugcagccaagacacaugucucuauccagcuugauaaggccugucaagaugaauguucaaggucugcuuagccugcucaaggcugggaagguuacagcugaaccuccagguucucccagcucuccucagucuccaccuguuacauagcaaaguuggcagaccccaccuuguacccugagcuuuccugucuccagaagaucuuccuauauaauccugacaguuuguacucuuugucucucuguuucauucucucucucucucucucucucucucucucucucugccuccuccuuccuccuucuccugcccuucccccuccucccuccacuucccucuccaucucccuccccccugcaugccuugcuagcuccuucuccccaccucugcuccuuauacucccaucccauaacuucucugaccuccuugggacuagugaacucucugguuccuugggaucacugaauccacuagagagcuacccccaaauaaacccccaaauacucuaauuucacuuggguugaguccuucaugcugggcuuagguaaacugcagcuacuuuucagcugguaaguaugugaacccuggaaggcaaacaggaaccagauaacaaacccaguggagcacuaugguuagccaacacaucuuccucacugggaagcuaaacauucauacacagaggcuucugcaaggccuccccaccccagcuuuuguaacuuucugccuucuacuuuucaugucuuuuucauccucugggacuuuguacuuaggaaccugucacugauguuguuucaggacacugguguacuuaagaaguaauucugggacuauauuugcugugugucugucuaauugguuagacaugcagucuccaguccauauuuaaauuguucaaaaauuaaccugggaccugaaccuaaaaggggcuuaagggugacagcauagguggaaauuaaaaucuauucccagcuggaucuucuuugagcauuagccagagcuaaauacaugcugccauuaaagagauuucucucaauuaaucuuuugugugugcagugauaaaaucuuauauaguuauagacucccuucuguaugaguucuuuuaggacuucaaagacuacugagauaugcaaaggcuuuaacagauugauuacacacuaaagguuuuacucuuguaugaagaucccaggaagcacaaaacuuuaccacacugucugugcuuauggaguuucucugcaguuugacuuuuucucaugauuuguaagacuacugcuacaugcaaaggcuuuaccacauuguuuacauuuauauauugucucucagguauguauuauuuucuguauuuguagauaacugugcugugaaaagugcuggaguccaucucuggugggguucuggaaccugaagacagauguguggucuccgcaaaagugaggacucugacuaccuguuagaccuuucaaccaaguggcacugaauagcucgagucaucuuucuuuaaacaaucuuucuuuaaacaaucacaagccugcucccaggagcagugauaucauugguuauucuacuuaaugaaaucauaacaucagcauuauaaaagccccaucacuguaaaagcccccaauaguuuuccuuccuccuucccaucuccugcuaucgauugaggaauguaagcuccagggauguggcagacagcaucuggugugcuccaacucagagaagccuucgugcagcaaaaaagauguuacagauauuucccuuagcaaacaaggaucagaaacucuauacacaaugcaggauuuucacaugccucuuucugcucauuuaugauacaaacuguuaaaugguuguugcuucccucgaugaguuauucugauuaaagauuaucuggaaaugau

SEQ ID NO: 8356 - RNA, 1065 nt, Mus musculus
caugccucggggcugaggcaggggcaugccggagccuacacugaccugagauggccggagagagucuuccuguccacgaccagugacugccugcuuccaaucugugguccccgggccagcggcgcuugcggcagcagcagagagacucuggggggcuuggcaggaagucccgcccgcucggccacaauugacggcagcggcuuccaaucgagaagcuucuccacucccuguuuccaggagcaggaaacagugccagaagucccgccugcccagccgugacuggcagaggcuuccaaugggaggcuguauuucuuuccccuaccaccuccgcccguaacugacagaggcagcgucugaggcuuuuuuuuccccucgauaaaggaaugcagaggcuuuagguccacgcugcgcggugggcgggggccucauccggaggggcgcugcgggcagaagacugcagccgccgcaggccccgcccaucacccgucgaugcugucagccccagguuccugucucugcuuuuccccccgcuccguucccgcucucccccuaccucacacacagugcaugcucagucccugccucagauccgugacucgcggucacgccccugccucagcuuccacgugucacguauuauaaucuauaaaaauagucauaaaguaaaacgccccccgcugcccaucgcgggcaugaccccgccucaugcucacucaggugagaccccacuauggucucccgcgucucagcugacgccguccccgcccaaccguggggucccgggaaaagucagggcgcguacugccgccgccaugacacccacaggccagcagagggcgcccucggcuccccucacagacggcccugagcugucugcccgcugugugugcgggucccacggguggggggcugcgacccccagggaagaagauguccacucgccgggccacccgggguccccagagacugaaaccgccccaccccaccccgcggagagauccgcaucugcagagacucgggcgggcgggcgugauuuuuauauaaaauaaaaaaagucucgugugc

SEQ ID NO: 8357 - RNA, 360 nt, Mus musculus
gaugguccagcauucgacauaccaucguaggcuuccuacaaacacagccucuaacagaacgaggcugucucgaaccccuggcaacagaauuguuuaccucuacaccaagaagguugggaaagcaccuaaauccuuauguggcgugugcccaggcagacuucgagggguucgugcuguggggcccaaaguccuucugagacugucuaagaccaagaagcaugucagcagggccuaugguggguccacgugugccaagugugucugucugugacgggaucaagcgggcuucccuuauugaggagcagaaaaacguugugaaaguguugaaggcacaagcacagagucagaaagcaaaauaga

SEQ ID NO: 8358 - RNA, 1354 nt, Mus musculus
ggugugauguuuuuuaguuauuuuuaagugcuuuaaaauaaaguguaacaaaauaagauggauggcguuacauucuguuggacagugaggccaugagucuuagcaagcuuuuaguacaguaaggagagcuaugaaaaggcagcaguaauugaaagucauuguucuuaccaguuucuuuuucagcuugcaguuuucuuuauaaaccaguaugacagcucucuuaaaaacuaaagggaauuuuaaaaaagaaaagagacaaagaaaaagaagaaaggucuuguuauucucugcaaacucuccccagguuaaauuagagcugggugcuuucugggaacaaaguccuugaaauuccacugcauugacaccugcuuugcccugguuaggaaagcaggucuuggcauuuguuuauccauuguuguauugacagcuaaggccagggcaucuaggucucagugagaacauacuaccuacaugcucucccaguucugggugagaaggaagaggauuugaaauguagcacuguuuagacaacagguuucuaaaccaccucaugaggugcuuccccuagcagcaucuucccaacuccccaaaaccaggagucagcaagaacagcaguguuagucaagcuuguuacuguuaacacuucuggaaggaauaccaaccaaauacugugagcucaauguccuuccuggcuuuuccuagagacaggaacggauucaaccaggaaacuguagagugcaucagaaguucccccauggacagcucugucaccuacauuguaaaaacaaagauguggagaccauggagauuuugauguuagacauagaauuguacacaugugcucacugcuaaaauguacaugcucacuguuuuauuuauauagucuccaucagcacagugugaagugguggaaugucugcaaaugugaggcaagcgucaagcugcaccccuauuauuaauauuaguaauagagaugauuuaugcuuccugcccgcuggaccaggguuuuaccacugagcuacauccuuggccugggccucuuuuuacuuuuuguuuugagacugaguccgucuaaauuucuuaggcugaccuugaacuuacccuaaaacccaggcaggcuuugauacugcaauucugcaucagccucccaaauggcugggacugcagcacuguuuacuaauaauaggaagugguacguuuuuuacuuaaguguguauguuaguacacacuuacauaggcgacaauucugccacagaagccaugcucaucuaaggagucuguuuacuuagcguuuacuucagguugauagacuacauagagcugcuaauaaaauacaccuaauugaccuaaauua

SEQ ID NO: 8359 - RNA, 1312 nt, Mus musculus
gugaggccaaaacagaaaacuuuuauucccugaagauaauaguacacaagguuccauaaacacagagggcuaccacguuuuuguuuuagaacuaauuuuuacuuugauucaaaaagucaagacccaagcaaaacuccaaaguauuugaugagaacuuugccacggacaccauaagccaccagcagguacuggagacugcaggaaggcaaggcugcugucuuuguagagauagggaaccuuguguuccaugaacucucucucacuuuggcauagucccagcuccaagccugggaggucuuugagaacuggguguguaccugguuuguauguaucuuaggcacacacaucaagauaccucuguucacuguacacacgacuguaaccucuuccugguggucucuuguguugcagcccucgaauucccggccugcucacaacucugcugacuuggauccauuuaaauuccgcugguugauucccauaucugcgcuucaaguuagacuggggaacacggcagguaaacacuuuggggggaaaugcagugacaaggugugcuuuucacaugugguauggaaacauaaggcuuccauguuaacaagauuccugauagaaaggaaugguuuauuugagcccauggguuucaggcccgugguacaguggcagcauaguacauuauagcagaagcaugugcgggcagacaucuguucauugugguggacaggaagcagagaggaagacaggagugggcgagggccuuagugacugagagcacaccucugacacaccacccucccccuagguccagucuuacagcucccaccccuucucccuccaggcuugaugugcaugggccucgggaaccccuuugaaccauugcaccuggggucacuuuugcauguacucuuuagagagagaaaaugagaacuggguugucuugguguuucuucacaaucuuuuggaagaaaccaaguggcacuggacggccuuuuacggccucugcaugguuucuucacuuuuauacucaacaacugucaccauuuccuuuuugcuguaggcuuugauacccuaagauuaaaguuccacaaauuuauauuuuaugaacuuagacauacuagaaaauuccuuaguacugcaaauaaagaaaacgcaacaacccccccaaccccaccccuccuugacuuagaacaauguuuggaggaccuucuaaacuaacuaacuggcaggaaaagccuuugaugcuagagacccccaaggcuucugugguccugccagaggcgcuuuauguuucuaagaaugugacugcaugggacag

SEQ ID NO: 8360 - RNA, 662 nt, Mus musculus
uuuacauguaauccuucaaguuaugugcucgccuguucuuuggcugccagguaguggaaaguuucugcuugggaggguagauccaugguucuugguucuucuguauauaagaagugcagaaaauaacaccagagauaaguaguagcaucgccgaaauaaacccaauguacagggcuccuccagguucauauuuguggcuuuccggaauggucagauccagaaaguucgcuaugaucuccuugguguaccacacuguugggauuaaaccagagaucccugcagugaugaagcagacuccuccagcaaaggaaauuuuacucuuggugugugugucuccuccuaagugagugcaguucauuccugcuaucgaaguacaaaucccccaagcagacagaacacaggccaggaccaugguggcccucgcagucugcacauggacggggagcgacagaauggaguauuuuagagugcagcuaaacaucccagugcuguaccacgugcaguccacccacaaccccugcaccuggacaacagcaguuacaauguuggguccugcguaugcauuaaccuuccaguuuggcagcagaguggcagcgaguacuccagacaccccagacacggccaggaugaaagcaaggagcuggagaccugccgaggccaug

SEQ ID NO: 8361 - RNA, 41292 nt, Mus musculus
aguaaacuuuuuaaugaacauucaaaaacagaaagaaagcaaaagcagcgaaugggagugggaaccaaacaggugacaagaggguuguaagcagauacaagacgugggucacacguguaaugccugugcagaaaaggugaagaguccagcccugcaaagcaggaagcaaagacuccaccccuguauaaaaccaggggccucaaagcuuugcucagacguaacgauaaauucagaaguucaauacaaugguucagcaaagaagccuggcaucagcuugggacaguggcuaaagaaaaaagccacucaucagaagcuggaggccugugcccacuguauacccaaggcagugcucacauccuuauugacuucguaccaagaaauucacugugguuaaguuaauuuuaaaaacacacaugccaaucccacucuggguguacugccagaaguaaaagcagugucucaaaagagaccugggcaccuacguucauagugccaugacucucgccaaccaagaggcaaaaaaucaaaaacaaacaacucaagcauccagcagugggugagcaggugaaaacgaugcaggauuuacggcugagggauagcauucaaccuucaggggaaggcaauuccaucacaggccaugaugaggaugaaucucaaggacauuaaaguaagugaaacgaagccacucaugaggagaugcuguaucgcuucugugaggggccuggaguucagcucaccaaaaucaaaaucagaacaacaguuuguagggccuguggagaagagggaaauggagccauuguuaaauagacauuuaguuucaguucaguaagaggaaaauguucuaaaaauuagcugcacacgacuagucaacacuacugcacuacacacuuaaaagaugucaacauggcaauuucugucagauguaucugaauguaauuucuguaggcuuuuaauuuuuuuacauguauguguguaugcaucugcuucucuguaugugcaccguguguguguguguguguguguguguguguaugugugugugugugugugugcugugacugcaaaugucaggaaaggacauuuacaucuucugaaacuagagucacaagugauugggagccacucuugugggugcugggagcucagccugacucccaagaacuucucauaaacccugggccagcucuacagucccuaaaccuaacucuuacacgcguucacgaccggccaggaaagacgcaacaaaccggaaucuucugcggcaaaagcuuuauugcuuacaucuucaggagccagagagcaagagagcaagagcaagagcaagagagagcaagaaagcaagaaaaagaacaagaacaagaaagcaagagagagaacaagaacaagaaagcaagagaaagaauggcaaaaccccgucccuuuuaaggagaauuauccuccgccuaggacguauuacucccugauuggcugcagcccaucggcucaguugucaucacgagaaaggcagaacacauggcgggaaaacugccccugcacgugugcagauuauguuuaccacuuagaacacagcugucagcgccaucuuauaauggcaaaugugagggcggcucccaacaccuaacuuuuuauuuaaauuuuuuuucacauaaacccauggugccccaaagggauaaaugagaaacaagacaaucuagacaagaagucagucagaaaucuguucaccccagaaaacaucgccuugaacucccaaaaauacauucacauucagggaugagcucuuacgcaaagauggccaacaugauggggaaaugagguaucaagacaaaaaaaaaaaaaaaaaaaaaaaaucagagacagagaggagaaaaagcucauccuccaagaauaucgacaauaaucagagauaauauaaaacaaaugucuauauacaggauauaaacgauaauccacagguauuuauaaucauaugaggcgacagaagagugauuagguuggaaaaggggaaaaaaguguuauuuaaagagaaaagggaaacacgaugagaauucuaugcacaagguacacuaccguuuccacuuuuaaaaacaccguugguggaaugaacacugcuaauucaugggacaaggcgagcaggagacgacauguuuuacugauggcaagagccauuccucagccaacuguauggacucaauacccacgcuacugcagaacacaaaauccuagcacgaguacucugcgccuucucagacguugagccgggcucucggucuccgucccaaaguuaggaacaagacagcuggcgucuuuccucuucugguucuuuguuuuauuguacuguguuuccuagaagcugaaaggcaaaaauaaauccaaauacugauucauauuuucauaaagaaggcagagaccgcugagaguaacacucgggguucagggaggccucucuggaaagcggcagauaagccgugcaggugaggaggugagacagcgguguuugaacaacacaaggagaaucgaggacagccguucagaggagaaagaagcgcaagucauuggacuguccucaaggaaggcucaugcgcacaccucaaacacggcacguuagaugccacaccggaggaccaugugacacaaucuaaaccccaccuucugcccaguuuccugguacaguggcaugaaagccuuggacccuccaacuagaugguuuucuuucuucuaggcuuccgguggcccgcagccccguggggcuucagaacaaucacuggucacagggaagaucaaggcccgacaagguugggaaucuucagcaugccuggcuucucacggaaggaguccaaaagcuaaguugguagccacuagucacugacuuaaucauuuaugccuacaaaacuaagccuccccaaaacugagugaaagggcuggauuccaagaauucccaggucccugaacaugggaagguuucuaaaggauagcauacugcaaaggaugaggaagucccuccccacccgcauguucugugucucuuagucuuggcuguuugucuguaucagugguccucagucuucccaaugcugugacucucuaauauaguuccacaugcuguggugaucccuaaucauaaaauuauuuuuguugcuaucucauaaauguaaucuuccuauuaugaaucauaaugcaaguaucugauauguaaucuccaaacgggucgaaacccauacuuugagaaccacugcuccucucuacuaucccuauuaggaaaaaaacaaacaaacaaacaaacaaaacagcacagguuuuucuacgagcucugugaacuuuccuggcaagucaaagaaaaucauggagagggucaugagaaccucaggucacugcugauuggucagaaauggugacaauguauuccuugagguuggcaucugaaguaggggcaauccuguaaaacuaaguccucaaccuguauggcaugacaguaacucacaggugacaaugucagacugacuuaaugaagaaugcaugggacaagguagggaucccaggccuuaggacacagaggcacgaagguuacaaguucaaggccagcuucaaguacagagugacacucugucucagucaauagacaacugaguuggacagcugauugcuugcuuagugugagggaaaaaacuggauuccucugcugucagggauacuguucugugcuguguggaccaggaggauauuguuacuauccauaaaacucaagcuguaacugggccuuucgauacagucugugcaagccccugacacucucuguugaguccaguuuauacuccuuccaauauguccucccaugggucuggccucaccaucugaaucugucucagcaaaauucuuugugagucuguagcagcugacgucacucugccaaucagccugaguuacgagagcugcaagaagccaccagaacaucaccagaaguuuucuggugagcuucuuucuauggagucauggcaaaugaugaccaguaaacaauguuaaggcuuaccaacaccauccaggggcuuuugccuucugcuugguccuuguuaacaucacauagacguccaugggucuaccuuagugaaacauccuucagugugucugcuucaggaaaacguuccuuccuuugucugacccagcaaagcgccauccaaacaaaccagaaguucccacuucaagucugcucaagggaaucaaaccccaggcccugaaccccagcuggaacuauaccgccaugaacagaaacaaguaggaggccaugagaaacuuacuuuucaaacugcuugccucugcaugagugaaaaaugaauauuuggacgccccaagcucccauccauuucuuaaagcaagacuaguaacuuuuccuaagggggcuugcagcagauacaguagcucucaccuaccagcaauauagccacccuccaugaucauuggaggacauacuucaagucccccaccuuggaaagcacccaaccuaauaaauccauuuuuccuguaaacacacuaagguuucaucugugaaguacagauaguaagagauuaacaaucauaaaauagaauuauaauacucuugauaaaagauagauuuauagauucagacauaguugacuguccugguuagcuucagcuguuaccugagagaaucucaauugugggauugcccagaucagauuggccugaggcugugucuuugaggaauugccucgauuggugauuagugauugaugugggcgggcuuagcccacugugggcaucaccguucuuaggcaagugggccuagguuauauaagaaaguuagcugaagggcuggagggcuaguuuagugaguaaaagcacauacuguucuggaagaggcccuaaguuugaucuauucccagcacccaccucugacagccuaccacuggccgugccuccagcuccucuaugacugauaccucugaccuuacugagcaugggcaaucaugugcacacaccuaagcaccaacacagacgugcguugauauacauacguuuaaaauaauaaaaauaaacuaaaaaggaaggaaggaaggaaggaaggaacaaacgaagggagggaggaaggaaggaaggagggagggagggagggagggagggagggagggagggagggagggaggaaaggaaggaaggaaggaaggaaggaaggaaggaaggaaggaaggaaggaaggaaggaagaaaggaaggaagcuaauuagcugagugauccagaaagcaagcuaauaucagcauuucuccugacuacccucaaugauagauugugaccuggaaacguggguccuguauuuaucacaguaacaacaacaacaacaacaaaaaauacuaggacaguggucucggucuuacugugcccuauuccccauuguucuuggaaugaugugagguaauagauugacuacaugacaagcuaaaguaacguggaugcuaggcauugugauauaaugcuagucccuuacagaccucaaggcagaagguauguuccaggugagccugggcucuucagccauggcaguggugauagcuaguaucagaggcagguaauuucagugccugaguauauucuauagaugauauuauuucuaaaaacccuucagugugauucauguccuaauagcugagaaccagaagcacugggauauagauccaaucagaagcaggagaagaccaaguuucuaguccgagcaggugggcaggggugacagacuucaaucccccuucuguucaggucuuugggacacugaugaagauggaaauccgcuuuacucagugcacaaauccaaaugguaaugcuauccagaaacagccacauauacccagaauacugucuuaccaacucucuaggcacccaugccccaaccaaguugacccauaaaauuagccaucgcaaccucugaaacaagacaauagaauuuaauguuuaagguguuauuccauauuuauaucuugcugcacuucuaguucauguaagucucccggugugcaugcuaaagccuucacuggcgcauuuacauacugaacauguaaaacauguauacacauucaugugugcugugugcucaugguauucuucccaacggaggaaccgaaucaaaagaaguauggcaacaacuggugagacagaaggcagugguugcucacuugcuucuauuuuccacaaucauucaucagggcacccaucuggaggucaaaagugguaccaaauaccuucgggaaguggcagcuaaugcuuuggauuuuaagggggagcgaauguaaaaaucacaugagagaagaagaggcaguaguguggcaggcauuuuggcugcucuucaagaugaacagaauguuuaaaaucaaggacacguuuuacuuuaaagagcuaggaaacucauggccccuuuuaaggaucuaaagcaacaaaucucuaagaaaaaaaaaggaagagugcaugagggaauuuuuuuuuuaaacacuuucuuguaaaauaaaaauguccuauuuuuagaaagggaaggauguagguauuuagugggaagaggggagagaaagagaaagggagagagagagagagagagagagagagagagagagagagagagagagagagagagagagaaaagagggaaauuaucaacgucugucaucauuaacugucaacuacuuaccagaaauacugcauugccucuccuugucacuauacuuucucaccaaaacuuucccauacagagaccaaggucagaagaucaauccuccugaaaucccacauggucacaugucacaugucacauggucacauggucacauggucacauggucacauccuguagcucaaccaaauguccaguccaaccucagacacuccaagaaugugccuagugacuacucuggccuauugcagaaggucacaauuaaaccgucccuucaggagugacccuccccgagccuccacaguuacacucagcugcuauuacacauauuuagaauguacauuucacagucaggguaagucacagguuuucaccaaauuauuugcacucuugaaugauaucugucaggccaucauuacugagaaccauagucuagauuguuggugugauucaaauguuccucuaacuuuguaccuuagaaacuuggugccuauguucuucaugguagugguauucagagauagggucuacaagaggucaucaacauuaaaagaagucaugaaauuggggacuccaugcuucauaagaaaaggaaaacagucuagggagauggcuuagcccaaaguacucacuaugcaaaggguaggagcugaacucaaccucuaacacccaucuaacgagcugggcauggcuaaaugcauuggcugagcagugagggcaagauuccuggggugugcugagccaaucagugagcuccagguucacugagagacauggcucaaaaaaugaggggcaaagugauugcagaagcaaaccgacuucgaucucuugccuccaacacccacacaugugugugugugcacgcauacacacauaagggcauacuucuacacacaacauaccucuacuacaacaacaaagaaggcauguuuuggccaugugaaguucuuugccaugguuugccauagcaacaaagcccucugcagacauugacagcuuuauuuaggcuucucagccuccaauaacacaagaaauggucuuuauaaguuaguguauggcauccuguuguggcaacagaaaacagacuaacagcuauaaacaauugcuacuaugucccgaggccucgcuuacagcuagacacucuccaaguugauucucauccucccaggggccuuuuagcauacguuugacugcuauucucauuuuguggaagaggaaaucaaggaugaacuuguuugccacaagccaaaccggcagcagaagcuugaucucagagaccaugacugacuuguugaauauuauucuaguagcucuaagacuacaugucuauaaggaucaugggaaaucacacuaacagaauaaccaugugcuuuaacuccaacucuugacugagcaugccuuaccauaucccagcugacacuaacuugguuaguuaguaguuuucugagacuugcauuaaacuguuguaucuuugacagacaccauugcaugcacccuaauucuagcauucaagaggcagagggaggggcagaggcaagaaaaguuccucuagguugagggcagccugaucuacauggugaguuccaauucaggacuaauagugcaugcaugacacagaaugauuucucuuauauuguaaugucacuugccuacuuaaauaaaccaauugaacucugacacauagauuaugaauuuaaggaaaagugugugugugccacggucaaaccacaaacuaaaaccucaagagaauuuucacuuguuuuacaaauuauuuuucaguuuacaaaaaaaaaaaguucuucagugaguugucuugcagugccaugcagcauugccuauaaauggaagcauguuuagcugcuaagccaaugaugacaggauccccagcaaacaaggcaggggaggcugcuacacuggaaaagugcuugccuagcaaacaugcccuugcugguuccuaagcauuaaccuaagaaacacuggcuauccccaccuauccccacauccaggagguagaagugagagguucagagugucaaggucauccugggauacuuacccagccugggcuacaugagacucugaaaaaaaauagaaaagacaaaauacucuagauauauggagaagugcuuaaacuuggugaauuuaaauuuaaucauuuuaauuuuguccuuucaugccuuuuucguagacaucugguggagcuuccaguuaauugcucuugaaggaaaguugaugacuaagaaaauaaaaacacacuaagccauuauugaaugaaacagaaccuaugggucacauuugacaccagagagguuuuaaggucccuuuugcuuugugguuuuugcacaucacaaauguggcagaauaguacauucuguugaugaaauuguccccagcugacauggaaugacagaauguuucuuucuucuguguuugcauuaaaaagaacaucaagacuucaggugcacugccaucugaacaagaacaugaacagcuggacuggcucccuucaaaugugauuuuauuuauaccacuucaaugauacgcuuuucaggaacacauuuauuauguacgcucucaugugcccuuuuauuguuaagcugaaaucuuuguucuuauaguuauuugccuacuacaaagcaauagugacacagcucaggaaugccacaucccugagagacaugggccaggagugauccaggagaagucaugcccuuggcuccuguaugucaucaccucugcccuguagagggccaagggacaucucucagcaaagagagaggaaauuaguaagaggacccaggggggcaugcuggaaacacaaagcugggugugagcuguuggcagagagaauggaauguaaagaggcuccagggaugacuaaaucucccuccccgcuaguugcuaagacagaacuucgcuucuggaaauagucaguucauguaccaauuauguaucaagcuaaagaggccauucaagggaauggcuaaggaaugcgaaauggaccuugagugaaagacauccaagaauacagggauagggcaagauaaacaguauucuauggagcccagagaucagccaaguucuccacuagaggaagugccucuuccuccaaagcccuuacaccagcucauccuaaagaccacccacauucauccauuggaccaccaaccucuucacccucaggaccaucaaccuucacccucaggaccaccaaccuucacccucaggaccaccaaccucuucacccucaggaccaccaaccuucacccucaggaccaccaaccucuucacccucaggaccaccaaccuucacccucaggacuaacaaccuucacccucaggaccaccagccuucacccucaggaccaccaaccuucauccucaggaccaccaaccuucacccucaggaccaccaaccuucacccucaggacuaacaaccuucacccucaggaccaccagccuucacccucaggaccaccaaccuucauccucaggaccaccaaccuucauccucaggaccaucagccuucacccucaggaccaucagccuucacccucaggaccaacaaccuucacccucaggaccaucagccuucauucauccucaggacaacuuacacacauggacagaggucauuuguccccuggaaccccaguccucagcccaucacucugucuccucccucauuggaccaucugugcaguucagacuuuguucucccuuucagguauguuaauuguaaaucuguggccuuuuucuuccagugucaauaugcccaaaaggaugcugagaagucuaggugggcuuuuagauggcuugacagcuccacaguuguaguggugccuaauuaauccuacucaaaucgaucccaguggcauuguccgcuccuugcuaccuaccccuguguucuggguuccugaaugaaauacacacacacacacacacacacacacacacacagcccuuauauuuuuauaugccuuaaacagcucaauggcugggccucuucuuaaccuccaccugacugauccaaccccaccccaauguuccugaguuauuacuuacuaauccuauauuccaucuuugcuguccuagaccccgucaaagggucugcuugggggcuccuucccccacucccacauuguggcuaugcucucugcaguguaccucucagacauggugucucuccucuuccaaaauaacagcucuccccuccuuucucuuuccuccuuccuuggucucuuaccugggaauccuaaagucccacccuugucucccugcccagccauuagccacugacaacuuuauuuuccaaucaaaacaacuggaggccgaguucccucagggacguguggauucucaggcaauuuggggggcccaaauuaacauaauacaaacaacaugagaccaaacccacaccacacagucccuaagcauaccuaagagaauucugccugucaacagaaacugcacgcugagcaugugggcgcaagggaauauguaacuauauaaguggucgaguacauuuuguguaaagagaggaaggacgucuucauaaggagcaccaguucaaacugccagaacccaguggauaugcauuuaccagaagguuccagacggaagaagucaagaggagaugccuauucccgugcuucuacagacugucauuagugccuggucauccaggaacaaguaaaugauaucgaacuguuacagaaaacauuugcagaguucuauccacacauguccauguaguuauuacacugucgucaaggugauuaugacuaacagccccccucacuuaacagguacagccguggacaggggcagugccagcaacucagaagucugaggcaagaggguugaacaaguccagcaguggauugccagccuggguggcacagugaagacaggaucaccauagcuaaugagcacagaccagggugcacugagcuaagcacuucaugccuuguaccuugcuauucaguucagcaaaguagaugcugcuguuucucauucauggacacaagaauuuaggcugggaaaagcgcacuagcucacacugacucaagauaccagugccuuagagcuauuuggcauugauaaaaaaaaaaaagucauagaagguccccagcuuuacaacaugguauaacugauaaaucuagaaauucugggagggagguaguccagcaauaaagugcuuucuagcaagcacaggguccuugauucaacccuucccugcccccaucuuuuaaccagacuagcaagauggcucuguggguaaaaagcacuuuccaggaaggccugaagaacugaauucaauccccagaacccauguaaagguucaagaaaagagucacuccacaaagugggccucuugcuugugcauaugcgcacacgugcacacacacacacacacacacacacacauacacacacagacacacacagacaaacacacauacacacacacaaacacacacacauagacaaacacacacacacacauacacacacacacacacagacaaacacacauacacacacacagacucacacagagacaaacacacacacacacacacacacauacacaauaagucacugagguaaaguugcaucauguuuggggaagaccuucaggcauuaaaaacuacuuuaagaagauuauuaucagagacggagauguggcucagcaguuaaaaaucagcugcucuucuagagaaaccaauuacuaguaccugcauaacagcucacaaccaucugcaacuccacuuucaggaauccagaccuucuucuggccucuguggguacuguacgcacacagugcacagacauacaaucaggcaaaacacccauauauguaggauaauaauuuuuuaagaagauugcuauuuaaucaaugguaaaacaaaaacuuaaaacuaaacuuuaauccuuagcaaauuaguguucggcuggccaaaagugcaucuuuggggacugaugauccuggguagauaaagucaccaugcaaguaaccaagagacagauggaggaucgagguaucagucaggcuacaguggcuggccagaugaaugcaaaggaggagaacuggggagccgugugagaccccaucugcccaggaaagagcuucggagagaacugagccgcaggaacagggcuccacucccaucugagcaaccucaccaauuguucaagaguguagucauggacacaaugaaugaagugugugucuaggugauagaucuaucugcugcagcaacauuugacucuucccuaauuuugaaacuucugacucugggccccacugugcacagauacagccagcaucagaaaucugcccacacuucagccucgaggauggaacaaggcaucaggaaaggcaaaccaauucucuuugucugcuguauuuaugcugugccucagaaaaccaauaagucugugaccuuguccuagacacacauacguucuuuuaaugggcuuccuccucucaggcaggagcucagcauuggaagggaggccagagugaauuuuccuuuuuggaaacacguaagagucuccuuucccagcuuuguuugguugguuggcuaauuugguuugguuucuccguuuuucaaagcacacaugugacaacaaaccucuuucuucacacggugauauuagcaaacccguacacacaguucuuccucccagcaccgcuggcuugguuucaucuagccauagacaaccugccgcugagcuucaggccaauuccgauucuuaucagcgccauuagagguaccauauuucuagccguguuccuuucugaccccuugacuacccuagucacauggauauauggauagacagaaagacaaauaaugagaucccgcaagucaauagcuucucucaaucuagugcuauaauuaagaaaacccugcuuugauuucccugccccuacauaacucuuguuuggggcugaacacuauugaaacugauuuauaucacagcacgcuaugaaaaaggcuuuagacacacaggagcuuagccacaaacguguuuaauuuauaugugugugaauacgcuccaagauuucgcucgaaggcaccuacacgcagacaggacagagcccauacaugcuuugugccggacucugcucucaccagacaccugcuguguaccuggcgcuguucuggggccacacuuucagggcagagaaaaaugguaaaccugcuggaacuccgugcuguguuuucagacggaaaacccauccuuuccucccuccacccaugaaucagucaagaacaaaaagaaacuagucugaauuuuuuuuucccccuuuauuuccaaguagcuugggaagaaccaggcagagagccaaaaagaggagagguuuuaccgaggcaaaccaccgcucugcuuggcuuugaugagaaaaauaaagagcaaagcgcacggcguacagaggcuugaaggcugugcguaggaaagggguguuuuuacggaugacugccgugggcaaaacagcagaucucaucaaaagcaguacacacauggacgugcccagccucugggagaaggaaacucucacagacugcuuuuucuucuacaguucggcagagaauguagacagccuuacuuugcauaaaauaguuuucacagccucccauccuucacaaggagaaaaaaaggacgaaaggccugaucccuaagacaaaccauucaacccaaacuacgcucagacuuaacauuuguuccucgugugccaccacacuggggugggggguagggauucccgugugcauccacgauuacaugcaaccagaaaucaacccugacuuggcaaccagugauccucuagccccuuuccccgccaguuucaccgccugugagagucggauucugcagcaagcagccugcuaucuaugcaagagggcaggggauguggccucugugcccuccaggcucacuggucccacaggaguuccuacccaaguuccuccucucauuccuccaccaccaucggcacccaccucccaugggcuccagaugucauauuuuuggaagucugaacgcagacacaugucugagcaagcaggaguggguaaggaaucugggagaggaagcagggucgggcuuccaaaagccugggaggaggggagggcucuccuagggagcgcuucuacaccaaacacuuaguaacaaaagaacagaguuaacuaaggaagagcugagagguacaaaucauaucacaacacccacgcagaaaacucuggguguuagcauugugucuaagcuccaccccucaguuaccuggcaacagccagguuggccugacccacuauaaaaagggcugcuugcccccuccucgcucucuugccggcuuuucuuuuugcuccagcucugucccuucgccccuucacccccucucuccacgugcucauggcuggccucugcucuucuacuuucuacuucucuccuccuccuccuccuccuccuccuccuccuccuccuccuccucuuucucucucucucucucucucucucucucucucucucucucucucucucucucucucucucucucucucucucucucccccucuuaacucaccucuccaugcccugaauaaacucuauucuauacgauaccaucauguaggggaagggaugccuuggcaugggcccgcugaggcacccccuucccccacaccucaccacaccuccauagaacauauccccuccucucuuuaucuuuuuauaaacacaucacuggguauuaggggaaagauaccagcucugucgggaaccuuucaaagaucccagaagauaguaucuuaaaccuacuccaggcacagcuguuguccaagucucugucuaccucuccaccugcagguaaucuccaagucuuggcacaugcccgcaccaugcugggcuuuguggguuauuccgcucacuucucauggcaccuccuuuggcaucuguaccauuacuacaccacugcugcagaccagggaaagagcuugcccaacuuagcccagccaacacagaucagagcuuuagugggcagccaugugauccaacucaggccuauucaccuuagaccgugaggcuccuaccggguuuuaaggagcaaccaggaaaacugaauacauuucuacccucaaauaugaaagccaacuaguuuaaacucuuaucaacccuguagagugaagguauacccaauugucuagucagccuuauuuagcagaugucaaagcaaaaggaauacagaaauaagguucauaagugagcaaaaucccuauuagaaaauuaaacuuaugagguaaggcuaugaacucaaugucuuuuaauugcacuaagauugaacaucuaggaugagccaauucagccaaugacaagggaggagagcucacagggguagagccuccugcucacaggaggguauucucaaguuucucugugaagcuugucgguucucuccuuguggacgccaacuuaucccucuggucugaauccagauuccccacccugccuuggacucguuuccuuucuguuuagcagagauagacgugguuugugaggguuuuuuuuuucuuuccugcuucuuuccuguucacauucaccccacuucuuuccucuccccucuuccccucauguaugauaaagagcugucgcucuacuuuuucuaaaaccagccccuucuauccagcuucucugcaggcuggccucugcuuggaaaccugcacuacccucuccucuuaaugaacacaauaaauaaauaaaucuaaaacuguggcaggagaguaaaguggagagagaagaauuaauauuggcauaggaaacaagccaguuggcagaaacacuggaaaccgcagccgccaaggccaaccuggaacagagcaugcgccaaggccaaccuauaacagagcaugcgccaaggccaaccuggaacagaguaugcacaggaaugcacacacuuggaaaugacccaaaaaccugugguacugcaauagaaaaaccccaaucauuuauauagucuuugcuauugaaagucuaaccuuuccugacuggguagcccuucuccuugccuccaaaggcuuuauuaacuaauucucucugugucuaccacuauccacaugcggcagcuccgaguccuuauugaagggcauagaaccuggaagugccaacaagagccuuccaguucccgauaucuuccuagcauacagccuuccuucugcccaugccacucccuguugcaaaguuuacaaaacucccugacucacaggaguugccccgggugucacucgccuagauuccccggcgcuuuccccuggauguuaacugcggguguauaagguacugaaauuguucccacccaguuuguuugaaggauaccacccuaguaccuccuaaucuguacccugacgacccaagccgucagcuaccagcucagccugugcccaccacccacacuuuugaacauuguacgcaucugccccagaaacuucuuucuggcagggauccuggauaacaccagagcuaaggcaaacuuaaugucugaagauuucuuaaccuaacugguucuggcuuuagggcuggccaugaaaaaucuggcaggccacuucuaaggcaggaaugaagacucgggauaacccgcuaagggacagucccagcucguacuuucuguugcugaccugacucauacaccugccaacuuccugcugcucuggucccugugcccaguaugugaagcguuacugcaaaggccaccagccacuucugcgguuguucaugucaccaaggcuaaagucaaugagagacaagauugauggcuuguccuugaaaguguaacucaucaccacaguuucuggugugccccaaauuuucugugucuagcuuucuccccaacuccuagcgcuucuaacuuaaaaccaguacaaaggaacuagacuuccacagacuuuaugccagcuuucacacuacccucuggucuaguugcugccugaaauccuauuugcaugccccagccaguggccuggcuucucugauccaaccugccuggauccauacugguaagggcaggagacucuaggggacauuaaaacuggcacuagcuuauguagaauuagauaugguuagguuuccaggcaucaauguccugucacugacaguaaagagaggccauuaguaaccugugguacacaauagcaaacauauucacuaaacuaucacuuacaagacaaggcuuuggguguccacauggugguugcuacaauacaugcggucaaaauaagaagugugugaugcaguugcuugccuuaaagaauuuagcaaaagaaaaagauucauugagggcuuuuaguucacagcuuuacuagcuaagagaccagaaagcuccucagaccaucccagaggaagacuuaucuccuagaaucaaagcuucuaagauccaacccuaaguccaacccaaaaaugcaaugcaugcaagagcccugaguagcacccaggucagagcuuccggcccauggauguagcccuuucuuccugucuguuucucucugagcucuucccacagaaaagccaccugaagggucacugcuagagagucgccuuguggagacugccguuucucccccaaccccauucaccagucaccaucguccagucacuggcaagugucaggcgcuacaguguagaggacggccuugagggcauuacaugcauaccaaagaacccagaagaugcugugaaugucugucaaaaguuuccuaggaaagaugaaugggaauuggaucagguuagagagucgggcucaucuguuagugugggugcacaguaaauuauguauagguaugaugagcagacccuagaugccauguuaaccugaaugguuggagggucucuugaaguuuauacaguugaguuucgacauuacuuuacucauugcuacaccugacccuguuggaggguacaaucaugguggagaagcaugguggcuggauugaaagguggcuggucacacugagcauccacagugaggaauucacagagaggucaccaucucgcucagcgcucagcuaacucucaucguuaccgggucugugaccccagcccacauagcggaggcacccacauuuaggauggcuuuuuuuuucuccaucucaauugacucaaucuagaaucucucucaagaaguguccagaggcuuaacuacuaagugauucuagauuuugccaagcugacaaucaguauacaacaccucaguuuccugaaucaggaucaggauggcuucuauugacugauguugggugucagaacuuccuugaagaaagucuaaaggguaagcagagauuugggaaggaugaccaugcaguggccucaagauguaaaccuucccugccucguucuuaguaugccugguaggaggccacagacaacucuucuagcaggagaugagcaauggacaauggaaggaacccaggacaucauauaccauggcucuucucugugggccauggaagcagaugaccucugucagcacacuggaccaccaaguucauuagggugggaauguacggagaagggucacagucacagaaacuagguuggcaucuugacugacauggguggcacuggaaagcagaagucuggaucauuugaaccacagaagucuuugguauuguuggaacuggaaugggcacacaauugacucagucuuccagagagccuaaccuggucucucagccaaguccuagaugagauugguucacagacccaaagcuucuuguauuagggcaucuggcuccucuggaagaucccagcuauagacuaguagauaguuaaccaacacaucucccagacauccauaaaagccccugcucagcacggcacugauggcccuggaccucugaaguuaccaaccaccccaucccaggccuaugggcucugaucucugucauucuucugggcuccucuucuuccucuacccugagugugaagcucuucuuugcauuucugcccugguccauuuucucauuugcuaaaauauucucuucacuucaaaauaacucaggcuccuccagauagacuuugccaccucccucuccaacuccuacuucucuuuccccaagucccguuaccagggaauucuggguuccuuuuaaguucuuagaccuguuaauuaaagaauugaacaauugguucagaagggagcucaaggacgaucuuaucacaacaggcagcuguaagccuuggcaacuuccaggagcaaagaagaagagaaaaauccaugaccuuuuugaggcagcaucccaugaaagccagcaucgugagcaauggagggcaccagagguauggcagcgaggggcagggagcuucagggaacaacugaaaaaaaucucagagugucaagaaagcaagcucagaaucuuugguuaaaaaacaaaacaagaccaaaaaacaagcagaaaaggaaagguguucuuuuugaauuagaacucaaacaaaaaccaaagggggggggggaaccaaccagauguaacauggugcaaggccagagcuccacaagcagcuauagugggggagggguauuucagaaguguagaggggauguauauuguucaccuugaugguccccagcaaagccuugaggcagaagcugguaguugugguuaccugucuaguguuaccagggaaauggaggcaugggccgaagcucaccuugaagggggagcgcccauccucagcggccucccaggcuauagucugaggcucgauuccgcacuccugccucuccauucgcucagcagugcucagccuuccuaucccggccacccuuuaauacaguuccucgugcugugcugacccccaaccuuagagucauuuuccuugcgacgucauaacuguaacugugcaacugcuaccaauaguaaugguauuggcugcuacuuagcucaugaguagcuaaacagaaggcacuuccaccaucacaaauauccuuccacacagcacuucugucucccuggcacugacucaucuugcccuuuccacaucaauccgacaugagcaaggcucagggacauauugaagaagaggaggcagaggcagggaagacgugcugugaaauccugucuucuggaaacuucaugauuguggcacucaugaacugaagaagcaguggcugucggcacaagaucaagccaguugacaugccagcaugaagagggggguggguaaccaugggggcccaccccucccugggaagcucuagucagcuaauggcugcugcagguggggcagugucauaauccucaauggauagcugcugguaagucuuccuugcucaacagaauaacacccaacuugcacguaggcaaguaauccugguucaaugcagugugccaccaaacaaaagacagcaaaguagaaggaacugaagugugugcgugugagagagacagagacagagacagagacagagacagagacagagagaggagacauaugcacauauagagaaugaucaaauacauaagacauagaacauuggccauccuugacuacaucucucuucucauccaauaccuuguucauuccuuaagaugcuuagaauggauccuguuggaaguguguguguguucuuuaagguuuuguccagacacaguagccucugugaaacuuuccaccaguggugacaaccucuaagcucuggacucgcucccuugcuccugagacuagccuucuauccuucaggguccuaaagcugaauugccuuugccucgcaugcccugccccugacuauagucaaaucugucacuuccuucagccgcugaucacauggcauuucuucccucugccuaaaacuauccuccaacaucuccucugcuggcguuccaauaugaagcugcuugaguggguguuuauguggaggguagauauuguuucuguauuguucugucuuucacugggguuuauauccucuaugagcuggauccuaaaacugucccuaagaaucagugaucuauauggggggcagauauuauuuguguauuguaugucuucuauagaauauacaaggaggcuggauccuaaagcuguccuuuagaaucagugacuguucccugucacaucucuuagcuucaccaagauugcacuccugugagauaggacuuuacauguuccuugaagcuucaauuuguaagaccaaauucuuagucggagccuccuuucuccaguaauuguuuccaccagaggaaagagagaaggaaauacauuauccucguauccucucugauccagcucagugcuuuggggcacugccuuuuuuuuuuuuuuuuuucugguuauaucuagaacagccucugcccucuccccaaauuuagcaaacuaaagaucaaugucucugaguaaaaccccuaccccaaacacagccucuuauacuucuucuccaugacugcuuguccucuguggagccacagaauaucgguggccugguguaucuguguacuaacuaccagccacaggugucgcucagggcagcugccuugcaagaugcuaccacacaccuauauggagcaucauggagcaugacccaggggugcuuggcuccaccuccacugcccaacgaccuaucaccuccacagaagaggacucacaugaccucugacuucucagguggccuuacucccugauuggccacaccgccuggagucagguuugguauuguuuugguuuugugucacucuguguguguguguguguguguguguguguguguguagcuuugguucuccucaguggcagggauagauaacucauccuucagugaugugccugagaacagcacauugauggcaaaggcuguuuuagacauccuguccuggcuugauagugagcacuaaauugaaagcacuaaccucgagaucuccaugguaacagcaugguacuuaccaagccacacauccuaugaaggggagaagcuuccacaucuaaggacaccuagagugaagccuggagacaucaggcucagacacaaaggcuucccggggcgccuccacacuggaccauucuguggaugaugagcagugcccauccuucuaaaccugucuucacugcccaucaaacuucugugcuaagagcugcuggcuaugauccagugagucccgugguacacacuucaguagccuauguaaccagucuuccuauuagccagacacacacaccacaccacacacaucacaccacaccacacauaccacaccacacacacaaacauauaccacauacacacuauagacacaccacacacaacauacaccacagcacaucacacacaucauaccacaucacauacacauauacacaucauacauacuacacaccacaccauaccacaagcaacacacaccauacuacaagcaacacacaucauaccacaagcaacacacaucguaccacaucacacacacauacacacccauaaacacuacacauacacacacacaccucacaccacaccauaccacaggcaacacacacaccacacauaacacacacacacacacacacacacacacacacacacacacacuccucuaauauuugguuuggacccaugacuuucuccucuggcccagaugaauuuuacucacuacagaauuaggccagcugaaagucauccauccaaaggaacucugcagagccacuggacuuccagagcuaaugucagcugucccuuguagccuuguuuucucugguagacugguuggugcuuucuaccuuggguguggauucaaagcaacuggggaacuuguaaacugacucuggugucagggccccuccuucccagaccaauuaaguuaagguccugaagcagagggcuguaagccaaagccuugguacuuuuucaaaggucuccaggggaugauaauugaggucaacauacaggagccaucauagcggaugcuccucggagccuccaacccucagugcucuaaggccccuccauauccuggacagcaaaggcuguggacugaauguugacauacauccuuggcuucccuuaagcagaaagcaaaccacggaggcauggcucacuuaccucccgauauauuguccaaagagauaaacucagacccugugaaaacagccuccccagugacuugauagugcucuccucccagaacacucagaaccaggauccccagacuuuccccacuccuccggcccgccaggcaguacccagaagauggacuccucgacccaacuauagaaagaacccuguaugacguguggccccacacccucccuacaaaggccaaugcuaccaccucggaggcucccauaguccccuuuccauaccacucaccccucacuccaccucucucucauucauacuacacagucugugguuggccuaggcacuuguggagauagguaaacaggaacuuggaggagaaaggcugaguaggcugagggagcgagcugggugagccccaugugaggcuaggauaauaaaaggggugucaggcuuauccccugcagcaguuugaaaccugagcccccagcuugaaccugugccuuguaauucuguucugcauuuccauuccacacagaggcuuaugugacucuguagacugauauuauuucaaguguuagucauuucccccaucaaaugcuaugcauccuaaggaaggaacaugacuuauauuuuucugaaccuacugggcacacagcacagaguaggcacugagcuaaggcguggggguaccuuugaaaugggaacauaagagccagaaauaaugcugaaaaguuuaucuguacugcaaugcauucuuccaucaugcacacagccggaagguacuaugugccccauuuuagaucaaaugggcuuagcuucauagaauugcagcauuuucuaauggaggcauugaaacucaucucacccaaaguguucuuaucaggggaagaagucuguagccuuguaagucugggauaucccuagugggcaguugguagaaguuccuccaaaguucacacagggugccugaaugagccaucacuaccacuuaggcuacuauuguagcaucagcugggccacccgcucacccacucaacugcuggccccaguggguagggcacaccagugucaccagcacagccuauuccugaguccccugcacucuuggcaccacaggccccuggcaguucccugcaaauucagaaaaauuagccaaguaguuuacggaacaaaguguuucuuggugcacaguguuuucugcugucagccugccuccugcaucuugccuucucuugcagagaagaugucuaaaauagcucuaagugaguggugagcucacaccacacugagacucugcagcugccucgcaaaccuuuguuagccugugcccucugcaguaagcaugagggugcaccuccuuuagggccccuuagcagggaaacguaagcauaaaccaacacaacaugcagaaugguagucucuaagaugcaauuuuaucuugaaggauacuuuaacuuaaaagucauguacuauuaagacuggcaccaagcaggcuugacuauuagcuccuagcuuagagagaaaagcauauucauucauuugucuucaaaauauaaaauaucggaauauugacagugcuuuuccaaaacuacaugaagucuuauuauugcuuuagggaaaaaaaaaaaacagacaaaaaaagcuauacuuucaacucugacaaccaaagaagaaaacgacgccagacagaguaacgguuuuuggacugagccugcagcuuggaaccagguaccauguuuuuuaauucagauaauaggggcacuuggcagagaugccucaggcaaguaugcaaguuguaacugccaucgggagucagaggcuucagcccaauuccuaagauuacuaagaccuuaaacucuggccuccacaccuucccgcccagaguggauacaagauaaauggaaacuuaguaccacaccaguagccuuaaaaagaaaacaagguuucucugucugucugccugccagaaguuuauaacagacccucaaauaauagccaaacagggaaacaggcaggagcccguuucauccuccaugggaagauaucauaagauugucaagcagugagaaaaaucaagaauugaaaugcuacuggggagaauguugccaugaacacaggccauauuacucucugcuguccuccggagccaaagauuguuugccugacuaugauuguuuccugagccacccaaugcgaguuaagcacccaaugagggaaagcucaaaucuucuccuccauccauaaacggcccuguguuuugauaucaugguuguguugcucugcuccaaggguugggagacaugcuuuccugcgcaccgugggacuugguacaaguggaugcuacaaagaguagggauccauuccugugauaggaugaucaaaucucauauaaccucaauaauccagggaacagcaagaguaccaagccccaugugagcacuguagugauacggaaauugagugaaaugcucaggcaaaccacaggaccuacccauucaggagguccucacuacagcuucugucuagcggucccuuaugcugggagcuaugaauguguuguggauuuaagucuuaaaaccaugaagccacauaggagcuggaauccuuacuuacacgggaggaaaugaagcauggaagaauuaaguuaauugggcugaggagaaggcucagugagguagagugcuuacuacgcaagugggaacacccaagagcagacccccagagcacagagaaaacugggcacagcccauaucugaaaucccagcaccccuacauccagaugggaagcagggacaggagaguccauggaaguucaugggccagcuagaugagcuuauggcaaacaacaggagagccugucucaaacaaaagggaaggcaagaacugauuccugaagauguccucugaccuccacuggagcacuauggcacaaggaacacagcccuugucaagcacgcacacacacacauacaacucaaucaaucaauauguaguaaaauuuuaauauaaaauuuaaaaugaacaauuucugacuuguuaaaugucaaaggauagaguuuagguuucuaguccaacagguaaaacgcuuaaggauauuagacauuauuagguacauagauauauaaucacccuaaugacuucaaacucaacaguuuuugucaggucucugugagcugaguucucauaaugcgaaagacaggcagcucucucagaaccagaacaacccagaacauucacccuagaacaaaacgcugauggaaagcagccccagauaaacaaacaaaacaaaacaaagaaacaaaaacccagccugcacuggaacccacagccuggagcuuuaguaagcucagcuuguaucugagaacugagcauuccagugugagccggccacaggaguucugaucauuuugauugguuuucccuccaggaaguccuccaaguccacacagggaccaucaaaggaaagucccuuugggcuucaggcaaaaggaagaaagugagcugcugaggucugcccgcaggaggaaguguuuuacaagaagaaaaaggaaaaaaaaaaaaaaaaaaaaaaaccuaaccugugugguuuucggagucucacaaaccugagggaagggggucuaagucuuaagccugcuuccucugcuguucuuuuccauagaaggaaaccaaacaaaucccagacguuggauggaguccaugaugaggucagaagguuaggaacagaggugggucuuagcugcaggaugggaugcuggccuucccuacacaccugggcacaggaugaaaugcuugcucccugucaggguggaaugcaggcugaacaccacaugaaagaaaacacaccgcuauguaauaugcuuuccuaguuucaaaccugucucucgucuuucuuuucucuguggcuaaguucacaaaaaauguaagugacaaugaacacccuaaaaugaagcccgugacuucagaauaaauggacuagccauguuggcugggaugucuguagaaucugaggcagggcagguaucuguuuaagggguuccuuaaucuagcuguguggugucuuuauuuguggggccauuaugauaaacugauuuuuaaaaauaaaaaauuaaggccaauuccuuugacucagucuaguaauaauaauaauaaauaauaauaauaauaauaauaauaauacaguaacugcaaggcaagcaucagcgagacugggccagcuucgugugcaaagucagauacagugaggauguugggcuuacaaaaguagggucuuuuacaaacugugauaaguaugcuaagaacuuuaguggaaacagacaguguauaaggacagauggauauaaugagaaauaaaaacauuacaaaacgaaauaagaaaggucaaagaagcaaugagagaaaagagaaaaaggugaagcaucuuuucccgggacuccugagggcaguggccgcugccagggacgacacagacacccucaacccuaacagcagagaggaaaagaugaaaacugaaaaaaacauccaaagacugugugucaaguacaaaaaguccaccgugagcauaagggagccccagaggaggggguuaaggaagaggagguggagagaagggagucgagggcagaggaggaaaguuaagacuuucugaucaaacuucucaaaaucaaagaaagccaagggggcaggaauggggagggcaaagagacacuucaccaugagagaaauaaaagcuaagaauuacaucugucuucuucucagaaaaugcauaugaugauuuaauugugaauugugcccccaacgaguauauguguuaaauguugguccccaccuggcagugcugucuugggagaugaugggaaccuuaaaggucaggacucggcugaaggaagugggucaugggcaggcacgugaugcugaacuuugccugauccuggaucccuuucucucucccacaacaugugcccaccacugucauguuacauucugccucaccuuacguccaaaccuauggagccaggagacagccaaccacaaacuaaaaugacugaaaccagagccagaaugagccauuucuccucgugguccuuuauugggcauuuugucacagcacugaaaaucugacugguauauuaugcagccuaaaaaaaaaaaacuguuggcuuugcagacgccacugucgcuuuucgccgcuugcugcagccauggucaaccccaccguguucuucgacaucgcggcggaugacgaggccucgggccgcaucuccuucaagcuguuugcagacaaaguuccaaagacagcagaaaacuuucgagcucugagcacuggagagaaaggauuuggcuauaaggguuccuccuuucacagaauuauuccaggauucaugugccaggguggugacgucacacaccacauggcacuggcggcagauccaucuacggagagaaaucugaggaugagaacuucauccugaagcauacaguccuggcaucuuguccauggcaaaugcuggaccaaacacaaacgguucccaguuuuuuaucugcacugccaagacugaauggcuggauggcaagcauguggucuucgggaaggugaaagaaggcaugaacauuguggaagccauggagcguuuuggguccaggaauggcaagaccagcaagaagaucaccauuuccgacuguggacaacucuaauuucuuuugacuugcgggcauuuuacccaucaaaccauuccuucuguagcucaggagagcgucccuaccccaucugcucgcaauguccuguaaucucugcucucacugaaguucuuuggguuccauauuuuccucauuccccuucaagucuagcuggauugcaaaguuaaguuuaugauuaugaauaaaaacuaaauaagaaaaaaaaaacuguuuacguggcugaaagggaagaaaaccacuaaucuacaguucuguauggagucauccuucaaaggagaagaaauaacaaaguuuucccacaaagacugaaggcguuuuuugccaguguaugucuucaugaagguuuaaacaaacuuuucaaaaaagaaggaaaauuauaugggcaagaaacuuacaucugcaucaugaaaggaaaauuuggagggaaaaaaauagguaaaggugaaauaaaaacuggcuuccucaacucccauuuguuuguguguauguaucuguaacuuauuagcgugugcaucagcaugucacaugguuccguacagcucuacgucauagagugaauggcagccacggugcaauggacaggaaagggaaccaggugcauacacagcccaggaagcaguaaagcguuauuagaaaguagacuacaaaauuaaacccugcaaacuuucagaaaacccugcuaaaacauaugcauggcccacaaaaaaggagagaaaaauggaaucauauaaaaugcucaaauaaaacugcaaaugguagggaaaacaugggagagaaagcacagaaggaaugagagcagcagacagaaacguaaaagacagaauaucuaucuaaguuuaccaaggaaggggcaacagccaucagaagaaacugguuuuaaauauaaagacaagcacugaaaguaaagggacgaggaagagacagcacccagaccaaaaggaaaugagaugagcugcacugcuuucacacagagccgacuucaaggcgagaacaguuggcugggaucaagaaggggauuauaaauggugugcccaaagccccaugaagcccuaagcaacuguaucauauaugcuucucccaacaaacagagcacaaaaauacacaaaacagcacgcaucaagguauagaaggaguagauggaauuacuauuacaucugaagaucucagaacuccuauaucagcaguagaugcauucaauguagaugaacucuguaaagacuaaguuuggaaagauggacccaaguuaagagcacgggcugcucugcucuuccagaggacccagagcugacaucugucacuccaguuucaggagaucugacacccucuucugguguccaagggcaccaggcauauauguggugcagagcaaaagagcuauacacauaaaguuagauaaauaaagcuuuuuaaauaucaaaaacagaaggugugcugauggggagggagagauaaaacggauagcacaauccguguaggaaaggaaaaucauuaaaaaaccacucuaauacaaagucauuguaccaaggucacaggauggaugaugaguguacaacaaucuucccacaucccagcaaugaacugggauuaaaaguacauugucgucugggcauggcccacauuuuaauuccagcauucugggaccagaagcaggcagaucucugaauuugaagccagaaugagucuacagagagaguucaaaaacagccagggcuacaaagaguaaaucuuucacacacacacacacaaaacaaaaguaaacaaaaaaaguauauugucauuuaaauuaacacacauacacacacgcacacacacacugaaauuacuuagguauaaauagaacaaaauaugugcaaauccacaugacaauuccaagcucugaggaagcagaucaaagaaccggcuaaauggagagaaauucuacauucaugcauagaagcguuuaacaaugcugaggugccagcucgugccagccugaucuaugguuaucacaguccaccagaaaucccugcacauuguuuugugggaugucaacauguagcucuaaaaucaaugugaaggagaaaagauccagaagagccaacguaauguggaaaaguaaaaacaacaaauaaaauugauauuguugauuugguuacgugucagaucugggauuugaugaaggucgugaaggcugaucccgguugucaaggugaccggaucugaaguucaguaaaacacaggcugcugggcacucuugggaaagacuaucuucaucaguugauuugagaaaggaagacccacccuaaaucugggcagggccagauaagagaacacaaagaaggaaacuuuaccuuuugccugcuugcccucacaaucauugguguggggugugugugugugugugcauguguaugugugugugugaguguauguguugugagugugugugugugagugugugugugucugugaguuaauguguauguugugagugugugugugugugugugugugugugagugaguuagugugugagagugugugugaguguguaugagugucugugagugagugugggugaaugugugcaugggugaaugucugugagugaaugcgugucugugagugaguuuguguguguguuguguguauaugaaugaguguguaugugugugugaguuuguauuguguugugagaguguguaugugaauguguaugagugucugugagugagugugggugaguguguguauggguaagugucugugaguaaguguguguguguguguguguguguguguguguguguguagcauacacauauuuuuucauucuaucacuucuguuccuuuagggaauccugacuaauaaacuaguaguuucaacucccaaagcucuggcuuaauuuggaaccaucagaauaaaaaucgaguccuaaucaaauugauuggcccuugcaacacguauuucuuaaccuacuuuugucagguacucucagcuuuaacugccagcagcuaaggggauaguaaagacaguugaaacuuauaccucaguagcucuuacuacaagaaggaaaacccacuaaggaaacccuccacucauaccaaccaccacugaauucuagcugguccguuaucuguucuguacaauauaaccugguggcuucaaacaaccacaaccacauuccuccugcuucugugggcugggagcuucauagcuccucucccugguguaguggcucauggggcauauucagagggugagcccucugagguugugcucugccauguggggcuuuucugcagcauagugauguuuaaaacaacaaaaucgcaggcucuggaauccuggauccccaccucagaaacugugcaaggcugcuucugcuauauucugguagucagaacaaguccaagaaccaggacugagaaacuagagugugccucuuggaaagaauagaaagccaugcugcccaaaacaugaacaaaacaaaccaacaaacaaacaaaaugugugaugugcuggggaccacuauuguaaggcuaccgugugcauuccucucugcagcccauugauucacagcaacuucacagguagaguuccagagcuucauacaagcucacgauaaggcucaaaaguaaagacaucugacauccaaagugaagauacagauaaaguaucugagauagauagucccauucaaaagcugggggaucagccaggcacagugaugcauaccuguuaugccagcacuugagaggcugagacaggaggaugaugagcagaacaguagaggcaggagagguggcugagcaguucggagcacaugcugcuuuuccacaggaccuggauuugguuuccaacacucauagggcagcauguaauucuaacuccagaucaagaagaucugacgcccucuucuggccucuucggguacugcacacaugugauguacauguaggcaaacacacacauaaaaauaaaucugaaaaauaaaaagucaaaagcuaguucuguaguuagcuauggagcaaagaggagaaaaggagagagacagacacacagagacacagagagagacagagagagagaguaaguaacaggagucauagaaucaucacuggccccaccuaaaguccaagagugaaggcaccuucuagagacagauaucccucugucaggacacccucuguuccuuuaguugguucccuuggaaauccuugcaacucuuggugcugguccacacuuguagcuugaccuucugagguacauuucauuaaugacaagaaauggccccacguuugccucugcauugcuuccuggggcucugcccacagaagguaucccaggaaucuuuauuuuauuuuacugucauguucgauguacuuggguugcauaaaggcaacuucauccaacuguaucauuuacuuagacugcauucaccaccccaagcccuuuccuuagccuucuccuuccucuucccuccucuuuaccccuaacuagucuccuuccccucaguccccccuccacuguauguaucuauauauaaucuaggguacacaaguacaggaaaacaugugauauucgucuuucuggaggccucuuuaaucucucucucucucucucucucucucucucucucucuuucucucuccaugcugagaguuccuaugcauucuguagucuuucuccaugccccagaaaacacaucuauaaaucuauaacucgucccaauccagagcugugcuauggucacggcaagugaccaugaaacaauacccuuaagauucuuagaaagauuuugccugccugacagggacuauuaggcuccuccuuaaauuucucugaagccuuaaugggcacaguccagacucaguguuuaccuuaaggccauuucuuauuuuaacaaucuucagcugacuggagagacuaguauuuuuaaacagucuuauuuucucgcucacaaugucuugucucuccuguaguccauuuaaauucuaauuuuaaacaacuguuuuacucuuuggaucauuucucugaaggccaaugggcacuuugacugaaaucuuccuguccaaggucauucaauucauuuuuuuuccucuccaaaguuaccacaguugugaguuugcuucaucacacaacauaagcauuuuccucucuguucugagagccucugcuagcaauauaccugcuguccuacagucuaccagcuauguaguccccaacucauccuuauauacuuuuaagauauauucuucacucacacacacacacacacacacacuccuucgagacaccaauuuuucuaucaguuacuuaauaccacacacuaaaccucagugacuuaaaaagcugauuuuuuuuuccucaggaugcuguggguuugucgggaauucacugacagacuugacuuggauccugugguggcugaucuugguugccugcuugcuuggaacgggcaccaacuaaaacacaagcagugaaggaacugcuaggagggacaucgugaucagaauauaugaaucaggaagacccuuucucaaugugaguggcaccuucugguggcaucccagagguaaggacauggaaagagggaauggcuacuuuguaccuuaucaugcuuucugguaucccuucagugaaauuagaaccagagucucaagcuuccaacaaggacugaagaccaguggcucuccaggaacccuccagccuucagggucagguuggagcuucugagauacgcagccucauggauggagcaacuacuagauucucaaccucuucaguaugagauggccauuggacuaucugaaucauaccauguaagccaaucuaauaagucccauguguauccauuugauugguucuguuucucaagagaacucuuguggguaguagauugcuauuugaacucaccuggucucucucagaaaguuucaucugugccugugugagcccagccucugauaacacagacgccaccaaguucauauccuacaagucaagucacaggaccaguccuuagugaaaggauggacagacaacuggugauugagagaauggcaaagagacaugaaugcagacaggucugaucauuaggacgaccguccuaaccacgucccugcauuugaugugauaguuuuaugaacaggaguauguggauauaugcaaagcaugaacuuucuucugugucgauaccgucuccgaccagcagaaaagaagcgacgaaaccgacgaccuucucaaggcaguuuauucaggaacuuuacaaugugcaggaaaaaggaaugccccgaccucucucagccaucccccuuuauccccucucguccacuccccaucaccccaguccacguaggcacaguucauuggcccaggaauacauuugucacaucaaccgaucuuacguuguggugcaucugcgcaaugcagcucaagguucguggcuaucuugagggauaugaggaagucaggugccagucauaagacuuggcagcagcccugggcgccaucuuggggccagggccacacccacuccucacacuucugccugcuuuuagacaugugaugcucacacuaccagcuuauuuagauaaaugcaguugcgucguuaugcuuuuaugaccaucagcuacugaauggucuguaguauauuuggcaaaagugaugaauucuuagugauuugagauuugccuggagcuccuggcuauaaauuuuucuaugaaauaagaugacauuauugaggaauuauguguguguggaaaugaugggguuuguggauuaacaaagugagagguaaugaggcuccgcugucuuuucaacaggcagagaccugggauuccuauuaauucuaggagcgaaggcaaagaugacaucauauugcaagaaaaaggcuauaaaaagccuaaauuucuccaucacagacaucauuugaucagacuauauaauuuauauuaauuacauuuucacauggauaacuugaccucaaaguuauuuauagucuaaaucuacuaucuuacugguguguguguguguguguguguguguguguguguauguguguguauauauauauauauauacauauauauauauauauauaugacucaaggcaaaauauaguuuccugucuuuauuucucagagucccuauuccuguuuaaacagaaauguuuauacacuggaauauaaaauguuguuuuucagaugcccgugacugaaacaaaauguuauuuuuaccauuuccaaagaugaauaaaauuaauuauuaugagaauaugccacaauauuuaccagcuucauucauauuuuaagggaacuacuaacacaguugcauuaaguacuacugaauaagaccaucucaaccggagaagaccuuguuuuauacauagaagaaagagccaaucaagucagaggagggagaguaucaugacuuaucuacaauuccuuguuuaauagucaucaggccuaaaguucugacccucgcugaggaugacuugagagaaaacagcuuuaaaagaaaacacacauuaggagaaaaaaauuaaaauaugcuaaacauuugaaggcauuaaaacuuucaguaacacaugcugugagauuccugccaaaauuaaggccuggcaagauggcucagcaggguaagggcucaugccaaugagcccuuaaugaccuaaguucaauccccaggaccgauguagcaggagagaacugucucguuaaaacuguccgcugacuuccacaugggucuguauguauaaacacucacacucacacucacacacacacacaauucaauuuuaaaaguuaauguaaaauuacuagauacuaaaauuacuaggcugugacagucacacucaguguaggaccauagaauaguaauuuccaaggaaugauggggaggaaaguggggaguuacugagacugaguggcuggcauuggcugcaaacaauaaauguacucgauguacuaagcugugcucuugaguuucuacagucacauuagugcauugcacacggugugugcacuuauguguauaauguacacguggaggucaaaagacagcuuuguggagucacuucucuccuucugccuuuacacagguucuggggaccaaagucgggcugccaggcuugugcccgaugcaccucuaccugcugaaccaucuuguugacccuaagcuacacucuuuuuaaaacauuuuuuuaauucuuugugaauuucacaucaugcaccccaauauuucucaucuccccaucccuuuguaucucucccuccacccuugcaaccucucccccaacaaaauaagaaguauagaacaauaaaauaucucauugaagaagcuguagcaugccccacaguauagccuuuugucucuacacuuucacuuguaaaagcucauuccuuugagucaucggucuaggcugcuggcuucugccauacuaucaauacuagauccucacugagacuccucucggcuauccuauuguuaccugugccacagagauccugcaacuuuggcucugcagggccagcccuuucacaaucuccagcaguucauaggugggguagauguggaguuagccaacucaagguccuggaucuggaccugagggguagcugaguuggucagccugccugcucuccuguacccacaccaccagggugagcucuccagcacugucccagcuugcucacccagccagggagggguagaaccagcugucccucucucgugacugcaggaucacuucuccagucugccacaggagguaaggggguaggguuggggauaaggaggaccucucugucacccacagcaccaccaggcagggcaguggcagagcaagcucuccugugcucacccccucaggacaguucaucuguuccacaucgccagguccagcucuucuaugaagcccaggcaagguacagggcuagcuagcucuuccacucucaugacuucuuggccagcucuccuacacugcccaggcuaagggugaggccagcucuccagcuugcuucaggagucauagggaacagaggggcaucucuccagaaaccccacaucacagcacagacagcaagaggugggccagcucagcaacuuccccugacccgcaaccagggccagcucuacuguacuuccagggcaagguguggagggccugcuauccugaggguugcaaccagagaggggugaagccaguucugaacagcagucagacaucaucaacaugacccuggcagcagcccagaccagggauguugucauggccuuuagugguaacagacccaacugcuacagggcuacagacucagaugugguaguccucagagucagcagggucucugagugauuuuucaaauccuauuuuuaaugaugguucuuaaacauuuuaaccucccuuuagcccaccacccaccagagguaguggaaaacaaaggauucaggggaaguggaccuguuuagaaagauucuuuggagcaacuauuguuuguguugccuggaaauuggcaguuuaguucccagguuagcaggggcagcucgauccacucacaaacauuucacagaugcaucagcaguccaguucgguagaguuggguuagcaacaacugucacacaaccuagcagagacagccaggucucagccuugacucaagucagcagaaagaaccaacaggacaccagaauuucucagcugugccccucucagggaagcaaagaucagcaaagaugugagacccacaagcauugcacagcuagcuguaccagcaagccaagaucugccucugucacugcccauugaguccuauuuauacccuccaaaugucacguguccucuacagaucuuaccucagcacgugugucugucucagcugacaucacauugccaucauccaagucugaggaagcagcaggaagcugcagcacgccaucagaaguuggugcauuucucucuauggagucccacaaaugcagcucagcuaugcauugcaagguggaccaacacaugcguguuguuagcaaagaauccuucaucaugugucccuuucucaugcuugcuuuagcagaacauccuuucagcugugucuguuucagcuaaauguuccuucacaaaucuaacuuagccuuucaccuguguccauuucagccaaguacuccuucccauguuugccccagcaaaacuccaucccauugacuuuccaaagaacccauaaguuuccacuuccucugaguggcugaggucaucuuaggaauacuaugccccaacugcaccauguggcacucgguggggccagguugucucgagcauguucuuccugcccggugccaaguggcaauggccagaccccaaacuguacccauaaacaugagaacaaugguaaacuuuacgcugugugcauuguaccaugauaaaaauaauauuuguaauuaaacuaacacaaguacaaaacacauacaaccauuucagacugcaagagcaagggacagauacgggaggauguaacaaccuuaaaaggauugccauaaaaaguuccuuuccccagauccacuaccacuaccacagcugaagcucuucggagggccugucagacuugggagccacagcugagcuacacaagccaaagugggggcgugguuagugccaaaaggaguucaucgcuuaaaaggagccuuagcuuuccgaucaaauauuaaaaggucaguacuagcuuaaacaucuccacaucuucauggaaccagggcaacaccuccaacgccugcaguuccacuguccuugucauugcugcuucucaagccccagccuccuccucgacugagucucgucccuuucucuagaucacaauucagacagucuguugacuauguuccacauuuuccuucccugguggcuucuuuauaguguccaaaaucgucccgaaguuccagccaguguucauuagauuauuugagguuuuuuccagcaaagcucaucuggaggcugcccuuguguguggcuaagcaaccucucucuggcucagaguacacaucguguuuccaagagcagacagcuagcacagcucauggacuuaguuugggacagaugaaacaagcauuacagaaaggguccaacggcaagagucaaaaucaacuacaaaaaccaacauggagacuucauuguccuaaauaagucucuacagacaugauucaaaccaaguugguuccagcagcaggggacagagaagcaccuucagccagcccucccaaggagauagugugcugccucaccaguaaauuccagaaagcagcuuccacucuggaaggcuguauggaaguuccaguaugaagggccugugaagcgccaugaaaauuaguugacauacuugcuuauuaagacauauuucacugugggcauauucuaugcaugaagacucaaagauaccaaucaaguucuguaagggacuuguguuuuaucuuuacaaaaguuuacucuaagaacacacauacacauagauacauaccucaguauauaucuaaauauauuucccagaaucccuucaucucuuguaaaauguaaauccaaguuuucccucccagccacaauaacaaaucugagacuaauuauuuauuaauuagucugggccauaagcuuggcuuguucucuuaucccuuuuauucuaacguggguucaguuacguggcugcuuuccucucccugucuccuccgaguuccuagggugaaucuccccuuuauucuauccugaguucagcuaccugcugguugguuaccucuccuucaguccuggccuucuuucucaaugucuggcugucgaaacuuccacuucugacuaucucccagaauucucucucuccuugcuggaugucccaccuccuguuuccug

SEQ ID NO: 8362 - RNA, 1405 nt, Mus musculus
ccuaacauaagcuuauaucccucagggaacgacuacuugcuucgagguguuugacccaggucccgguugccacaccgacuucugcaaccagccucuucuccacaauggcagugacauucugaggaagcucugcugccuagaacaguaaagccuggcucugugaggcccgauaagcaaagcacuguguuuucacgcuuccccagcguaaacccagaaccaggaccaugaaagaugcguuguggguaggaaaagugacaucaauguuaacauuaguguuuugcuaagauuuuacugguguguguaguuauuugucacacguaagacugaagcuugcuuuucuuuguuuugacacaaggucuuaaaagcuagccuugaacucacuaagcagucaaagaugaccuugggcucuugauccuucugcccccaucucccaagugcuuugaauuacagguaucuucuguagauuauaaucuuuauuacaucguauuagaauauggucauuaauauaaauaaaguauauauaacaaccacuuagugacguaagugguugauauccuggauuuuuguuguuguugggguggacuacgugaagguucuucuuguauuguucaauuguuaauucuguagcagaggaggaggaaggggaagaggaagaggaagaggaagaggaagaggaagaagaagaagaagaagaagaagaagaagaagaagaagaagaagaagaagaagaaaaggaggaagaggagaagaggaggagggagggaaagagucggagaagguaguagaggaggagaagguaguagaggaggagaagguaguagaggaggagaagguaguagaggaggagaagguaguagaggaggagaagguaguagaggaggagaagguaguagaggaggagaagguaguagaggaggagaugguaguagaggaggagaagguaguagaugaggagaagguaguagaggaggagaagguaguagaggaggagaugguaguagaggaggagaugguaguagaggaggagaugguaguagaggaggagaagguaguagaggaggagaugguaguagaggagaagaagguaguagaggaggagaugguaguagaggaggagaagguaguagaggaggagaugguaguagaggaggagaagguaguagaggaggagaagguaguagaggaggagaugguaguagaggagaagaagguaguagaggaggagaugguaguagaggaggagaugguaguagaggaggagaugguaguagaagaggagaagguaguagaggaggagaagguaguagaggaggcgaagguaguagaggaggagaagguaguagaggaggagaugguaguagaggaggagaugguagugguaguaauggugauugagguuuucauc

SEQ ID NO: 8363 - RNA, 2965 nt, Mus musculus
ccuguuaggcugaccuuguuaaguaugcuguaugcaucuacauccuuucugauuaauugucuguaguugcaguggacugggagccugcugugauuucacgucuucuagacuuacccaugacaucucaacaaugugguugccuaaacaaaaccugaaucaugaccucaccagucaacauaccaauggggauggaaaucucauccugccccacccgcaguaaagagcuauggcauuccauagcuucggagggagggagaauccaggacucucuagggacaagacucuugccgggcugguuauccaggcucaaguggucagcucuaaacacauguauauaugaguaauaguaaaugcacugaggugugugucugugugucugugugugagucucucuauguguugugaauguguggguuucuguguguguaugucucuguguguuguaugggaaugugugggugucuguaagugugugugagucucucuguuguauguggguguguggugccucugagugugugugugcuucuguguguguacgcaugggugucuguacucacaucaguaacagugauggucacagaggaugacguugagucggugagagugucugggcuguagaaagaaggggggcagaugaaaauauuauaaauacagcaugccaugugugaaauauucccccaaauuauaaaagauuaacuuaagauauaaaaccaaagaauaaaagggugggcucaaacaguuucucuaaguuaauaguaucuuucaggugaauuaaacuuuuucaucuucaugaaguagccucuauuacuagugaugcaagguuuuuuucuguaaacuauuucuucuaaccagguggugucagggcaugccccuaguccagcacuugggagacaaaggcaggcagaucucugugaguuugaggccagccuagucugcagggcuaguuuaggacaacaaaggcuacacaagggaacccugucucaaaaaaaaucaaaaccaaaccaaaaccaaaaccacaaaauccccuaugucucuuuccacuguuaauccggcuucauuggcuuucuuugguaaauauugaauuguaucuuuccauccaagcugucuuugagacuagggauuuuuauuuacucuugauuauguuugcuguaauuuaccaauuccugccuaccauuuuacagggcacgugaaggucagucagcucuuaggacaggggugggaaggucgggggcuauacuugccucuccuagucgcuaggcuuuggggagguuuguguuacaugccccuccguccccacccacagcuccccaaugaagaauguuagucaaguagucucucuaaauuaaagucugaaaucagucaauaucauacuccuuuucugaauuuaaaaauagccuaaagaugcauaacugcaguaauuuucccaguacagucaguuauuacuuaguauuaaauaaaauagauauuagauguuuuuacuguauagaguuaaugauuauuuaggugugauuccuuuguacccuaucuuuguauacuauaucuucuuauauuuaaguccccuuugccucugccucgggagugcugggauuaaaggcaugcaccaccacacccagcuucagcccuuucuugguaguuuuucuucuacuuaaaguaaauuggaauucuuauuaaagaagguuuguuauuauugcgggaaauauuuuuaaaaauggcaccaucccgugcuauacccagcuacucucugcccagcagccccauaccccagacgcuaucuuccuagcuccggcucaccugacucagaacugcuuguaccgcucggccaucuaccccaugcugcuaguagccacaaauccccuuaacccaguaaaucagaacucuagaagcuuagaauuaaucagucagauuuauauaucaauaaauucucaauucacaagcugcccacacaauaauuucagagccgauugauaaugacauaaauugcccaccuagauaagacaaauugucuuguaaguaucuaucccuuauaagauauucauaguuaccuguggcuguuuaaagccacacggagucuggaucgucuucuucuuccuccgucuuccuccuccugcugcugcugcugcugcugcugcugcugcugcuucuucuucuucuucuucuucuucuucuucuucuucuucuucuucuccuucuccuucuccuucuccuucuccuucuccuucuccuucuccuucuccuucuccuucuccuucuccuccuucuccuucuccuccuccuccuccuccuccuccuccuccuccuccuccuccuccuccuccucuuccuccuccuccuccucucuccccucuccucucuccuucucccucaaacuuuuuagcuccaccuucccuuccacugcccaaucaccagcucuagccuuuauuuuacaaguuccgguggcgcacgccuuuaaucccagcacucuggaggcagaggcaggcggauuucugaguuccaggacagccagggcuacacagagaaaaacccugucucgaaaaauaaaaacaaacaaacaaaaacccaaaacaaguuaagguggggagaagguucuuaagaagucaccugcuuaugugauucacuccucgccagcaaccccuccugggaaagcggaauuagcaucaaaauacaagcaacaccaggacuccaggacacguuguugaugacuuggguauaucuccccugucuaccagaguggcuuuccaggugugaugaguucuggacugcucagcgucuccccauuccucagcuuccagggucccugcugagaagccacuggcuacagcugguuuuaagugcccugagucucucucccuguucuuaagacuccauuuucuguguucugaaguccauuguggugucaguguggauuugugugcauggcuuggggcuuauggggugucagggguuguguuucuaguuuuagaag

SEQ ID NO: 8364 - RNA, 590 nt, Mus musculus
uggggaaucgccacucugaguaagcugcuauccucacagcccucaccgaggaagaucagggcucccugggucuaucaccucagaaagacuccacagagggaaagcccagcccacacccuuaucugaucagauccacggaaagggcaaagcagugcagugcaggcaguuggguugguuugcucugcaucccagcugaccucuuccccguaagucuggagaaucucugagccugauuccuuucuccuuuucuuguaaacagggagucagugguuaccacaugggcuagggcuaaagacggaacauguuaacccgugucuagucuuuuuggcacaacguccgcaccgaguaaguccauucugucaugugaauaccaaauguuuuuccuaaacauuuccgauuuggaaacgagggcuguaaucaucguaucuaguaggggaaaaaacaugccgccacagaaacggcccagaaaaguauuggcaagcauaucaacgcuguuuggccagcccugaaaccuuguccaaacagaggcucugugcugcacaguuuuaaccugcccaguucaggaaaagcccccaaggccugaaguugga

SEQ ID NO: 8365 - RNA, 1374 nt, Mus musculus
aaaaacauuuuuaacauuuaaaauaaucgguccugauaauaauguguuuuaaaccacuuuaaaaaucaauugguuuuucuauaagauuuaaaaucccucuucguguuagauguaaauucacauuccaauccugcuucccuagacagucucccaaugggccaagcuaucaagagacucgacaggaacacugcuuuguuuucuauggugcuugggauggaacccaggccucacccgugcugugugagcugcaagcccacagucauaacccccaaagagaaacucuggagaggcucacggggccugccugggagcacucugaguggcuugugggucuguauaccugaccguggguguggcugucuuuggggcugccuccccugaaacuucugauagcuugcgagcauguucccaagucacugaggcugacaccgucucaucauuuuucacagcuggcuuaauggugaagaagucagccucagacgcguccaucucuucuggcacucauggacaauauuccaucuugcagacagcgaaacuucucccaggagcaccccagcaaccagugaguccucuguggggcucccagggcagugggcagcgcuucagaccugcgggaguagugcuucaccccaagaccauguggauuucuguggauacaaggaauauauaacucugucuccuuccucucccugcccgccaccuuaucccccaacccccuaaugcuuauuagcaacuucuuuacaggacaguuaagugacugugcgagcacugcaggagaagacacuuggaaugugucuccccgcucccaguuccccugaagagcaaacggcccacuuccagacuccucuucuacucccuuguaauucuugccuuugccuagagcauuggguggggaggagaaaaggagaaacgcagaugagcuggccauuuuggcauaagauuagauauaguguagaacaguucugaaaaacuucaagggagggggacagagggcugggguccucaucaggaggagucugagcugcugaugggcaugcagaugaaggacagugacaggaagggaaggcagugcucuacugcuggggaaguuacacaggcuggcaaggcaugugcagucuggacaggcuaaggagcugacuagauuccagaguguacaguaacguaacugggucucagaugacccaggagccgagugaagagguaggaaauucuguugggaaacauaccugggaggcgcuucacacucccacggaccauggagguguggccgagacacugcucuccagcucuuccuggcuguggagauaaacgcagaagaugguguguccacaucgccaaaucuggcaccaugcuguuugggagcuggucuuggca

SEQ ID NO: 8366 - RNA, 40334 nt, Mus musculus
cggggucacgugcucacugccgcuggguuagggcgcagguuacuagugguggcggagggugagcucuguagccggcggaguccaccgcgagccguccgggcugccagagucauugcgccggcagguaggacgggcgaacggacagaaggacggacggaagggagggagggcaagggcgucgccgcagccccaggagaggagggcgguaguccugcacagacacuaaggucgcgcggucucggagggacccgaugacucgccgcggcaccacggauuuuugucuuuuucuugauuggucacugcgccgcgcugguugccccugaggcuuggaggagagcaccugcauggaaggugcacuguccugggcucuguguucucauaagccacaccugagucggacacaucuugcucuucuccgaccugggagauugaauaguuggaaugcugauagguuuucuaaucccaguaaccgucauuuuaagcugaaggccuccggaaaguucugaaguuaauccuauucccaaauucugaucuguagucuuaauggagcugaguucucagcaguugagacaggagguaguuuuagcuucuugauccuuagguuaaauuguauuuccacauuuaagcucaugcugauauuugcuuuacacgucucaucuuccuuuagccaguuucacccuuccaccuguuucccucacagcuccucaaacuucucuuuuaaagaauguauuuauuacauauauguaugcauguauguauguacgugggucgggugugugauguguguucaccaaugcaggaacggucagaggacaguuggaaggagcccauucucuuccugcaugugaaucccugggcuggaacucuguccaucaggcucugcacaagagugccguguuugcugagccaucuuaccaucccugggcccucuuguuaguucauucccacaucuacuguaccccgcuccuuuuuuauuguugccguugcuuauuuauuuuuguagaaacgcugauuuuuuucauucuucuuucacguaauuuaagaggcuucagaccucuuuaccauaguuagugguaccuaaagggccagucacuucagaacaaucugccugugaccugaaguguccacaaaggguacaagcguuuaaauuucacaaugcauuagacaagcagaagugaggucuaaguaccauuuuacccaggagauuaaaauauuuggaaaugcaggcagcacuagucauuauuaaaauauagacggagggaguaguuuuguuugccugcacuaagugagcacaguuauacucaaaugagccacuauggcauuuucggacauagagauaacaaaccucauuaccauuucugccccuucaccaccuccucuuccugucaucaccuugggaguccaucuuucucucucucaugcccccccccacucucucuaaauuacagagagagcacgugcaguauuugucauugugggccuagcuuauccacuuagcaucauugcugccucuuccauguuccucaggugaugacuuugcuuucuccucuauggcugaaugagacucuagcauuuucuuuaucuguuugcucuacuggacaccuaggcugauuucacaguuggcuaccacgaacaguguaucaguaaaccgcucaugugcuaguaucucuggaucaagccgaguuugacucuugguuauagacucagaaguggugcggcuggaucauauuguaggucuaaaagggaguauuacuuuagacuugggacccauuuccaccuaggcacaggagccuccuuccaguucuuuaacugcucugcacccuccugucuccccacgcaagacagcuguccaucaugugaacucugcuucugucacacuuagggggaaccgugaaccccacucucuuaaagcuuccccaaguuuaaucuucccaagagccuuugcuuugcuuguuuucuuuugguuauauuugccucuuugaaaagucagucuucuggcugggcaguggugguguaggccuuuaauucagcacucgaggggaaucucugaguucaaaaaggaguuccauaacuaccagggcuguuacacaaagaaucuuucucucacgagaaacaaaaagcaaaagcaagaaagaaaaaaaaucagucguccaacucucagcugacuugugcaugaacucugcuguugagcugcggguucuggacucaggccugcacguuaauuaccugugaguaaccugaacuccaccuggcaaaugcauaugguuccuuucucuuacguuugccucaaccccuuuuugcuuuucuacugacugaaauccucuagacaucucugagcacguggugguuaccagacacucuucuggaugcuuguggugcaacggugaagacagaauuaauuuaacugggaacagagauagucucucuauaaacagauacgcagagagcugccaagauggggaugcgauauggcugggggguuacuuugguuaggaaguaucagcaauggauugccgacaggaagauuuugacauugaacuucuuuauagcagcacuaaugaccaggaauuuuagugauagggacacuauucaugacagcacucaaaacuaaaggugucuaaauaugcaucacauuaaagaugugagauucugagccaagcagugguggcgcacgccuuugaucccagcacucgggaggcagaggcaggcggauuucugaguucgaggccagccuggucuacagagugaguuccaggacagccagggcuacacagagaaacccugucucgaaaaaaacaaaacaaaacaaaaacaaacaaacaaacaaacaaaaaagaugugagauucugggcuggagagaugacucagcaguuaagaacacugguugcucuuccagaggaccugaguucaauucccagcaagcacaugguggcugauuauauauuauauauaauauauguaauaaacaaaucuuuuaaaaaacccacuugaggcugcaaauggauucccucagaguugucaguaaggacgacaaugugucuuguaacacugggcagaugcagccaugugucuaggaaucugcauuuuauuaaaaaucggugaauugggggcuggugagauggcucagggguaagagcacccaacugcucuuccaaagguccgaaguucaaaucccagcaaccacaugguggcucacaaccaccuguaacagagaucugaugcccucuucuggagcgucugaagacagcuacaguguacuuacauauaauaaauaaauaaaucuuuuuaaaaaaaaucggugaauuggcuuuguuuccccucuaccuuucuuacaaggaccaccugccugcuggccuggaacucuguguagcccagacuaaccuuaaacucacagagcuccaccuaccucugucucacagugcuggaucucaggugcggcuuauauaaacagaucuguuuaaaacuauuaacauuguauaacuaacugacagcaucacacacguucagagucuugcuguggccccuacuuccauccucucaauagcaugaguugacagaaccagcaagaggaggaaaccugagaaacgcucacaguucgcccuaguagacauuuguagaacacgcuaccuguucuuuccaaguacaucuggggcggucaucaaaauagggcccguucugugcccuaagacagaccuggugcgauuugcaagaguugagcuuuuaaccauuguggaauuagguuaagaauaauauagaaauugggagaaaucuaaaauauuugagaauuaaauuccacuuuuuauggguuagcugagcuuugauaggauagucuuuaaggacuguauucuaggacacaggcuggaaagugucuucuuaugaaaccaaggaagcaggugaaacuugguuuuaccaucagcacaaguaaauggacauuuacuugaacucugaguguguguaccuguguguguguguguguguaccuguguguguguuuaccuguguguguguguguguaccuguguguguguaccuguguguguaccuguguguguguguguguguaccuguguguguaccuguguguguguguaccuguguguguguguaccuguguguguguguguguaccuguguguguguguguauacacacaugagcacagugguguggaugucaaugaccagcauccuuaaccacccuccaccuucuuuuaagaaaauccacaucccuaguuuauuuaguauuucugugggguuggggagagaacauguccacagcagcugagggucagaggguagcauuuaggggucaguucucucuuuccacuguguggaucuccaggauugaacuuggcauuaagcucgguccagguaccuuuaccaacacuggaugauuuccuuugcuccaucuuauuuuuugagacaaggucucucaacaaaccuggguuucaucauuuuggcuagucuugcuggucaccaccaagcgccaggaaaccuccuacuucugcuucugcuuccacagcgcugcugccccaagcuuguaacaugcacgcuagggauccaaacucggggccucggcguuucuugcaagcauuucaccagcugagccaucucuucucccuuggaaauggaaacucucuuaaguccauagucuaagcccaucaauuugaaguaugugugauaguccagucagaucuuugacacaucguagaugagagcacacaggacucugccacaggaaacagucccacaagaugagcucgugaucaaagauuguaaagcuuagucagacaaauuaccucaagggcucggcacagaaauggaguuucaacacagagacuuuuauuuauaaaaagugcucaggaggcagaggcaaguggauuucucugaguucaaggccagccuggucuacacagugaguucugagacaaccaggguuauguaagagacccugucccagacaguuuauaaaauaucaagaaaucuuuagaaacugugugcauuggcucauugcagcagcguggaccauaccaaggccuaauggcccacacugccauuuauuacuuagcagggagaagagguagagggucaguuagggcugcuuagacuagagcuacggugcuugccuggcagucagugaugguugucagcucgcguucauuagcugccuuagagggaauuuucugcaucucuccauggauguugggccuucauuuauacagaugcauuguauugaauuuacuugaauuuuccugguuuccuauuaauuaccacuuacaauugaacacaacucaaagaauaaugaaagugccagcacgcuuuacuaaagucugguuuguuuucaggggugaaucccuuaagguguuaauuuuuuuuucucgguuuuuugaguaaucugacugcgaguguccuacugugaugaaauguccuuagggucaaaggaaagguuucaaauauauacuaaauuaaccuuguuucaauuacuuuccaauacaggaugucccuggcugccuacugugucaucuguugcaggaggauaggauccuuugcuccccgaucaaaaagucgcacgcccuggagaaauauccgugaguacaguuccaggccuccggucucucauaggaauagugguggggcugcagccacuuuccuggaaagcacugccaagccaguagucagcgcugagucucucguuugcucaugucuuucuggacuaaugacuugcacuaagugugcaaguccagagacauacaugagccaaucaguuguucaucuuucgauucuuaauuaugaccauguucucauucagcacacauuuacuuagcucuugcagagucagguaccucugaacacagugcugagcaaggagacuguccuucuguccuguggaggcaugggagggauccggccucaucucccccacaccucaggcauggaucugcccugauucaucccacaugguugcccagcucuguucccagaacuuucccugaccagcuaggccaugcagagccaccagucgccaugcaauagagucagcauagaaccuggcuaguuaucuggcuccucccauggauaaucuccgauggcagugucauguuccuuacucuaccucauugccaucugcggcaugcggguggugcuccagccaugcuuguugagcagaaggaucaaauaacauuccuccuccagcucugauuguuuugucugugcaccccucauuuaucugacaauaaacauuuacgacugucuuccgugcaccaggaagucccugucuuuacgguguuuccuuugacagaccuguuggaauuggguggguugagcaugccuuuaauccuagcgcucuuucuuagagaagcagguggaucuccuggaguuuggggccgcccuaagcacagaacgcgggcuagccaggauugcacagucagacccugucuccccaaacaauacaaaacaaaaauaucuguugggcugacacggagguuuaguguguaagaaugcuuacugugcaagcaugaggacuugaguucaaaucccuagcacccacauaaguuaaaaagcugguguaguacacgcacgguaacuccagcacugagaagugugcaguagagguaaggggauugcugacugccagccgagcuccagggccugugagagacccuuguccacagaacaaagcagagagugacagagcaggccuucaggcagcaugcaugggccuguguaccugugcacgagagagcgcaugcacgcgcgcacgcacccgcgcacacacucacacacacacucacuuacucaugcaugcgccuauuuuugcaguguauucuuuuuuuauccagggaauugugacucugaauuguaaauauaaaaggagcaggggcaauaaagccuagggaaggcuccucucuuugcuucucucgguauugcuggccccgugaacugcagaaugucgcauuuacuuuuaguggaggagaacagagaggaaaggccaugaagauggagaagaagcagucuaggaagcugggauagagcucaggggaagagcgugugccuaaagcccacuagcgccugugugaugcccagcguugagagaggcacaggagucuaguaggaggcacaggcaguagcagcagcgaaggaaacacugaccgcuccauguugagggcuagagaacaccagagagccaucauggaaucagacuaucccugagagucacagucagcaacucugugcuugccucugcagaccuccucgucccuguggcagacauguggaggccugggagugccuggggaagugucuccuccucuacauuuccacaagugucugacuuuaguacauggccagccuuccugcucagcaguccaggauuggauaggcaccugucugccaguaauauauauauauauguauauguguauacacacauauacacacauacauauauauauauuuuaauguuuccaagguccaucaaaagcuuauauucuuguugccaguauuuuagauggggcuaugaaaucucugcugcuuaagcaaggacagugugauuauuugggagaaaagccauucauguccccacucgagagucccucagugacaguacugggaagcuuggugaccccaccggccccaccuugccucugacugcagaagcuccugcgguuacacuugguggacccguggugauccugguugcauaacuuugccugggacaugaguucuuuugauuugguuuaugguaacacaacaggagcuuaaaggaugaguguguaagccaugaguauaaaucauguuuuacucaguacugccaguggacugauggucacugauaauaaguauaauauguaaugugaucucuuucucuuugaaggaaauauaauaagauuuacuggaucccucauuguaggguaaguacugaugcucacucuccaguuuuaauggcuucaugauacuguuguuggaaaucuuaacagaagagacuuguagcgagcacagagugcccaugggauguggaaugucagaagguugaacgugccuccauagaggaauguaugugaacauaaauaugaauaacggcauugcaugucauagauucaaacuaaagaugucaugaguguccauuugcagggcaguggauaaauaaguugugggaaguguauuuguguugugagggaacuguacauaaagacaguagugugaaugaguggcaggaauauaagacuaaauaaaagaacacaucuagccugagucuauguacacaaagcuuaaagucaggucaaaccaaucacguguuuaaguaugugcacuuaggcagcagauccacgacgugagacagggagguugugauuauugcugcugagagagagaacgcacugggacguuugggguuguucaccuuguguuucuuguuuggauauaaucaugugaccacuugcucaguguuuguguguguguuuguguguguguguguguugguuggguuuuuugaagacaggguuucucuguguagcccugucuguccuggaacuugcucuguagaccagguuggccucgaacucagagaucuaccugccucugccuccugagucugggauuaaagccgugagccaccacugccuggcucacuuguuauuuuaaacugagauagccaccacugccuggcucacuuguuauuuuaaacugagaugaacauauacacauauguacauauguguguuuacauacauguaaagugacacuugcacauuacuguaugcuaguuuccuaguaaacuagaaagcaguucacugugaaaagcuccugggucauauuuagauccucguuugugaggaacuuuuuauuucuuuuuuagggguucucuauuuauuacauaugaagugcuggcccugaaaaagucuuuaauguuggacacucaggugguggaacgagaaaaaaugaagucuuacaucuaugugcacaaagcuccuguagacagguuagacaaccgugguaaguuucaugcuacaucaaguuuagaagugggucuguuuugaguacaguuucgacaaguaagcucagcauucugaaaggaucagcagagccuguuggagccagguucccaggugucuuucuuaguuuuggcucuaugcagugaagaaagaccaugaccaagacaacacuuacaaaaagaagcauugaaaugggggguuccuuacaguuacagaggcuuagaccauugacaucauggcuaggagcauggcagcauacaagcaggugcuggagcaguagcugagagcuauauccugaucuguagccaggcagagauugagccaggcauggacucuuugagacaucaaagcccacccccagugguauacuuccuccagcaaggcugcacccacucuacaaggccacaccuccuaauccuuccaauucugucagagucccacucccuggugaccaagcauucaaauauaugagccuauggggccacugguacugaaacaaccacaccaaccauuaacugaugaccagauuuggggcuucuguguuuccccaggucuuuagcuccuuuagaacaaaggacuggccuuguccuuguguccaacuuugguuccccugugcccugggagccauuagcucaguuuugcaaauguuugcuuuugccauucagcucagagacuaucauaguguaggggugacucaugcaacugagcucaagaaacagauugagaaacguggauacaacuuauuuauugcuguugucucuuacgaauacugagcggucgguccaugugaguugggacauccccuccuccaugucaagguuguaugcuggccucuucgcucuucgguagaugagauuuuggcucagaggaggucucuucagcucugggcaucuugucgagcacucaaucuacucugcugagaaccgcagccuugaugaaccugugagcagguuacagccccugcacgggugugcuucagcauccaucagggcuacucaguuucagugugaagauuguucccugucuuguaauuuaccugucugcugaggcucaagcucauucuuaaaguguuuuccaaguucuguucuaggucagcuuguguuccucaugagaccugcuagagauauuuucucaccuuguucccuuucucucugaucuuguucugaguccaaagcauucuguguucccaugacaaacacaguggaaauguguugccacuuacagcggcaauaagaggucgcgggugggauuauuuuuauguucuuugugauaaacuuuggagccuacuuuauauauuucuuuuucaaguguuagagcaugauaucaaaaguacacauuuggucuuauuugcugccaucauuuuagggauuguuuggcaggcaagaaaagaacuucacagagcaguaagaaaacuguuggcggcagcagccaagguacugcggagcccauuugcugguauguguagucacggguucucauuaguggucugaaagucgcgugggcgagcagccaagacuggaacagacucugaaacuuuacuaacuauaagaagcuggcugaagagccuggcggugguggcgcacgccuuuaaucccagcacuugggaggcagaggcaggcggauuucugaguucgaggccagccuggucuacaaagugaguuccaggacagccggagcuacacagagaaacucugucuugaaacaaacaaacaagcaaacaaagaagcuggcagaagaacuuccucuuugcgauguuuaauuucacagcuuaaagacuuuggacaguuuuugugucuuuaauguuaaguaacugcugagagugaauauucuuugauaaaaugguuagaauuuaaaacuuguaagaaaaucacucccguguuuucucauauuauuaaaucuccaauuuggaguuagcucuaaaaugcuguccugaccaggcauaguuguuaaucucacuacucaggaggaagaggcaggcuagucucugaguuugaggccagccuggucuacagagugaguuccaggacagccagguucaaaggaaccugucuuaaacaaccaaaagggaacaaugagaagcuggccuagucuccuccucacagggcugacaucauggagaauaugcaggacaacuuucuagaaucaagggagacuacagagaaguuaccaaguccugcuuuaaaacaucuuuaaagacauuuuacagugaauauuugaauguggaguuugccuggauuuuugauuuuuugugagugcucuuggauauaauaauaacaucaugauauuuguuuguuuuuugaaacagaguuucucuacauagucauggccauccuagaacucacagaaauccaccugccucugccucuugugugacccaacaauaaauuuguucuuaggagaugcagauugaaucugaaaggguuaaaaguugucaugucugcauagguggcuuacaugcacgcagguggcucaguauggcagagugacaguugcugcugcuagcuggaacaagcaugugguuuuuuauauuacaucugcuucaaaaauuuuuuaguggaaaagagaauuaccauauaauaaaaguuauagaauauuaaauaaauaaguacacauauaauacauguuguaaauauaaaaauaugauaugacagagcuaagaucaaacgcuaggucacuuguaucugcuuuuaauguucccguuacaauucccaacuauuuacagauuaccauccaauauaacagugaauauuaaaauauuuuggagcuaggaagauggcucaaucaguaaaguguuuuuccuucaugugugaggaucugaauuuagauaacuuagaaccuacauuaaaaaccagugcauaauuacagcgggagccuguaaucucagcgcuugggaaacagagauaggaggguguguggggcucacugggcagccagcccagcagaccuggugagcugcuuccgugagagacucugacucaaagauaugaaugcaugcggugcacgcacacaaaugcgcacaugugcaugugccacacauacacacagacgcugucuuaccuguuuaugcuguggucugucauauucuuuuugcagacucuuucagcacaguugacauagaagaucaugacugugcaguguggcugcuccugaggaagagccgggaggacgaucuagcugcacggcugcaggccgugcgugaaaugucagaggcucaccacuggcaugguaaugagcaccucagauugugcuuagccuccuuguguucucugcugaaugcgagaagauaugcuguagggaaggaagaagauucaggccgucuacauaugagaccauacaaggaagggaaaggauuccgaagucuuaauaugaaaaccuacacaacaaacaugcacacauaccuacacacacacacacacacacacacacacacacacacacacacacacacaccuacacacucaaacauuugaggaaaaaguaucaggauaaacuggaaaaccugcuaaguagugaacaauacuugggaaauuugaaguuacaaaguuguagaauaguuaagaauuaggguacuugcuaggcagugguggugcaugccuucaaagugaggugaacgcccaccauauuccugggaagccagaucagccuggcugugcgcagccgggcacuuguguacaagaugguuuauuauguuuuaaaauauugggggucagccgggcggugguggcacacgucuuuaauuccagcacuugggaggcagaggcaggcggauuucugaggucaaggccagccugguguacagagugaguucuaggacagccagggcuacacagagaaacccugucucggaaaaaccaaagaaagaaaaaaaaagaauuggggugcuuucaaguaguuguuuacuuaaucuugugauaacuuuaaguuaaucuugauguuaacaaaaacuguauuuuuacuacagacuaccaguacaggauaauugcucaagccugugacccgaggacccuuauugguuuggcacgaagcaaagaaagugaucuucgguuuuuucucccacccccuccuuugccuucuuuaaaagaaguaagcaagcauguuaauaagggaguggaagcacaugcuccuaguguggguuccgauaagcuuccaugacaagcuggugucugauuuugcagagcaggugaacuggacacaaagcagaagucuggguccucacaagggcuguuucugugauguuuacugccuuuguggguggagagagucuguucucgguaacuccgcagcaugucagcauccaaaagagggggccuugcacaaacuuuuuuuuguuacugcuuuaagaauuauuuucucuuuaauuaugugugugugccugaaugugggugugugcaugugaguguuaguguaugggaggucagaagagggcagcagauccugggagcuggaguuaacagguaguugucaaccaccagaucugagugcugggagccaacugcagaagcagugcaugcuccuaaccugagucacccuggcagccugccuugcuguguuauaaaacagguauuucucaacucgagcucuccugacauccuagaucacuagccuuuuacugggagaggcuguugugcauauucuagcacauuuagcagcguuccuggccucaguuccuagggugacaggagucccccagauuguaacaaagaaaauugucuccagacauugcuaaauacacucugggguuuagaaauacccuugagaaucauugccagaagcaugcauuuaaaaaaaaaaaaaaacuacacauacaguauucuaccuguuuguaugccugcacgccagaagagggcgucagaucccauuacagaugguugugagccaccacgggguugcagggaauugaacucaggaccucuggaagagcagccagagcucuuaaccacugagccaucucuccagccccggaagcauguuucuugagcaccuuuuuuagaagagaaaacaaaacugaaauuugauuuaagcaaucauuagaaaauaggaauugaauauagaggguaucaguuauaaagaaaaugaaacacuaacacacuccagacuuaaugauauccuuaguaaggguacaguugauuuugagucaagauaucaagaaguccuaaaguaaacauugaguuaugauuuguaaccgucuuuguguguguguguguauuuuuaagacuuuauuuuaugaauauguauggggccugcauauauauauguguauauaugcauauaccacauguaggcugggugccuggagagaccagaagagggcauccggucuccuggaacuggagcuguaggugguugugagccaucacguggguacugggaaccagacccacauccucugcaaaagugcucuuaacuacugaacuauuccuccagccccuguaguaugucuuuaaugcgugucauauguguaguauguaauaugugguagcagggguugaagcguagaacuaaaaauaaaugguuauguaaccuucacuuuggugggcgaguaugcuccacaucacaaccacuggccauccucucucccuccuugccuguguguauaucccggcccccgcucuuuggaggaucuuauacucgguuguggaguuugugucuaaagacuuccucuguguuuuauuccaggacuccuccacugaagaggaacucaggcaucugcuggccucucugccucagacagagcuugaugagugucuccaguacuuuacauccuuggcucuuagugaaagcagccagagccuggcugcacagaaggucugcuuacaucuuacucagcgaaugaucugaguguuaacacuuucccagggcacugugcuggggcuagccgcugggcucacucaucugcccagugacagacacuguacuccgcacugggcugcauaguggugggaaauccccgagaaagguagacauagauguguauaagaaagauucagguuaccggaguuagcugggcuucugagcucauuuacagcguuguaggagcgaccucugguauugcaccuugagagucaauagucaggucugcuguacagcucagugacggagggcuugccuagcaaacucuagacaaggguuugauccucagcauuugagcugauacggcuauuuggaccgaaccugcccucccugacccagcccuaaccucugaucuuccucucagaaugguacagcuucugcgaauuugcuuaagccgcagccuagcuagcccgcucaguccuuuacaugcauauagcuguuagcagcugcagguguugcagugguucaccuccugaccugcugcagcgcuugcucuugcacauccucucugcagugugggcuucuccuucgcuuccucaguaaucuuuaacuccccuccagacucuugaauuagcucccuuucagggcguugguucccacuaacgcugcugucggcucucucuccugauugugugcuucccugaacuuuuggauaaacugauuguuuuccagagaguuccacauaccaagaaugauagcuuuauucccacagagcagguuuuguuuucuuucuccuugaagucucuuggugaucucccuuuugaaagaauuccaugaauggacacauaaaacacaagcaaaaaugauguaagcaaagacagauacagaaagacacagacauacagucuguguguguguggcaggaaugggcagagguagucauagcauaguagucucuguguugcaaauuuuaagaaaguguuugauuucuaagucugguggcauauuugugguguacaguggcccuuucccugucuacacuguaguggguaaggccucccuuuuacagaauuuauucccaugauccucuagaaaacccuacaaagaggacgauguagacccuuugcuggugcacauuuguggggaaaugcccuggugcccuagguuuugauauaucaagaacagcccguccaugacgucaaauguuuaaccacaaaucggcuuucugaaccucaggagcacagcugccaagaaacagcugucgcuugccuaccccauguccaguuccuuuucaagacugcucaaggaccaugguugaucugacagucuguugguuaagacauuuuguuaguuuuaaauugagguuucacccugaagucuagggccagcaucuuacacaaagcagagugcauaacagaggcuguaauaggcuucucuucucucagcuccaccacucugcucugucuucuguguagcccuucauggcagguuuucccauacccucuuagaaggacuuuucaagcccuugcugucaguggagaucucagauguagccaaagugaauccuaagaaggcaucuucacugagcacagcgagggccugucggcuuucuguccucgcucaucuccugaguuucauguucucucuccaguucuagcacccaggcuuucucuugauuucuuuuuuuccuuagagcuuuucuguguccaauagaauuugaaguauuuuauauguuuuuacuagaugccugagguuucucuccaguucaucuuccucagugcagccagacagucauaggaacugcucuugucccugcauaaaccccccagaggcuuccugcuccacgcuaaacccaaucccuuuuuaauguugaaggcuugcacagacuaauuacgcacacggugcuugcaggucagaagccagggcagcaggaaugugcagugacagcuguagugugugaagccugccauuggcaaaggcugugggagcugauagaguucuuuauauagggcagagggcagagggaaaaguugggcugcaaccuaccgucucaucagcggugacagugcuucucagcagcccaaggugucgccaucaccaugacuggauaaugucauaguaccuagcaucuguuaguacucgcuacuccucaugauauauucguguguguguguguguguguguguguguguguguguguaggacaauguuagggaucuucggguauuucuuuuuuuuuuuuaaagauuuauuuauuacuauauguaaguacacuguaacugucuucagacacaccagaagagggcaucagaucucauuaugggugguuaugagccaccaugugguugcuggaauuugaacucaggaccuucagaagaguagucagugcucuuaaccgcugagccaucucuccaguccuauuucuaacuuuuuaaaaaauuuuauguacauucaugcuuugccaacauguauguccgugugagggugucagauccccuggaacuggaguuacagacaguugugagcugccaugugggugcugagaauugaacccagguccucuggaagagucagaguaauagauguguaccaccuaccuauuuuuuauguuggugcuggggaucugagcucgguuccucaugacugcguaacaagcacuuuccccccucgcuaugcuacgcuacgcuacgcuacacuacacuacacuacacuacacuauucucccagugagcuucacuuucagcugggaagaaugaaaagccaucaugucuuuaauacuuuugcuuggugaaucuuuccccuucacuuuuuguauuuagacuuucaguugucucuguucucauaaucauaaugugugaccuagaaaaugcugagcgggaugacaccaggacacuuuggccaggugauaaagaauugacuucagccgggcgugguggcgcacgccuuuaaucccagugcucagcaggcagaggcagguggauuucugaguucgaggccagccuggucuacagagugaguuccaggacagccaggacuacacagagaaacccugucucgaaaaaccaaaaaaaaaccaauaaaaaaagaauugacuucagugagaggacacagaagauggcagacuuguuuugggaaucacuuggugucuuuucuauucuaauacacaguauaaguuucauaacauccccuuuaaguuuccaaaguauuuugagacauuuacauacuugaaaucuguaauuuguauguaguacacagauuguuaacaagaagauggguuuauaaaaucuuugucuuaacuucagggaggacugugguguuuuggaggaaacggacugccuuacgcagaaagcuuuggaaagguucccucagccacaguggaaauguucuguuuagaagccauaguaaagcauucggagguaauugcauuccacaauagagcuuuucauaguuacuuggguaugaauuuguuagcgggggagauauggggggcaucuuagaggaguuaugggaagcacagugaauaugaucgaaguacauugucaaagaauuaacaaaaauauuuuagaaugccacuagaauuaauaauuuggacuaaaacauaccuuucauuuuauuacauuacauuuuauucauuuuuauucauuuuuaaaaccauuuauuaguguguaggugcuuugccugcaugucugccagugcaccagugcaugccuggugcccuuggaggacagaagaggacacuggauucccuguaacuccaguuacagugaugaagcacccaccauggcggugcugaggacugaaccugaguccucuguaggagcgacagacagugcuuuaaaccacugugccaucgcuccagcccuuauuacacauucuaaacaacucauaaucacauacaaggaguucaugcucuaaaugugccuuuugucuuugguuugcgcugucuuuuccuuucccaaaacuguuugacagacagcauuugauaguuaacuuccauuaagauagcugucagcugucagcugaagguagaacugauaggaaaggcagcucuuccauggccaaguauucauaacccaaguuacgaguccugguaauuucuaggcauucuggcaaaguggugccuuugcuuauuuauuuauuuauuuauuuauuuauuuauuuauuuauuuauuuauuuauuagacaggcucuugcuauguaucccugugugucuguaugccaccaugcccagcuauaguuugauuuaauaauaauuuuuaaaaagacaaaaagccuggugacauccacaaguacaguauaagcaccaccuagaagcagguugggcacagugccgagaugauuuaaccuaagcgggucuggugugcagugcaggagauugcauuuguggcuggcauccuugaccacacccuugagguucugaacucuuuaaccugacugaagugcauggcucuaugaggucaucuuugcuucucaccuguacaguggaaacuaagcaggaaugagaggaacuguagccaucauagcaugggggacucaccuugggaggugugaggugaacugugcgaugugacgauguaacaucugucaccuuguguuagauacccucacacugugaccacauugaagcaggcgguggcuugcaacuccugcagaggcucuaccagcuucacaaggacugccccaaaguacagagaaacgucaugaggaucaucggaaacauggcuuugaacgagcaucuucacccugcuauaguccacucagguaacagcuuugugugcgugcucggagugugccggcgcauggcucgcucucgcacucccuugccucagucuacauuauuucucaauagacauaaagcucugcucaggguuucuuggguccuuugcagcaugcugcuagcguugucagcacugcacacuaaguaaggacucagaugaagaagcagggaggagcucaggcuuugauaugaaguuuguugaguuguuggcucacaucuguaacuccaguuccaggggaucugacacccucacaccaaugcacauuaaaacaaacaaacaaacaaacaaaacaacccuaauaaacaaacaaacccaucaugaucagggaaccuuaagggaggaaguuauuugauguacaguuccaaugggaucagacuccagaggcauggcagcaggagaggcaagcugagaacacacacccugagcuauaaccaugaagcaggaagugugaacuagguguggagugagacuguaaacacccaaggccaccccagagauacacauucuccaggaaggccgcaccuccugaacauccaaaaacagagccaccaaccgaggacgagucguucaaauauaugagacuguaagggacauucccauucaaaccaucacauauaaauacauacacacacaugcauauauauguauauauacacauauauaaacgagagcauauagauucacgcauaucuacacauauauuagaaacuaugaauugacacuuaaaaucuuugaaucagcagcuuuauuuauuauuuauuuauucagugauggggucucuaccccugccuggcugggaauucacuauguaucccaggcuauucuggaacucacagaucugcuggccuggauguuuugguugcguuaacucugugcugugggagccaggagacacuggaccuacuggagcuggagauaacugugagcugacgugugggugcugggaauugaacccguguccucuggaagggcagccagcacucuuaacauccacucugucucuucaaugccagaucgguacgguagaguuuaauuugaaugaaauaaaauccagaaaucagaaaacuuugugaaagcaugaaaugaucaguauauuacucuguuagaacuaaguguggcuucucucacauccacacgguuuuacagcucuugggaggcaucagagcuauucuuuauuuuccuuucucuuucauaucaugagugcucccuucucuuucucccuccucacccccaggcuggccuugaacucacucaguagcugagguugacccugauaguccugauaguccuguaauuccaccucugccugcugaguucucgaccuauaaccaggcagcaccauuuuuuuuaaaaaaauauaucuucuuaaggcagacaucuauauuugauuugaaccuugcuuuuucaguugucugaguuggaauaagauuuuuaguuuguugcugggcaugguggugcacaccuuuaaucccagcacucgggaggcagaggcagguggauuucugaguucgaggccagccuggucuacaaagugaguuccaggacagccagggcuauacagagaaacccugucucgaaaaaacaaaaaaaacaaaacaacaaaaaaaagauuuuuaguuuguaucugugaaagccugggccuuucagcagacccaguaugcacaccuagccaacagcuauuauuacacucuccuguuccuggugcagaugugcuaaggacccaugaugcuggcaggucagcuccguuaacaacagugcauuacccuagucucaacaauggccacaauagacucccaguguucucaguaccaaaaacauggcauaugcagcaauguacacuguauauauguuugaaaccagugccgugggcuggcaggguuguucaguagauaaggauaccuccugccaagccugaugaugugaguucuauccccagaacccagagcugauuccacagaccggccugcccugcaaaugcaccaaucgacaugcucacauacacacaaaaacucaugcugcauaccgcuacagacacacacacacacaaguuuuauuuuuaaaauaaaauaaacaguaugccacagggcuggagagauggcuuaguuuaauaaggcucacaaccaaaaagacaaaaaaaaaauuacacuugcaagaagaaaugaacaauuugcagaaaaccaaaguugcuguugcuauaucaaacuaugccugaaccccauguuauggcaacagucauuacugugcucauuaacugaaauuuagggcauagucugaaggaaguaugcaucuucuagacaggcaauccagcuguagggaagaagggacacuuggagacagugcccucauacagaucgaugcugauugguggagcuaggcugagagaucaucagcucagggcugugaagugacugacgugacagaugucauauagggggacagagauucaaucccaagucucucuggccccaaggcccagagucugcuguaauauauaugaacaucauauauguauacauauguaugauacacagguaggcacuugaacauacuuaaaacagacacagcaaaaacagcuaaaccuagcuuuuguccagcucccucccucaucagucuccugagagcuaaugacacuggugagguugguguccugaaucuuuucagaucuuccaguguccuugugugcauguuuauacauaugcugaaaucauacuuuauccacacuuccucuguuucuuuuuaaaauuaaaaaaaaaacauuuuuccuuucugaauucuaggugugauaaguaguucaucaaauucacuaagaaauagcuuccuggccgggcgugguggcacacgccuuuaaucccagcacuugggaggcaaaggcaggcggauuucugaguucgaggccagccuggucuacagagugaguuccaggacagccagggcuacacagagaaacccugucucaaaaaaaaaaaaaaagaagaagaagaaggaggaggaggaggaagaagaggaggaggaggaggaggaggaggaggaggaggaggaggagaagagaaaggaaaaggagaggagagaaaagaaaagaaauaaaaauccuuugcucguuacagucaggguuguuuauggauuaccaaucuucagauuuuaguccuuaaagcauaccaucacagcauuuuguccucuuuugagcucacccacaguaaucgcugugcuuauucucuguguaggaagaggccacuugcacacucccuacuuagccaccccuccuagggcugugguugggauaucacagcuuugugcugugcgacccccagguacugaggacagacuugagcuggagcaucuggcuuccucacccagcacagaccucgaagcaucucucuguaauggagaccaguuugcaucaguauucaggguacauguucuuuccucaggauggguaucucucauggcagaagccuugaaguccagccacauuauggaggcuucccacgcugccagaacccuggcuaaccuggaccgagaaacugugggugagaaauaccaggacggaguguacgugcugcauccccagugucggacaaggugagcaucgggaggacuugguugguuuguuaagauuuuuuuuaaacuggaaagugaucucaaaugcaagugaaagagggggaaccuccagaaaggagaugcaagacaaagccauagcuagcugcaguuggccaacccuuucccacucucccugauuccugugaagagagacuggagucacggucuaaggaauaccguacaucccuagauugacuuaagaaaugccagggguggaggaggcuugugggaaaggaggccccucagguggucugucccuggggcucuccaggcccuccuguguuucucacaaagcucugggccgccaugacugaguggcugguuuguguggaccuuccucucauagcccuucccuaagcccuggguacacucaucugucucacaggaaauuagaaguagcaaugggcuccuccauuccaccagcuccuucagucugaccacaggaaguggugcauaaggggagacgguggcaggccccuccuucugaccccauuucccaaguuuggugguggugggggguauaaagggcugucagagcccuguucccaugacugucagcuugggugccugguccagaaguccuugggguguggguguggggcggucuguuccacucuucagcugggagugaggcaggaugagaagggagcaggguccugggagcaggccuagggcuuuaugcuggggaggcagggagagaaaucacccacaucaugggagaaccugacaaauucacagacucaaggccacugauggucgcugucuagcuguugucagggucaggguccccuagcaagagguucuuuuaauaaggccucugcaaaaaaaaaaaaaacacgguuuuauugguucagucuaaugacaaauacaauguuacaaugagcagugcaaucagcucucacuugagcaggaggaagaagagaguguguucccagcugagugagccucugugcaucgggccagccagcugcaggcaaagccagcuucuuagagucacaaaaugaagaaagucacgaguaaauacauuuaugauauucugguggaagcaucaaguaggugggagacagcaaagcagggggacauucccagaguaggugucccugucaccuggugacauuuuagcuuuuggcugauggaaacguuggagccuauuuggaggcauuugaauaaauucaaaucauuguuuuuuuucuucacaccuugaaaacauuuauguaaaaaagacaaaaccauuuguuuuuaaaagccugcacaagagaaauaggaaauguguggagcaaggauggcccccuagugguauauagugggaauguugguuccuauuuaguuuagcucaacaagaagccagucaaauccugaguuuuugcgaaguccauugguuaaagaaacagaagcuguguucccucggccaccuuucugcuuucguaaugugacaucucauuccuuuuaguucugaacccacgggaugaaaaguguggucauaugcacacaugugaaugcagacagauacacacagacacacacagacacacaugagcaugcucgugcacuuuuuaaccuuucucugcuguaccuugggucacacugcccccugcagggcuguccuuuuuucuuucuuucuuucuacuuuguaaagaaccauuaggacagaaccuuauuuuuuaccaggcugauucucagggcaaagaauuucccuugcuuucagccuuguuuuaacccaaaacuauuuuaaugguuuauacuucuuucucauacuugauggcuccuuucugcuuuauacuucuauauaaaacuuuugaguuuagaaaaauauuuucuuagccaggcucaggaggcaaaggcagguggaucuugguguucauggccagucugaugaguaacagggcauccagggcuaaacagagaaauccugucuggaaaaacaaaacaagaaagcaauauauuuucuaauuaaauaguuaauuagugaucaguuuaaguccuaauagcaggggugcugucgccuuugcuaaaaccuaucaacuuuccauuuggaucuacuuugucuccuuacucugggccaugcuccugccugagucuaggcuuauuaaugcucacggggacccaccucagugaccucauuuccuuuauacuccucagagcuagaggcacaggguaaguuauuguccuaagcuuccaaucaccuugcacuuugaggacagcagagcccucugggccacucaggugaggacagucauccuugaaggugaugcuguauccuggagugugaguaacuacaucccaagaacuggugucccucaagcagcaagcucuuagaccagucugccucauagagcgcacacccagacagugauggagcccacaccucaccaaggcggugguucaguucuguacacuacaugucugcuguccgguccuucuuaccuuuaaagcucaugucugugcaccucacccccacccugugggcuuugggcuguuggucuccuuuauuaguccuucccaaggccacauccauggaacuuguugucauauuacugucucuuugacaggcacacuagggacaggcugugugcuacugcagcucaagccuuuguccucaaauucccaucgcaugugacuaauuuuauguggucgguuguaagcugauuucagcggaauacuuuugggggagcuuuaucauguauacauaucaaauaacauuucaauagcacacagaaauugauaaaccaagauaaugcaaccuuucuguuaaaacauauaaagcaaagcaaauuagugaguuuaaaaagaagugagaaucagaauuuuuaacaaaauuaauuaaauuagaaucaccuuuuaguuuguuaaacucuuaaaucucuuauucuugcuauuuucuuaaauaauuuucauauuaccuagauuuaaaauguaucuuuuguaauuuuuuguuucauuucaguuuauauauauauauacgcuuuagagaggaugaucuugagauagcagccuucuugggcuuaguaggaaaaacaguccaaauuccuaaaaaccuauaguuagagcaagagacagaaacuuccuugagucucaaagaauaggaaccaacaaacacaauggugcagccuuccaacagcaguuaugaacauagacuggaaggacacaguuaggacaugcuuacaguaaaccggagggcacccacaguuagaacaugguuacaguagaccugagggcacccacacuuaggacauaguuacaguagaccagagggcacccacaguuaggacaugguuacaguaaaccagagaguacccacaguuaggacaugguuacaguagaccagagggcacccaguacaaaggagcuaggaauguugugucuccaagauguaagaggagccaggaaaagauaacaguggccaacagugaugcuucauacacagcuugggaugaugacucugcccacugugagagcuuucggcccaggaaggagagagacucacuugcucagggaaacaucaagucagagaccccugcuuuguaggucagugggugaucaguaauugugaaaauccccagagggccuugagccucacaucucagcuguuggugugagucuagcgcgugucuagggaguaaggcagugacugaucaucucuuuugucuaauccuguuuuccacauggggucacuggagagggaggaggaagaggggaaaaaggcagggucgaggagggcugagaccagugacauucuguagacuucaucugugauugugugugauagauauaaccuccaaaauuuuguuuauuuuuaauguuuuaaaaaugguauuuuucuaagcauucauuagcuuauuaauaauuaauuggcaguguuauccuuaguuuagugaguuuaaauuucauguaugauuuuugcuucugcccaggacuuuuaguguacauacaggaacacacaaaauuagcaaugucaaaugguucccauuucuuaccauuugaauuaaugucauuacuaaacauuaagccagccagaguacaaaaugacaguuuuucuacaagguuucccuuucccugaauuuccguuucccacuugaguguguguuuucucucuucccugagcauuguaaucuucggugcuagcugaugggaucugaguuuggaucagaguuacuuacgugcugcuucugggagcaaccccuggugcucccucacggcggguuuguccugguguuacagaacugugaggcaggucagguacggggugagcccccuguaugugugucuuccugccugagccaauaagcguccuuucuacccuggaaugaggcguauuaucuuggguuucccccacgaggccacugcauguccuguggauguccccugacauuucucaugcccagugacuuugccauuauauuagcguauucuugucuaacuucuuaaaaaccucaacuggcuuguggagugucugcauagacuuacugggaggauaaucacgugguggugacacucacaugcugaaucauggaguucauuacagucgcugugguuggucugcuuaacggagucucucuucacugaaggaacagugugcuccugucucugucacaguucccggaucccucagcagcccuguguguugauaaaguuugcccuaauuaagucuccuuuaugucacgucagccugcuaaagcccuccaaagagaaugcuguguagcuugccacaguaguaaugcguuuauucugcuucuuuuuaaaacucucuucccucuuagucagcccauuaaagccgauguccuuuuuauucauggccuaaugggagcagcauuuaaaaccuggcggcagcacgacagccagcgggcucugacugaaagugcugugguggaugaagacagguacacuacaugcuggcccaagguaaggagcagcagcuguggcugccgcccacacacuggcacuugcugcugcggucaucauggcugcuucccuguccugagccacugggguuucccucacacugcugcugcuugcucuuggagacauucaugggauuuuucauuaucagcggggcuugugauccuguguuguguauauucugugacucuagaauaauaaugaguuaaaaaguaggguaaucacuugcuuuguugauacauaauuuaauaauacagccagauauacuuguaauagccaacuuuaugaccuucauaacuauagaaguagaaaaacgcgagugauguaguuaguucuccucugcauuucucugacauuauuuccuccgagcucaacucugggaugaggucaugggcugagauuuaucccaguucaugcaggacagugcaucuauguaugaacaguucccagggcucugucucucuugcuucagaaugcuaaguccuagagacaucagcgccuaguucccagagacagacugcaguuaucauucgcuuccaacucucacgucucaguuauccagcacaaaguguagucuguucugagauaauagcuuuuacuaccugcugaaagccgccaagacaagucuugauuuuggcaauuacagauuaagucugacaguguucucacgccuucauuauaaagauugauggcauuuuaugaccagagauaugaagagauacgaugcuuauuuucaucuucacucccccacuugcuuuccaguaucuucuguagugucuauugcagggggccuuuggcuacagagagcaauuacuaggaaguagcccgauggggaaauggauacuucugcucacagcuuuucauuuuacuuagacauggcuagcaaaggacugccccucacuucgcaucauaucuguggaguacgacacgagucucagcgacuggagggcaaggugcccuauggagagguaacaugagagggagggaguacuagccugagaggaaggggagggauaacaugagagggagggagcacuaacacuagcuguugucucccaggggaacauugggaaucuuugcucucaaaaaagguauugcagauacacaguaugagacuagcagacuaccacacuaugacguuaacgucccuuuuggucugaaaucacuuauuuugaacucugaugaucaucuaguauuucuacauaaacucaaggaauagaagcuuaaugucuguaggaguaaacucagacaaucaagacagacuguagaugaaauggggccccauagguaacugcccugggcagcuggggaaugacccaugucugaccuguacaaauugccagauccauuugcuauucacacagugcuuguuuuguguaugaguggcuguugugggcuuaguagucccagcuauguuagugugagcaaguuucagauagagaauaagauugguauagcuacacucaggagugagggcagacagcguugaauagugaaugcucuuaaguuaggcagcaagguuugggggguggacgccuccugucaugagauuugggggauggaagccccuccuauaaugagaugugggggauguacguccccugucaugcuuggcauuuuuguuuuguucagaaagucgauugcauucagaagcaacgaacuucucagcaagcucagggcugcugguguuggggauaggccaaugauuuggaucucacacagcaugggagguaaggaugggcucaucuucacagacagccaucaugagguaguugucaggguuucagccaacugaaaguucugucugucugucugucuuacuagucuccccacaccaaguuaacauuuuagcuaagaguuuuaaaguuacuguuuuccauccaugcuguucguuuucuuagaaggggauagcuaauaacagucugggugggagggcguagauugguggcuuggugguuucaugucuucauucugaaucagauuacacugugggaugcuuaucguuaggcuccaagaagcuccaauaagccagcauggccacaggccucgcggcuucccugccuuccuauccacucagccacugccugugcugcugaggcguggugagcacagguucucugugccugacugcugugcuuggagccuggcuccagcuacaugccuuacuucuccugcgcuccuccaaacuagcucccggcucucuguaugccuggcuuacagccucugcccagccccaggcuaggcugucugauuacuaugacuuaggcugagccucagccagggcccuuugcugagaaagguggauguagcccuucugcuucucagaaacucacuguugcuguuccuggcuagggaacauggcuaggugcuccugggggccuuucccauagcagcugaccuuccuugguggguccugggacucuggauguggguggcagugacugacaccugccucacagaggcagugagaucuaugagagaaggguuugcagucuguggucuuuuaacugcuuguagacucauagggacacauuugcagugguguucuccuguaaaggcaguucucuuacccugagaaguuacauuuuaaagcgucucuguuuuguuugcuuacucuuuuugagaaggcguagagaggacggaagaaacucacucucucuucucuuucuucgguggcaggucuucuugugaagaagaugcuguuggaagccucuaagaagcccgaacugaaugcucuuauaaacaauaccagaggaauuauuuuuuacagugucccucaccaugggucacguuuggcugaauacuccguuaauauucgauaucuucucuuucccucacuggaagucaaagaacucagcaaagguaacacuugcuguugggaaggaaauugaaguuguagaacauuaaauacacgaaagaaggaaaaaaaaucaccauuucuucuauaaauguaccaucuuguuuuuaaacuugccuagacuuuuguuuagauuacccauugaaagcuuuuggguuggcgugacuuuucuuccaucucucuuuuguuccuagguaguuaucuucucuaguuacagccgugaccauuaaguuaucucaacuacuuaaaccuagacagauuaugguuuuucucccaaaguaguaaacuaccuuucuccaugaauuuggaaaaucaucaacuaucgaaauauacaugaacuuuugagccagcauguuaguuauaaagcacuguuugguuucggagcccagcaugugcuuagcucugcgcauagaagaauggguuucucugcugcuuuggagagagcgagaggguuaagaauccauguuaggcccugucacuguguauggaggguuucagcuugcucucucuggaugaucuuagcauaguggaaaguggggucuggaugucucaacucucacuguuaauccggcucugcauuuaggucuaauacguguuuuacccgauugggugauucuguguuagaugcaugcauaucuaagguuacugcguguucuugcugaaccgauccugucugucucucuuuauuguuucugacuuaaaauaugauuugucugauaagagcacagcugucccugcacaagucccucuuuucuucaauucuuuuggguggagaggauaauucaccaucuacaggcuuagcgaguguguagugugaaugccauuuuguuggcuguuccuuuacaccgcaugcuuguaugguuugguagcuuugggaguuucgguugggucuggugaacgcguguuccuuugugagcuuuaacaauggcugacuugucuucugcuguagucuggugguggugagucauuuuugaagauaauuuugcuagauacacuguccuugguuggcaguuucuccuuuagaaucuugcauacgccacuccauccuuuccuugcuguuuucuacaacuuugcuuugaucagguuuguucacugagugucucugggguccugaccucuguacguggaugucuguaucucugccuguuuggaaguuuggcuguuacuuuaugacuuccacaguaugaauauuuuuucuuccuuuucccuccccucccuccuuucuuuccuuguuuaacugaguucaguugagaccuaucaucaagcucacguucuuucucucauccuaaucugugacaaagaugcuccuuuguaauuuuaagucucaaguucugauugguucuuucuuuaaaaauuauuuuugccauuggucaaucucucauucguguucugaauuguuuuuguguuguguguaugcauauguaugcacauguuccucacacgugaguacaagggcccucagaagguggaggcauuggauccccuggagcuggaguuauggauauggcugccgggaaccaacuuuagguucuccguaggaguggcauaugcucuaaccuacugauccaucucucuggccgugcuguauagucuugguucucuuacauucacugucuccuuagauucacuaucuacuuccuuuguaccauuucauagauguccuucuccucuguuucuggagaacucaucuuuccuucaugguguuaugcuucccuugguaaagugucccuuuguugaugccucugcauugaguauauucaugccaaguauauucaugccgaguauauucaugccgaguauacucaugccaaguauauucaugcugaguauauucaugccgaguauauucaugcagaguauagucaugccgaguauacucaugccaaguauauucaugcugaguauauucaugccgaguauauucaugccgaguauacucaugccgaguauauucaugccgaguauauucaugccgaguauauucaugccgaguauauucaugccgaguauauucaugcagaguauauucaugccgaguauacucaugccgaguauauucaugccgaguauauucaugccgaguauauucaugcuguucacuguuaugagggcccugaggauugagcacaggcaauacuggggucugcuaaacauggacuugaggguguagaaccuaagagaucuuccuauauccaguaggauagcuugggauguuaacaagagugaugcuuaucagauaugagcugcggggcucagaugaccccuuuccaggucucaggugcuuccuuguggccaaguugcucucaggacaccucuugucagccucuugauugugguggugguucuuuaguugugucuucguguguuguggucugcugucuucucaacucguucugaagauacuggagugcucuguagguuuccuguacuccccagagguagguauggaucagacuucugaugucaguuuuuuuccuguucucccccugcacccccagguaaguuacaguuguguagccacagcuggcuuuccacacagguucuagggauccaaacagggccucagguguauuagucaggguucuuucucuagaggaacagaacugauagaaggaacauaucucugggauuuauuauguauuuucuucaguaugucagaauagccaccccacccccaacccccaggcucuaaugcugguggagcaggagugagggcaaacggugaggagcaaacacuuugcuccucuaggugguguagcucagauuaaagguugguccucgagugaucuggauauaaggugugucuuccuaccuuaaaugaugcaguuaacuaaacaucccccaccaggagugguuugaguuuuuaguuaauuccagauguagucaaguagacauccaagaguagccaucaccucagcuuugugaggcaaaggcuuaccugccuagccagcucuccuaucucagcccggcaugaaucagaaacuuaauuuccucucugaguuaaauacgaacaccuuuucuccaugucucauucucugaccuuacagacucuccugcacugaagacgcuacaggacgacuuucuggaguucgcgaaagacaaaaacuuccaggugcugaacuuuguagaaacacaaccgacauuuaucggcagcaugauuaaacugcauguagugcccguggagucagcagguacucacucuggagacaugguggccacuggauggacgccuaguugaugggaccuagcauuuaauagauaucaguuuuuauagccagugucuuagggauguauaggagaaaguuuaauaaaaguccagaaucuaaacugauuucacucuucagcaccagauuaaaacccucugcaagcgcacagccuugguaccgccucucaucucaguuaacaguuagaugacaauggcuagauuucuagcuccuaggcaccaacaguaguaccugcuuuaagaagaauaacaaacacuuccguaagucagaauaaaggcgcauuucaacaauugauagcugcauagaaagcuuaaaccuacugauaaaaaaguaggauauaaacauuuggaaggcuuggaaggggaaagugaguggguaauauucaagcaggaaauauuuaagagaaaaaaaaaaaaccuaguguuaaaaauacuacuuuuuaacuagcuccuccuaaagaagagcuagcccugcugcucuggugcagagcuuccauccaagcucucccuccgugggugaugcugugugguagccucccaugcaucucgcucugaauugcacccugacuaaccauagccucgacuugaucaucaucuccuggaacuccuugaggcuggcuuagguccuguccugguagcucauagccaguggcaaggguuagugaccagggauaguaugcuugucuuagugaugaaccugagcguggauaaugagcuuggucuuauuucuucauacaccacacagauggaaaguaccccagauccuaaagaagcucucuagcagggcccaggcccuaggcugaggguacaaagcagcuacuugaagauuacaaagaauggcugccagaugucuuagaaacuuaaagcaacagcagaggcagucuccuaggcagcugccugcagaguccuagcuuugccauagaaauccugaccgcacgauuacccucaugccuccacucaguggcuggcuugcuggcaucucuucuuaccugcauccagguagacuucagaccgagaucaaaugcaggugacugcucaaguacugcauccggccuccacaccuaccccuccacacacccccucuauacacgcaccccuccacacaccuggaauuugggucuggaaugguucccaugugguucccaugcaccucauucauagaagaaaauuucucauagccugcagguacagggaagucucuacaaugccagugcgcaggcucugcuuagaacacaggugagauuuuaggaaaagcacaaacugagacuuacuuacugggcauccuuuuucacacagggagucagaguucugcuaggcaagcauggcuucccuuuguuuuauugacacuucugcuuucuucagauuuaggcauuggggaucuaauuccuguggacgucaaccacuugaacauuugcaagccgaagacaaaggaugcguuuuuguaccaacguacucuacaguucaucugcgaaacuuuagccagagaucuugaaaacugagagauacguucuuccauuuuuuugugugaauauagugcgagaaacguggcauucuccaucuguuguuaaggucuccgcaguccugugcacucacugcguguggggugcaggcagcagagcgcagcucuucacgcaagcacugggagaugcccgaguacaccuggaggccacagaggaaggcuuacauugagaaacuccuugugcugggccuugggguagggagcagagcugcuguggccagagggcccgaccaccugagacugucccagcucacccaagaguccugacaggcaagcuagcacaccaugagaaugaaacuuggggagaucaagcuagaacuuacagaggcugugguugaucuggguaccaugugccaugauguuuuacugccagcuuuuaaugucaauaugccaggugcacaguugacacuuuuacaggggcuccugugccugcuuguaugugcgggccaggcucugcuucuggguuucucacagugcugagaacgauuggguuuuuuuuuaaguauuccuucuaagauauuuuaauuagcuauugaauaguaugcuccagauaagguaaggaucagguuaugacacaccuauuugaagcagucagguaugcugaccacucaguauuaagccucuccaauuuucuggcuauguaaaguacagcuucccuucaugcccccuuagagggagggugggaacgugugcugaugaucguuguugaguuuuaguaauagcauuauuaacaugaaagucagugugugugugugcgugugugugugugugugugugugugugugugugcgcgcgcgcgugugcgcgcacgugcauguguguggugcuagggaucaaacuggaaaccuugugcaugcuauguccucagccccaaauuuauacaacuuuuaguacauucaaaguuacuaucaccacuguccaauuucaguggauugugucauccccaaagcagcucucucaccagcaggcaguccccuccuccgaccccaaccccaggaaacacuauugcuuucccucucugcgagauugccuagugaacauucauaaagucgguagcgucaccguggugcucuuagcacaaugguucuuucuugcaucacucuuucugccucucucugcuuccucccugccuugcagugagcaguuuugcccauucucccaugaugcccugucucgccaugggaccggugaugacugacugaaaccuugggcagcagacaucuuuucuccuugaccucugcugcccagguguuugucaucgaggugaacaugcuuuaaaacugcgaucugaaaagagcugucuaguguauugcuaaauuaguguuaguguuucucugacaagacagucggcauuucugcucugucuauaugauggaaaggccacucuccauuuaucacaaaggcuuggugaggcguagaugauaacguacaccaagguggauaauagagcaagauggaacaaauccaacacuggcggaaucauccugaacaaagacaucauugaaaccaaugagcacaagauaacugcaaaacagcagcgccuuaaagacggcacagacacacgguagcugcagaaggaccccucaaaggcaaggaacccuccuaccucaccuaccucaccuaagcugcccuugagacuagugugggcauaaugaacagauguggucaggggcaggaacucaagcguuggcgaagccugacauuugcucugccugaguucauguaaauuagaaugugauggaacggccuggaacauaaucugguauuuuaucauaaaugcacauagauuucugaauaaugcugaugauaauuuauggguacauuuggaggaucuacaaacaauccacaacuaaaaauauuuuggugaagagaggcccuuacguuccugucacagggucagagacagcaaggaugaaguugcugggaauuugaguugggaggugcaugggagcaaggaucaaggucuuucuugggcagagaaacagcucugauacugcaacauagacguuauaccgugcagggagcgaagcugaauguggagccagggccaucagaggugauggugucagcauggggucauuaguuguagacauccuagggcagggcaucucgggagcucccugugggaacagguaaguguucgggaacccuuaacuuuaauuucccgcugacacuacucuuacucaguauaccgcugagcccauccccugccaccuugguauaaagaucccacagucugcugauuccucucuuggccaggucugaacaacacagagagaaaucuuacugguuuaccauuuugaaauuaccaguauauucuuaauccugagagacacaauaugaguaacuauguucugugaauaagcuuagaauaaacgugucccaucuguuuccaugaaaaaauguauauaaagcauccucagagcccaucuauuccacagaguguuguaagggccuugcccgagucucacuguguguguggugucagcgaucaugauagcggcucucacacaauucucuauucacauauaauugcuguguguguguuugugugugcgugugugcauguagcucagcgggcaacagucaggaguuaguucuuccaccaugugagucuuggggcucaaacucaggucuucaggccugacagcaagcaccucugaugcucagccaccccuugggccuuaagccauaauugauaaucuaucuuauucucuugcuuuucaaccaauuguugagucccaauuguugagagauugagagagagaaccaaaacagcaugcaguaagaacuaucuauugcauuugauaucgaggaaggcuggccaaaagaauccgaggagccccuucagaucugaaaagacucaauuuuaaaagaacgaaaacaucuaacgcauccaacaugagaacaaauuaccaaucaagauacacugcaggcuuugacuggucacugaucucuggguauaaguuucccuuuccgacaaaacgaccauuugaaagccagcgcuuuaacaauguguaauuagcuuacacaugucgucagggagauuuuuuuuaaguaucucaaacuagcaacuuuaaaccuuuguauuucagucaccuuaacaaauaucuuuagcucugggaaaugagucuauauuaccgucagcgagacugaacuugucagcauugccccugaaauacugugcuaaaaacgugcagucaucguaacuaaggcagaccaaaagccaaaacagacuggacacaaaauggaaucuuuggguggugguugcucacugcugaagucauucaaccaacagaugcuagcuuaaaacgcccuacaguuaaacauugguuuaaaaauaaggcuauuccaacuguuguccuguuccccacccccacuugacacccuuacacugucuugaaacugggucuuacuauguagcucuggcugucuggaacaauguaggccagguuggccuugaacucacagagaacccccugccucugacuccugaguaauggauuaaagauguaugcuaccaucuggcuuguucaauucuuaacucuacuuuuuuugacgcacgguccuggguguagguucuaggugugguacuuugauuucagauucucaggggcagcugcuggcuuaauuacuauguagaacaaggaaaacuacaagcuggaguuuuucccaugcugcaagcaaucuuguagagcugaccucccugcugccuuucugacugggggguuacauuuaucugcugucaaauucaccuccaacguggcaggaaaagacgguauauacaggaagagggcaucugagcuuaaaacauuuuucuguuccugacugcauuugcgagaaaaaaagaccguggcaguucuuucccaucucugggcagcccacucugcuuucuccucggaugcuugcucuaugguuuuauuugaagaacacaagaugauccacaguaagcaucuacaugccaucuuuagcuuuuccuuuauuguguugauugguagguggugguugcucguucaucuuauuuacuugccugcauguaugucuguguaccuugggcauacagggcucucagaggccagaagagaauaauuggcucucaugagauuggaguuacagcugggaaccaaaccuggguccucugaaagagcagccagggcucuuagcugcugagccaucucuccagcccccacaccaaacuuuauaacugccaaauaugcauauuauucuacuuaucucugggucaguggcuucuuuuucuccaaucaauuuucagauuaauguagauacguggaguuuuguuuuugagugccagauuuaaauaauuugcaaaauaucuugaaugugacaguaaaauaauuucugaaaucccaacagucugguggguaaugaagaguggcaugucccaggcaaaauggccacaucugccccaucauuagcaucuaauggccaugccuaccccauucauuagcauucucuucaggauuggccauaaggagcaacauaggacauuguguaugggccuaugauaugaaagacucauaaauaaggaaguuggcauaacaagauaugcuaaugaauuucuuucugaaaauaguaucuugcucuguugcuccaacuggucuugaccucauggccuuccuaacucugccuucuucagcuaaugagcuuuuuauauacaaacaaug

SEQ ID NO: 8367 - RNA, 6722 nt, Mus musculus
cggcgcaggcgcagugagucggcgacgccgggccagcucugguuuguuggaguuggaacgcugcugccucugcgcgccuagaaaaagguagguugcguggggcucggcugccucggagauaaggcggggaagaggaaagacacagagccuucgguccugugggcgggccgaagucccgcacccuuucuaaggccuguguuguggguccgcgcggccaucacgcauugcaucgcgguuuucuguggggaagguagcugcccaugccugcguguagacacugguggcugucacgcaggcgauugccaaugcagauccuuagaggacguaguuuauuaaucaaaagaacacaagaucuggagaccuagguguuuguaaauuuaaauuaccugcuuuguccagguacucggucucaucaguauaaucaggcggugggucacuguaauuuugaggcucuuucggaacuaccauuuuguaguuucugccucccagaaucuuuucaguguaucguucucuuggauaaaaaagaaaacaguugaauaaugaaucuauuuuacacuguguugggcccguuaauuuuugaggaguuuugguuuuggguuuuuuuuguuguuuguuuuuuuguuuuuaaaguuuguggcucacuauguagucuaggcugguccaaaacuaaagagcccugccagccccuuccucccuccugagugcugggauugaaagccugaaccacccugccguguuuggagcuuacuuuuuaaaagauuaauuagaauuuguaaguaggauuuaugcuuuauuaauauugcaaauauucugcuuuagcacugguaagaacaggaauaucuggaugccucaauguuagcuuuuuaaugcugacauuuaguuuuuuguuucaucucagauguaaauccccaaaguggguuuaaacauuuggauuuuaugucacuucaucccuuuuaaauuguauuuauuuauuuuagaauucuugaagucaucugcaccgucugccugggaaaagauggucaacgugcugaaaggggugcuuauagaaugguucguagcuuuaacaauucaugauuuuaaauuuacacaucgagucuuguuauguauauucacuaugccucaauaguguguguguguguaugucuuuuccaaaauuuuguuuuguugauauaaaugaaauccaggcuucaacuuugaauuuccauaagcuuuccuuauaagugggacaggauuugcugcuagguuucuugcugauauuacauuuuauugucucuguuaagugaauguaauuagcuuuacuuccagugauuuuuuuuuuaaugggaagcuuguguguuagauuagccuuguuuagagaaacagugucacuaucuaaaaccaucagcucuuggcuagauuaagcuuuggaagaaugcaggcgcuuggcuugggccaggcucuugggccaggcuccuggggugggccuuugucccagcagguggaucucuuagcugaucaaagucauccugcucuacaugguaaguuucagauccugcuuccuacccaccccccaaggcuguauaaugaaaccuugccucaaaaaaugaaaagaauaaagcaauacaugaacuugguuaaaucuuugccacuacagcaugccuuucuugaaaggaaaugagagccaaaugcaacaggcuuaacuuaggaguuucuccaaaggagaaaccauuuuuagaguugaauucuucaaaguaaccuaaaauacaggucuuugcugucucugacuuuuaaaacucgaacucaaagcuuucgcuuuguugguaggaagcccuguucucuggacuccccuuuauuaaaaauacugucuccuuucuguuugccuauuaugagucauuguuuagguaguggugcuuuuacugugauggcaaagcugaggggacagcagggucaaacccuaggauaccuguaacauuuggagcagcacuguccaguggaaauacaguauaagccacauaaauuaaauuuucuaguaacuacaucaaagagugaaaugaaucagguaggcugugaguaauuuuauuuucuguguaugaguauuugccuaaggauaucagaagacggcauuggauugccaggaccuuggguugggaacaaguugugagccacugggcugggaacugaaccuggguccucugcaagagcaacaagugcucuuacccucugagccagcucucuuuucccauguauuaagucucaaaaaaacccuucaagucuaguaucuuacuuuuacauaguaucaaauguucugugacuagugagcuaccauaggauaaaacaggaagauagagauuucaacaaagucaguuuuguuuuguuuuguuuuguuuuguaacuaucuuuauucucaaauugauaaaaccauuuaacauauauuuuacaguauaaacaaauuaagugcuaugcauuuuacuuauaaagugacuuaaaguauuuaagcauauaauuuguacaaaaguuuucaaauaaagcuuugguuaguaaaacugacuauauaccaucaauuccauuuuucaauguuguucaaaaaauuaaaaagaaaaacaaaacacaaaacagcacaggaggaggaggaggaggaggaaaaagcaaacaaaaaccaacacuaguugagguuggagggacuguaaaucgggaaauaguucaugaauuuaaaagggcugauuguagaggcauuuuaauccagcaguauggcuacccuggcuggaauagagacaggcccuuagcacacaccuuuaaucccaagcagugaggguaaaguuaguuuguacaaggagguauccguguuugaaaguguuagcuaacugaguggcaaagugaggagucagaaagguuuaacaggcuaggauaugccuaacucgcacaagaacagagaggagaggcuacauaagagacggggguggggggugggggugggggugggcaggaagaagccguuuuauggggacaguuauaaaaaagacagauugcagaacaagugaagacaaagagccagagacggagaaggaaacggaagauuagaacauaucgccaaagguguugugaggccuuggcuugagaggacuuugagucagagcagcugaguugaaccagccaacuagaguucagaaagaacuagagcuuaguucacuaagucucagagguugaaaaccuuguuggccuagauaagaauauucagagaggcuaggagcuuccaguacugggccuagguuagaggacuuaggcaguaagcccucgggacaacgguuacaucagguaaauaaaaguuacuuuaacagagcaaaccaagaaauggggaauggggugaauacugaguuaauggagugguggauuacaugccagguuaaaguacaauaauccugcacuaucaaggauaggcuucacaguauccccauugcaucgcugagacugcagagacuaccuaucacaauuaugcucucuuagcuaagggucagacacuggaacguucacaauuugacaugugacgaaacaguaacuuuuuuuuuccuucaugauuugaaggauucuuaaccauagacccuagcgauuacaaaacauaaggcuucacacauauuucaccagugcugcaaauagcugcacccuggccaagaacccucaucugaaaauaagcaaagagagagccauagaaaagugauuggcucauuauacccuggggguuggggggaggaagcuauuuuugcauaaaccagccagcuuccauaucaaaucugucacagucgcaucacuaaucucuucucucugcagaucagauaaaguguuguucuagcuuagggacuuggaaacuaaccaugaaugauuccaucuuauuuuuaaccagaucuguacaggaaccuaauccagaacaauagcaucucaauucuuacucagcccacaguaaaggacuggcucccaagcugggauuaaaggcgugugccaccauugccccauccccuuuuuuggcccuuccaagguuuauuuugggcugaggaccuggaaguucaguucagugagccagcugugcuuaaugagauucaguccucagcuccuccccccuuacuccggcucccaaacaaagaaaaccccuaagaaucaauuuguacaacacuugaaagauuguauuuuuguggcaagaugcgauuugugaaagugggucugagcagcaggagcucggacuucuugucuuguguccccuucuguaaggaggaagccuguuacacuggcuuuguccacucugggcugcuagacuugccucugaaguccuuuuguuucuccccgagcucuucaucugugguuccgggcauuccucaucaaaucaguuaaagaagcuauaguuuagcacuguuaucuucagagcuucagauagccguauucucuccucuugugagagacgaguucuuuaaaagccuuucucuugaacuugaucuaacucaacuuguaaugugaagucauagcuacaaauggugacuacuuuaggcugagagaaaaacaagacacugacagauggguccacacuuuaugucguccugaaaagucaccacucucagaagugguuguuaagccucuccagcuugguuggccacgggcugccuguaaccuguguuugucccacagugacccugccaugaagcaguucuugcuguacuuggaugaggccaacgccuuggggaagaaguucaucauucaggacauugaugacacgcacgucuucgucauugccgagcuggucaacguccuccaggagcgaguaggggaacugauggaccagaaugccuuuucucuuacccagaagugagagcgcugguguugagcacuugggaaucccagccacagacacuugagagaggccagcucagugucucgugggguuuauacuuguuaugagcaugucgugggaaaggcugcagggucauucauucagaugaaagccccuaacugauuugguuggaccauuaaaaaaaaaauauguguacagaagaacuuuagcugcaauuuggcuuuuuaaguguuauuuguuauuaaaauguaaucauaauugugcuggugagauggcucaguugguaaagguccuugccacuaagccugacagccugaauauaaucccaggggccuacacacuggaaggggagaacucuacaggcuguugucugaccuguguguguguagcucccucccacacaaauacggaaauauaagaaaaugaaaucauaaauguuuuuccuaccuucuuagaaccaauuaaauacaccagaaaaauaauggaguuugguuaaauuauccuuuuacccuggguauuauuaauuuuugcuuguuccuguuaacgaaugugcauuuuuuuuguacuguggaguuagaaaccagugggaaagagagagaaacauugcuuugcaucuuuaguuuucccuuuuucacacuauuggucacguuuuccuaucaaggcagguacuccuugauagugcaagguacagcaaaaguguauguguguaacuaacaggugggaagauaccugcaauuaugcuuaauauuuauagagauuacgguuggaagauuugcaugugugugaacucuuacauugucugaaacuauuaauguauaucaacaaaauacauaauauaaagguucaaacaaaaaugcagcaaggucagccuccauggggauaaauuuuauauuuuuagucauaugcuaugacugcaguuaaaucuaguauuacucuuuuuaugcuguuuggccaucugccuaaguauacuuuucagacuaauggaauuaaaagcauaaaacaaaauucaggggugggcauggugguauacaccauuaaucccagcauucagaaggcagaggcaggcaacucuugaguccagccuugucucuauagcacguuucaggcuagucagggauauauagugagacccugucucaaaaaacagaaacaauccuuuauuucauaggaggcgacauuaaaaauucaugucuuuaaucccaguacuagagaaacagaggcagaccgacucaugaguucaaguccagcccagucuacagagugaguuccaagacagccaggacuacacccugucucaaagauacaacaauuuacuucccgagguguugagaaauaagguuacuuguaucccuaguagacuuuuuuuuccaagguagauaggaguaaagaaacagccucuuaggaaguaguaaacuagguuagaaacaugcggagccacuguuaauggcaagagaaacaguaagaggggcuugguaccccuuacugaagacagcgccucuuggccccuggugggagcuuuuuuccaacagagaagagagccuggggaugcuauguauguuguuucuguguugcuggaggcagcuaggccucuucaguuaacuugcacuguguuacagggucugcaaguugccacacuucaaugugcaucauaguucuugcccauggacuuuuugaucaugcauuguaauguaaacuuuccaguggauuguuacuuacacaccugauacuaagaauuaaguagaagauagauuuuuauggacacucuagcuguauuggagcacuacuggauuuuauauuucagucaucccuaagucaguucagcuuuugauauguugaucaccaauaccauuuuauauuaaaacacaaaacuuuggaucuuggaaguggguggagagagcaagugaacauggaa

SEQ ID NO: 8368 - RNA, 1166 nt, Mus musculus
guuuuuuuuuuuuuuuuuuuuuuuuuuuuuuuuugacagaugagucuuuuaauagaaaaacaaaacaacucccccgcccccaaaaaaucacaagccacacgugcaacaguaacaacacacaucucuucaauccagacagcucugaguuucaguucuucaccuugggagguggccuguacacaccgacaaccacggcguggucucgcucauaaggcucuagcgucagcugcuccugcggcuucauguucuccugcugcaucuucuucacuucagaugcaaacacagccucugcugacgcaguggagucaaugcaguuggccuuaauggaaaucacaaaguguccuccauuccgcaggaaggugugggcguucagggccacaauucggguuuggucuggcugggccacaucggcaaagaugacauccaccauugcgauaagcaugcgguauuugugugggugucgagcaucuucaauuacaggaauaauguuaguccucuucuuggccaaguugaugaggucacggccagagcggugggagaacucaacugcguagaccagaccauccgggccgacaauaucagagacgugggagacgguggugccugaggcugccccaagguagagcaccuuggcuccuggcuugauguggaucuggucuacgccgcccaggauagcugcugccagcuuggagcggaagggguuccaggcucuguacucaauuuugucaucuccuucugaaauagagacucucuucucuccauacacagacucuccagggaccagauucuuugugacaagaucauccuccuuuccgagacagauaaagacaccuucaugccgaugcggcuccaccaucacauucuucccugacugguuuccucucuugccuccccggccaccaccucgaccccgguugcccccagacuggaagcccccaccucggccaccgccaccuccucguccccugaagccaccacccccuccgccucgaccuccaccgccaaagccuccucggccuccucuuccaccuccucuaccgccucugucaccaaagccgccucugccaccaaagccacccccacgggggcugaaaccuggcuucauuacugcguucuggucgcacgacucaggcaaccugcggcguccccgacuccacgagucucag

SEQ ID NO: 8369 - RNA, 20575 nt, Mus musculus
ccugguuuuacugucagaggaugcuggguuaauagaaugcguuugguaguguuccuucccucucaguuucauggaccucucucucucucucucucucucucucucucgcucucucacucucucaaggcuugauacaguucaucagcggcuccauccuguccuaagccuuucuuuguugagagucucuuaugacuaugucaguguuguugcuuauuuuagaucugcuuaaauucuuuguaucuugaaauccaaaggauuucaguggaauaaauuauaaugucuccuuuuuauuacuaauuucauuaaucuggcccccccuuuuuuuuuuuugguuugauuggcaaagggcuugucaaauuuuuuguuuguuuguuuuuacagagaaucuaucuucuugauguuuuauguauuauucuauuagucuccauuuuauuaauuucugucuugaucuuuucaaauuucuugcuaauggccuuccauuuuggcuuguccuugcuuguuugcuugcuugcuugcuucuccugaaaguccaaguuucaucauuagguuauuauuuaauugcaaucucucugauagucuaauggaagcauucauaguuacaaacuuucucuuagucauauauugaaaguccugguuuuagugcuuugauuuugauuugauucuagaauauuuaaaauauccugucuguuuccuuuucaugacucaaugaucuuucaguuccuucaauggguuuuugguuuggaugauacaucuaaagaugaaaauagaguacugaagucuucauuauuauuaugucaggaccuagaugaccuuuuacaacuauuaguauuuguuuauaacauuaaagaaaaaaaaaagauugccuaggauuugugaguucgaggccagccuggucuacaaagugaguuccaggacagccaggguuacacagagaaacccugucucgaaaaaaauaaaccaaaaacaaaaaacaaacaaaaaaaaagauuaccuaaaaaauauugaaaaaagucauaaaacaaaaagggaagggucugaccagagauaaaaacauagaaguuaaaagaugauaugauagcaugcaauuaugacugaaaguauacuuaaaauauaagaagaaauuuaagggcaaaaggaaaaaaagaugaaauauugaagaaaauucuuucugggccuuugaaaguuggagacaugcaccuguaagaaggcaggagggacauuugaacuuguggacucuucuuauuccugaguuuucaguggugcagggccuguagcagacaaguguccagugccugcuagagcugucuucaguuuagaagcuucccuucuucgcacaucagaggucacugcuaaccacaucucaauuuuuaaaccugugggcugggcaggcucuuccacucuccugagacgccccaguuuuuauguccugggguggccaauguucuagcacagggagugacucccaaauacauugagaucaugggacaugaucauagcaguugucuauaugggcagcucugucuuuguauugucaaauccuccuggagauguggcugcagaugucaagaggccugcacggcuucagauuucucagcucuacagcagugaaucucaugguggguagagggcacacacauucacugacuucaaccucagaagcagucagauugcagagguauuucuaacugaugaggcuugaucccagacaagagggaggccaucuugcccugucuaccucagugccugggucaagucuccugcugaauuuacaguuccguuugucaguuucagguuccuacucucugcagcuucccccaaggcugucucucaccccagaauggaggcagguugaguucaggauucccaacuugugauuagcuuguucccaggccuccaggacagcucaguacuaaauaauaggcucucucucaaguagguaccugauggggcugguaagacggcucagcauguaagaguacuacucagguucgguucucagcacauacacaaugacucaaaacugccuagaacuccaguuccagggauucuaaugccuucucuggccuccacaggcuccugcccacauacauaucugaacucaugaaggcaaacacacauggguuguaaagcauuuaguaauucuauuaguucuuaugaccuggccagccccccuauaauugaggcaaagucuuaucaauuuauucaacuaguuuuaguacaauuacugggcgauuacccauaauuauuuuuuuaugcuagacuagcuacuucccagcugugcucuccacguuacucgcuuuuuguauacauucuccuguuauaauuguugucucugaggcuuacgggccucugucugcuaaccuaggccuagugcugggagcgucuagccucuauacaaucuaaucuauacccagaauauuuucagccucugagacuugcugcugaauaagcucacccuuucuuguucuuucugaacucuggcuggcugguucaacgcaacucuucuggcucaauacuccucuccaagcugacugguucagucuggcuuuucucucuuggccuccggauuguucugguuggccucauauuagauuagaagauuucuaaucugcuggcuucuucucacucucugggucauucugucuucaccugugucuagcucauucucucucuucaaccugucuuugcacaacugucccaguaacacugccuccuucucccucucugugcugcuccacucucccucucaacucgacugcacugcucuccauggacucuacuguacuccugcacuguacucucuucuuccugcacugucucuaccuuaaguagcuucccuuucuucucucuucucaugagagucaggcagauccuauccugucaaaucuuucugugauucgucaauugucugccacucaauuggacauuacuuucaaacauggcugcuuucuucugcaaacuaacguuaccuucauuguuugggauuaaaggugugugguaaggacugagccacacccuaacuagaagcagguccaaauauucuguaauaguuugacucuuguucggguucuuucugcuccuucagucugucuucagggugcacuucucucaggcauaugcuccugguccauuccaucuaauggagaccagcucgcaccccccccuucucugcccccccccccacugaggacucccuaccuggaaaccccauucugguaacugaagccccaccuaccucuauucucccuaguaacuggcugucaaucacuuuuaauuaaccagucagagaugauuagccagcaaaguuuaugugacauuauuuggugcacaugagaaugugcuucuguagauugcaacccaaucuugggggccaguauuuagcauuugaauauagcggcaccagaccaauucccaacauauaugcacauaaaagagaagaaaagagagaguuaaacaaaaagagaaagugccuggccuuagccuuccccugcugucaaaucuuuacaccuuacuugaaguuauugucuugucaagaccacagcuggauuugagggugugagagcuggguucuuggcuuguagguggaucuguaucuuuucacaccaguugccuagcuuaaccuuuugggugaagcuucucugggagcuucggggcuuuggagcuguguucuuccuggacuucuguugcuccauugacuuucgccccucugcaugcuguuucugcugucuucuaacucuuuuuugugaguuugaguucuuuugucuuucuuugggauggagccuauaucuauuuaucuuaaugcuuuccuuuuacugggucacacagugguggcuucuucuguuuuacuccagaagucucaguuccugucuauucucuuaaaucaauaaaucucucucucucucucucucucucucucucucucucucucucuuucucuccccccccccccaagcugaagagauggcucagugguuaagagcauuggcugcucuuccagagguccugaguucaauucccagcaaccacaugguggcucacaaccaucuauaaugggauccagugcccucuucuggugugucugaagagagcaacaguguauucacauauauuaaguaaauaacuuuaaaaucccuccccccgcccccucagagacaagguuucucugugcagcucuggcuguccugguacuugcucuguauuccaugcuggccuugaacuuggagauauaucucccuuggucucccucaaaagugugucaguguuugggaaugcuggucuguggccugacuucuaaaugauuuuagguuucuucuuaaacagggguaauaaugagaacaggagguacaaucuggccagguggggcaggggcuccccacuucaaaguagcgguucuaggaccaccauugcuggaggcagggaugccugaggggagcucuggcuccugccuuugguguucuaagagagcacuucugucuagagccuugguccucaaccugugacuugagacccccuuggggugggccacauaucagauauuuacauuuugauucaugauaguagcaaaauuacaguuaugaaguagcaaccaaaauaauuuuauaguugggggaucagcacaauaucauauaugagggacauuauuaaagggucacaaucuuaggaagguugggaacaacuggccuagaagugacaugaggguuugacagaggcugaaagcccacaucuggacaccugucugacagcuuaccuccccacacuuuacugaaagucucuuaaugaaccccagaguuucaacuugauggugcccuauuuccugggaccccuccugcuguacagaaaccucucugucucucucucuccauccuucccuuccucccugcccccccuuaaguucccaccuaugaaucuauaauaaacuucuuucuaaaagucacagucaaugguccaugaauuucauucuuugaauuuuacaacaauaaucugaaagccacuggcucgggucaucuuugguauggccacuggacuuucuuuucucuuccuuuuuuuugggggggggcaggugggggaccuuggccucccaagccaagguuucacccuuggggcucaagccgggcacuaugcuuccuugguggacacacuuuuaugggcaacuaagguuggacagcccuaaggguuaaaguuauaauaaacaaaaauaaaaagaacuguguagcaugacgccugaauccagcucugugauauuacgucuugaggugaaauggggugggguaguuagaaccucuagguaggacagaaguauuagucagggggaggguuacauccagaaacagaaauuugaaugcuugauuucuuaagauggagugaucagaucuaaaagugguugaccguaugccucugcaugugucugaaauaucuuauuaaaaagcaaaagaggagugggcugaugaaauagcucagcagggaagagagcuugcugguucuucuagaggaugugaguucaguucccaguagccaugucagguggcucaugaccaucuguaauuccaguuccaggggaucugauacccuccuggcauucccaaguacccacauauauauggcacacacacacacacacacacacacacacacacacacacacacacacauuuaagauaaaauaaaauaaaaugaauaaauaaauaaaagcaaaaggaggccaggacccagcacacacuuaaagacuaggcauugggucccacaccuguaaugccagugcugguggagaccagauaagaucucugagucuuagugggugucagccugcucagaucggugggcuacagauuccaaaagggacucugccuuaaacaguaaggcagacaucuccugaggagcugaaguugacuucugacuuccacauguguacauauaugugcacacaagcacacgugcccacccccacacaaauaggagcacacauaaauauacaaccucccccagaguguggagggacaaggggguggaggaaagccacuugaacccuuccagccuucgagggguuugucuggguaucuggggcuaccaagacauccucccggggcugguagaucgagcuugggcugugcuccugagaggauccucucuuggugugucucccacccccaggcucaguuauucucuguguaaacagauccugauuugacuccuccuugccuuccuuaauccucugaucagcaaacacuuauuucgaaacucuucagucucauagaugggaaagaaaacuccacaguaagggucaaauguggacaagcuugguuaaacacaguuccaccaugcagcuuaauguagcugaugcagucauagaaaccuuuccuugcuucaacauggaucuuaaauauuuaaauauugccuucucuuuuggcaguucucucuggugucuggggagaagagacccgaaggccugaaugaaaccucuagaauuaaauaaacgauacugggaagcaggccccuugcuaaguucccucuggaagugacaccucuauagcaaacuuuuuccucucggagugguuucaguuccaggccaaacccguucugcagcgugccuuugucccuuuucugggacugagcggccguaucggcuugccaggacuuuaaaccccacuggguucuuuuauuaccuaagagccucuauucaaagccuuucaguagaucacagaauuaacaucuaaaaaggcguagcggcaggaacccuggaaaccgggggagcuugccaccuuacagagcgaccucccugaggucaguuugcaagaggaaggggcuuugcaggugggaauaagauagggaggagccaggguaguagggacccagccggagcccgaaacucccccucccuuugcuaggucauucucacaaaugggauuaaaggccuccuccucuccuuuguauuucucccucucucucucucucucucucucucucucucucaucucagugcugucgucucccucccaauacuguggagggaaaauaccugaacagggagccaauuuuauuguuuucagucaguguaaacuauguuugaauauacauuuuugauucauuuccauuaaaaaaaaaacaccagacaagguuuuuguuuuuuuuaaugaagcaaggacaauuugggggucauuuucaaagagucugacuaaccaggccucaguuuacccuacaaauggagccucucuuuacugcuuuacggcucuaucuuuccagcucugaugacuuccuggaggagaugagggugcugaggcugaggcugagguaggggguggggugcucucuaauaaucuaucacuauuuagaauuugguuucuggcaauucucguacucugcgguuaucucagggaagugugcgcaucuguugucaaaccaccaccagcaccgccuucgugggagggaggagagaaaagguaccugcuuggguaccgagguucaucuugcugaugccuaacauugugguuuacaaguuagaagcugaggagaggagcuccuaccucuugcugaggcccuggaaggcagaaaguagccgaucuuuguauguaaggguuuuguuggaauaaccagcuaacuggauugggaggggugguggucaaaggucugaaggacugggcacaagacugaaagccgucucccugcgguggcgcucugcucacggaguguguuaaauacaccgcguucucgggcagcauuugggagccucgggagccgugcagagcguggugacugcaguccgugggggcccuggaaacccacagcgauggccacagcacaugcuuugucccuuuagaggguugcugcucaugguuggccagauuauacuugcaaaugugcuccagcauguccgcaggaaggggacuucgagaguaccaacagggugcccuuuguucuaaugacgcugcagggaggggccccgggcaagaggcagauuuucgaagcgugguucaugccaagagacggcugcuacaucuccugggaagaggacucccguucugggcugccugguggcuuuccucuuucuauuuggucuuacaauuccacccacccccccuugcacagccuggcuuccuggaggaggugucccucuucuuucuucacugucguauauuucucacccugaugcaguuaacaugggccaucaggcuucaguaagaugucaccucugcuguucuccuccgggccccucugaggcuugcucuccugcccuauagacagagcugagcaccacauccuguucugccuggacugguccuuaguggguaucaaaaucacuuggguuuuaccuuuuguucucucauggcuucugacucucuuucuccguuuuccccuuguguuuuuggcauucauagagaagguucagacccuagaguucuuauucgaggucaccaaggccuggggugagggaccaugugcucuaaccacugagucuaccccaccguguggagauccuaucaaucaacacaaaagugacucacuugaagcggcucacacagaacgcaucugguacacgcugccuuaugcuacuuccaaucauuucuccugcuauuggcugccuauuugcuccuucucguguucugagcacccacggagagagcaguagggaaggaggaaucuugauuguguuaacagggguauagagaacgugaugguugcucagagaaacagcacugguuucuacucuguccauucccccuggggaaaguuuuuggcucuaugugcuucuggcaaccugggcgccugccucuguuugaauuuucucugauagagauacgcuggaaaaucccaccccuugcaguguuuuccaggacgauggccuucugacaagcacgaugugaggggcuuuacccaccagccccuucaguuuagacauucuagaaguuuuucuuugugguaaaaccacaaagcuagggagccugguacuucuauuauuggacauuauagcugccaugccucuagcuagcugagcugugugaguucuucugccucagaagagacucaagaagacucagaagagcacagugggcuggugcucugggaagccagccuccugcuucuuauuguugauguaaaccaucagaggaagcucacccaacucucccucuuuguaccuggccugcugcuccagggucugcucugccuuucagucuguuccccccucuucucuucucucccuuccucuuucccccuccccacuucccaucauaguccccaggaccaugggggaagaagaauuggaucggcugcuguguuccuucagagggagguaugugacagagagucccuccuugacugaacucuagccaggcuucuucaacgagaaaccccaucuuuggagaucucuccaagagccuacuuuuagcaagagucuaguuaggucaguuuagccagaagccaccuugacuggauaaucacucaugcugaguaaaguucucauuccuagcccuugcucugcugauaaucaauguccagccuguuggcagcaggaguucucuugggucaaugcagcuggaaucuuuaucauccacccagacucaucagggaguuaggcauaauucucuacugucugugguuggacuugagaccagugucccacccaggguugucaaaggccuaaaccaaccuccaaaggccggaggacuccgaagaucauuccuuguuucuuccacggggacagaccagcugcagucugucagagaaggucacggcugcaagggcaguuucugcucacccuccucauguguguaaguaacaagagaagcuaugaacacuuccuguugccuugggaaaaagauaauccuuccguuucucaaucccagaaggcagccaaacccuuaaggccaaguucaccucuauaagaauuaguugguaaauguaggucugugaagcgucucugguguccaguaggcaucagugaagacuuggaacauauguucucuggagcaccguuaggcagcucuacuuacucaugggccuuugggaaugucggccugccugggauggccagaacacuggauuuuaaaacaaaacaaacaaacaaaaaucaucaggggcuggagagauagcucagugguugugcgugguuugugugaauaugugcugugugccugcacugucucagauaagauucgagauguuggucccauagaaucagcaucccuaucugaugucuaaagucuagacugcucaguucugaucuuagcagucagggggaaaaaaaaucuuagcucagucaggaaaaaaugcuacaagucaccuuuaugagggccacucaggcuauaaguggguaccacaggcccuuccucagggucucugaacuacagaggcccaggaguaccugcuuugaguccagaaguguagauacauagaggaagcccugagcugguuaguuucugucaguuugcuaagaacuagagccuucugggaauagggacucucaauugaggaaaugcucccaucagauuaaucugugggcaggucugcggggcauuuucuugacuaaugauugaugugagaaggcccaguccacugugggaggagccaccccugggcaggugguccuggguuuuauaagaaagcggcauaaauaagcuacagggaggcaggcagugggcaucauucccugggacccuguuuccccgcucugccuccgcggugaugcuuugugcuccugccccacuucccucagugacagacugggaccuguaaggugaaauaggcccguuccuucucaagcagcuuuuggucaugguguuauaugacauuauaugacagcaucagaaggcccacuaauuuaucccggaaacguagcucagacuaaaucguauuuaaugaauguagaaagggagagggagcagggaaguggaagagagagugcggggagggggggggagggcucgggaaacgcccgggacugcauaucugucaguacacaucuaggugcuuagagucucuagguggggccggcccccucaagcccaaggaugcgaggcugcggaacacaaacacggacagagucagucaccgugacaagcauggguucucucccuuccaagccuuugcugccguugugaauucuaggcuuccggacaccauguugcuuucucccacugaggcagaauuuaggaagccauacagcccgguuccuuuuaacugaugcagugccaacuucugccaucagauccacaggcguuuuauugcucccauuuaguuuaacaauuccucuucccuugacuccagcugcuuaaaauagaguuuaaugagguuuucauaguacccuuuuuaaauugugugcacuugcaacuuggaagcaggggacaauuuauuaugagguuuaaaauuuuuuguuuuauguguaugaaugugugcuugcacguaugcauaggcuacaugcauaugcaguuccuguagagucuggaaagggacucuggaacuggaguuacagguggcuaugagcugucguguggguuaugggaagcaaacccagguccuuugcaagagcaccaguugcucuuaauugcugagccaucguuccagccccuguuaggagcuuuuauucugaaucuccuuugcacuuuuagaaccuuuugggacgggaacaaauccagugacuuguaucaguagcauaugcuaagcacaggcuucucaagacaggcuguuuauauggaaaguaaaugagguucagaacacugcauucuguucucggacuggaggcacauuucuccucaggagucucgguuccagaaggcugaguggcuggcccugagugauaauccagcuguucacaaucaaggccuuggaaagauugcucggaagugaguuagaggcuguuuucucugcguauucugggcuguucucacaugcagugguucaauuaaggcuaugaacugaaacuauaccuuuuggcuacuuuauuggguccuuuuuccuaucacccuuaguuaccccaauccuuccccaacacuagguacaagaaaaagaggguuagagggggaagcggguauagaccucuucagacuauuccugcugacuagggugaguuccuaggggcaagaauaaucuuugucaucgaacuaucuccauacagcaaacccaacagcaggaaccagcagcagaugcugcaaccucuggauuucuacacagaaaaacacaggguuuuucuguguagcccuggcuguccuggaacucacucuguagaccaggcuggccucgaacucagagguccaccugccucugccucucaagagcugggauuaaaggcaugcgcuaccacugccagacugccucuggaauuuuuauagccuugcaagaguucccaaaauccaaaugcaaaccuauuuucagcuggcagaaucaugccccugccagagcaggagacaaaagucugaaacaggcccauaucccacaccugggauuaaaacaaaaacauauccccauaacauagccagguuuuuaaaagaaaucaaaauucucacuacggagaacacccugcuuuucaugaauuuuggguuuugaagauguuguccuaugcauuuuaguugucugugaugcuaggguguauuguauuauacuguguguccucugccccucccacaauagccuuccuuuuuuuacacucucagagucuugcuuuuucaacuccauuuauaccuuaguggcaucagacauuguuauccagucuaacaggaaauuccacuggaggagaguguuuuuuuccaauaugagaugguuagcuauuaauaaaggcuggcacaugcccucagagcucccucucuugagauggucauguuaggaagccaggugagggcugcuucuccacaucugcacuguaaaucacccaagccaauugcauuuauaagguguuacuccuuugcaauccaagcauugguugggcaggucacugaguaugaagggggucgaauuuuguacauucucuugugucucagaaagguggcuccagggauacuaggcuggauguggcugcaauguaugcauggccccaggcuucugagagugcucaggaguggagcaauaaaggauuucuguuugggaaucccucuacuaaaaauagguuccggaggcuggggauguagcuuaguugguggagugcuuauuuauuuggguuaaccccugagcuagaucuccagcauugcauaagcuggugugugagugcauaccugcaaauccaguucuaaggaggcagagacaggaggaucaaaaguugaagguuguuuuugacuaacuaguucaaggccacccugagccacaggagacuaagaaaaugaaaucaaauaaaacaauaaaguaauggauuucucugcuuagcuuuuuguuuuggugugugugugugugugugugugcucacgcgcgcgugugcacauguaugugugugaguaccugugugagugugugugcgcguauguguguaugugugugaguguguguguacgugugugaguguguguaugugugugcgcgcgcguaugugugugaguguauguguucgcguguauauauguguguguguguacuugugugagugugugcgcgcguguauguguguacgugugugaguguguuugugugugcacguguaugugugugcgcgcguguauguguguguguguuuggacaaaagaggaaagggaauuuacucuuuuccuuucccauuuaauaucagaucuuuguuacauaagccuuucaaaaguuguuuaaauaaauugguuuucagauuagugcuguuguacaccuuugcaguuagguuuuuuccauagccuuaauuacuuguauacacugagcucucugggugaggggaacgcccaguccacgugcucgggagcagcccgguagucuggccaggagacugcaacacuuuccuuuucugcagggcucuacaggaggcagcccuugguucaaaggacagguuucugcugagauggcuggucuccuauugugacagagcaggcugaggggguuggcagacuggcuuccggaucuggaggacacaguccuuucuccaguggguuacagucugagaagggaguucuugaccacucuccucagggcuccaucuuaaccugaccgugccuggggcagcggcagacagggaaguguggugcaugcaaugagaccaagagaggugagagagauuugacacaaaugguucuguucagugaggguuucucuggcgaauccuugaccauuugaacucaagcucucagaaaaagaaaagaacaagaggaggaagaagaggaagaggaggaaaaggaagagguauaauaaugagaagcagcuguuguguuuuagagauuuauaaaaagauaagggagagggggcuggagagauggcucagugguuaagagaacugucugcucuuccagagguccugaguucaauucccagcaaccacaugguggcucacaaccaccuguaacggauuugacgcuccuuucugguguacuuguguacauacaauaaauaaaucuuuuuaaaagagggagagaaggaauauguuugguggagguguaguuagcugugagggaaggggguuucucugugggcccaugcugcggcaucccuuccuacugagggaccagccacacgaaguuauaguauagaauacaguuuauucagggcauggggaggggaguuggggagaguuggggggggggagagacagagagguaugagaggacagcgagagcagagagcaagagagagaggagggggcaagcagccccuuuuauagugagucagcacaccuggcuguugccaggcaacuguggggcagagguuagacaaaaugcuaacaggagcagcagcagcaggaacuaccacauugucuuaggguuacugaugugaggaaacacuaugggaguuaaguuagggaggaaaggguuuguuugcccuacacuuccacauugcuauucauuauugaaggaagucaggacagaaacucaaacagggcagggccuggaggagcuggugcagaagccuuggagggguguuacuuacuggcuugcuucccuggcuugcucagccugcauucuccaggaacaccagcucugggaugacaccacccaccacagugggcugggcucucccauugaucccuaauugagaaaaugccuuacagaugaggcauuuccucacccaagguuccuuccucucugauaacuauagcuugcaucaaguugacauacaccagccaguacacacauuaacauugaggauuuuacaaggcugauugaacuuggccacuguggagagcuguaguauuauauacagagcuagacuaccuugggcuaucuucagcucacuuaguagccuuuuguugcccacguguaucugacuuaacaucuuacaaaucccuuuugagauguacuaaccaaucagacaacuccugcaagcuuccacaaauucaaaaacuuagaauauguuauuggauaacagauacagaccauagcagagaugucucaacuugauacaaccugccuaucugauguuuccacuaacgcauuugaaaagugccuuggauuuugacuuccuuuguucuguuacuaugaaaaccacaugaacccagauucaggauauuagaucuuggcucuguuucaacacuacacugucuaccugcaacugagaaagacaggccuacuaccauucuaacauaaaaauugguggauaaauucucuccucucucuccuucucuagaagccuucaggcugaugcaagucacuucaagaaccaucaaagugccuaaaaucagauccugguuacaacccucucaaacccaaauaaaucaucacacacacacacacacacacacacacaaaauagacucaagggcuagagagauggcucagagguugagagcacugacugcuuuuccagagguccugaguucgauucacagcaaccaaugguggcucacaaccaucugugaugggaucugaugcccucuucugaaguaucugaaaacagcuacaguguacuuguauauaauaaauaaaucuuuaaaauaaacaaacaaacaaacaaacaaacagacacaaaacaaaaacaaaaugaacaaacaaaccacaaaacaaaacagagaaggaacccagggaaugacgcuccuggaauccuaucaagcaauuuuccuggacuuggaucuggacauuggaaagcuaucccuuguucugcccuauccugggcaggccuuguaaugcucacagcuguugccuuuacuucuuucucacaucuccuuucucuaucacuuggcucuuauacaaagggaauuacugaugcgcuugggggggcuuuuaaguagacccaaggagggcuacccuggcugccacagcuucuacccccacucagcaggaagaagccagauuagucauuguuccaauuccguaauggaaguuauaacucuacucuaugugcugucugccuguugaccuauuucacucucacaaaauccccaugaggaagggaguccuuuccaagguggggagcgcaggcacccagaagcaguaaacugguccagcaaaaaugacucagaggugguagagcuagcuuggcaugacccaggugacagcuucuacuguugaaaccacuuuacuauguagacaccggcacaguccucaaugugagggucacacaaaguccuauuuucaaaacauauagcaguucuguacuacaaaagaugcaggguaggucagacaccaauuguucucuacauccacacagugaccuugcugcucugaaugugauuacugauccaugcacacccugggugcucacugugggcccagcucugggcuacaucugccaaaaccucauuguccuggcuaguuuuaugucaacuugacacaagcuauaguuaucugagaggagggcaccucaaugaaguaaauguccccauaagauccagcuagaggacauuuucuuaauucgugauugauguggggcagcucugcucauuauggguagggccacccugggcugguguggucuugaguucuguaagaaaggaugaggaacaagccaggaagcagcacaccuccauggccucugcaucagcuccugucuccaggcuccugcccuguuugaguucauguccugacuuucuucagugaugaacagugauauggaagaguaaaggcaaauaaaccauucccccccccccaacuugcuuuggucaugguguuuuaucacagcaauaguaacccuaagacacuuggcacaugcauaaugcagggguuacucacaacagacaguaucugucucaguaccgagcacuuagaagaugcuucggauaaaaaagcacugaguccucaucuggacccacaaagucauuagaagcaggaugcaagccuggccucacugccuucaguuugcagugugcagucuccuuuacucuagggcagacuccugcuugagucuucacagacaugcuaaucacaaagacagcucuagcucucuaacucaugauuucauccuuccuccuucaagggagaaggcacagagauaagucaucgcucuaacccaaacaucacccuggaguccaggaacagcaagaccuagcgggcaggcagagagaugcuuuaugaugcagacaguacacucaagagcaacuccucuugugagagccaagcugcucucugcugcuguuggcaguggcugauagauuaacauuuuuuauuggaugcagguucauguggccaaggauggccuugaacucccaauaacuccugcucuaccucccaagugcuggaauuguagguaugugccaagaugcuggaccaaucagcagcuucuuauuagauugccuuugugaauggagcggagauacccacgugagguaccaugccuccaggaaggcuuaacugugcacaucucuugcucccauccuaacuauuauauuuaaacacaccaauguguacaacauacacaugaaaaaauggaaaagggaagaaaagaaaagaagagccaagaguuuuaaaggggacccagcuggagcaaaccccguaguggcugugacauacaaggugacuacggucucucagccaaacucucccaaaggucaccuuaauuugugucuagccaucuuuuguugcuggaucuugauugauucacacuagauuuuugauuuguucuugaucuuaguuccagaagccauuuauccauccauccauccauccauccauccauccaaccaagaguauguucaauuacucaucaaacagcccacaguuuguugacaguagacauugaguagggccaugggacacagaggaacauggaagccccagauggugggcagcucaucaggcaccauauaaauuugauggcauguccuuuacuuggauuaaagguagaaaauugaacaagugucaccuuuaggggaaacauuguuguugccaaguucacucuucagcaagguagcagagugccagaucaggaagagaucaugugagauuguccagcaguccccuggagaaaccugaagaugauuuccaaugagaaaguucuccuuaacagcuuuagauguugcacgugggcagaucuguggucuaaacuacacuagcaugaauagccucuaagcagcccuucacccgacccuaagcacuuuaaauauaaacaaggugauagacacuuagugcugugggaaauauuggcaggcuccaugcacuacugcuggcaacucucgguccccgcacagucucacgggcucugucucuauccaccaacucucugguggggcuggagcucccuucacugccaugccagccccaugcaacaccuauucacccugcagucagcugccacaacacccagcaaccugguagaaacaaaacucuagaagcuuauaauuaacaagucagauuuauauaucaauaaauucuuaauucacaagaucccaauacaauaauuucagaacuaauugauaaugauaaaagcugcccaccagauuagacaaauuaucccaaauauucuauccuuuaugauauaucauaacuaccuguggcuauaaaaaccacaguggaucuggcucuucuuccuguccauccaucuccaucuuggcucuuccccuuucuccccugagacaccucugucucugcaacucuuagcucugccucccuuuucuguguccaaucacaggccuccuacugcacuaauauuuuaauguaauuggauagggaaauuccagucacaauucauguucuuuuuaauuaaaucaaucucucucucucuccagagucugucuauuauguagcucucucuguccugaaacucuauguaaaucaggcuggccucuuacaggauauuugaucacacugugaacccugaaauuguaucguuuucuguaaaaaccuguuucuaguugugguguggcucagacuuagcacacaccuuuaaucucucuggcuggaauagagacaggcccuuagcacacaccuuuaaucccaaacaaugaagguaaaguugguuuguagaaggaagcagccauguuugaaagugaugucuaauugaguggcagacaaagugaccaauuagagaaagauuugacagaaaaggaucugaccaaaucucaugaaaacagagaggaaagagaggcuacuuaaaagagagcuguaagaggagagagggcaguuuuacugggacaguuguacagagacaggguucagggacagaagaagcgagacacaggugaagacggaaugagcccgagaaugagaaugagccagaagauucaaacauauugccaaacuuaguaugaagccaaacaaaacaauucagucagaagccaaaagaagccagauugaaucagucagcuuggagaggaguuuugagucagaagagcuaaguugaccagccagccagagaucagaacgaaauagaaagggugagcuuauucagcagugagccucagaggcugaaaaccuucuaggccucgauaagauuauauagagacgagaagcuuucaggacuaggccuagguuagcagauggaggcagugagccuuggagaugaaaguuacaucaggcaaauaaaaguuacuuuuacauugucuuggaacucacagaggaauccaccugccucugccuucugcauccugggacuaaaggugugcgccaccacaccugaccuaaauuaaauucuuaaucaaaagaaagaaauaggguggagagccauugcaaccucuccugcuccccucccuucacacuccauuguaauauccaaaaugaauucaagaccacccaguaccuccccccuucaaaaaggacuuuccaaacugcucuagcaggcaaaguacagagccaaauaagaaagcuggcugacuaaacaaauguaaggacauaguuuuagcggucaaaaugauuaagccugcagcuacgaaaauaauauuagcuguucacagagaaauaaccauaacaagauuagcaauucuccugcccccccccuccacacugaauucugacaaagaccacaaaccacccugaccuuguugugagaauuccccugauguuaauugcugugacguuaauagcugauucauaaguucaaaauguac

SEQ ID NO: 8370 - RNA, 1287 nt, Mus musculus
uccucugcugaugcagccagugaguucuuccuguguugaagugcaaagaugcucaacgcaacauggcaacuccaucaggauggccgcugugcaauggaggaaggcucuguccuggugauucaaaucagccacggggcacuguaaauaucagggggaaauccaagugagcccagcuugucaccauggugacuuacugugucuggauucaugcagugcaguuucuuucuccuuauccugagacuauuggguuguuacuuaaauccaaagugguucccaaacaaaaggugaacugaggauuccaauagucaucaggaauaggagucccugagguugucgcuaggugacucugcugccuuccuccugccucgaaggcuuuugagcaccuuccgguaugagugggugaaggcuggauuggagaagcaguaaauggcugggcucaauguacugugcaggcaggugaggcugccagcgaugucagaggcccgcacuauggcuugcuggacacugcagcucuuaaauuccugaaagaugugcaccagaacccuggucaggacacuaggcaggaagcacaguccaaacaguagcagcacuauggcaaccagcacccuggcccuccagauccuggacuguuugucagacucuuggagucucuucuggaggguccugaugagcccacuguugcagaaggagaugaggccaaagggaagcaggaccugaaggaagaagaguaguaccucuuggcagguggcaauggcuuuggccccuccugugggguagaagcuggggcauuccguggaauucuggguaguccugcaagugagaagguuuuggggagugagaacaaccaucagaagccagaugaggcuggagaugccccaagaugcccucagagacagcaaguuaacucugagccgaggauggaccacacgcagauaccggucuaaagccacuguugucaggaaggcuacuccuacaccacggcugaaugccagcaagaagagaaggacuuggcagggcauguguccaaguuuccagguguugcccuucagauagaaggcagcaaagaauggcagacugguggccaauagcaggucagccaccaccagguugaacagguagacagcauaaggcuuccauacuuugagacgguaaaagaagguccagagggccacagcauugcccauaaggcccagcacacacuccagugucagcauggugcccacggcugucuccccacagugcuggcagcugagcaguuggugcgcuccaugggccugagccucagug

SEQ ID NO: 8371 - RNA, 1597 nt, Mus musculus
gauggcggaaauggaccugguggcugaguugccgcgucccccgggugcugcgcgcugggccgagguuauggcucgcuuugcggccaggcugggcgagcagggccggcggguggugcugaucacaucuggaggcaccaaggucccacuggaagcgugcgcuuucuggacaacuucaguaacgggcaacagggagccgcgucggcggaggucuuccuggcugccggcuauggaguccuguucuuguucggagggcacucagccuuccccuauacccaucgcuucccgccccaggccuggcugccagcccuccggccuucuggcccagcccagucgggcaagcugagucuggaggccuaagagaaugcgcucccgggcuuugcuacagcauugcagagcuuccaagagacugguaccuuccuggcuguagaguuuaccacuuuggcggauuaccugcaucugcugcaggcugcugccuuggcucucgguccauuaggcucuucugcgauguuuuaccuggccgccgcagugucagauuucuauauuccugucuccgaaaugccugaacacaagauccacucaucugguggcccacugcaggugauggacucuucucuuccagagaucugacccccucuaaccaaucuuggguuacuuuccucuugaucuggauggcuuuucagccuucugcaugagcuagguacugggaauacagagaugaacaagacacugcccucaaggaucucacagucuagcgagggccuggacaccagccauaaucacagaucagaaugauaaaugcuguaguggagauaacaaugaagaugaugccaaagaugcuuucuccucuggucaaacacugggcuccuaaagcauuuguaguuuccuuuaagcuggagacagacccggacaucauaaucagucgggcucggaaugcuuuggaaguuuaccagcaucaaguggugguggccaacauccuggagucaauaaaguccuuugugauuauuguaaccaaagacucggagacagaguuacugcuguccgaggaggagguggcaaaaggcuuggugauagaagagaagauaguagaugaccuucagucucgacacacagcuuuuauacgugacaaaaacugaaggaaaugcuccucuaggaucaaacaccagagcucuuaccacugauaggaacuaagauugauccucuguuaaggaucaacccagugaagaaauaguaaacgcggugugcaggcaagcgccugcugggacuucaguucugagagugaaacacuggacgcucuccuggaucuggaaagugaacaggaguucacaaagaggacugugggauugcguggucugcagagcagacgggccaggagccgcugcguguuggccuacuguaaggucauggugcgugaauggucaugcucugaagaaguauuuaucaagugccuaccaugugccagggccuuugugagcugugagggucugaaagaugaaugagcacaucucauuugggaacuggauguacaaaaauuuaugugcaauaaaguaugugcccacaaagggacacuuggaaaauaaauaaauaacuuuaaaagucc

SEQ ID NO: 8372 - RNA, 1597 nt, Mus musculus
ggacuuuuaaaguuauuuauuuauuuuccaagugucccuuugugggcacauacuuuauugcacauaaauuuuuguacauccaguucccaaaugagaugugcucauucaucuuucagacccucacagcucacaaaggcccuggcacaugguaggcacuugauaaauacuucuucagagcaugaccauucacgcaccaugaccuuacaguaggccaacacgcagcggcuccuggcccgucugcucugcagaccacgcaaucccacaguccucuuugugaacuccuguucacuuuccagauccaggagagcguccaguguuucacucucagaacugaagucccagcaggcgcuugccugcacaccgcguuuacuauuucuucacuggguugauccuuaacagaggaucaaucuuaguuccuaucagugguaagagcucugguguuugauccuagaggagcauuuccuucaguuuuugucacguauaaaagcugugugucgagacugaaggucaucuacuaucuucucuucuaucaccaagccuuuugccaccuccuccucggacagcaguaacucugucuccgagucuuugguuacaauaaucacaaaggacuuuauugacuccaggauguuggccaccaccacuugaugcugguaaacuuccaaagcauuccgagcccgacugauuaugauguccgggucugucuccagcuuaaaggaaacuacaaaugcuuuaggagcccaguguuugaccagaggagaaagcaucuuuggcaucaucuucauuguuaucuccacuacagcauuuaucauucugaucugugauuauggcugguguccaggcccucgcuagacugugagauccuugagggcagugucuuguucaucucuguauucccaguaccuagcucaugcagaaggcugaaaagccauccagaucaagaggaaaguaacccaagauugguuagagggggucagaucucuggaagagaagaguccaucaccugcagugggccaccagaugaguggaucuuguguucaggcauuucggagacaggaauauagaaaucugacacugcggcggccagguaaaacaucgcagaagagccuaauggaccgagagccaaggcagcagccugcagcagaugcagguaauccgccaaagugguaaacucuacagccaggaagguaccagucucuuggaagcucugcaaugcuguagcaaagcccgggagcgcauucucuuaggccuccagacucagcuugcccgacugggcugggccagaaggccggagggcuggcagccaggccuggggcgggaagcgauggguauaggggaaggcugagugcccuccgaacaagaacaggacuccauagccggcagccaggaagaccuccgccgacgcggcucccuguugcccguuacugaaguuguccagaaagcgcacgcuuccagugggaccuuggugccuccagaugugaucagcaccacccgccggcccugcucgcccagccuggccgcaaagcgagccauaaccucggcccagcgcgcagcacccgggggacgcggcaacucagccaccagguccauuuccgccauc

SEQ ID NO: 8373 - RNA, 79950 nt, Mus musculus
caaggaggugcgcaugcuugaaggaagcggaaguccggauuuccggccggcgcuugaaggugcggauuccgggcuuccgggugggcgugggggccggacgagcuaggggucggcggcguggcaagaggacagggcuauggagaagcugcggcgcgucuugagcggccaggacgacgaggagcaaggccugacggcgcagguaacguccucggccgcggcgacagugggagaggggaccgcgaaccgcucucggggagucggucccggauccccgggacuguccgguccccgcuucucugccauggccuuucucugcgcccuccccuccugcaccaaguuccgccgccccugcagcgagcaggccucggggccaggcugccuguggccggcucauucauuccaggucucaagacagaucuggggcuggggagauggcucagcgguuaagagcacugacugcugcucuuccagagguccugaguucaauucccagcaaccacaugguggcucacaaccaucuguaauggggaucugaugcccuuuucuggugugucugaagacagcugcuguguacucauauaaauaaauaauaaauaaauagaucuuuaaaaaaauuaaggcugagaucugggcgagagacuggagagcacggacgugccaaagguugccugugaagucagcccuccuuaguaaugcaugguuuuguuuuguuuuguuuaauuaacagagcccuuguuugcuugugacccagacaugagacuugauaaagacuuacuuccuccaguaagaauuaaaaauaggcaaacaggaacugcuuuguguuuugcacgcuagcacauuuuggugugucuuggcacagaccugggccugauuuuguauuacaugaagauguuuuguuuguucguuuuuccuuucugacuuauuuguuggcagggcugagguagcccguguugagacaagugaacucuauauuguauuuuguguuuuguuuguuuguucuuuuuggguuuguuccaagacaaagucucacuguguagcccucacuggccuggagcuacaaagguccuccugccucugccuccugagaacugaaaucaguauuguaauugcaauacaaaagaccuguacauagucacuucagcaauggcuguaaauauggcuuauccaccgugcuugauaguaucaacugcuucaugcuccacucuuuguucuagaucuuugcuguagcuaugaccacauguagccacucaaaauguaaacagauuaaaauguagaauuuauuuccguaguggugcaugccguuuuuaaguguugaguagcauguggcugcugcucagacauugcuggaguguugucaggcagugcucuuguaaauccuggggacaaagaagugaacuugguccuuggagcuguuuccggaagagaggagauuguguaaagaagaguucagucaaagguggaacgcucugguggugauagacuguuaggugguuauccguugucacuguggauguaauaacagugacugauagaggccuccggugcuacgguuacaguguuaguggaaagugcguggaacagguagaguggguugggaagcuuaggguugccguagugcauaggguagucagccucucagguagcucagggaagcucuuccugagcucccaacuaggagagaguggcagggguggccucugugugugcugggccggugacuggaacagagggaaagagggacacagguaggagacaaaggcaggaaggcaggagguggaagauucugcgucccauugggucucuuaggcuguggagaggguuucgauucacugugagugagugauacuguauuagccacuuucccaucgcugagcacaguaccuggcagaaacagcucaaggagagggaagguaugucgugguuccauuucagagcuuuaguccaucuugaugggaagguaugguggacaguucaguucuuggauagacgugugggaggggauucgcuucccagcuccaggaaggagagaggucagcccuagggagugacuucugucaagucggccuuagcaucucaaguuuccagaaugucucaaaguagggccaccucugagaagagggcgugggagcuuagccuguucacggggaagccucagcuguguugauccaguacucccauuuucuuaccuuuuuaaagauuuauuguuccuucauauguauaaauauuuugcucuccgagaaugaaagguaugacaguaaugagggacagggguagaaugucaugguggccuugaaaguauuaugugucuggggaggagcaugggccuagagggaagagugccuagcacacugcuuguccugcaggaugugugggaagaacgcaugcccucggggaggauagaccacaaggugagagauacuuagaaguuagugaggaccagaaaguuuguguagaguucaggguguucugcgauugugggugaccaggcuuaguagggcagugggguggugacuucuuguacugcaggauggaaaagguccuaucuauggaauaggauggucacccaggugcagguuagacaaggguguccaggcacccuggaaauugagcuacuccguucugcugcagagaggcuugagggccaggauugacuagaagcuaggguuccaggcccuccuuggcagguaucuaggacaucuuccuagagggaaaggccugaagcaggccucagagaaccccauccugcucgcucucccaccacugugcuucuagaguuaagcccagguuagcuucucagaccugcacguaccuagucccuccuccaccugccaggacucugugcuucagguguuucagcuuccuugccugaguccuuucuuagcuguacaacuuggcagucuuuuagcaaggucauucuuucuggaaugcuccaaccuggcucuucuaguggagucagcacugaaugucuucagagagacuaggcuguuccuaguuacccuccuauuugcucuggcugcuguucucaccauugaccgcccuuccccauuugcauguaaggccugucuguccugcgaccugucauugaagccuaacaagucucugccaugaacuguguguucauagacuuugaccagaacucaacgacuggggagcuuagaaaccacagaaguuuaauuuuuacuauucagucccaagaucauggucagagugaaaucuuugucucccaagggucaccuucuggucuguggauguaccauuccaguuucagugcaaggggugugggaauucccugggaaaggaaacuaaucccacuuccaaagguucuguugccgugucugaaugccccugaggcucuguguucuagcaccagugucugaaagguuaggauuugggggaacccuaggugcacauuguagcccagcacggcagauaacuaguccauguuaacaaaggaaacggccauguuccaccuucaaguucacugcauggaagauguuaauaaaacccccuguuauguaagccaagcaguggcucucagaagacugacuaugaccuaccaaggugcugugaaacauuuaguuacugugaugguuccuauaugccaggcucaaggaguggcacuauuagaagguguggcucuguugaaguaacugugucacugugggugugugcuauaagacccucauccuagcugccuggaagacaguauucugcuaucagccuucagaugaaaauguagaacucucagcuccuccuucaccacgucugccugaaugcuguguguucuugccuuaaugauaauggacugaaccucuggaccuguaagccagcccugauuaaauguuguccuuaugaguugccuuggucauagugucuguucacagcaguaaaacucuaagacaauuaacguuuuuuuuuuaaucauaacacuccaaaaauucauguggucucugaguugagucuucuacauguuauugagcugcccaguugcugaggccucuacauaguuacaggauuaggacaaucacagaaaaacaccgagcaguuaagguuagagaaucaagccuuucaggcccgucuucaggccugggguacacugugugaaaaugaaaggucacagccagugaggagcugcaggucaggacugcggcucccuuuagagccuauggugcuccaggcccauguggaauggcagcuucccaggagguucauggucaguccucaacagucacauccagugcuguguucugaaugcuccccaaauucauaugcuaaggccuaacuuccagcaugacagucugcuuugcuuaacagggagaccauuugccccuucuaucauguguaggagcagcagacaccuugucuauuaacacuugaucuuagauucacaguuuccagaaucaggagaaggaagaggaggaagaagagguggugguggugaugguggugguguuuguuacagcaccucgcauacugguuuguuuguuuuuuagacaaggugucuguguggcuggcuuggaacucacuauguggacaaggguggucuugaacucaugaguucuuccuaccucugccucucaagugcuaggauuaaagacaggcuccgccaugccugaucagcauauaguauuuguuuguuuauaaccaggagcugagccccucaccuagcucuuagaagaagcacauaguuguucucagugucaggaguggcuggcuggcuguggaggcuggagggagguuuuuuuuuuuuauuuuuuuuauuuuuuagauuuuguuucaaggaaguuccugaagcaggccugaggggugggacccuaaagcagguaggcaaaugugugccucccugggacagguaggaagagucuuuucccgggagccagagcaggggccuggugcucuuguaaguaaguggauguccuagguacuuuucuauugcugugauaagacaacaugacaauggcagcuuacagaagaguuuauuugaggcuuacaguuuuggagugugaguccaugaccgucaugguagggagcaugacaccagguaggugaacauggcucuggagaguaguggagagcucacaucuugagagacaacaugaggcagagagcuaacugggaauggcauggaccuuccaaaccccaaaguucacccccaccccagugacacaccucuuuuagcaaagccauagauauuaauccugcccaaacaguuccaccaacugggggccaagcacucacaguaugugaguggaugggggcagcugucacucaaaccucaaugggagccaugagcugcugccuucaguucucugugcugucaguagguggaguugucagcucagugaggggcacugaagcagaacugggaggcuugagguagcucuagaaaacagguugggguggggagacugaaaacagacuugaccaagaguggugcucaacauuauugccacugaagugaggaggagcugagggccugauaaggagccugcgaggcaggccagguagcagcuccuaggacauugcuuauuuuuuuaagacuaguuuucuuuuguguauaugacugcuuugucugcaugugcaccauaugcauagcugaugcccacuggggccagaagacggccuuggacaccuggaaccugaauugggaacgguugugacugccauaugagugcugggaguugaaccuagguccaguguaucuaaaagugcucuuagcuccugaaccccagccccaagacugggguuuuugaacaaggauuucagagacagaggaacugcagggaagaaggcucuggcaguaagucaauggguaggaugaaagagaaaagccacugaagauggauugaagaacagaacggaugggcuguccauguugaauuuggagaauaggcaagaucuaccauguagguaggauuggcuuuguggccaggaauccugaaggacaggaccaaggaagcugguuaggggcaacuggggggcaaaguggcuuucuaccucauaaaucccaggaggagaggggacaagcaaguguguugcucggaauagaugugaggagcagggccuuccgcuucugccgauugcugucuuuuuacaugccagccauugugggagagauggaggggaacgcagaaaugagggcuuucacuacauugaaagccacagcaaguguucuggaggcaugggcucugggcuguguggcuguaacucucccuggcccugcaggugguguggcccugggccuuagucuaucaucaaguacaggugcaaagcugggguuacuguguggugcauccauccguucuccucauugccuguguggcugaggagucagugucagggguucaucuuucagcccugauuccuugcugugucuucucaguggccuccuggucaaaggcuuuacugucucaugugacagcaagaaguucugaagaugaaaagugaaaauugugugcauguaugacagagcaugguguucugaugugugugacagcagauuauuuguuaagugauguacacauuuggggugucuuauucugugaugaaaauacagguauuguauaaaucccugguaagaaggggcauuggguauccauagccccauucacccaauuuacaaccacauguccaguuaggcuguaguggguggaauugcuggaaucaggaugucuaacuuaaagggcaaagacacuaagaaacauuaaaggugguguguugcgcugacggagcacuuuucucucugccuuucaugcugcauaaggauucccagaugaucugcugagguaagaaguggagaccaaggggauugcaggcugaugcccacaaguuccuauuaugauuucacggcugagaauguccuggcugcuguucuuacugcucuuaguguauaucguagugcccauuagaaaguucaauuugggguagaaauucuuguaaauuucuaauucuagcuuugaacuugcuguauagcugaggcuggcucucaacuccugauccuccugccucuacuucccaaguauugggauuacagauaggcacuaccaugcuuggcuaaauuucuaguuuccucaagggccccagaagccagcucgcuccuuaggcuagagauccauugcaaagugguucucugaggacccaggcucaccucugggugaagcacacccuugcugggugccuuccauuucccucuccaggucccccugcuuccuuaaaggucuccaccgagaucauccuugccucacuccgcaggccuggcagaagaugagagguguaggaugagccugugugcaggcccagcuucagcaguguccagcaugcagccuaccuggcuuuauuccaguugaaucuuuaccauuguguuuuugugccuagaugaacauguaugugcugcacccaacagggaaggacuuuaugagaccuaaaaaguacugugauucuaccuaccagguuguuuuccagcaucagcugauguucauuguccuuauaaccacagaagugacaguauuauagagucagguccauguuaacaaugaaugcugccagguaugguggcacacacuuuaaucccugcacuugggaggcagaggcaggcauaucucuaugaguucaaggccagccuggucuacauggugaguucuaggacagccagagauaugcagagaaucccugucucaaaagacaaagaagcuugcuuacuguaguagucagauuuauacaugcugaucuaacuuucuuaacugucccucuuuucuaagguccuggaugccucaucccugaguuucaacaccagguugaagugguuugucauaugcuuuguugcuggcauuuucuuuucauuccuugugaguuaaggcauugucuuuuuuaauagucuuacauuguucugaaugaauauuuuaauuuaaaacaaacagaaguagccugcuguaucuaaauguuagauuauuuugauggaacacagugaccuuuaauaaguguguaaggauugauuaaaaauaaacagaaauuaauguuaugguaauuuggagaaaauguuaaaauuguauuuggaacaccaauuuuucuugaaaaccagacagucaaugauuuagcuguguugcaguaagccuguuuuaacuuggcauucaaaugaguacuuaguuugcgaccagugugaagacaguucugcuagagcaccucuguagacacaagagauacacgagacuguauuaccacaguuguguuugggcacuauuguaugguacuuagugucagcugcuggaggagagcuuucuaguucuggguucugaaggucacauuguuaucuaacuaacuauaaauucuacuuuagggaacgggguugcuauggcuucccaauggcaugaaacucuuugcaguauuuuacacccuuggaaaccuugcugcauuggccagguguguguauacuuuggcuucuuaaaaugccuuguuuacuuuugguuccagauuuucuuucuaauaggucuuuguaaguagcaugcuucucuugauuguuuauaaugucaauuuugcagcaaaauguauguucacucuguaauacuacuauuguauugaguucuggggauacugaguggccagcagugcauuuggggagcacagaggccaggucccaggcuggggucugcuccagggcucaacuguguaguugucgugacucuuguggagugaagguuuugugaggaagagcacacacaggaagcuaggaacagaugugacaguguuggugcaguguagagaacuggagcuggcaagcagcagggacuggagcugccgggugucuucugagagagagcauugcuguggggaugaguagagcaucaggccacuugugaugcuuuagcaacaugcuucagcaggccgggaguccaaagucaucugcugagagcugcacccuguagcccugagggcuugcacgcacuuccauguuuggcgucaccucagggccuugcuuccacccauauggggaugggaggcagucuguggccucuuuacccucaugccaucauaccaguaucauguuaaguccauagcaugucuugaaguguccuuucaaagguaaggggguaaaaacaagcaugguggacaugcauguaauaccuguuuucuggaggagaaaacagaacuauugcaaagucuaggccagccugggcuaguagcaagaccauaugucaaaaugacaacaaaaugaaaguaacugcucaguauucagaagggaaggcaagaggauugggaguuuauggccagccuaggcuacauagaaagacccugucucacaggaacaacaacaaacuaagguaggggagaaguucccacuacagaagggugagguguuuaaggccagccuaagcuuugucccaaacagcaacaaaaacaacagauccacagacacguaaagcaagaaauaaaacaacucauacaguuuguuuuauagcaauuuuauuucugcauagccagacaaauuacuagagccaucucuuacuuuguuucaaauaguacaugcuuuuuaaugggaccugugaagcaacugaagaaaauguuugaaacaacaagauugcuugcaacaauuauuaugcuuguaaguaaauaauguuaauuuuauaaacauauuaaugacuuuucugcauuauugcugagagagugagugugugugugugugugugugugugugaggugggguaacaggauguuaaaggaccuggcuuguacagcacuguuuaguguaauuggcuggguggaagaugcuucucguccgucgcauauguguuguauagcuggaaguaguuaugaaaaucagcugucauauuucauuuuuaagcccuacacauguugggaugucuguuccucggggagaaggugcaguacuugugaacucauagcaaucuucucagggagaauuggaauuguaacuugggugguuucuaucuucugcuguuugcugacuugacuguuguugugggacagcuucucagcagugcucugaguugagucccaucaugcaacaggcucuuauuguggcugucacuauggcugucacucagugcugguuguugagucacacuguuugcaggaaaauguugaaugugaaugaaguugcugcacacccagacucugccucacgguaacggugaagacgacugcugccucagugcagaaucagcaguguuaggugcucucuggguagagagaggaaagcugaaccuuaggccccccaagcaaacccuggccccugagcugacgaugcugugacgaugugacuggggacacauuaagccuucccagguuaaacucccacuucuguucuccccagcccguccaggugccaugggugugcagcaggcucaugcagucuccugugugaagcauuguccagcacuguaaaggaaacaugauagagcaugcuggugcuguuagcacugccaugagcaucagcaagacacaggaauagccucuugcuucucuaaacuugacuuuccagucuuucccuuuacuugaccagcacauuauuuagggcuucaguuugcugggacagcggauauugcuucuauaggcuuuaagguggcaccagaguccauugucccauuuauuuauuuauucuguugcauguuauccaagcagaugaaugcagaaguuucugcauuuuuguugggccuugaagaaccucagguuucucaugaacuuuuuccuucccuguaguugugccugguauuuacccugugugcugcucuguggguaaguuauaucagccagucuggcuaucugcucacugucccuacuccaccauuguccuagaacaaaacugaggccaguuucaugaagcccucaagagagucagugucccauaaacagacguaaggugggucugcggucucuaaccuacccagagguuguuaagcauaggucccugugagcacacucaugcugagacugguugcuacucuaacagcguccuagacugggccuggguccucugcuuugccugcugcagacucugugugcuuugggggaagcgacagugugaaaagcucccagagaagguagguccagagaacaagcagaucaacaaauaggauuaaaaagaauuuccaucaggaccacaugugguggugauaucuuuaaucagcauccuagaggcagagaaagacagcucucuugaguuugaggucagccugcucuacauaguaacuuccagaucagcugagggcuccuugugugugugguugugccauaaggaagucagaggauaacuugcaagagccaguucucuucuuccacaaugugggugccggguugucagacuuggcaaacaauugcuuuuacccacuaauccaucuugucuccuccucucaacuuuaagggcaggggcuaguuguguagcuuagugguagagagcauuuguccagcuggagacaaguccuuagcaccugcccaccuucuuccccccaaugauuaggaauucucaagucaguuaucuuagaacauuguaggaacuucauauuaucccagaagacugcaguaguauaauugcccuuuuaaaaaacaaacaaacaaaaacaaauaaaacaaacucucugggugaugguuggaugcaccucuaaucccagcaccaaggaggcagaggcaggaggaccuuugggaguuugaugccaaaaugaguuccaggacagccaggacuacacagagaaacccugucucacaaaaagaagcaaaaccaaaaaccucaagaagccaggcaugauagugcaugcuguaaucccagugcgugggagauugaggcaggauugcuguagguucaaggccagucagggcuguguaucaaaacaucuccaaagaacaaaauauugaggguaaguaauuccauggaguuuuacgggguuuuaaaugcugauuguaggaaggguuacaucacuuuguagcaucagggucacaucaagcuauaaccuugaagcguucuauuuccagccuuugcauacagucacuuaugcuguguauuuuauaguauuuaagauaauagggauggcauuggaaaggaaauuacuuucaugggcaauauuuaaaguuuugaaauauauaaggauaaaaacaaacaaacaggauauccauuuuaaagcgaagaauugaaccugauuuauaaugcuacuuuuuaaaacuugaauguguuguuuguugcuaguggcggaagaaggggcuggccuuacucuucugcauauugcaguucuugucgaugaccugguaagucucuucuuauaccagcuauagaaugaaaacuguccaggauguuagaagcaucauuuagauucuagagagcccuaggaaaggggguagaggccuaugccugugauccagauuccugcaaaggcagauggagugaggcccauucugagcacugccucccugguacuuguagggagaguugugguaucagggugcacuggcuaugggggcaggcacagagggaagagaauggagcagaaauguagacaaagccaccugaauucucagaggaggaagcucauaggaugugcuuacaggugucaggugccccaggcacuccaccuccuguugcugugugccuucuuuccagugccacauccuccucacagccccaugcgacugacucacucugccuccacucacaggccugggacgccccagccagccacuccucaccugcuccccaucagagcagagcacguuuuccuugccuuuuucagcuuuguuguugugugucuuucccauugccugucaccuugcugggcucagcuccucuuguggcuguuucuaccuguccacugacagauaccacaucgaguauuucaggcucaccauguaagguugcuugacucuuucauugcaaugugaagaauuuaggcuaaaucacauaggcuacucucuuauguuuugcuuuccuuugauguguuccaguuggcuuuucuccagaaaguggucaccguacuuaguaauguuagcuuuugcuggaaagauaagagggugacuucugcagaaggccucagcaucagcaucgcugagguuuacuuagcacauugucuguucuguguaugugucagugacagaggaccugggcuccauccccagcgcagcaaacucuacaagcuguguaggaggcagucuuguuacucggagcuguaggucucggaaaguugggaucuuccacaaguucccaaucaaugcuauugcccgagauggagucacaguuugaggaccacuggccuguguucugcagcugagguggcuacaguagauguguccagugggaauaggcgggcuugguguagagaaaaugucaacaugcuugacucucucuugcagguacagucuguccuacaucccguaugcaaggugagcuccaaaucccauuguacuccugaacaugaguuuaaauaauuuucacauuaagcuauuuauggcuggacaugguagcacaacuuugugaguucaaggcuuaucugaucuauauagugagcaccaggccagucaggccuacaaaaugagacaacaacaaaauuuauaggaggcuuuuuuaguuaacuuuguugacuuuguugcuuuaagagaguuauuuuuaagaacgacuagaaagcuuggcucacagacugccuucagguagaugaacaucuugcugcacauagcagcuggggcggcgcuugcuccugccuugcuguaugaacacuaacagggaauuugaaaagaaaucuggaccuuucuauucagugcccaaguggcagagacuccagcaagaacaauucuauuuuggaaaguuauagggaaguuaggguuagggaaucaagguacauuaauguucuuagcuagcagaaagugcucucuucugcagguugggggccaggggugauagaugggugaauguacagauccaggcagccaguguagucuaccaugcuguuucuuugugcuuuucuagaggaauucaugaugauuuaguuguagaagaaaaccaugaugaguuaauuccaaccuuagaccugauagauuuggaaaaaacaauucuggugaaguagggcuuugucucuggaauuuggaaacaccuacauauuuaaaagacagcagaguuguauaccuaaugugaacaguggaagacauuguuuuuauuccaccucuuacugugagugaguauuucugacaaacacauaagaggagaaaacgcaaagcagggugagcugcaggaaggaggccccgggcgagugcagaggcgcauguggagcggaggagacacugucccugcgcauccaagccagggcucuggggacacggcacagcugcuagaaggugaccaugugccccagcagucaaggcuucuggcuggagagcggcaggcaacaugcagaauacauuacaaauuuuuuaguggguguuuuaaacagcaaguuguuuuuguuuguuuguuuguuuguuuuuuaauuaaagcacauuauguaaugguuuagacacuuagagaagaaaacaugaaagccgaaugaaguuuaucccaucauuuuggggauuuuuaggaugcagcacaaagagucacuguaugucugcuuccuugucucuggagcaagcagcuucgcucacacuuuaccuccaugauguccugccucacucuggccagauuccaauggguaaauaaccaggauacaggcugacuccauauaggaaagaacacaaguggagcuugccgcccagaaauggcuuuaucuggcucacauuuccagguggcaguccaucucugacagaagucagggcaggaacugaagcaugaagcauggagagccacugugugcugcuugucaggggacuuagguguggccagcuuugccauaagguucaggagcauuuccuggggacuggcacuguccacaguaggcugagcccgccuguaucaauuaaucaaaacaguccccacagacaugcccacaggccagucugauccaucaaccccucaccugagauuccuucucaguugauuguuuaagccgaauaggccaggcgggaggauucuguucuuucuguggcugacuaaaacgccauugugggggcuggagagcuggcucaggagugcuugcugcucuucuggagguggcucauccaccugcaugucuagcccagcaccuaggggucuguuugccuuuucuggaguccgcaggcacccacauucauggcagacacacagacauauacaacauauacaaauauaaaaucaguauuuuaaaaaccaacucauuuucuucuuccauucacacccacuguuggacguguuggcugacuccauagcuucgcuguugugaccaguacaugaguaugcaaguuaaaaaaaaaacacacaaaaacauuaauucuuauaaaaacuuaauucccgggcuggugagauggcucaguggguaagagcacccgacugcucuuccaaaggucaggaguucagaucccagcaaccacaugguggcucacaaccauccauaacgagaucugacucccucuucuggagugucugaggacagcuacaguguacuuacauauaauaaauaaauaaauaaauaaauaaaucuuuaaaaaaaaacuuaauucccagauuauuuuguuauugagagucauuucuuuuauuaaaaucaggguuaugugcuaguaaaaauuccuguaauaaauaccauuucaaaaauuagcaagaauacuucaaaagcacuugcaaguauucugagugaaucucagcaaagccuugguucuuuggaaaccaggcugcagaguccagcccugcuuggaaguugcuaguauguggugggacgcugcugaugcucccgcacccugcugcuucauggcccuuucuccuuccuucccucagggacgcggugcucaagugcugcuccucacucuuggguugaaagucgcaggagcccaggaggagugcuugggaacagugcugaugcggugccugcuccagugaucgccucagaagcagcagcagcagcagccucagcccaugccauggaccgcugcaccucacugcacggcccuccauucccugcccgcuaaccucugcuuccaaagacaggagggcguaaucauugccacuuguaaauaaguuuuacucaguuuuuagucuuuacaaacagcuuuugaaaugugaauauuuaagguauaaaccuguguuguaagauauauccagcuuauuuggcuuuuuaaaugcucuacaacuuuaaaagaauuuuuuuuuaacuuuaaaaaugugaaacuuuauauacuucaagcuuaaaauuacuuauuaaguguaauaaaaaaguaauauauguaucuuuacaguuuugaaauaaacuacucuuggaaauguaacauuuucuggaucaacuguauaauacauuaaguagcuuagcucaaagaaacccagccccagcucugugugacguguagccucugucugugugacaggaugggcaugagagaaaaccagcucucaagucaagggccccacauggccacuuggaaucccagcucuugggagagcagccagaaguacacagugaggcuccacaugggagcucggagugaagagcagcuggugcuccuaaccagaguuaaccaaguaaacaacccaccuacccaaaacagcauccaagggcagggggaggaggggcugguggucagaagguggccccagaggugccaaggaccgccgacugcuuucaucccaggauagggaucagggaggaggcgggagaagagagcuggcuuugggggggcaacaggaugugaggaagcagugacuugcugucuccuucaggucuccacaggcugacaguggcccaguggcagcaggaguacacuuguggggacagaaugaguggcucaggcaggugcagaugaagaggggaggccuccucagugguguauggaagaaucgcucaucucugccuggugaguggcccagcaagcguguaauggacacgagguggagaaggugcagccauugugggacguucacucugcucagugucucaacguacagaaaugguaagaggugacaggugacuugggcacccugugcaccuggacaccggagagaugacccugcuuaggaauaccugcuuuugggcuggugagauggcucaguggguagagcacucaacugcucuucugaaggucugaaguucaaaucccagcaaccacaugguggcucacaaccauccguaaugagaucugacucccuuuucuggagugucugaagacaacuacaguguacuuacauauaauaaaaauaaauaaaucuuuaaaaaaaaaaaaaaaaaaaacuugcuuuuagccgggcggugguggcgcacaccuuuaaucccagcacuuggggggcagaggcaggcagauuucugauuucaaggccagccuggucuacaaagugaguuccaggacagccagggcuauacagagaaacccugucucagaaaacaaaagaauacuugcuuuucucuagagaaccaguuuaauuccuagcaccugcagaguagcucacaaccaucuuuuaauuccaguuuuaggggaucugcgcccccuccuggccugcggaggcaccacaugcacauggugaccagacacacauggugccagauaagaacucgagcaccccugcccaauagagacucuggguaccuugcagaagugugggaugcacagagguuccauccuguggcaggugugcugugcugcucggcaccugcugggcucacugacagaccugcugagagaagcaggucuuagacaauucccauaugggagugaaggaaagagccugcauuucaggcccagggaagaagucacaagccgugcuccccacaggugccuggcuccucuaaugguccuagccuguccaguuggcuggauucugguaggccaagcccugcugugcacuuuacuguauggaccacgcccuucugugcacuuuacugugccacuccuuugagucaccuuguucuccuucccuggaugucacuugcugugucacccauaccuucuaaagaaaacagaauuaagggguccccuucgaaaaauaucuccaaguagacuuuaaaacccagaugucugcucaccuuguucccuguccugacuguauagccagucucaaggaaggguuuuuucagaaccugggagagaaagaagcagaggcuacuuggaagagcugaaucuggguagccuagcccguagcccguagcccguagcccuugggaguucuuccugugcaagaaucucacagaaguggcucacagaaagcaauacucugugaggggcucaguacuaguacaggucccagggcaagguaaguaacuuugaauagagaugucuacagaggcagcagcguggccuuaggauggagaagugggaucgugggauccuaaacccaccuauguggagacaugugugaaugacaggauguugccuuugcuuaggacuugccagauaggacaggcccuuagucccaggccagauggcagcagugguggcagcuugcaugggcauugcaagauaugggguagugcugggaaggauucagacuuggggagcacaggcagacccugcagcagaguuggggggcaugcacacuugauguguaggggcuagcagucacagguggggcacuggaacacugauauuuaaguagacccaaucuagccuuccaguucagcccugagccugucggagaguuugcagggcugcuggugggaggaacagagcagacugaguuugaguccucagugggagggaggggacaggugggcugcuaugccagagggcacagcuguuacagugugaaaguugucaucaguuaaggucgggcugugaggugaugugguuaaggcauaugccagcucucuugucugccggccagcuaacaucacuuuauacuagagaggaucccgccccuauccccacccccagauccaugguagggcccacaucaggagaauggguguuauagacaggcccuaagggaucccaucacccauuaaaagaauuuaguacuuucuuuaguaucccguugccuuuccaaaaccuccaagguguggaaugugugcauaauaccgggggcccggauggcuuaagaagguuauuuggaacagaggcaaauggcccuccucaccaggaauguccacacuccacuaucuuguggagguuugagcauugcaaaggugugggcccuucacaguuuggacaagagcuccacucagcauuuuuucaucaucugagaguugcaauaggcuaggcuugcuccucuguaggauaaccagcagggaugaauggcugcuggugcuugguaaggagcacucuguaggcagaccauucaaaaaggguccaggcagcugugcaucugugggaggagccugcaguacaaggcagagaacguucuuacuuugcacugagccugggaugcccugguuuaagaugagccccuauuagagugaccaguuccaggauugaacgcuaucggcaugagacaguagaguguucuuugguggcagaugacagucgcgguuaauguggcuucuggcagcuucucacccugaccaucaaggguagagucagugucagaauccccaacagugaccuggggaccuguacuguggcagcucugguuuccaacagccagaagaguuagguuggcaggauccugaaaacgaccagccucaggguggggcagaggcaaguauccagugcccuguuugcaagcugcucuggcuucacccacacugguguggccugagcaaacacucuguucuccucuuuccuuuaaaugcugccuaagccagcuuucgaaauauaaaacuaucaggaaaauguuugugaggucguuugaaauaucagugcuugugcaaagcaucuauggcuuguacucaguuucccugguuccauagagugcagggugggaugacugaugaugguaacaugugccucuaucccacccagaugugcuuccugcagugucgcugccccuagcccacagggaaaugacuuaggagacugcuucaaacuggggugggugggggcagguuaaauuccccgccggugggggcucucaaaacacaccugccguggcaaagggaccuggguguaaucacuuuacucauucugaaaauaucuuuaagguuguuguaguggcuauuccugguugucaacuugacaauauuuggaaugaacuacaauccggaauuggaaggcucaccagugacccuuaucuggaggcuuggagauccuuaucuggaucuugguuugaagaucuugagccauaguggcuauggauuccagaagauugaaucuccaaguuaaggaacacaccuuuaaucugggcuaugccuuucaucugggauuaaaggugugguggaacacaccuuuaaucugggcuacaccuuuugcuggagacaauauaaggacauuggaagaagggagucuagcucuugcucuugcuccuucgccugcuugcugcgugagacugaguaacugcuagauccuuggacuuccauucacagcugcgacugaaccauuguugggaauugggcugccgacuguaagucaucaauaaauuccuuuacuauuuagaaauuauccauaaguucugugacucuagagaacccugacuaauacagaaguugguaccaggagugguucuagaguaacagaaguacaggaugaaucuuuuaaaauacuggaauuggcuuguugauccaccagcacuuucaaauauugaaaccucuccagauucucucccuccugggagcucagagaauuuugaagacccaugguugaaacuauauuccgaacuuaaagaagcuaaugcccuugauuuucuuaaugaauuaggugauucagugcacaaagcuuucuacaagauggggaaaaaaucgaaaaaugauuuuacuggcuggcugcucuuaguaucuguggaaaaaaugaugaaugaaaggaaggaguugugugauaaaaucgaaaggcuccagacacaaguaaacgaucuaaaaguugcuaaguguguccuugaggagaaucuucucucuuguagcaauagagcucaaguugcagaaaaucaaacagaaacucucauuguaagguuggcugaacuacagagaaaauucaagucucagccucagagugugucgacaguuaaaguaagggcucuaauuggcaaagaaugggauccuacaacaugggacggggaugugugggaagaccauguugaagcugagaauuuugaauccucagauucucaaggguuugccccaccugaggaaguaguacccucagccccaccucuugaaauaaugccuuccccacaugaggaaauuaauuuugcagagucugcucacggcccaccaauaguuucuucuagaccuguaaccagacucaaagcaaaacaggcuccuagaggggagguagaaaguauaguccaugaggaaauucgcuacacuacuaaggagcuuaaugaguuugcuaauucauucaagcagaaaccuggugaauaugugugggaauggauuuuaagggugugggauaaggguggaaggaacauaaaacuagagcaggcugaguuuauugacauggguccucugaguagagauucuagguuuaauacggaagcucgcauaguuaaaaaaggugucaaaaguuuguuugaaugguuggcugagguguuuaucaaaagauggccuacuggaaaugacuuggagaugccugauauuccguggcuuaguguugaugaagggauuuuaagacuuagggaaauugcaaugcuagaguggauauauuguguaaagcauaauuguccacaaugggaagguccagaagauaugccuuucaccagcucuauaagacgcaaauuggugagaggggcaccagcacauuugaaggguuuuguucuuucccuuuuccuugugccagaucuuagcauuggagaugcuucugcucaauuagaugaauuaaauucacuggguuuaguuggaucccgagguaacaagggccagguagcagcauugaaucgccggagacaaggugauccuaguuauuauaauggacagcguagacaaaagaauguuuauaauaacauacccaguaauggucagcacaggagaggugaaauuuauaauggcaugacucgcuuggaccuuugguacuggcuaaucaaucaugguguuuccaggaaugaaauacauaggaagccuacugcauauuuguuugaucuguauaagcagaaaaauucucaaacaaaugaaagaaaggcuacauuagaucgugguaaacagcaaucucggccagugaaucaauuuccagacuugagacaguuugcagauccggaaccccuugaaugaagggguggccagguuccccugaggaaggaucuugauaagacacucaaagguuuugcuguuacccuuucuccaguucuuccccagagggaccuacggccuuuuacaaggguaacuguacacuggggaaaaggaaauaaucagacuuuucggggucugcuggauacugguucugaguugacacugaucccaggggaucccaagaaacauuguggcccuccaguuaaaguaggggcuuauggagggcaggugauuaauggaguuuugacugauguccgacucacaguagguccaguagguccccggacacauccuguggugauuuccccaguuccagaauguauaauugggauagauauacucagaaauuggcagaauucucauauugguucccugaacuguagagugagggcuauuaugguuggaaaggccaaauggaagccuuuagaguugccucugccaaagaaaauagugaaucaaaaacaguaucguauuccuggaggaauugcagaaauuacugccacuaucaaggacuugaaagaugcagggguggugguucccaccacaucuccauuuaacucuccuaucuggccagugcagaaaacagauggaucauggagaaugacaguugauuaccgaaaacuaaaucagguaguaacuccaauugcagcugcuguaccagauguaguuuccuuacuugagcaaauuaacacaucuccuggcaccugguaugcggcuauugaucuggcaaaugccuucuucucaguaccuguccauaaggaccaccagaagcaauuugcuuucaguuggcaaggccaacaguauaccuucacaguuuugccucaaggauauauuaacucuccugcccugugucauaauuuaguuagaagggaucuugaucguuuggaucuuccacaaaauaucacauuggugcacuauauugaugacauuaugcugauuggaccaagugagcaggaaguagcaaccacuuuggacucauugguaacacauaugcguaucagaggaugggaaauaaauccaaccaaaauucaaggaccaucuaccucagugaaauucuuaggaguccagugguguggggcaugcagagauauuccuucuaaggugaaagauaaguuauugcaccuggccccuccuacaaccaagaaagaagcacaacguuuagugggucuauuuggauucuggagacaacacaucccucacuuggguguguuacuuaggccuauuuaccaagugacucggaaagcugcuagcuuuguguggggccuggaacaggagaaggcccuucaacagguccaggcugcugugcaggcugcucuaccacuuggaccauaugacccagcagauccgaugguacuugaggugucuguggcugauagagaugcuguuuggagccucuggcaggccccuguaggugaaucacagaaaaggccuuugggauuuuggagcaaagcucuaccaucaucugcagacaacuauucucccuuugaaaaacagcucuuggccugcuauugggccuuaguggaaacugaacgucugacaauaggacaccaagucacuaugcgaccugaacuacccaucaugagcuggguacuaucagacccugcaagucauaaagugggacgugcacagcagcagucuauuaucaaauggaagugguauauacgugaucgggccagagcagguccugaaggcacaagcaaguuacaugaagaaguugcucaaaugccuaugguuucuacuccuguuacaaugccaucugcugccaagcaugcaccuauagccucaugggguguucccuaugaucaacugaccgaagaggagaagacuagagccugguuuacugauggcucugcacguuaugcaggcaccacccagaaguggacagcugcagcauuacaaccccuuucugggacaacacugaaagacacaggugaagggaaaucuucacagugggcagaacuucgggcaguacacaugguauuacaguuuguuugcaagaagaaauggccagauguacgauuauucacugacucaugggcuguagccaauggauuggcuggauggucagggacuuggaaagaucacaauuggaaaauuggugagaaagacaucuggggaagaaguauguggauagaucucuccaaaugggcaaaggaugugaagauauaugugucccauguaaaugcucaccaaaaggugacuucagcggaggaggaguucaauaaucaaguggauaagaugacccguucuguggacagucagccucucuccccagccaucccugucauugcucaaugggcacaugaacaaaguggccaugguggucgagauggagguuaugcuugggcucagcaacaugggcuuccacucaccaaggcugaccuggcuacagcugcugcugauugccagaucugccaacagcagaaaccaacacugagccccagauauggcaccauuccucgaggugaccagccagcaaccugguggcagguugacuacauuggaccacuuccuucguggaaaggacagcguuuuguucuuacuggaguagauacuuauucugguuauggauuugccuuuccugcacguaaugccucugcuaaaaccaccauucacggacugacagaaugccucaucuaucgucaugguauuccacacaguauugcuucugaccaaggaacucauuucacagccagagaaguacgacagugggcucacgaucauggaauucacuggucuuaccacauuccccaucauccugaagcagcugggcugauagaaagauggaauggccuuuugaagacgcaguuacagcgccaauuaggugguaacagcuuggaaggcuggggcagaguucuucagaaggcaguauaugcuuugaaucagcgcucgauauaugguacaguuucacccauagccaggauucauggguccaggaaucaagggguggaaaacggaauaguuccacuuacuaucacuccuagugacccucuaggaaaauuuuugcuuccuguccccauaacucuagguucugcuggcuuagaaguuuuggcuccagagaggggagugcuccuaccaggagcuacaacaaacauuucauuaaacuggaagcucagacuucccccuggucauuuugggcuucuaaugcccuuaaaccaacaggcuaaaaaaggaauaacaguguuaggaggggugauagauccagauuaccauggggaaauuggauuaccucuucacaauggugguaagcaagauuaugucuggagugcaggagaucccuuagggcgucucuuaguacuaccauguccugugauuaaagucaaugggaaacuacaacagccuaauccaagcaggaugacaaaggacgcagacccaucaggaaugaagguaugggucaauccuccaggaaaagagccaagaccugcugaggugcuggcugaaggugaaggaaauacagaauggguaguagaggaagguaguuauaaauaccaauuaaggccacguaaccaguugcagaaacgaggauuauaaaguaauaugaaugcccauuguaaauuuacuaaugcguuugcgauuguacgagggauaguuauaucauguuaggcguauuuacaaccuuguuauuguuucaugugaacaugagauauuauuugugucaaguugacaagggguggauuguaguggcuauuccugguugucaacuugacaauauuuggaaugaacuacaauccggaauuggaaggcucaccagugacccuuaucuggaggcuuggagauccuuaucuggaucuugguuugaagaucuugagccauaguggcuauggauuccagaagauugaaucuccaaguuaaggaacacaccuuuaaucugggcuaugccuuucaucugggauuaaaggugugguggaacacaccuuuaaucugggcuacaccuuuugcuggagacaauauaaggacauuggaagaagggagucuagcucuugcucuugcuccuucgccugcuugcugcgugagacugaguaacugcuagauccuuggacuuccauucacagcugcgacugaaccauuguugggaauugggcugccgacuguaagucaucaauaaauuccuuuacuauuuagaaauuauccauaaguucugugacucuagagaacccugacuaauacaguugugguaguuacuauacgauuauguuugaagucuggaaaacaaguuaauuuaagaugagaugauaaagaacucggacagagccaaggaugucuauuugggcuugcugacuugugcuuuuuuucugucaacucgggagaguaaauucagugaguauauggguuacuuuucuguuggugugauaaaacaccaugauggagguagcuucuaaacaaaagcguauguuuccagaagguuccagaaagcuggguuucuguuggcagagccagaguguggcagcaggaacaacugagagcucacaucucagacggcacacggggcagggagcugacucggauauugaugugagucuuuugaaaccuccgaguucccagcauccuccaacaagaucccgccuuuaaaucccccucacaaagccauuagcugggaccagguacucaaauauauggggggacauuuucagucagaucaccacauguagggaacguuguuagcccuuuuuuuguuuuguggugugugcauuccuaugcgugugccuguacuguguaacaagguuucgugucuucuucagacacuccacauuauaugaaauuccaaguaaauuaugacuauaaaaugaugugaaaauguguacuggucaacuaaucacuucaauauaccacacaucucccuuuaaaaaacuacuuuaaauuguuuuugcauguauuuacuuuuguauguguuugccuguguccugcaacagugcaugcauagagcaucagcgaacaacuuacaagaaccuguucuuuucuuccauugcguggcuuccggggaucgaauucggaucaucaggcuuggcagcaaguguguuuauccucugagccaucuugacccgcaucuccucuuugaaagucuuuuggucaccuucacuucagaugaccuccccuuguuccaacugccaccuguuaaauaaucccaccaaauggaaugcggaacagguuccuuaaaagucuaguguugugacugguagauacccgucccaugccuccuuucagguacaccugcucuuccuaacuucuugcaagaggcagagggagagggacagacaagaggcagagagggacaggaagaaaagugucacugauguauagacacuccucccagagucagaaguaugcaagcucuugcuaaggcagcucacaugaggugcugggaugucguccccugaggucgugccuggacccagguuuccugcuuccauuccuccugacucucaggggacggggaugcuuguagcucccuagguugcaggcuccugggcuagacagcaggcugcuaaggugacauggaacauuccaguaccuagucugaaccuaacugucacccugguaaugguucauuugcuccucugggcuuuuaacacaccagucucuaccaguuggaggugggguucacuuauguggguuccccaaccaacacacucuuccuugucuuuaguguaauagucacaucuggcucugaacucucacguggugcugagucuuguccugucucucacagcauuuagagccucuggaagugccauguccuucccuguagaaugggcaagguaauaggaaugcucgacacagaccuacaucaguauaugucaccucuuaaaguuauuagacugccuaccacccccaccucugaccuucaacccagccauuccuguuacuucuggacaccugaaaucuuaggaagcaaucugaacacgggcaggaagcagaggauuucagacaucacacauuuccacuagcacacgugacaucugggcauccagcaguuuguggcauuuccuccaaagaugaccuccccagcuguaccuacagaaauggcuccugacuccuuuccccuaauauucaaucugcaccaugcuuacaucuccauccccacaacuaccuagaaacuagaacccggacuaaaacgauacaagcgugcuucagugucuugggagcuaagcugcccauguucuaguggccugagcucaaggcagagcuggguccccuggcaggggcagaaggcuccugugagccagagagcucucuggaagcuagcgagcugccuuugcauagagggaaggugauggagaugccuguguauuugugggaccuaugccaacuuccuggaugcucugaugagaaaagcuuccgccccccacaaguucccuuggcuacccugggcugugaguguccaguugcuacuggaaaaggacaaacagaagaggaggggguggggugacuguuggcacaagacacagaggcuuacccacuuucccaugugcucacccugggccagagcuauucauugugcacggggagcagucuuuuaagucuagcuguuuguugcucccuuucagugaaacaggugcccgguaaaucccuuugacuuguaggugcauugucuucuaacuguugaauggcuagcuuauuggaucuuucaguguugugguuauguuuucauguauaaacagccagcuucccuuguuuguacaacacauggcauugcaggcagucacuugauaaaacagaacaugucauauauuuccuauguugcuauuguauaacaaaaccuugccuauucauagacaacaauggcuuuaauguguaaauaacucccaaggagugguaucuugggauacaaugcgggggguggggggggaccuagguagcgccuaaaagccccacccgguacuggcggcuuucucugcuauuccagauuggcuccaaauuccucuccggagucaucugaaaggauucucugucuaacgugcaggacuccaccagugacuuggugcuaccaguucccuugagaccuagcucucugcuucugauggacuaauccuucacuucucgagccaugggagaacgagagaggagagacuugggguacugggugccagcucccgccccugcgaaugucgggcacuuugucuccagcguucagcagucugcgauagccgcagccccuagcagcccgggacuuggcaagcccuugccagcgugcgcuccuccuccugccgcccggcccagcccggcgcgucucggaggugcgauccaggcgacauccagauucaccagcaguggggcggcugcuggcgugaccgaaggacccagcucggagcacacggagggagcucccgggguugccgaagcgagggaggggcgggaggcgccuucgcuugaaggaacugggagggagcgggagaugcugcggcugcuagcaggugggugugcggggagcgcgcggcgaucagcaacggauggggaggugccgggggucgccagaccaguggggcggcuccgcgcgcggcgacugagacccgccccacccgccccucuccuuccaggacacugaugcuccgcuugcucggcagagucaugucauuccugccuaugccgccgccgccgccaccaccaccgccgcccccccgaacuccggggggccccgcugcgcgccagcuaucccggagacccugugcgccgcccgcgccuucaccgcccgcugccuccgccgccggcggcgagaaaaagaggaggccgcccgagaugcugcucuccagcuccuggcccuccgccaccuugaagaggcccccgguacggcgcggccccggccuggguucgggcaccccacagccggcuaccuccgcacgcgucccgccccagcccucuccgggccguggggggaccucgaccacgugcuccgcgccccggcgggucgccugcagccacaucccagcgggauccaccgccucggggaccucugcgggggcgggggcugggcccgacgacgccacgcgcuucuccuugaaccucaccccagaagccauccuggucauccagaggcgccaccuggagaagcaguugcuggcgcgaccccgcaggcccuuccccacacccucugccgacccgcggcucccacugguacccuguccccggaccagggcuucgacccugcggagggguggccccaccaguguccccaacgcgccucuggcuguggcugucagcagccgcccuccccgugccucgcugcugccaggaggucugcaggccacucugcccagcccgugccccuccagccugcgcccagugcuuaaggugucgcugcucaaugagaagcacaaguacgaugaugaggaguacgaggaggagguggaggugguggacgagggccucgugcgcaagugcaccgaguggcugcguggggucgagucggcggcagcugcgaggggccgcacagggcaucuggacucgcugccacaccugagcacccugugaggcuaggugggccugugggacccagccuggcuugaagcccacggccgccuccugggcuccuugcacaccugggcucuugugaaccagguaggccagcaagggacaggacuauugccugguaccuuccccaggugugcuuauucaugagugacccacaggcuuuucuaacgccucaccacccaccuccugugcaauuaggucagcgugggacacaacagacucgccugacucuagcagcuguccccugcuccuccugcuccccgcccucccuaaugugggggucgggggaggaccugugaaaugccuucuaaccucucacccuaacuaaguauuggacccagagguccucugccccagguggcauuccacuuccuggggacucugcaagccuguggccaccgaggguggggugaucuucuguugcagaacuaggacauggugcuaucuauguauaggauuuguuuccuuacaagucagaaagauguuagguauuggaaacugguuaacuaaacuuguaauccagcaucccugaaacaguguacuguugccacugggugauccaggaggacuugugcuccgccugccagcuaguacucagccaucccagacacuuacacacacuccacucccauggcuaugcacaggcaaccccauuccacuagcugucaugcgugcaugcaugccuacauacacagccacgcacacaugcacacgauaacacacacauuggcucucacauacauguggauauauggccaugcagguagucacagccacacacaggugucuccaauggcacagcuggaauuguuuucagaaguuggaucaagguggggacaggagucaggguugucgucugcugggauugcaguuuuuauuugagggcacagcaaugucucccucaguagcuagggaaggaacuucucagcacagaggacgucggugggugaaagcaaggcagggcaagccugcccacggagcaguuugaggcggaagcaggaaguaguugugggccagggcaggugucucucucucaucacugugaagaccagugacaaagggguucuguaagcuguaaauaguggcuuuuaaaauccuauuuauuauuugaaugaaggguaaaacuccugucucuuaauagcugagcccuucccauuaacuggaggaugauucuuuuguauuucuucugugccugaguggauuuaaccccaaggauaagaaggaaguguuuguucuaaucagauaagguugccuguagaaacguaaugcauuaccucaauauuuuuuuaacuuaucguaugcaagucaauaaccaguuuaauguuugucuuguuagacuuuaaugugucaauucucgauuguauuuuaaaucaaagccuuacauuuuuaaaagaccaauuauauuuuuuccuuguagagaucuuugcgcucucucucucucucucucucucugucuccaucucuccucuccauccuucuuggugcaagcuuugccaaccaagaggccuuacagagggagcuacauuagacaccagaugaguuaaaaaaaaaaaaaaaagcuacuuauugauuuuaaaugguuaaugccaaaggggcaaaguuagcaacacuggugggggagggguggaagggcuguuccucuaggcaaguuggguggugagggcacugccucugcccuccagccuggcacagcacggcuuuaucccgucugcacucagcgcaaaugccaguacuucacgugcuuggcuuccugcccccagcagcccuaacaacaccagaaagcguuccugguaccuccuaaaggaguggccucuagggagaucuuccuuccccuuuggccaucauggaggucugcggaccacccuguccaucccugucugucugcuuugguuuucccuccccacugcucccucucacuuuuuaacuggccucagagcaaagcucaacguucucucuggcuggugaucaaaggggccccgugugccugccuggcucuucacuucagagaugggggcauguuuguguugggcggccgaugacucucuguaaggaaaggaaggccugcacgugacuugcggggucucuaccucguugcugacauucugaggacauuuucuagucacugugcuacaauuucuuaagguuuaaauaauaauaauaaaaaaaagcaauuggauaucgugugaugcuucuuggaaaaagcggauaaccauccagaaaggagccuucaaacacuuguaagcccccugagguggguccucacugccugccuuuuuaggccuggggaguucugggcucaccaaagucucuacuagagauucucuagauuucuaagaauuuuaagaacaaaagccuucugagaaugcuaguggauaacaacgaacuugggagagauugcaaauuucccaugagagcuuuauaccccuaacucuucauuccaaauacauucacuccacagaacgagaaaagugcauauaauaggcauguauuucaagaagauuaugaaaccugggugacaccguguccugcaugcauccaguaaaacauuugcuucugccuaacacacuuucuaucuuguaggccauccuagccagaaguccaucugaguaacagccuggguugcuacuggauuguguacuaagugugaccugucguuaacagcccauguagaaaagaaucgugaauguaaagucacgaaccguucucccucuuucccucauauguuuaagggauagguuggugugcauccuagaugguaaccuugcauguugccccgaccugcgggaauaaucaaucagcggggaccugauuauugagagagaaaugagaaagaaaacugugcaccaugcccaugguaugugccugugaguucuagaguuugacccugugacaucaucuccuccauaccuugugaaacacuuaagugggacacuuguaggacacuuagaggguuccuggcaucuucagauagguauuguuacuguuuucuuuaauuuguagaauagcaaucgaugccaaaaugucaggacugguagcuuugcgguuuccucugaaaaguuccaguucaguucagggugguugaucuagggauccugugaggguccgcguauguuaagcuuggcauuaggacacuuugcucuuuuuagcaugauaacuguaguauaucauucaaagaaagugucuccaucaaagcaagcagcccauuccuugaccucggugcacuggccauugcgacugugucgaauccguccauugguuacuuuaccccuugcuaugacaaacagcuaacaaacgcagcuuaaagaccagaggguuaucuuucucuuagcucacagccugccaggaucaaggacacuguggaggggaaguuaguuaccuggcagccaagagggcucauugcaucuucucuuaggaaacaaugagggggaaacacugaaacucagcuugcugucuccuuuuuauuuauuauuccauuucauuucauuuaaaguaccaaccuaugggauagcacugccuguauuccaagagggccuucucuucuguuaagccucucuggaacccccuuugcagaugugcugugucuucuaggugauucuggguugacaacuccaccucuuagaaacuugacagccagacacaguacuucuaaauggaaauauucuacccugugccuuaaagggacauuuacuagcucauuucaguagugaaauacaugcuagugaaauacaugcuagugaaauacaugcuaauaaaaugcaugcuaguaaaauacaugcuaguaaaugaaguggaaacuuaaggguucuuuggaaagucaguuggaagguguuuugcuggggcaaacauaugaaggaauguuuuguuaaaguggacacaggugugaaaggcuaagguagacucguggaggaacauuuugcugaagcagacacaggagagauuagucaggacucaauagagagaaagaaacacaccccaccccaccccaccccacccccaaaaaguucugguggugugcugcaguuuguugcugcuucagcagacucgagcugauuggaugcaugugcuggaggccagcacauggaggacaugugacguuuggagggcauaaauagaaccccauggagugguggagacagagcuuggcucgcugguacaacuagcuuugcaacacuuguggaucucccaucuuagaugauccucacuucccugagaggcacagcugagaacuucuccugguguuccugcuggccccuccugcugacucgagccaaggcugaggccuggcugucucugcaggucaugucaccaccuguugcuaagccaacucuaccgaacuugacugcugguguagugagguguuugcaaguggaucgagcuaccacugccuacuaacccaugaacugaacugcugauuuccagacaacacaaaugggaguugcuccaaagaaccuuucuaaacaguuccacuucucccauauccuuucuuuuccacucccucuggugggugguggguuacaagggagguuaaaacguuuaaguuacaaguaaaacacacccaaaagccucuguagcaucugcuaguuccuacgucgcucaaaagugcggagucucuucuucgacucaagauaaauucguaacuuugggccucuauaaaaacugguaaacaaguuacaugcuccugacauaaaugacacagaauaauauugcuguuucaaacgggagggacgggagcacagcaaagaaggauugggccaauaugagaccaacaugcagcugggcagacauugaguguugcagcuccgaggcuuggauguagcugcccugggcucagcugcccugggcucagcugcccugggcucagcugcccugggcucagcugcccugggcucagcugcuuugggcucagcugccuugggcucagcugccuugggcucagcugcuuugggcacagcugccuugggcucagcugcuuugggcacagcugccuugggcucagcugcuuugggcacagcugccuugggcucagcugcuuugggcacagcugccuugggcucagcugcuuugggcacagcugcccugggcucagcugccuugggcucaggugccuugggcucagcugcuuugggcucagcugcuuugggcacagcugccuugggcucagcugcuuugggcucagcugcuuugggcacagcugcccugggcucagcugcccugggcucagcugcccugggcucaggugccuugggcucagcugccuugggcucagcugccuuggacucagcugcuuugggcucagcucuccugggcucagcugcuuugggcucagcugcuuugggcucagcugcuuugggcucagcucuccugggcucagcugcuuugggcucagcugcuuugggcucagcugcuuugggcacagcugccuugggcacagcugccuugggcucagcugcuuugggcacagcugccuugggcucagcugccuugggcucagcugccuugggcucagcugcuuugggcucaggugccuugggcauagcugccuugggcacagcugcuuugggcucagcugcuuugggcucaggugccuugggcauagcugccuugggcacagcugcuuugggcucagcugcuuugggcucagcugccuugggcacagcugccuugggcucagcugcuuugggcacagcugccuugggcucagcugcuuugggcacagcugccuuucccuccagcuccccaccugcagcaaaccuggccuuucccuugaggucuccacgcugugugugcagcuuuccaugguggacauaccaaguuugggcaucuccagcaucccagggucucugcucugauuuaggguucaguggucucuuagggcuuccugugggaaauccaauccuucugcccauucccaagccuugguaaguuucuggaaccugggugcaaaccucuauaucccauaacuuuugcauuucccaugccacaaaaauugccuccaggcagaugcugcugcccgggucuguugccagcuggacuugccaucugguaucuuucuaccacagcggucguggcuuucaugcaccgcagcagcugaaccuuggaaaacacuuccuugaauagauguuucugaguggggaaagccuuccagcaaugacaucaguucagucucuccuuaaauaagcuugcauuuuuuaccagcuggcacacuccucuuguuuugguauuuauuucuaugugugugaguguuuugccugcuuauacguguaugcacucuuugugugccuggugcccaaggaggccaacagagggcacuggauuucuuagaacuggaguuacagacaguugugagccaucauguggguucugggaauugaacccagacuggaagagcacccaguguucuuaaccacugauccagcucgccagcucuuccaguuucucuuuagaagcuguuuugucuguauccuuguuggagucuuuaagcucaucuccacucuuuguauuuuccaaacagcacauucccccaccucuccaaucuuucuguucucuuucacuguagaucugaauggugagcaauagccuucccacagccugaauguuguaccauuuuauaacauuuccucaccaaacaacccagucuccccccccccccccccccccgcacacacacacucuauuuucuccagagacaguguugcucuguuuaucccugccuguccuggaacucacucuguagaccugccugccucugcaucucaaugcugggauuaaaggaguguauuaccagcaccccauuccauugcuuuuaaauuuagcuucccgaauauuuuucagccagguucucugccucuuuguacuccucccugaagcgccgauaguccacauuucucuuagucccuggucuuuggaagucuccuucacaugguucauuaaaccccuaggcuucaaauucuucuacauuucccccacaacuggguccaaaggucuauggaccacaugaucgcacccccaguccuccagcaccuggaggagccuuaguuaccuuccccauuucuguugcaaagcaccagaagaaagcauugaaagaagggaugggggauguguuuaagaucacaguuugaggcugcaguccauguaggugugacugacugugccaauggcuuuggcuguggaggcagcaaugugaguggccggucacauugcaucagucagggagcaguguuaacacacagcucacuuuccucuuccuggccagaaucccagcccaugggacgaugcugugcacauucaggauggauuugccgucagucaauccuuucuggaagcgagaaucuugugcauaucccacuccaaccagugacucaauauucucagacaguaugaacaagacaaauauccacaggugauggacuuucaucaggacagccuccagcgggauagaauuauccagagauucacuuggaaaagaaugucauuucugccggauccuguucgcuacacagaccucacagacucggccugugcgaggagaccuuugagggguugucuguccacagcaaugggagguuggaccaaucaguuccuuuuaaaagccacuaucagugucuguucaagcugccuuagaacccacagacuggggagcucaaaagacaagggcuuugccaguguuagaggugcacaccuuuaaucccaguguucaagaggcagaggcagcaagguuucugugaguucaaggcuagcugggacuagugagacacuguccgggacugucggacagucccuaaacccauacgaccuacggguaaggccuucucucagcccucauccuagaguucauguuuuuaauuuucucuaucaaucuugugggaacuugcucaauacaacucauuuuuaaagugaccaaauuuggacuuugcugauuucuguuugugacuuauuuuucuauuucuuauugugauuuuauuuuuacauuuauuuuuauacauuaaguaugugugucucucuguguguaguguguguguguguacgugguugugguauguguauguauauacaugucuguguauguauguguguauguaugugucuauaugcauguguguggugugugucugugauguguguguauguaugugucuguauaugugugugugguaugugguguauguguguguguguguguauguauguauguguauguauguguguugugugugugagguguguguaugaguguauguauguauguguguguguauguguauaugugguauguggggugugugugugcacguccucacauuggaccuucuaaucuguuaccagugauggugucugaaugagcccuaaccaauaauuuucuuguguuauuuuaaaaaacuauucuguccaugauucccccuaaguggucacccauucaggacaucugauagccaugugacugaagcuauccuuucaucagugaaagcaagcacucuccaguagucacuggccugccucccaugaguccuccugcucuguucccaggacccugauaugccagcagaggggcauguguggcauuccugggugucuaccuucccugcccugugcuggaguccacauggaguuagaucugagccuuagugagucuccccaccccuggauggagagacacagcccagggcccaggcuucuuuucugagcucuugccugugcccucagcuugcaugcaauuccuuggcccagcucuuaguuaaagggagacucugcuguguguguggugacuguccagucacagcauccuucugugaccauccugccccuuccacucacaugcccaaagggaucaauguauucccacuuacgcacccucgccaccccccccccacauccuucucacuccucacaccagggggucggucccaucugaauucagauggugguucagggaguacaggugacaacuuucuuacucauaucacagcagugaugggucccacacaguggugggaccacuuagcuaugucggugaagcauggguuccuuccucuugggcacugcuaaaagauucgcuugagugaagccagccgucugauaacaugucaaggaagcaagggaacacuggcaaccacaaaggggacaauauuucuagguggacggcauacugucaggcagugccugagccuagccacuuggcucauugucagccauuuagccuccccuugucucugcugucucccacauguggaggcugggccuggcacacaacagcaugauccucccuauccuccguccccauggugucuaauucucuggcacugccccggguugugagccucgcuugaccacaacaugugcagcccggggacaaucaagcuaaagaguccugagacaauugcugcugucugaauccucugguuguggugaugucacacucggggacaaagcacacccaaggcucaaugacuuuggacaaagggcccuuugaucaugcccgcuccugugucaggucuguagagaagcagcaacaguggacaugucaucuaaagagacccuuggaugcgagcuuacccaagaucacaugcauaaaugcugaaaaccagaaacgugggugcugcggacaguagcacccaccaugguguucucagauuuuucagccccgagggcucugggggcauguguuuucugcagguggugccuugucagaccuuuuagagguaugucuaggcugacacaucugcagccccucggcuaugccaugcugaugccccucaaacgaugggcauguguagggacuuaagaguguuauaguugcaggugggggaauggugugggcucucacaccagcuuaggaagaaaucagacucgggcccaggggaaacagacaucauccuguccaucacacuuccuuguguguggcuccacccacuguggagaacucgcagagaucugguugggaaaaccaaugaggagcugaggaaaggugaaguuuugaauugcaagacaacggacuggaagcagguguacuggcgguuuuaagucagcuugacacaagcuggagucauuagagaggagggagccucaguugaggaaauacugcccgagacccagcuguagggcauuuucuuaauaagugaucgauggaggagggcccagccuauuguaggugguuccaucccugggcuggugguccuggguucuauaagaaagcaagcugaaaccauggggagcaagccaguaagcaguaccucuucauggccucuccaucagcuccugccuccagguuccugcccuguuugagguccuauccugacuuccuuuagugaugaacagugauaugaagguguaagcuaaauaaacccuuuccuccccaacuugcuuuuuggccagagaaacccuaagacaaguugguaccaggauaguggaguauugcugugauagaccuaacguguuguuuagguagaggacugggaaaggacuuuggaacuuugggcuagaaaagucauugaguggugagagcucagggaacuauccugcaggaacuuggaagauaagaacauugagaggaaaacagacaaugaaggccuggcuugugacguuucagaggaaguaaagacuuuaccaggccuuuugugugaaagaaucugcaguucugguuagcuggggcuggagaaucaacugugauuagcaagguaccugaacuacuagaguaaaacuuuugcuuugcugggauacucgauguuggucagcuagugcugagaaauuagcagcgauuaagagaacagcaucauugaggggaaaucugggaagacaaaaaauuuaaaguugucuuccccucacuccccccaccacacacacacuuuuuuuuuuuuuaaagauaauauuucuguguagcccugacuguccuagaacucgaucuauggaccaggcuggccuugaauccuagagaucugcugggauuaauggugugugugccgccaaccucccagcugagacuuugaacacuuaaaagagauuugggguuguuaaagagauugaauguuuuaaagaggcugaacuucuuaauguguuggaauuuuugagacuuguggaacuuuuaaauuuauuuuuauacuauuauauuaauauuaauacuccaccuuagggauaaaugagaaagggaaaguucuaauuaaaaagugauguguuuguaugucaacuugacaaagggucaguuguacuggcuaguuuuaugucagcuuuacguaagcuugaggcaucugaaaagagggagucucaauugaagaaaugccuucauaagauccagcuguagagcauuuuccuaaguagugauugaugggggaggguacagccuguugugggugauacugucccugggcuggugauccuggguucuauaagaaagcaggccgagcaagccauggggagcaagccaguaagcaguacuuuuccagguaagaauuccagguuccugcuuuguuugaguuccuguccugacuucuuucaauaaugaacagugauauggaaguguaagacaaauaagcucuuucuucuccgaguugcuuuuuggucaugguguuucauugcaacaagaggaacccuaaaauagcaguagagggguaaaagagcuuuguauaggacacucaccuggcaugcauaaagcacggguuccacuccaguaccgccucagccagguuugaagacacacaccugcaaucccaggauucagggaauggagagagaucagaggaucaagaacaugguuggcugcaugcaggggcugaggcucuucugggaagcacugaaccuugccucaaaaauaaaaauagguuggagagcaaagugacggugguaugugacuuuaauuccagcacucaggaggcagagacaggccuggaucucuugaguuugagaccagacuggugagcuaguuccaggacagccaaaaauugcugcacacacacacacacacacacacacacacacagagucuugaaaaacaaacaaacaaaaaaaccaaaacgacagacuggagaguugacugugcuuaaaagugcuuaggacccaagucugguuucuagcacucuggagccacugagugucuguaacuccugcuccaggguaucggugucgucuucuggucucugcaggcacccucacauacagacacauaaguaacaaccauuuuuucuuuuuaaaaucuuaagacaaagaacacaguaggccugcuuuguguuucugaacaaggaaguuauugaggggagggcuggagcuaccuagcucuccugcaccagcuguccucauuaggcuuaaugucgcugugaugaaacaccauggccaacagcaucugggggaggaaaggguuaacuuggcuuacacuuucacaucaguguucaucacugaaggaagucaggacaggaacucaaacaaggcaggaaccuggaggcaggcgcugaugcagaggcuauagaggggugcugcuuacuggcuugcucuucaugacuugcucagccugcuuucuauagaacccaggacaacaagccuagggaauggcaccacccacaaugggcugggccuuuucucuucaaucacuaagagaauguccaacagauuuguuuacuuacagcccaaucuucugaagguguuucucaacugaggcucccuccucuuagaugacucuagcuugugucaaguugacauaagacuagccagccagcccaucagccaucuccaagccugccuggucugaggguguucacauggauucucaggggcaugcagcaaggugaccaccggcagcuugugugcucaguggugagugacugaaguguaguguuguagagggcagaggggaaggggaggcacuggccaggcagugcaagggaacagaagcgacuguaggguccacuguuuccuuacccagugacagcuguaaaugaggcaggggcugaagagcuggaugaagcccuugccuaggaggcccacaggguuuauguuccuguggucggaggcagcaguuaguagacaaugugcaaauggcauaagguuagaugacaugcgcagugggggaagaaaaagcagaucagguuucauuagagccaguguugggcaggacaaaauuaaauuaggaacucccaaguauugucacugggaaggugacugagcaaagacugcagaaagugucccaauaaacaccuguggagucuggccaggcagaggacaagggaccagaggaccugagccacaaaccagucuagaagaggccugggagagguaagagaaggcagauuaguccuuuaggacucugccuucagauagguuaagacagaaaugcauggggccacuugcccucucuaggguguagacaugguuaggaggcagagccagaggggucagggugugacucagugagcaccagcccagcaugggacugcccagaagaggagccaaagaugacccuggcacccuagucagguagcaugaggguguguguguguguguguguguguguguguauagguguuuugcuuauguguguguauaccaugugcaugccuggugccugggaggccaggaagccagaaggaggcguuggaugcccuggaaguggacuuacaggcaguugugagccaccaugugggugcugggaacugaaugcugguccuucacaagagcaacaagugcucuaacccgcugagccaucucucgagccccaggaguguuccuaauaacaugagccuacucuggguccugggagacuaccaagcacuaucuucucagugcauggcugcggaaaugcuccccaagaagaggguccucaaagaccuagaaagcugggaucauugcaagcacaucacgcugaaugaagacucugaaugguagcacccaggaacauggcuguaacagcucugccugacagacagcugaguucacagugguugcuuccucuguuuccacgugaaagaauaaaccguguuguuugcauuuccacaguuagccuaaguagguauggaagggauguuagcaguacacacugcucagcagcuuucugcaguaggccagguuggggguggggucgccgauaugaacuauugccaagcaguugagagcuagugucugaucccaacaugaaaaggaacucuacuuaggaaaaaaaggauccaaaaagagcaagaaagcuguagcugggaaaacucaagucucuccagaggcagagagaaugugccacagggccgaagacugagcccagggcaggacacaccaagucuccuccugcacucuuguuacuagggcugccuuguugugacaacagaguguccugaagccuguggugagucugccugaaugugacugugggacccacaaggucccagccucauugggugagcacggcugagauccuugguauagaggugggugggauauggagggaggacaaggcaggaggagcuggggcacacaccugcucucagggcaucugggcagcaacugcauaagcccagaaagacucuguggucugaugagucucuuuagggccuggggguggcaggucugggagguaaggacauugacaauagcccugacuuuagugagauguagaagguuugguaccugguggggaaaggggucauuugcaaaauuaaaucuagcugccggugucagauugccauccccucuaauuuucaugaaaacucagaaaaaucaggggguaggguuauagcccauuugacaggguggguuacuuaacuugcaugaaacccuugauuugauucacagcacaacauaaacuccaagguuccaaaccugccuuccaagugcugggaggaugcaggcagggcagaugcaggcagggaggaugcaggcagggaggaugcaggcagggcagaugcaggcagggaggaugcaggcagggcagaugcaggcagaggagcguaaugucaugcuuggcuguauaaggaauuagagggcagccugggcuauauaagacaguaucaaaaauauuguuuauuacauuccuagauucucuugguaguuacuuguguguccccacucccauuugaaugacaaagagcaacagugucaaaccacuuuccuuucuuccuaucuguucugugugagggauggacaugcucugcucaguccuggcugguuaaaaaaaccaaugaacccaccaaccuaggccagcagcagugcgucugguucuaggaggguggccggggcaugucaccuggcuccguagugagucuaccauaugaggcacuuccuaagacacugccauuauaagcugucugaagauaucuacccagguaaccuguagccccuguuccuuguccaccccucaugaagacacagucuggaggaaacguccaaguuuggaguauaaggggaggggucagaaaguuccagagaaaaacuaguucucaauaaacccggagaaagaugcugucugacuuccugcguaguugaaccaucucuaaagcagagguaaggacucaggugaacgaggcugauaaggcgucuggauaggauaacgcccuuccgcuugcagauagggggccggaggguagaaccauggacauugacucgggaccuuaacaauuccauuggcaaaugaugcuuugggaucuacagggagaaagagugucuuaagguguuggguucuccugagaaguuguacuuuguagccagguggguuugcgcucaguaauuaaagucacauggcgauagaugaggugccugaguccaagggcuguugcccugagggcuucccaucuccuguagcugcucucuucagucaggugacuucauucccuccccacagccauaggcugggccuaggccugccugugcuaaguguguucugucuucacaaguguaacuccucagagcacacccacaggccuccacacuuaccacaggggcuugaaucggccucuccugaguagacgccuagcacaaggcccucaccgacagguaauugcuuuaaugagcagccagagaggauaagaaacuauaucuaagcagaagggacaagugugucccaugacuggagccugcggagaauccuaguugcucuagcucuuggccacagaggugacauacucaaguaaauguuaacacagcuaaagcuccuuacagucaagucaagugcauguguguguguguguguguguaaaaaaaaaaaaccaaacuccacuccaugguccaaaagagucucagcaaaacugagaaaucaaaaucuuguucuaguuaggccccuccuugucgggacacacgccuuccggugguguggugaguucagguggaugaggaggaggagggggaagcagaggaggaauccaaagaagagggacgagggagagaaaccugaggaggggaaaggugagggagacuuggaacuccauuugccacauccaauccugcaggcagcuucccucagaaggugaggcucuguugcucuggcauggcugauguggcgugguggcuucacuagugaaaaagccaggaggcaucugcguuuguucuuggggcuccucuucccacacugcucuguccaggguuccuuugagauaggaaagccuuagggacuccuguguaucugcugcccagaaugccucucacgggacugcuugaccccuuccuuccucuguucuggaacauucauaucugagggugcagagacccagagucuguggcaccuuuggccuuguggaaaggagcacacaagggggcagcagccuggccucagaccuggugaaugggaguuuucacagagguacccagccauagcucacaaccaucuauaacuccagucucucucucuucugaccuccucaggcaccaggcaugcauuugguacacaaacacacauguaggcaaaacacccauacacacacaaaaaauuaauuuuuaaaaagaagagacccaaagagauagcaaacaaacaacuagcagcccuccugguuauuaacauuugcaacacacaaucauggggagaaacguccauggcgcgucuuaucgagcagcagccacacccuggcuucugcaggggcaagagaguuggaaauuaaaaggcacaguagaacacacaccuuuggaggcagcaaacaaacauggugguugucuguguagagggugguuuugauguuaaggcacuguuuucuaauugguuugugaucaaucaagaugucaggagccaauugcuuaaagcgggguagauuuaaaaaaaaaauuauccacuacaucuguggagcuuguccugugaacuccucgguguggauuucacaguuggagcaggcagcagacuuuaauggcacuccaaaccuguaucccaauuauagacugagagaccgccuauucuugcuuuuuuucuguccuuggcucagccaucgcucagauuuaggaggcauguuggucugguuuccacugucuguuuccaagagucauaugaugcuuggucccaguagaggccaccacacccagccaccucacugcuccauggucacagcaccaaggauacuggcccauuguucccacaggauguugcucccugaccccccucccaccucccucuuucucugaaguucugccgucaucaccggggcacccccaaccaagagagcggugcccaggggucgguaaagggcgcagagacaaaccauucuggagacaucuucagggaccacugcuuuauugcacacaagcaaccacuccaagugggagcuuaucagcugugauugauuagcauagugccuuggguuggagggauuguaagcucucagaccaccagggucuguaugcagaugaagcacauuaaagaugugcgaugugcagacucacgugaaggccagcuaccagccacucgcacuacuuaagacuucagcguucugacuucaggagcaggaggcgcucugcuucuuauuucaaagcacacugugcacaaguaggcugccugccuggucaugcccgcaucuuuugcuacaacguucuaccagacgacccugcaccggggccugauuuuuuaggcuguucuggccaaagcucuuucuccucuuuguugccaucucaaauccugcaggagucagcucaaggcuuucugugcccaucugagguuuucccucaucccguuucuuuccauugcuccuccaaagaccccaggauagcgaccagcacucuucucuuacauccuaccugccuuuugcaaaagcauagggaaaacuggucacaaaaagaauaaccaagagcaagaaaaggcaguguuugcugaacuagucaaggaggcaacaggugagucccagacagggcagcaugagggaggggcccuggggguuuagagcaguugaggcagauacugggucuuguugccugggguccacagggcaucacacucucugauaagugguaauuuuauagcauaaguugcucuucuugagacuugccauuuuguuucaggccaucaacaggucauugggagucaggcucagacaucuguguaagauguuacuauagcagugaaauaggaaaggcuugaugcucccagaggguuguaccugcccaaaagcucuggauucaccaacaaaacacacacacacacacacacacacacacaccagcuaauuuggauagcucaaugguugggcacuucugaaccuccucauagcuagcacacacuccccucugguauuucuagcuuaacaccuucuaaaucuauuacuucugggcagccuuccccagcccccugggaccgcuuucccuucccaccuacauuguuggguacuuucucuccugcagcuuuuucuuuucuuuuuaauugcuauaaucacuuuucuuuuuuauucaugcacagaauuguucaaaaacuuguguguuuuguguaugauguucaaagacaaaauaaguaauauaaaaugugcacaggcuaagugcacagggcaaaucaaacagaaaucaaauguaugcaaacuuguggcagucacugcaacaucucaucauauauuacaaaaaucauugccuuucccaaaucuggaaaaauccccaaauccaaaauguuccuaaacacuugagacaagauaugcacacaccaucucccucaggugugaacacaggugggauagaugugccaucuggacucugacauagcucaguggguaaagucacucguagccaaguuucgaagccugaguuggauccaacccccccagaauccucaugauggaaggagucaauccuuccgguuauccucuauacaugugcacauguacacgugcacacacccaaugcacauuauauaauacaggcauauguauauauacacacacgcaccuuuaaaacacaaaagcauccaauuuuuccucacacuaaacuggauuugcacugugcauucuucauuguucagggacguggggagaauggaaagguuucccugugauggacagccuguacagacaacauucacacgccacgacugguauucgcuuuauccauacaugucagcuccaccaaucugucauucuuuuaguauccauggcaacaguagcugcaucgcucaacagugagugcagagacucuucaaguggcccaccuagaccuuuggaucugaaagcccuacagcaucugcaccacuacagcaagucugcuggcacugugcccgagcccacaucuggcauuugguguccuuagaucaggaaugccaaccgggcucauagcacaugcuuagaaacccaggugccauuacugugaacugacauuagcaacagcugccauagcagucaacuucagacugugggacaggcuaugugcuggagaccuguguccugugucccgcccuugcuuuaggugguuucgagcagcacuguggggacuucuguggugguccacaggcaggagcucccuguccuggcauugugguguaagugaagacagaugcugcaaugagggugggaagagaaccauccuuucauggcccucauccagaagugaccucagcaugucaaucuaucacauaugcuguccaaacaggaaagggaacuacccaaaaaccagagcccaguggaaggacagccugccuuuaaucaaggcucagaaaaccuggucucagcagaugcaccagccagguguaaaacauucuagaaaacacggagggacaaaacacugacaaucuagccuuuugccuuuugcaccaggggcagguuacuugguccagcugacucugggaaugucauagugcucggugaguguguccaggugucacuugaaguccuccacucucugcuuguggguuuuugaugucuucuucaggguucuuuccuuuugcugcuccuccugcaucuuuucgaagccugccugcaccagcaugcguuuguccaggcagcgccucuucuccuccucgcucuucuugcguguccccauggccuccagcaucuuggccuugucuuuguccucaucuuacuuccuccuccuccccuucaucacaccaagcucugccacgccuuucaacuucagggggcccuucuggaccugcuuguacaccuccuuagcacucacugccauaaucacuuuucaaagugucccguuuucuuccugugacuucuacuagcagguugaaagagccacgcaguuccugagucuguaguccaacuaucccaacaaccagccgcuguagauggggaaugcaagaaucuaguaguuacuuguucucaggaggcuagcuguuucggcuggucuucugcagaaguagguuccaacagaugugcuggcgaguaaaugcgagccggugagaagagucuccugcaacccugaaaucugaucucucucccuccaggucauagccauucuccccuccucuucugucccuugcccucaaaaucuaaaaucccaccucugucucccugcccagccauuggcuguguggcaauucuuuauuaucaaucaaagccagcugggggcagggacccucagcgucuggaagcacgguuuuugggagccaaauuaagacaaagcauuagaacuaaucuccaauacaucacaaguuauuagaggucaagacacaagcaucuguggcuuuguuaagugucaaauuuugcuuuuuaaaaaauuucuggucuuuuguauuuaugcuauccaccgugucaaguuaaucuuuaaccaugguuggggauucuaucuacucuuacacgcuuggaaucaguaacggaugccggauacuuguguucaccacagaccugacaugcauagaggugacagaagcauguaggucccucuaggaggccaaggucgagagagaagcaggcugcaggguuaugggagcccagagcaaaacuggcuccuguaucaaagaccugugauauuguuguuuaugcuuguuuuauuuuuguuuuuucgguuuuuaaaaaauuucuuuauuugugugugugugugagagagagagagagagagagagaugaggaggaggaggaagaggaugcagaugaugcagauguagcaaguguggagguuaggggaaagcuugaagucguuccuucucucuucaccaugugggucccuaggacagaacacaggacaucaguuuguuaagccugagugaagaacauggaggcagggaagggggaggggaauuaaugacgguuuccaggggcagaaaauggcccuccaucaccuuugacagcugaaugucuguaucuggagccuagggauccaagacaaccacucugccccaucaaaugggacauuuuguucugcaucuuuacagccuucuguucucacugccuuuauuauuauugcccuauugcccuguuucauugaccucgagaguucucaccuuacugcugucuuauauucucacccaucucauccuccuuccagggucauuacccuccccccuacacuaccucucaaucagggucucuuggaaguuuccaggacauauccgcagcagagugggggccagggaggggcuucacucgacuuaagucagaacauuuaggaauggugccuuggacuucauuacuuuuagccaagcugggguuggaaaagggggcacaacaggccugauaaagaguuacccaaccuuccucaaagggcgguggccuggccagcaauagcagaccccaggggagcuggacaaucgcagacagagaaugcuucugcucucaagggugaucuucaccuugugagcuguaguucugcagagcugugaggccaugguuccauuccugaggaguagguucuccaaacccuuugagcccuccuccuccuccccccuccucuuccuccuccugcccuucuuccuccucaucuuuuuccuucucuuccuccuccuucccuucuuccuccuccccuuccuccuccuccuccuccccucuucuuccuccuccuccuucuccuccuccuccugcuccuccuccuucccuucuuccuccuccccuuccuccuccuccuccuccccucuuccuccuccuccuccuccuccuccuccuccuucccuucuucuuccuccccuuccuccuccuccuccuccccucuucuuccuccuccugcccuucuuccuccucgucuuuuuccuucucuuccuccuccuucccuucuuccuccuccccuuccuccuccuacuccuccuccuccuccuccuccuccuccuccccucuucuuccuccuccuccucccccccacccucaccuggcuccugcuccaguccuaaacccuagcuguacucgacuacaguccagcacagugcagccuugccaaauggcagcauuugcaaucucacagaugcauccucuucuuucuuuucccacuuacagaacgugauggguagucgcagcuuucugaaugugaaguuucagccacagguccguguguuugaacacuugcuccucagcuaggggugcuguuggaggagguuaugaaagcuuuaggcuuuggggagagcacgguugguggaggugggucauugaaggcaggucuuugaggggcagggcgcccccccccccggcucuucagauuuccugucugucgcugagaugugaggagccucaaguuccacugccacugacucuagcuguuccaucauguuggccccucugaaccacgagucaaaauuaggugcuucuaucggguauuuggcugcagcaaggaaagaguuugguccuggacuaucccacgagucacugacuaggcucaccggucacucaugcccccuucccagcccauguucaugcugcagacucugaugcugguccagggccugugucacaggcugugggucaucuucagugacauaagcucgcaggacuugggaugacaccuuacugcugaaaacugucucuccuuccugccucaaguuacugguuuccagagucccucggccaggaagcauucugucccauggagagugccacuccuguacagucuacugggagguuccaaauguuugauugugcucguuggggacuuuugaaacuggauucuuaaacagaggauaaccccuuuucccuugguacugcagugccucauaccgauguggccagcacuuacuggcccuuugucuccaggcacguggccuucauuccgugugggcagcccagcuccuggggucaccuggggucaccuagauugugccucaguuuccaggagaggcuauggguugcuuuuauggacagcucuggggauggaaugcagaacugugugccuguuagucagaaaccacccgcuaaguauauuucaaguccagcuaaguccuucacaugucauuucauauaguauuuauaugcuaaauuuauuuuauuuuaaccacauuuuaaauuucgacgaaacaagaagguuauaaaaaacacacgucaacucuucuugguauuagcuauagcagaacguuucucuguucaguuuucugugaacauuccuaguucugccaauuuccgugcuugccuucgcgagaccacauggaaaagcaucuaagugaacgaagcucagucugccucucagugcacauaugugugcaugugugugucggugagugcauguguguguggugugugcauguauaugucgaugcgugcaugugcgugugcguauguauaugugcauguguacauucauguguguacaugcaugugugugugccugaguguauguaugcaugugucucugugugcauauguguguagacagacucuggcuacuuuguggauucuuuuaucuuccacccuucuucaccccucuucuuccacacucucaacccccuuaacaugagguaggaaagaaaaaaggauagagaggaaaggggaugaugauaccauuaggcuacuuccugcucaugugugagugccuugugugcacaugcacuuguguggcuguguauaugugaguguguacaugugugugccuaugucucugccugugugucuguguauguguuagugcaaaugcuugugugugggauaucuugauucuuucauacuugccuuuaagaucaggaaaaccugcuccucugucuuacuauguuuuacuguguguaucugucuguauaaguucaugcacaugagugcagggccugagaggcuagaagagaccaucagauccucuggagcaugagcaguccuaugugggggauggguccaccuuaacuacugagccauuucucccuguaagaggcuucagcaguccccuucccucucuugcuuucugcuauucaaggauccagccuggcuguggacaucaccacauacuaguggcucauucuauucuuguaucccaggccucagaacuguuaugcgacagacuucuguccuuugagaaccagccagucugugugaugcugcuguagccucacaaauggaccaagagaaucggcuugcacauguacuggaucuuuuccuggggcuuuaucucuuuuuguuuuucauuuaacucuaccugucuuauuuuccuuuguaauuuuuccaaugaaaugauuaauuuuuaagauagguaugguaguguaugcguuuaaucacagcccuggggagggagaggcagagacagaggcagguggauaucugagauggaguccugucuggucugaagcaugaguuccaggacaaccagacaaccggagcugcagagagaaacccuggucucagaaacaaagauuaguuuucaacagcgccccuuuguucccucuggacacugauguuaaugugugcaagugugggcuugccuucuuuggcucgugagugagaggugccuguugaaugacccaugcuuggguaaagcucccagcuucaacucugucucagaaucugagaaucuguuugggaacacacuuggcuugcuuuggaggagugagcacacaguccuugcugccccaccagacccauaaguaccgcugaacauguucacaccugccugauuuguguacggguggaucccucugcuuucccucugcauaacuuuuacccaacagauguuuacuguguucuuucuagaggcaagcacgugaaagaaucugagcuaucccagucccacuguuuggcuacacacaguaguguuaacaucuggauaaaacuuaagugugugugugugugugugugugagugugugugugugugugagugugagugugaaauagaaggcugcuaacuaacucacagagugggugagggauccagagagcuugcucagugguuaaggcugcuauuccagaggaaucucaauucaauuccagcacccacauggcaguucgcagcugccuguaacuccaccuccugggcaccugacacccucacgcugacacacaugcaggcaaaaugccaaugcacauacaauaaaaguaaaucauuaaaauacuuuauguuuacggguaucagugcaauucccugccuaucugugcaccacguaguacggaugugaugaccaaucuggcucagagugacuuggguggccauugcauuuccagagcccuuguucauuguguuaaacccaucuaagccuggaagcaagcugucacacugaaaggcccuguaagaguacugcgguaggaagaaugcagaacccacaggucuggaugcaggcgcagcugcagcucgcguuuugcuuaaacauuuucauugcuguuuuugcuuuaagaacccgaguucucuucccucggugacugaaacaucagcaugcaaaugugucacgggcgugaggcagggaauggauggaagccagacccugauccaaaagccaaucccccuuucugcgcuagccccugcagcugucuccgguguucucgagggguggccuuuguucuccuuggagcccuugagucacgggggucuucuuccuuucucucuguucacuauugcugacuugcagggaacugguuugaaucuacugcugggcccugguccaauuucugcugucacugagaaagugggauggggucugccccccaacccccaccccggggucucuagaccggccucugacacaaggcagaagaccugccagagcaggcugcuagggcuaggccuguguagcccugcuugagauaucuucccuucccaccugcccuguggagguggcggugacaacuggagguuugaggaggcuggagguuugugggggcuggagauuuguggagacgggggggggggggugagggggggugguggaggaggaggggacaaggcagccaguuuucacagccaaacgaagcagcuuaaggagauaauggugacaggcugggaagauguugcuauggcaacacagcagcaggucucucuugggaugcugcgucaaauagcauacacacuacagaugaugucauccgguaucuuuuuggccuccucaggucuggcauauuuucccuccugcucagacucaccuaagauaacugaauucagcuucaggagaaaaucccgccagacaccuggugggugauccguccuugguauggcuaucucaccauggugacgcuaccugaugcagccucugcuaagcccggcaggcucugcucuucagaugcuagcuuuguuuccagagcuaauuaacgccaggcuacaccagugugcugugaaguucccugaagcuuccugggcccaaccaccugcucuuccaccucuuccugguuucccuccuuuccucaagcaggaugcuguucugaucuugccugcgaccuagcccucgaugcaaauguaugcuacauaguaaucguguguguguguguguguguguguguguguguguguguguguguguguauacuuggaacaaaagaugaaugagacaauauuuacccucacuguguaaaugaaaaucuuucccauaucacacagaagagagcacauuauuuucucuaucacauaugcuauuuggauggccauaccuacuugauuacaugaccccagugguuucguauuugggaugcccuguucaagucaugugccugacaagugauggcucagaccccucucuccucccuccccauuccaaggcugaaugggaggggcuagcugaugucauucuuucagggaguauaccaaagaugaugcagacaggaaguccuuccuucccucccauuguccacagguucguaagaugcuuaccuucauuguuuggccaaugaucaaaagaggaggacuuuguaagccuuaauaacucauuaaaaagaacacagccaaacuuguuuguuaauauagauccauuacacucucucucucucucucucuccccccccccccuuuccuccucaucucugucccuuucuuuuuauuagaagaauacuggauauccaacauagggcuucauuugugcaaagcagaggcucuaccacagccuagcauaaaagucuuggaagaaauucaagauaaagcguguggaaaggauuaauauauaucuacuucugauucuuaaguuaagucuuguuugggaccaggauacuaaaucaacaccuauuuccccaaauccacuaagcuacuagacuuugucaucaagaugcagugauaacuggggguggggugguggugguauacauucagcaccugggcucugggcucagcagaguugcuucaagucuaaagcuagccugggcuacauaaugaaacccugucuugcucgaccuaacaaacaaacggaugacaaagguucaguggugacugcagcaaauauuuuuaaaaguucaaauaaaaaguuaggaagaguuaagccacacuuuggagagaagcagaaauuugaucuugaguuugacaguauaccuguuugaucaugaguuaguagaucagcugguauggcuacaaucucagacuuagccuccaugugagucaaauaaauacucuacccucaggcacuguggugcacauacacgcagacaaaauacccauacacauaaaagaaaucuagcauuuuugguuuugagccuaaccuuuagugguugagccaucuuuccagccuaaacuaauuaaacaaaucaaaaccccaaggcauuuaauuggauguuuuugcuauuggcuucugccagucauaauuaggauuucuauugcuuugaugaaacaccauaaccaaacaggaaguugguagggaauuauuuggaauaacucgguauucaucaugaaggaagucaggacaggagcucaaacagggcaggaaccuggaggcaggagcugcugcaggggccauggagggugcugcuuacugguuaaccugcuuucuuacagaacccagaaccaccagcuuagggauggcaccacccacagcagacugggcucuccccacauugaucaccaauuaagaaaaugucuuaaagcuggaucuuagggaggcgauuucucaguuaagguuugcuccuuacucuagcuugugucgggcugacagacgagccagccagcacacugccccucccccaccgaauaccccagccuucacuugcucacguggcaggccccugccuucuggaggaaucucagugauccugagaggcaggaagauguuuuaggguuccaucacucugacaaaauacccguggaaaugagaaaggaaagauuuaucugggcucccaguuucauaguggagcaggguauguggacagcugaacuugugccgggucagauggcagcagaagggccugccugcgggauggaagccucccuucucagaugcugccacguggccugauauucuuuugccacucucuuugcuggcagcccaugcuccugguggcuccucaugcaugcguguguccguguagccacguuuccucucacaaggacaguggguuagaucggggcccauucugugaucucauuuaacucagugggccucuuucaaggaccugucuccaaaugcaaccauauucugaggugcugagguuggggcuucaacuugugacuacuggggaccgagacucagccugaaaauucucuaaagccaggccauagauaaagcugcagguauugggaugcugugcuccuuuuggggcaagcaaaaugcucacagcuugauuauggugauaaucgcacaucucuggaaaaaccccaccgaaagcccacugagucacaggcuuucaaggggggaguuuugaguauaugaaucacauaccucaauuuuuaaaacuauuuuuaauuauguauauacaugucugucucuguauguuccugugcaugcagucggaggccagaggcauuagauaccucuggagcuggugguugggagcuggguccucuguaagagcaugcacgcucuuaaucucggaggugucuauccaguuccuguuucaaccuucuguauaagaaagcauccugcaaaaggucaagaagggguuauauagguggcuaugggggaagagaagggaagggaaggguggaaucugaagcccugugauagcagucugcgaugacugccagucucccacauaagcccuaagaaugcucugcccccauugccagcgucuuugacaaaccaccugccaggacuucuuuccaccauccaacaccccucagccccguugcucagcuacagaaaacagagcaugguuugcugcugggaaucacaaagccaagaaacagaaggagcgcgcuuggugggagggggcugggcuggaggcggagcauguggccagccagagccaggcagcggcugugguccuguagccccucccugccuagaggaugcggcugcugggcuuagaaaagcaacuuccuuuccaggggcgucugggagacucagaauugucuugccugcuuccucacuuucuguaacuguuccugugguuugcccacuuugagccucagccaguuugcagcaucaaggagcugcugcuucaguguacucugugaaagggcucucugccuguguuuccuaacugcuuccagaacuggcuugugcaucuuuuuguuuugggguacacacaggcacaggcaagcuaacuguccaacacgucacaguauaaaaaaagucuaacucuguuuuuaaaaugcuguaauuuuaaaauugacgcacauuuuuguuguuguuguuguuccugugacaggauggcccagaucuugagagaccauuuuaaaacgccaaagaaacacagggggugucacacccaaguggaggacaaagagaaggcagcacagcagaccuugccggaacagguagccacuauuugugucguugugaacaaagggagccagucuugucuuugaucuuucucuauuuaacggcucaguaaauauucugaccacaaagcuacaaugagcagcgggacauaccacugcacacuuagaacggcagucaguagcuccagacaauuaaaacuguaagaacguaaaauuacaacaaaguuguuggguuuuuuuguuuguuuuuuguuuguuuguuuguuuuuuguuucuuaaaaucagucucagucugucauccgaggucgcauggugaaugaaaauagcucaaaagaauuauauggaaagucuaugaacaaaggcuccuuguucuacggcgcccucugguggggcugagaggaaauagcauuucugaagcgagggacacacguggcuuaaaacaggccccaaaugcuucccuggcguccauuccagucacugugacaccaaggaucaaacucugcaaacccuccuguguucugugaaucguuucuuuuuuauuuauuuauuuuuuugguuuuucuuuucgggauaggguuuuuuucuguguagccucgacuacccuuaaacucccuuuguagaccaggcuggccaagaacucagugccacccccaccuggcuugccuuccuuccuuccuuccuuccuuccuuccuuccuuccuuccuuccuuccuuccuuccuuccuauuuuaauuauuuuacccuugaguuuuaaaauccagaaacuugaggucuagaggggagacugugucucuaccucagguagauacugagaccacgguucugagucggaggacccuucccacuccucuggauccccagcuaaugaagggagagcaggccaggcaguuaguuuuggagacuugguggagggaauuugguuccuuugaaggaggccaguggccacuaaggugggugguggaugggagacacugggcggcaucagaaguggccgcugcauguaucgggcagcaaucaggcugcagggcacagggacacggcuaagcaugugggguugaggagcaagaccagaguguacagacucuuuccugggaccccgauucugccguuugggcccaagcaguaccaauucaccccucuguuugguggugaaugggcugaggcugugagcuuagggccugugcaccagcguagacagaagaaugagggcuggcaaagacagggaaagaauuggaaccaugaagccaucucaagagucuuagugcucuaggacagggaguggucuuauuugggaaggaauucauuugaccugcuugguacucaccugauacaucaggcauuugagacucgugguacacaaucaccaacugccccagauuucuguaucucacggcugacuagauuucuaauuaagcacaaugaagaaaaacacccccuucauuauuguucacagauuaaaggauacuaaugagagauccauggacuucuaaaacaaccaaacccccaugguucaguaccagaaaacgcguagauuuagucuucaaugccacacacccaucucacaaccccugaaggcccacacauaggcacacauauacaaacucgaacacacaaagaccaagaagacauauuuuaaaagauggccaagcugggugguggugacauauacauuugaucccagcauuuggugggggagaggcaagcagaucucuauaaguucaaggccagccuggucuacaaauugaguucuaggacugcaagggauacacagagaaaccuuguuuugaaaaacccaauaagaaaaaaaaaaagauggcgagacagaagccaagcuucaugguguaggguggagccaugggagcuucagagugaacugucccuguuuuaaaaaaaccucuuuguacacuggggagagagucaagugcuuucugcacaaggauaagcagccaggugugagcgcacaccuaaccugugauuguagcauugggaaauagggauggcuggaucccugggguucacuguccugccagccuugccugcuugguguguuccaggcuguccugagggacaacacccgggguugacuguggccuucacauauacacauugugcacacacacacacccauaccacaccuacucuuacacacuuauuuaauagagagagaaacaggacuggagagauggcuuggugguuaagagcgcuugcugcucucucagaggaccugggcuugagucccagcauccuccugguggcucaugaccauccuugacucaaguuccaggggaucuggcacuuucuuuuggucucugccacaauuggaacacaaguggugaauauauacgcaugcugguuaaacgccuuuccaucauuauggcuucuauggcuguguugaagcacaauggcccaaacaggggcuaugaaaggguugauuuaucuuacaucucgcacuccaccaucuacggaagccauugccaugaaauuacagcuggaaucuggaggcaggaacuggagcauaugcuacagaggagccuggcuuauuauguuguauaaaauaugguaugauggagcaggaggggaggggugccuuagugggcccaugcagaggcacccccugagauaccagccguacugaugggccuaguauaaaaggaaguuuauuugagaccugggaagggguauggagaagggaguagaggcagagaaagaaagagaggaauaaagggggaagagagagagagaauagacggaggggaggaggaagacagagggagggguaagggaaggagagccggagagggaagagagauugaccaugagcagcccuuauaugacuggcuuacuggcuuguaccuccagaugcuagguaacuguugggcagagccuagaggaaaugcuaacacugcuuacuggcuugauuccccacugcucgcucaguuggccuuguaauacccaggaccaaccagccaggggcggccccacccacauuagucauuaagcaagaaaauguaccacaggcuugcccacaggccaaucuaguggggcauauuuucucaauugagauuuccucuccccaaaugacucuagcuugugacauaaaacuagcuggaaccauacucauaccuauuauuauuauuauuuuauuauuaaaguacaggagaaacaacuuaaagaccuggccuacaguggucagcugugugagagcuugucccaucucguacaggagagcccucuaagagccacucagcaaccucaccucuaggguucucuccagauaucgcuggcagaagggcaaaauaagcugaagccuguguuguggacgacagguugagccguguggccacucugaaguuuuacacaucugagagaacaguaaacuugggcacucuggucucuaaugaggucuuuuccuagcagcccccccccccagcugcuacugggcccccugggguggaccccucaagcccacccuugggagaacaguuaaguuuaugaaccuuuccuggggcaggguggguaaguagcugacaccuuucgaagaggucacugauauggaaauaauuccuccugucaccggcucuccaggcccgagucaguccccaaaccugccucagggaucucccaccuuccccccucccuccccccccccaacaccccuagauggaauuaaaauacucccaugcccuucuguuggcaagaugacuuagugucaaacgccucgguccuggcaggagggcaggauuaccauuugauuaguaugcacauaagauguugucugagcccaaauacacaaguugggaaaucaaagggcucccuuucacaccccuuuccagcuccauccugaacguuuauuuuguuuugaaacaacuuccucaguuuccuuccuaaaaaagaaagggggaaucuccauuuuaaagugaaacccccaccccaacccccccccccccaacacacacacacacaguugagugacacggcaaucagcccuuucugggucccucuccacagcugaaggugagacucucauauacauccccaggaaaucuaggagcuacaaagggcuuguguuuugucuggaaucuauaucaacacucaaguacucugugugugugugugugugugugugugugugugugugugugugugugugugugugugugugugauaauuacuaaaacauugcauacuuccaauuacgucuccacaaauaaauguacaaugacuuuaccaaaauauuuguggguauugaagaguggguuuccuacuggaaauuccacccaugguuguguuuuaacucucugcuacccacagagaguacagacaggaaaggcaggacucggggcauguguuuuaagagcuuaauuacccucagcagacacacuggacggauuaaugguuaaugcuuccaagacaccaaaaugauuuguuugagugacaguuugcuucugagacagauuuauucgagacuuaaaguuauaacaacuuguuagugaucucauuuuucccucuugacccaaacaaugaaaacuuuauaguuuucaagcaagcaaacaaacaaaccaaauacacuucugaaaucccacaaacuuuaaaaauauucccucucccuccccccccucuuuuuuuuuuugcuuuccaacaaagugucuaggaaguugccaggggcugugagguggugaaaucccagaucccagcccagauauuuugaaugaaaagcuucauaaaugauugcuuuuuggaauaguauucaacaauuuuuguucaucuguuguuuugcaaauuagcaguggugcuuucauggcauguguauaucucaaucugggcucuucacauaucuccuccuuaaugggucuaauuagcccugcucugucugucugucugucugucugucugucugucugucugucucucuguguauauacacaugcacaucugucugccugucugucugucugucugucugucuuugagacagaaucuggcuaugcagccccuggcuggccugcgacuguuccuucuccuucuucauuuugccguguagguuaaccacaggcguuagucaccuucauuuguuugaaaaaaucuucagucgaguuugagcucuaugucaaugaaacccuggagcccagaucugaauuucaguauuugaaaauguaagguuccuuggccugucagccauugcugagaugcaucguguaaggggcagggugcugauguacacagggagauuguggaccgacuguggggugcauggucucugagucucucuuucucacuucccacuuuaccaaugagacucaaaggucacguguuccuggcucuucccagauacuuuggagugaugguggugggcaccuccuucaaagacauucuuaagcuugacauuugagagacaggcgucacagucauuuugcaggagauguaauuaaacuggccaucccaugagaagcugcaggguuugaaggcccuuguaucaggcuggaggaagggagauaaggaggaucaagagcuauauaaggaagugagaggaacucuuccacucugauaguuuuucaauugauugggauuuggggaguaaagacuuggaguaaaaucccagggccugaugcccuguucacaugcucugcugaguucaguccuuggcccagaacuaauucuaaugaagauuuauuuuuaugugugugaguguuuugccacacacacacacaaagccacaaacuugcauaccauguacauacaguggucauggaggcuaggagaggugucagcuccccagaaccaacaguugugagcugcccuuucgguguuggggacuaaacagagagcagacaauacucuuaacuguggaagugucucuucagucccgagagcuaacuaacucugcagagcccagaugguccccugccuccaguguguuaccaucuaacugauaggaacagcacaaaauuguguucaucucguaauuauacuaauggccggaaaaccucuuagaaccuuaauaaacuuacucuguuuucaaucagcggcaguuuuuaagugcuuuauuuccuuaguaguacauugcaucgaugucucucuccagacuuuugacuugaaggcgcuauucugagacuuaucaagcaaugaugccuuacgaggagauaccacagguuugugugccaaaucgcucgguuuaacuccgauuucucuuuuccacgguucguuauuuuucuccauucagccaaaaggaaaggcucaggagauaaaaacagggagacuggcagaggagagagggcugugagugaggagagaaagccaggcuuguccuuaugacugggcuugagaccacugccacggggaagcuuagacggguggcuggaggucacccagguguccuggggccucugcaccccacagcacccucagagacagcacuggacuccuggaagagcagugaaggggucugagccgagagcagcauacauugcaagccugggauacacagcgguagagaaaggagugguguggaggucaugugaucucucagcuuugcggcucacacauuguaucccaaccaccgaggggacaaccaugguuuaguguauguauuuauucuguguuuaugcaugcguauguguacaugcacgugcaccacaguacaaagguggaggagcucaggggacaacuuagggagcugguuaucccuucccaccaugugcgucccagggauuagacucugauagucagcuuggcagcuagugccuuuacucacuaagcagucuugcaggcuccccaaaguaccaaagcuguuuuuaaucaguuuucaaguggguauguuuuuaaguaccaaaagcaaacuuucuuucuuucuuuuuuuuagggggggaggguuuuuuguuuuuuuucucgauacaggguuucucuguauagcccuggcuguccucgaacucagaaauccaccugccucugccucugccucccaagugcugggauuaaaggcgugcaccaccacguccuggguuuuuuguuguuguuguuguuguuguuuugagcagucagugcucuuaucugcugagccaucucuccagcccccaaaagcaaguuuucaguuugcuccuuuaacuguuggaaggaaccucacucacuuuugucuguuggggaauaggauuuuaggcuuccccaaagaauauuauaaagauuuuggcauauucgaugaaaacaucuuuccuauuuuaaaaaagccauugagggggcuggcgagauggcucagugguuaagagcgccgacugcucuucugaaggucccgaguucaaaucccagcaaccacaugguggcucacaaccauccauaacgaaaucugaugcccucuucuggagugucugaagacagcuacaguguauuuacauauaauaaauaaauaaaucuuuaaaaaaaaaaaaaauaaaaaauaaaaaagccauugaaauguaagaauguaaacaaaccaaaacaaaacccaaaacgauuaaauguaaauggagcugagcagugguggcucacgccuuuaguccugucacugggaggcagagguaggcagaucucugugaguuccaggccagccagccucaucuacacagauaguuccaggacagccagggcuacacagaaaaacccuaucuccaaaaauaaacaaacaaaaauaaaacaguaaaugcgaaaacaugcuaauuucuuaaaguugaauugauacuaguuguacuggcuaguuuuguaucaacuugacacaggcuggaguuaucacagaaaaaggagcuucaguugaugaaaugccuccaugagauccaacuguaaggcauuuucucaauuagugaucaagggggaaaggccccuugugagugggaccaugccugagcugguagucuuggguucuauaagagagcaggcuaagcaagccaggggaagcaagccaguaaugagcaucccuccauggccucugcaucagcuccugcuuucugaccugcuugaguuucagucuuggcuuccuuggugaugaacagcaguguggaaguguaagcugaauaaacccuuuccuccccaacuugcuucuuggucaugauguuugugcaggaagagaaacccugacuaagacacuaguguacaaacauuguugaguaaauucucaaagaauauucuccauucacaaaaacagcaucagauacauuguuaucguaacagugacagacugccuauagcuguauagccugggcugcagggggugggcuucacucuccuccucucauggcagcaccuguaagagaacccagggauaaggaagcagaaacaacagacugcaacgcuuugcaauccuaguaucucuaauugucaccgcucacaaagcugaaaacaguucccacagaaauaaaaacuaaacaugacaaggacuagagagacagcuuagaggguaaguacacuuguucuugcaaagaacgugggugugauucccagcauuuguaugguggcucacgaucaucuauagcugcaauuccaggagaugcaacagauguauacauggaacacaugcauauagaaguuaggccuaagcuggguggugauggcacacgccuuuaaucccagcacucaggaggcagaggcaggcagauuucugaguucgaggccagccuggucuacagagugaguuccaggacagccagggcuauacagagaaacccugucucgaaaaaaacaaaaaacaaaacaaaacagaacaacaacaacaaaaaaaaguuaggcuuaguuuuuccucccagccccaugcucccagagauaagacucagacucaauauacauuuacaaauaucuuggccagauagcuaggcucugcucugacuagaucauaacuaaagauaacccacuuauuuuuaaccuacauucuacaacaugacuggcuuucguacucaggcaacccuauguccaucuucucacaucuucccaggguaaucuuccugcaacuggcucuaucccagaauuccuucucucuccaggaugucccaccucuauuuccugccuaagccauaggccauaggcuuuuuaauugaugggugaugcaucaacacacaauacacaagauauucucucuacaauuccccuuuuuaguccaauaaaaggcugccuuucuuucaaauauauauugaauacaacuauaaugauuaugaaacaauuaugaaaucuauaaggcauaauauacauuuauaauguccaauccauaguauuuggcaauuaaggaaaaauuucuauuauuuauccuaucuggguuuacuuacaguucugcaucuaaaucaauuucuauccuaauuuguauuauuaacuuaaaaauacuuucuuaaacauuuugggggggggggucgagacaggguuccuuuguguaguccuggcuguccuggaacucacucuguagacuagcacuggccucgaacucagaaaucugccugccucugccucccaagugcugggauuaaaggcaugugccaccacugcccggcuuacuuucuuaaacuuaaaacaucuuuuuaaauccuaaacaauucaaacuuauaguaagacuaugacuaucuagcagccuucaaccucaucagagcccuaagaaggaauaaauauuaucugcguauguaggaagugcuagaucacagcuuccaaaaauaauaaaaacgacagagauugcugacugccuggacaguccucaauauucucuauaauguuggagcaucuaucuucagccuucuggcccagaauauccaacagaccuuuugugaagcaggaauuauaaaggacuuguuuaccgugucuuggcagaguuaggcaguuaauuucccugugucugucuguccugucuggacagcauuuugucuguagaugaaguuaagauauuuucuuugccucaugacuagcuugccauaacugaagcaacucaacauggaaauuauuaacgcucaucaucaucucugaaauggaauggggauacuggcaggaacagaccugacuccuaguuaaaagaucuuacaauaaucagauaauuuuaaaugucauauucuguggaucucugagguuacugaugcccaguuaucuaucuauauuauaucugaauugucaaacauuguuuauucuuagcuauauacuaucugaauaaccuugaaaacauuuuauuguaacuagcuaaacuaguaucuaauaugaccaugaguuugacuaugacuauuaauuuguauuucuuaaccauuccuaauaguucauaauuugcauuuuaucaucucuaacaguuuguagaagcagcuuucgaaaguacuagaacuuuauauugcaucuuuaagaauuauauaagcacaauaccucaaauaaauguuaaaaacauauauacauuuuccucuuuucuguccuaacauagcauauccuuggucuggcagucuaaagucauuaagaguauggauugauuuaauccagcagccuccuucuuauauaggucugcucuauuuugaccucucucauaggggauuuguaauaccauuacagccauaugacuuauaacuaucuucauuuuaauaauuuuaaacuaauuauuauuauuauuauuauuauuauuauuauuauuauuauuauuagagucaggguuucucugcguagccugggcugauuuggauuuguagauuaggaugucaucaaacucacaaggaaccuaucugucccugccuuaucucccaaauacugagaucaaaggccaggauuuguuuauuuauuagcuauguaaccuugaaaauaauuauaucaauucccauuucuuucucccuuccuuggagauuaauauauauguggauaaauacaccuauauuccccuuguucuuuauauaaauuuaaguugauacguauuuuuuuuuaauuauuaaggauauuuuuacuuauuauuaagcaaaaacauacauaguauccuuaagggaaaaaaaugugacaauucuaauuuuaaacugucauuugcaaguggcuguaucuaucggcaguguuguguagaccaggcuggucuagaauuccagagaucugccugucucugucucuugugucugcuguccuguagagcucagaagcugugcugugccuagccacuccccugucccuuuguuuacagcagagggguuugggccuucugugcagccaaccuagggcugcauuuuugcacaccaugaauacuugggagaaccugaaguggcuuaucccacagcugaggucuccuggaagucuccauggauucugccagcguuaugggcugcuuccagccugaguguacacaggagccucccccuuggaggcugcugugcucugcccuugggagaagcccaacuucuguguucugccuuuaaacuuaguaggagcuucuuuuaaaagccaccuuccauacuaucacucuguagguuccugcuccuuggcuaggaaacuuccucccaucuuggaauguucuggaaggcuuuggcuuugaucuguuuccuuccuucuuuccauccuucccucccuccuuuuuuuuuuuuuuuuuggacuguccuaaauuuguuuauuggauaugaauuuuacaaauaucauguguauuagcgguaacgguggaacuggagaguauugcgccuucuccaggcugcacggugggaaccaccaauagugugguggaacuuguggcccuuuccaaggccacggcucuuucggccagcagaugucagcccacgcaucucuguguuuguggacugguuuggugauccacugggugucaggauuucuucugauagcuuuauggaauggaucaaugaagauaaccucaaaaaauuuauauguaaucuucaccaacccaguaggaauucaggacucucaaagccccacaauggcgcccagcucucuccucagcaacagacugaaggcuucgggcaaauuucagcugguuaacaccaugguggacaggcuugcgguaaguugcacccuuaggaacugggcguuuacgaccaccacagcggacacgaauccuguaaaugacauagccuugcuuagccuuguaccccagucuucgagcuuuaucaggccggauggggcggugagcccugugcagcgcagagagcuggcgguauugccagcagcggacccucagaagaaagcacaucaugucggacugcuucuuccuccauagcuccuggauguauuuguaugcacccaucuuggcucaccugauggcugccgccagaggaaagguccucccuccuucuuuuuaagagaccagaccucuuguccugcuagccucacuuuuuccagcuuuuuacucuggccuuuucaggcuguaaacuuggguucuaacugcuguaaguugaacaccauuuuguagaacuuaggccugguucuuccucccagcuccaugcucccagaaauaagacucaagcucaaaaaauauauuuacaaaugcuaggcucuccucugacuagaucauaacuaaagagaacccguuuaucuuaaccuacguucugccaugugacugacuaccugcgcucaggugaucacguguccauuuccuccaucuuccugugccuggcucuaucucagaauucuuucuucucccagaugccccaccuuccauuuccugccuaagccacaggccaucggcuuuuuuuuuuuuuuuuaagauuuaucuauuuauuuauuauauguaaguacacuguagcuguauucagacacuccagaagagggagucagaucucgugaucggaugguugugagccaccaugugguugcugggauuugaacuccugaccuucggaagagcagucaggugcucuuacccacugagccaucucaccagccccaccaucggcuuuuuaauugacaucugauacauucauaugauacacagauauucucucuacaugugcauucaugcagguaaaacauucauacauacaaaguaaaauaaacaaaucuuuaaaaauaugcauggcaaagauuuaguucaacaaaauaguugccaaggggacaauuuagauguuuaaauugacuuuccuuuggaguuguuggucauugaaguccuagauccacaaacacuauaggccaaugcucuaggaaccacaaacuacaagcuaaaccaauguucucagucauccuccagaacuugacaguaagaccuuauggcugagauaccacauaguugagucauagaccacagaaagaggcuaaggagacagcucagugguuaagaacacucuauucuucugguggucccaaguucaauucccagcaccuacacggugacucacaaccaucucuaacuccagcuccagggguucagacaacccucucugacauccacaaggacugcacacaugugguauguauacauacgugcaagcaaacacucauguacauaaaagaaacauauaucuuuaaaaaaaauacuuaaaaggacguggagaaaucaugcggguacuaccuuggaagcuucguccguacuggauagcuuuuauagagcuggaaagugcuaugcaaugcgaugcgaugcgaugcgaugcgaugcgaugcgaugcgaugcgaugcgaugcgaugcgaugcuaugcuaugcuaugguaugcgaugcuaugcuaugcuaugcuaugguaugcgaugcuaugguaugcgaugcgaugcgaugcgaugcaaugcgaugccugguaacagaagaggaaaguagucaucagccuuaccgagcugagaacgaacgcucugagaugugguaauaacugagcuggcaagacaaugcccacuggugcaacagacacacaaauguucugggagugaucgacuauuuucugauuggauugaaguccuacuccaucaauucaaaccccauacuggagccaagaaccuguagcuagacaggucaugggcuucagagacauaguaucuaacugccuccuacagaugacuuuccuuuggaaagccacccacagauuaguagauuggucagcuaucaugugagaagcuuuuuauggcaaucaacuaacagccagccacuacugaccaaugugcagagaauaagaaauucagaaaggcuuaacccugggugggaugccuucaucacaacccuuccacccaaggaagagggggcaggaggauuacaggagccauaggugguggacgaccacacagaaacaaugcauucuggacacagcagagcagcugcacauaagaaucuacagccguugaggcugugcacaaaacucgggcucagacaaaauuacagcauugaggagaggagguggcauguagucccucccgccccuagcuaaaggcuacuggcgcugaucuuugccuggagagagagucaguuuuaagggugugauuccugugaacacgcuugacccagggaguggcacuauuuggagguguggccuuguuggaguaggugugucacugugggugugggcuuuaaggcccugauccuagaugccuagaagccaguuuucuccuagccgccuucaaaauaagagguggaacucucagcuccuccugcaccaugccugccuggaugcugcuaugcucccaccuugaugauaauggacugaaccucacaaccuguaagccagccccaauuaaauguuguccauuuaagaguugucuugguggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaauggaaaaaaaaaaaagaguugucuuggucauggugucucuucacagcaguaaagucuuugucuugcugugccaagacaaagggugcggccccuggagaguaggccagcuucuagugaaugccauagcucuaugaguguaugggcagcauaaaguguacuugacgaauuaaaacaaacauacaaaaacuaaaaaauaaaaacacagaagguugaguggguagaaaagggggugggguaaauaugacccaaaugcauuguauaagacucugcaagaacuaaccaaaaugagaaaaggaguuuaaaggaguugguauaugaagacuacauuguggucaauaagagaaagggugaaucaugcuuaccaauaauguaaaacagguuaucaucccacaagaccacagcccacagccuguauaguuguauuuacacaacaaacgagaagggaaccugucaaaaguauacaaccaaaggagaggagggcagggggagguggggaggcacacccuucucuuggaugguaguuauucuucuguuccuugccuggucacaugaaaguggaccacgggagaguauggucccuauaaguuugcaugggggugagguagggaaucugauguuuuaagaauucuaagcacuuugaguuauuacaaaccacacaccuguacugugauaucuuaaguaaaauuauaggaacuaugucucuuagcugaauuaggggcugaagaaggcacugaacccaagaauucgaaaaguuguagauucaaaaguguguguguguguguguguguauguguuuguguguccuguauuaaauucuugcagguucauuuaaaauuaaugucaggaguuccauuacaaacugauaauaugcuguucuaauguucagugcauggcacaugaaauguacaaaugaaaauauauuugaauuuauuuucauugagcaaaauguauugacaggaauguaagcgaaggcaugugugcaaauaugcacacacucaaggacccagcaagguaugugugcacaggcucacucagggacccuaggagacacccacucuuuaccacaguuccuacuggggucguuuaaagugauuuguuauggcucuuuaaauaugaauaagguguuuacagugaucuucuuauaugacacacccccaucuucccauaaacgaucauaaguuuuaagcgauucuaagacauaccuagagcccuccugaaacuuaucaacugguuuucccacacacuuccugaaccaucucagaugcgagggcuucaaaggcugggaauuccuaaaucucucucuguguguggucuggggaaaauguccuugagaaggaccugugaggcuaagguucgggguacccaggccugggaauuucaggugcgaagaauagccgcugggugucgcugcuguaaggacaagaaggugcgaggaccugcauccuugaggaugcucgaaaugugcgcaagaaguagggugccccuacagcgucuguaagaggcugggccugccauggaagaauucuagcccggcgguaagcauuuggaaaucucuuagacaagcuccuuuaagcaaccugaaagcaugguuuacaaauuggcagaaacugaggaacguucgggaagucaaaugacuucuuuuaaaaggagaaaccuuucaaaagacucuggaagguggaccuaacaccuccggucucccacgguggccagcaaaggguguguugggggguaaggggaaggcaguccuuuaccuuggaguuggaagcccaucugcccccugcaacugcagguccugagaagagaucacagcauccgauggucuuuccuccucaccccuaacgacacaaacuugaagggggaaccgauggagacuacaaacagguuuauagccugccagcagggcucagggcuccaaauugcccggcgaggcaguccccggugguuuuggcggggcgggugcgcagggccccgccgcgcacucauuagcgcccacucugcuuaauggcuuccugugguugcuuguuuacuucuuccuugccugaggcuuuguuccuggccaccgcucgccuugcccaccaccuuucuuugcuuguuugcagucgcagcccgaagcuuggucagcauccccgcccaaggcuucaaccagguucccuuccagguccaacgccuaccugguaagacagaaucccgguaagacguguacuccugagagcaggaacacgcugagcaucccaaaggcccagaaaagggggcgcugcuuccugcugugccaggcgggcauuugucacaaaucccuccaccagagacaaccgccaaucacuugcccaacaggcagaggggagggagacccaacaccucuaccuaagcucuauacaccggugagccucucuaaggaucuaaagcucgaguaagcaacacccccaccccacccccagcgcuguuccuuuuaccacuuccuguagaggggguaagaguucuuucuuuagaaagccacagccugaaucugagguaguccauagucuccacaaaaaaauuagcauagccugccucccauuucugcaucaggaguuagaugggggucgggcggugucuguggaaugcaaggugcguuuuggucauccaaaacgaaacgaaugaacacuaaccuguagcuagagggcagugcauggccgauuuuauuucacucuuggauuuguuaaaucucaggcccaccgcagaucagaucaaaccuaauggucucugugccaggugcauuguuaguucauaggccacuccacuaggcuccucucagggaccuagcagugacuuacgccauccucugucuaaugccaggagcgcaggugcgggcucuguaugaaaagacuacccagcucucucuguuguaggcguucucucucccccuuucuucugucuucggaauccccuuucucaccuucucugugccucucucugcguguccuccagacucgcuuacugccucuacccuucccagguguuacuccucucucuucucccaguaaggccccuuuauaccagcucuaacagccugguauaauuucucagggacauaccuuggcaugggcccaccagguaccucccucucugcauuauauuucauaauagucaugaacuccagcuaagcucugugucugccagcuucucaaagagauucccuuacccaaugcugucccagaaguccugggguuaaucucugcacagaaagugacuuuggaauggccuuuccauuaagcagcuuugggcuugguugcuugaugcuagaaucacauauaaaagccauucagaauagucaacgguagcuguuccuccaugugucugagacuccuuuaagagugguccuggagauggacaccagcaccuaugaagcagaaguauguuugaauggggaagcaucccaaggccuccuuucugcugaacuggcaagcacagcaaauagcaugcgccugugucgcaacuaggauagagaguggugucacagaggacagaugauguuagaagcgcacuucuucugguugccuucagaccagccccccucccaaccaagcaucugcuagaguuaacuucaggcugcuacuaauuagcuuuaaaaacaaaaacaaagccaaaaaaagaacuuaucuauaugcccauucucuuuggaaaaaaaaagauuauaggguugcaaaacgagcugaccaaaugugggaucuugaagaacaugagcgacgacgaggauuucuggaaacugguucaggaggaagcucuuggagugggaacuaaagaaaagcuccagaagauaaaac

SEQ ID NO: 8374 - RNA, 1229 nt, Mus musculus
uggugguccacaaccauccuuaacuccaguuccaggggauacaaugcccucuucugauuuucaguggcaacagguaagaacaugcauacaugcaagcaaagcaaggacacauguaaaaugaauucgauuuaaauuaaaauuaauuuuccaaggggcuuaguuuggucuauagcucgagggagcuauaguugaucauggugggaagauaugagaguagccagggaaggugugguaacaggagguggugacugccugcucacacucaucugcaguccugaagcagagcaugcaggaugcacgucugggcuaggauaacuucuuccaauaagacucuaccucuuaaaguuucacaguguucccaaggaucaucaucacaugggagcuguggugguuugaauaugcuugaccuauuggaagugacacuauuaggaaguguggccuuguuggaagaagagagggcuuugaagcuccucugcccagugcggaagagucagccuucuccugccuugggaucaagaugcagaacucuuggcucuuccaggaccaugucugccugaaugcugccauguuucccacuaugaugauaaugaacugaaccuccaaaaccauaagccagcuccaauuaaaugcugucccuuacaagaguugccuuggucauggugucucuuucauggcaacggaaauccaaacuaaaacaggaaucaaguguucacgacacccuggggaggagggcauuuuacauucaaaucacaaagacauccguguuuaucagugaugcuuuaauuaaagugccaugugcuacacaggggauugcacuugcgauuggcuaugaaugacagcuagaauaacagggauccuguuaacauaggcuccugcuuucuucuagacaugagaagcacgauauucugcuccagcacggagacgucuuccacaguccaguuaugccgaguggaaaaaauggggaugcguuugcaaugaugguggaagaucaccgaagcagggcucuccacaggaguaacaaagucaugaaacaacagccaaugacggauaaacucuuuggaguucuggaagcuaagagcauucaacauccaagcagaguuuaugcaaagaaaacaacaggaccucagcuaacaccacgaaguucugaccuguccuguuucuaacccguuggugccagacugucuuccucagccagcuucacuuuacccaagcaagcucucucacugaac

SEQ ID NO: 8375 - RNA, 967 nt, Mus musculus
caguuugacaugaauaugguuuauuuuagcuaaaaauccaagccggcccuagucacucucgcugugagcauuuucaggcucuccuugcaaucccaagaguacagaaaauaaauuugacacaauguuucuuuugucuucccccaccccccacgccucuggccaauugauucggagcucuguuucugucuugccacugcugccuccaggucgagcugagauuuccguagcuuguuaagcuaauuugggugcugagcaaggacaaguccagaaagcagauucacaaagcagagacucacagaagcggggcuguugugcuaugcuguuuagaagcuggcaaacgugcccuggauccuccucaaaacauccggcugagacaaugcaguuucgggcucacagcauuguuccuggagagaccugaagaucccuggaggcuccggaagccaugcaaggagcgaccccaggggagcugugguucccaggccucagaggugaaagacaguggcuugcaaaugcagcgccucagaggugaaagagacaguggcuugcaaaugcagcaacagcaucccaugagugcaggggagcgcucuggguggagcagaacaguaaaguucauaaauucagcacgucagagcagccugucuccccuauuuacucugcaaguccgugacaucgcgagcgcucgcuacuuuacuuugucuuaaugcuggcgcguuaaccucugaacggugacuuuccagccacuagccuggaggcuguaaggugcuucugugccuauuuuuagccucuuuuccgcgaagaaaagagaaaauaauaaugucucguuccggggauccuucucaagcaugcacaggauccaggaggcaacaguaacaucccuaaggagccagucucagaagcagguguggggcgcccucucucuguuaucagagagggugccggaaagcagcugggccacagcggggcacug

SEQ ID NO: 8376 - RNA, 3225 nt, Mus musculus
auuaaacuuaaaaaauuaauuuguauuugugaaaaacagcuuuauuguauagauggcuauuugugaaaaccaaccccuuuguuauguugcuuuucuacucaaauccucacucuuuguauggagaaaggccacucacccagcucuucccucccuagaacccacuuagcucauaucugcuccagaggguaucaugccugucuuccugauauguuuggguuuucucggggcuugaaaaaaaaaucagauuaacccucuucccuccaaacugcucccucuaucuccaagucuucuaucucccuucuucccuuuuuuccucccucuauguuuuuauauaguaugcuuuuaauaaucugauacuuuuguuuuagcuucucauucuaccaaaacacaguuccaaaaaaccaagacuccuguaucuuccaaaacacagcaagaugccagugcauaaauguauucugaauguuagauugaguuugaagaaggcacauaauuuuacauaaguuaguucauucgaugcuauaaaguggaucagugaaguccagagacuauggagguaacuuuugacagcuguuaaaauucacuuucuguaguuuguuuuggacagaagcuucuaaguugaaggcgguucuuugguacaucaauugacaggguugucaauuacagauggcauguguuuuguauccggcaacaacugaguggaaauacagcuggccacacgacaugaguagccuucuagaagucucagagguauuauuagccaacagcgaugccuuuauuuuuuucacuuuuacucuuuaaggaagcuuuaguaaagcaaggauacuaugauccaaaucaugguccuugcucaaguacaaguucuguuacuuagaaaugacaucuugagcuauuugaauuacaacugaaguaagagaugcuuuaaauuuuugcacuuuccuaaaaagaaaaucauuuccccaaagucgauaacauuaauuugcucuuaaaugucacuauuucuguuaucugcugucuuaaaccaaguggcuugggcuuugcauugcucacuagaccugacucugacuuggcacaggagauuauaaguuccuuucccuuucauuuaguuucuaguuuucuuuuuguugucauggguuuucaaugucuagauauuuuucuucagugaagcagggguuuuuaugcauucaccugcucaucuuuaagcauuugggacaccagcaacacugcugacugcuuucugugaagucucuuuagcuuggugagcuugcaguacagcuauggcuucaucaacuuugguguggagacacucuggagacucaagcauguggcguagcucuauauuaucaauuuccaacagcauacccgugauuuuaccagcaagggcagggugcauggccugaauaagagagaagagccauuccccuaacauuugcuuuugagcuugaggaggagcagaggccaacauggaggcagucaaagacucuuuaccuuggacaggaacagcagaccgcugcgugcugacauguggcuguguauuaggaugcugagggggauuucggacuccagcaguauauuuauacuggguaauugugcggguggcaggagcagcugcagcagcagcagcagcugcaggaugugggcccaucaucuguguggaugugcuggcaguacgaugucguauagccugugagguaguggguccugaaguacuaaaugauggcauaguaugugauggguggaugguacuagacauguuuuggaauggaugagcucugguaccgugagcacucccacgggcacuugguccuugcugaguagucugauuaggagcacaguaugcccuacggcucugaguugguguagcugucaugcaguaaccugacggccccugcgcuggcuggaaagggcugacgacuggguuaggcccggcacuggugcuugccauucuuugcauguacugguuacugaggugagccuggcgcuccucuuugcguugagcuaaagcuacguagagugguuugguggccacuauuuuaccauucauuucuguaacagcuuugguggcuucuucuggagaggaaaaacauacaaaaccaaacccuuugcugcgcccacccuccaucguuaccuuugcacuaguaaucguaccaaaaggggaaaacuccuuccggagacgcucaucaucgauaccaucaucaagguuuuucacauagagguuaacaccuuugcaucugacgcuucuaucuugugguacccguucaauuuugugcuuaucuugcuucaucugcccgaauuugugcuucaguucagucugucguuccaccuuuuucugagcacgaccuacauaaauuuguuuuccauugaggucuuuuccauucaucucuuccacugccuuucgugcaucuucaugccuuucaaagcuuacgaauccgaauccuuuggauuuuccacuuucaucagucaugacuuuaacacuuaaggcaggcccaaaucugccaaauagauccuggagucucucaucauccauaucuucucccaaauucuugauguaaacauuggugaacuccuuggcccuggcuccaaguucagccugccugucucuacgagacuuaaagcgaccaacgaacacuuuguggucauuuaggaacaucccguucauuuucucaauugcucguucagcuucuuccugugucucgaaguguacaaagccguaacccuuggagccauucucaucacacaccaccuuacaggaaaggauguuaccaaaggcagaaaacguaucauacagcguuuuacugucaauggaucuguccagauuuuucacaaauauguucccuacuccgcucuugcgcagcgacgggucccgcugagaccacaugaugcgaaccggcuugcccuuuaucacgucgaaauucaugguguccaaggcccgcucggcguccuccagcugcuggaaguugacggacgcguagcccagcgagcggcgggugauccugucccuguacacccggauggagaggaugggcccugccgggcugaacuucucauagagcaucgccucggucacgucgggaugcaggucccccacauagagugaagccaaagaguagcuggggucgcugggguucaugucugcaaaggcugagcagggagcaggagcagcacaggaacagaaggcaaccggaauggaaaggcccucaacugccaagaacccggaggucggcggca

SEQ ID NO: 8377 - RNA, 3762 nt, Mus musculus
uuuuaccauggaggguaagugccaguggagaugggagcaggcuagcaucugucagucauuucuccuagucaugccacuggccuuucagcaucugcaauacuaauuccacacuuuauuuuuccugcuccaaaauaaucacucucugcucacagcauaaagagucaagaaauuuacuguaaugaugcaccuugagagaccaguuugauucuuuguugagucuuuugccuaaauuucugugaacaggccaguuuuggucucauagaguucauagcugauauuucuccuguguuguuuagcuagcugcuccuauuagaguuaagucggccucucuaggucuugcagucccauccugucugugacacacacauacacaccacccccucuucagugucuugaagagcucaacuuggguagcuuuccccuuacgcaguuccagaacagccuagacaacuacacaggaagcacggcagagacaaacacuguaaucugacguguguguguuugguuaaauucuacagagaaguagaucuaagauccuucuuucucccauucuucacuugguugugcucucuguaaagagaccucuucuucagcacuugaguccauuuuugugucagaucaacaguaccuugucuggggggaaaaaucuuacaggauccagaacaaacaaacaaacaaaaaaaaaaaacccucuuagaaugaauuuuacuuuugaaguaaugguuuauauuuugaaauuguauuuaagaauccuaaaaauuaaggguugaguucuaucauaacuuucugaaaggacacuguuaaaauacugcucugugcauauaugaagcucagaauagugagcuuaguuuaauuaucucugaucauuuuugguccugcacauacggaauaucucuguuaagaggaggagaccgugucauaucacuggguagacagguacccauuaccuuagcaaguauguuuagugcucagugagcguuucagacacugucaagcuucugcugcacaaaagcuccaaugguaauauguuauaacaguugaggaagaacuuaugugcuguuuaauguucucugaagccuguguaugcagucucauccuguuuucagugagggcacuugauuuaugucucaucaccaccauuccuauugaaaauguugcucaaagacucacauggugcaaauagugugguaugccacauuuucauguaagugcaguaguaucacacagccugaugaugggauaggaauguucuagugucacuuucuuaguugaugcuguuuggugaaaugguuaucuguguuuuauucaaaaggcuggugauauugauguacuuagugaaguaucuuuuauuuuuauuuuucuuuaggaaaaauaucuaggaaaacaugauaugaaaauuauauucacuucauuguaguguagcauuuucauguauggcagugccugugugaaggaguuguagaaaugcccuguccauuaaaaaaagaaaaaaagguuuugugugcacacaagaaagcuguuugguuaaauuuauggguguaaaggaugugugugugugugugugugugugugcucucucucucucucucucucucucucucucucucucucucucucucucucucucucucucucuguucgcuuguaugccuggacuaggaugccugacucuuccuugaugacagcuguuauucucgaccucaggguuuugguggaaugaaacauguugccaaaguaacgguuaaguuucuuggucucccacauuuuucaaaguacauaggauacugugcuuaaucacaucuugucacauuuugucacaaaucauuuaauaccuguacagugggaaugauaacccauuuuauggacauaucaauuuagacauauccaugguacauguaguaccugguuuauccuguauaaaauuaacuaaauugugaguugucuuuauuuuaaagaggccugacaaaaguguguguauagcuggugcucaaugcugaaucaaacuggucaaacugaagcacaauacacuccuuauuguuucugcugcacuaauugccaggggugggagaggaggagcagcaacuaauccaugguaggcagaugugggcaggaggugcuguauguagugagugggcaaagaggagcucaacauuacuugaaguuugcuauccccuggagagauacuggccagcacugggacagucucagaaccaggguaaaauuaauuuauaucucuuuaaagguucuauuauuacaaaguuuugagccaaauauaucuauauaaccuauguuauauugguauguauaaaauuuugacuuguagaaguuguauauauagggauauacauauauauguaugugugcauguauauauauggauauauauauagauauagauauuccugaaucauacacgaaugggaaacugcaaaugacuguacacaacauacaauaaaaaacuggacaagugcaugugcugcaucuucucaagccaacaauaagauggcaguguagcugccccaggcacagagaaaugaauacuaaaguacagagcggaguuaagugucuacuccuccuuuaagcacugcauagaaaauuacagaaccucacgaucaagacuuguaguaauuaacagaucacuguuuauaagaaggaaaucggugaacuuuuguuguguuccccagcugaucugagcauccaaaacauuaccaugcuaaucuuuaagaaacauucauauggcuuuuagguaguuuucuaaauguaagaauucuugggaaaggagugaggauguaucucaguuggugaaguuacuagcuuagagugcacuccuggcaccauuaaauuaaaaaagaaccaaaucuuggccuuaucuacuuugugaaaaggacugauguuauagguacaccauuaaaguuuccuuuugacaucuaaauuuuacagcucuuuauccuuuaagauaaccaguuuuucuuguuauauuuggaaguuccuuugucuucuaacugcuuacuggaaggggauauccuuuucauauaccuccaaagguacauauacugguaccccuguacuuuugauggcuuagcucacauuaaaagucugauuagauuuuucaccaaaucuucucuucaaagaucacauucucauaguagucauaaucugaaaauagauuuuuuuuccuuguccucaaagauaucucuuuaagcccaccacuacuagaauuacaccuagggcacuaagaaucgcacauaugaauuauugcauagugugcaaggucuaggaauaugauuucuaucuucaggcacuaccuucgauacccugccuucucaaaaaagguggccacuagaaggugacucaucagguaaaaugcuuucccugcaacccuuacagccuagauuugaucucugugacccauagaaggaggaaagaaccagagcuguguucagcaugugagccauggcaugugaagcucauacauaccacaaacaauaaaagacuuuuuaaaucacugucauucauagaguuuguauuucuuacagugaagacgagcugaguggcaauugggauuucuguaauuacugcuuuucuauacauuagucuuguuacaaaaguggguggauggauggacagacaggcuguaugauuucaucaaaguguaucaccuguugggguggaaauguuauugcucuuuguuuucuuuaugcccuucuuacguauuguuuauuuaauuggauacugauuaaaacauuacagugugaaccaaau

SEQ ID NO: 8378 - RNA, 114712 nt, Mus musculus
auucagugacaaaauauuuuuuaauaauauacaagaaagaaaccucguuuuuuucuagauucugaagaaagauuuagaaaauguaguaacagcuuuuugaucaaauuauuccaugcuuucacuaauuuauuguuuagagauaauuaagggauuaucuauaguacuaagaacuacuauagccauuguuggaaaauuaaaauuauuucaauuacauguuaacuuuguucaucauuugcucuaaaaaacguaguuuaauggacaacuagaaaaccaaaacccaaaccaacccaaacuguagucuuuaaauaaaauaaucagaagcuacuggccaggaaaagaguaaaauugcuuuaaauaccguugguaccacacaaacuucgaaaaugcucuuuagaaaucgcguaaaucaaaguuuaaaacaacaacaacaaaaaaagcaauccaacuagccugcuuacguacacauuuaaaauacagugagaugauucccagaaaauuauagccagggccaacucucaaaaugguuaauuugacaaucuugucuacauuuuaauggagcauguuauagagaacuugcaacaaaacagggaugaugcagauuuaaugaccgacagcuucuauaaaucgcaggacuucauugcugcaauucggaacauuguuuccgaaacaaauguaaccggcagaacuuccucuacacgccauagaaagccccuguccuggcccucugccugucauuuauuuauuuauuuuugucaaguagguaaaaauaggcguuggccacuucguuuuuuccccgaauauguacuccucacacaggcucccuugugcgggggccgcaccgcugaggagccagcgccuccgccaccagggacuggaaccugcggugaggauuaacggaaccgcgcgucacgccgcauggaacagagcccgcccgcacgcccgugggugcgcacgcgugugccgucuccgcccacgguccggggccgccucgcagcccacggcaacgcgaggcccgucacgcguggcgcuggcuccaggggaaaccucacuggagucccuaccgccggagacacuugcggugugggcgcccacgccaacucaguccgccgccaccucgcaccccaagcgauccgacggccggguuucccgccccgcgaggugggcgccgcgccagaacgguucggucccgcuccuccguccgcaggccaucuucgucccgcuccacccccacgcaggcgcgcuccaggcccgcuucccccccaccccccgcccccacggcgcgcucuccgccagguggggcggagcgacccucggaaggggcguggucacaguccucgacgcgcgcacgcgcucucagccucucggcuacgugucuggacacgugacgcccacccgagaguccccagugaagcaacaggacguuuaaaaaaaaaaaauuuuuuuuuuuuugaggggguagcgaggaagguggacgaagagguuuaagaaaaaaaaaaaaaacccaaacuauaguaacgcgcgcggacgcgaggcccgggcggcggcgagcgcagcgcgucgcggagagucccgccgggauuccucucagccgccgcacccgaccgcgcccgccgccucagcaacagcgcgccgacgagccagcgccgccgcccgcgucccccucagccgcgaccccggccccgcgcgggcggccaccggcgcgcguccuccccgccgcggcccggcccugcgccggccgucccgcccgagcggccaggggcggcggcgccgccugaacugaggcgaacuccgccgccaagugagugaggaggaggagagccgcggaggaagaggaggagcgcagucggagcgcggcggcggcggcggcggcgguaacgcggagcgccgcggcggacagcaccgcagacucgcgagcuccggcgcaggcggcgcgaccggccgacgagcggccccccggcuccucgcggcgcagcggccccgcgccgcgcucggcccgagacccgccucugccgccggccucgcgaggggagccgcgccgggcggccgaggagcggcggccgcggcgcgucgggccgggcgaaagugccugcggggggcgggcgggcgcgcggagccggccgccccggggcucggcgcgggagccggagcgggagccggcgcggagcgggacgccgcgucccgagcggccggcggccggagcucgcccccgccccucccuccucuccuccggcggcggcggcggcgggcggagugagcugcggagccuggaauauggucggggaaauggaaacgaaggagaagccgaagcccaccccagauuauuugaugcagcugaugaacgacaagaagcucaugagcagccugcccaacuucugcgggaucuucaaccaccucgagcggcugcuggacgaaggugaggcgcccggccccggcgcggcggcccgggauggcggggcggcgggaaggucaggcgggcgggcgggcgggcgcacaaaggcggcgcgggcggcucgcggcccggccggggccgggccaggcccgagggcggacccgggagcgcgcggggcugcggggcugcggccggcucccgacggcgcggcggcuaggcuccccgccaucccggccaucucggccggcccggcggggccacgcgauuccccgagcuccgccucgccuggcccgcggagccccggcuuagcgggcucuuuucgguagaguugcguggcccgcaguacccgaucggaccccgagauguccaggaaucacguaggguaccgaagaaaaguagugcuuauguggccgaaggcgaggacgaaaugacagaguagaacacuuuuuguccuuuuguuuggggaagcgagaacuguuugggaguuuaacuucacuuuuuuuuuuuucuuuagucugugguggugguggugggggaggaguacgaaauaccgcgaggacagaccugaacggaauccgaguuuggaagaacuggggcggaggguucgcucccggcguagccgccugcguuugcagggcggggagcuggaaguuugaaaggacggggauaaaauagagcagaaguuugcacaagccgaguuaggagcgcuguggggagcgaagacugacuggagauuaaugcuggucagcucuggaauuccuuuaggaacuacucauagcagcgaccuggaguguuaguucccaguagcuguagguuucuguggacgcccggggcgggguuggggggugggauaggaccaacaagucuguuuuaaaucgaguagcgaguaguuucugucuucucuuuuaaagucucugaguggacuguuuaaaggaagcggaaaacuauguuguacagaugaacauggauuuuaggaucuugagaagaaugucgaaaaauuuuagagauagcuggggauaucugcuggcaugucagggaagaacaaaagacucccgagcuaaaagaugauuaaagagucauccucagagcuuccguuggauggggagcuuugggcaguauuuaaaacagaaaacauucagcuauuacacaugaacaugcaacagcaacacaucgaaagaggcauuuuuuauuguuggguugguauauuuguuaguguuaaauugcccuggagaaaaaacuugaacugccccuuuaaggguuuuugccuuuccuauuuguguuggcauuugaaaaauuguggaggcagaaaacuuucuggaauguccaaaaaaaaaaaaagaaagcuggagcucuuaaauugaguauuuccaaaagugagcgcuaaggggcgccaguuauuuuuuuuuaaccuuggaaauguuuggaacaaaauaguaugcuuaauaaucugaccuauauuaggugcaguugaaacuuaaauuuuuagaugacuucauuugucacuauucacaaaugugauuagggcggaaacaccucauacauugauauuucuuccuuggcauugguuuuuaugauauuaguagcauauuuaugaggaaaaauuuaguuuuuaaaaguucaaucaagagggaauuucuuacacaacaaacuagacagcauauacaaugaacuaaaaagcauucuuaaaaugcuucguauaccuaagugacuuaguggacuuauaaaaaguuuggauauguuauaaggaaaacuaguaggcguuucuuagauuaauuguaaaggcuguucaaguguucucuuucagcuugaucagaaauaacugccuuauuuugagguuggcauaagucuuucaacuagaggaauuucaaucuuugcacaggcuuauuucucuugguuagaaauagugacccuuuggguuucaaauguagaagacagcuaguucaggauuacaauauucaaaguaauguuuggugucuccuugucauguuuucuccaucuucaccuuagucuguuuguucuugggugucugagcauuaggcuagaguaaagauagcucggauuuaauaggagacaggagauugacuggggauugugauuguuuucaucacuugcaggaaaugggcugguccuuagugugcuauaagcuuuuaacuguacuuguuagucuuacuguaaauuuaauuugacuugaaaauucuggcuuuuuaagugcaccaucauaauuuucuugguagaugacuuaauugugaaaauuggcaacuuguccuuaaccccuugugcccucucauugucuaaaacaaauuaauuaugacuucuguuuaugguuagggauuacauuuuccuuugacuguaauacuuggcagaaaaauuacuuuuaaauucagauaaaacuaaguuucacuuuagggauuaaacuguucagugauaguaagauacucuacucucugauaauuagaaacuuugaaugggacuauuuagcaguuuuauuuuaaaaauucuuuuccagcagugaacuuuuaauauaguuucuguuugagaauuuucauuugauuuaacaaauuugggaaugaaauauguuaguuuucuacuuguuaaaacuugaaugauagaagagaaaucguauauuaauucuugcuggcuuaaagaaaguaguccauaguuuuaacuuagguaguaguaacucaguccuuguguuggcuguuaguucugcuuggugaguugugucagucuuucuuuccuagcaucuuuagcaggauaguuuuguuuuaaagcuaacaauauauuuuaggccagggcaauucuuaaauaaaagcuauaacuugaguuaauacuucuaagacuuaaaggaucauuuaauuagaggugagcagaagauuacaaauaaaaugugggucuuaaacugcuuucucuuaagauuuuaacuuuaucccugggauaaaguuacacacaaauuaucuuaaagacuuuucuuuguaaugaaaacgaguuaaaugcaaaacauuuuuaaaaaauaaacauuuuguaauuuaauaugaagacgugcagcaguaaauaacacaaauaacaaguagagaaaagcaagaaugugauacaugagcaucgaauuuccaguuuuaauuccaugauuaugagagagaggcugcuuuuaugaaaaugagaagggugugguuugaugaaagggggcagucugaauauuuuuacagaagcuugucagaaaaacuagaguauaauuuaggaaaaguaaacaaauauguuagauuuugcaugaaugauuuaaaaaugcuuuuaguuuuagauaacccuuuuucauaaaauuuccugcucccuaacugaucuuaauuuucaauuaaaaucggcuuugcuguuuaucuuugagaauguguucaguguugcagaugucauaccucugcuuuucuugaauuuuaauucuuuucuuuuugaaaagucuuguuuguccauaaacacuauggcuuaaaacuuugcauggccguagauacugaaaggacauaggugauauaguuugguaaauuuuuagauuuucuuuugucuaaaaagcaagucauuauugauaguaguuauugugucaagcauauuuuauguaagaugggguaguuaauuuguuuaggaacuaggacauugcuuuugcaauccauugcuuuuguaauaagcugcuauuuuucaccaguucucuccacuaugcuccucaggagauagcacagcucugugugggucuaauggaaacaaucguuugcgaguuuauucugcauuuacaccacacugcucuagaguuggaggugguaagcuucaucauguuuuauaguuaagguuguacuguuaaacaauagcacaauuaaguuuauaguagaaauagggcuuagagcgucacauuuccuaguauauuugcuaucauugccuuuucugagaugaguaugagaacgguaaaauaaaaauucucauuugcgugagaguggguguguuugaugauagggaccuucagagcugucucagaucagcauuuggcuuuuuaggugguuugaacauuguguaucucuguuaaucauggccccaucucuguccugaagcuggugucuaacaaguguuccaucagaucaagugauuuuuaguauccaaaagggaagcagaguccugugacaaaaucugacaaguauaacccugcgcugcugagacccuugauaaagcaggguaaagaagcaccuuuuucagcugcuguauuuagauggauaguuuuuugcuuuucuuuuguuuuugguacuaagaauuaauuaaaccauuugauuauauggacagcuuuauauaaacauaggaccugcauuuugauuuauuugagaaauuccguuuguuugaugcuguuguaagcaaaaauucucccuuucugucugaaauggaaugugcugugacguuauuagguuuuguuuguugauaacucagaaaauagcgcacugagcaacuuugugcuccuaguaugucaacuguuguggggauagcucagaaucuauuuuaaggcugagggauggaugaaacggauccauguuaggaggucaugauuagaaccgugugcugguuucuuuacauggaugacuugacgauuuuuuucuccguucuuuaguugacauuaaggcaauacaguagggauuuuaaaugcaagauuucccuccccccacccccugcaaugauuucuuuuaggaaauguauauaccucuuaaaaaaauugagcuuuuuaaaucuuggagcacauagaccgcuuacuugauguccaaggaaugauuucuuccaguaucauuuucauuuaauauuaaaaacaaaaugaacauaaacaauaaguuacuauaguuugucauuuucauguggcucuauuaggaagaaaguuaauaaauacaaaccauuuucugucuggugcuaugucuuauguaguuaucacaauuggaacuuagaucugauuuguuucgguaugccuagcuagaagugauucacuccauguguacaauucagaacuuguaacagacacuuugauguuuaaauuuuaaaucacuuauauuccuuuugauuucuaguuuuuucuuaaaaugcuuuuaaucacaauacgaagguggaauaaaacacuaauacuuuaaauacauaaagcaguuuuguaauaaucagugaaagcuuugggcacuuacagaacaaagguaaaugcauuuucuuuccuuuaaaaauuccccucuccccuuguaauauuacuguuuguaguacuuguucuguagguguuuaauauuuauuuuacuuuauuaccauugauauggguaggaauuagaaauauaaaauuccuuugcuuuuguaggguuguuucugacauuccuuaugcccaaauguccauccauagucagaaacaugucaaugcuuauauuaguuuuugcaagcuuuggcauuauggaauuaauguagguaauuuuuuuuagccauuugcuuuuaaagucaauauauaggcuuuguaucauuacugucauuuuuaugagcagaauuugucaaauucagguuguuuuagauccuguucaaagaauagacugccagaaaaaaaaaaaaaugaaaaggcagcuaacucuacaaagugguccuuuguugugggcaugguacaagaaggaaugcuugagagugcuuguggaucuguaaaggaagacaccaagugagugcuggccagccuaauggagcuagcuggugaacuuagaggaaagacaggaagcaguuuguggagguagugacaauaaucugcugggcccaggguugacuauguuuuuaagccuuguucuggauuuaguacaaaaccaaaucauuacaaagucagggcacggucaauuuggucaguagcaaguuauugggagcuaguuuuaugauuugaaauacauaggacaaaaucaagcauacaucuguuaaagucuuaagagcauacuuaggaaaaauaauacagacuuuugggggcuggagagauggcucagcaguugagaacuggcuacucuucuagaggaccuggauucaauucccagcacccacccgacagcucacaaccaucucuaacuccagaccaggggcaucugacauccucuccuagccucuuugagcacuaggcacauacauucacacaguguacaguauaucauaugugcagaaaaaaaugcucauacacacauaaaacaagaaaaaguuaaaaaaauaaggauuuaaaaaauuugaaauguuguauaaacuucaaugucauauucuuuauccaguuucaaaauuuccucauagaugguguggaagagaauauagaaauaacuccaagaaagacauuucuugguugagucuugguagagggaaaauuagugcaaaucaagugaucauauucagaacugcuaggaccagagaucagaaaaauguagacauagcagucuggagaggguggggacuugcucuuaucacaaguuugguuguugcaaagguggugcaggguucuuucuuuauucuguaugcugaucuguuuuaugaugugccauucauguaaggacugagaagaagagauuuacaacauauuuccacacacugaaaaaacuguuagagcuuccaguugugaacagaacgaaaauggaaguaauuuugccaauucugugcuauguuggacuuuaacaaaugcugaucaguuucuuggagcuagaauauauauuauuccuaaaauagcuaaaaauaagauuuuuugacaguuaugauucuaaaaguaagaaaccaaagguguguuuggaggauuuaaauuuacuugaacuuuucuguaagcaaagaauagagcccccguaacaaaugaauucaguguucauuuaccacuguggcuauuuuuauuacuguuauuuuuaguaaccacucagaggaagcaguauuucucauuagaagacuuaauguagaggcuuaauacuuuuaaguuauucaagccaggaacauaaguuugcuucacuuuuagaucugcauggggcaauagcucuauucuuguuguuguuuuuaaaucagggagguaacuggagaaugacacuauauaaagcagcugcugugacccuuuaauacauucauguugugaccuccaacuauuauaaaauuauuuuggugcugcuuuauaacuguaauuuuuguacuguuaugaauuguaauguagauaucugauauguguguuaucagauaagugauucuugugaaaggguguuccuaucucugguggggucacgacccacagguugagaaucucugcucuaaagacagccgauugugagcugaggaguaggugugcugcauucaguuacuacauccuauucccuauaucaguuuauggaggaugagugacuguucauuuguaauuuuauuaaaagaaacuuugaaaucucaguucuuuguuagcugugcaaaguaauuuuauuacuuagaauuguaugcuaagaauugaaccuagagccuuacacgugcuaggcaaaugcugugucauuuguuuuauucuuacaaauggaauuaacucccuuuccaagcaaaauccauguauucugaggauauaagauacaaaaaaagacugcucauaugagaagucuuuuucuaccaguauuuuuaaguuucuucugguaggaguaaucugguagagaaaccugaaaggcagagaaaggugcuuuauccguuagcuuuauguucgugagaauccuuaacuguaguuuacaggucacagagcuaaaguaucaaguagaucuucuugaguaauguaaccuggucuugguagucuggaaugaaaugagugggaagguacguucuaggagaaagaaaggauggcagugucagaaagguagucaaaagaugccacacagcagcacaugccugaguuuaaagucagccugauguacauagcaaguucuaggcuagucaggacugucuaagaagacccugaagaaaccaaacaaaaggacgagaacuggcgauggugaugccaucuuagaauguguauauugauuaguugguuaguugaaauggcaagugcuuggagaguaacaguguaaacaauaagugaagaugagagaguaggcagaaucaggacuggguuguggugauucuaaauacuggacuugauaguugcaguuuauuccagagauucuuagugcuuugcugaaguuuuggacuuuuuguuuugggugugucauagugaauuucuugugcauaauaagcuaauaaaaacacauugcauauagucauguauagaaacaggauaauaaaaaguuaagcauuucuguaugguugacuuauuacaauuccuuuccccacaaggcuucauaguaaauaagcucucuucugcaaacuuaaaagauaguuuucuguuuagaccaaugcauccuuuguguuuuauuaugaccaaaaagugugacugugcauguuuguaugugcaugugcauguguguauaguuuucagcccaauuuuggucacuuaagagaggauugaauuuuauuguuguuuuggguugugguuuuuuuuuuuuuuuuuuuuuuuuuuuuuaauggggugggguugggggaggggagacaggguuucucuguguaggccuggcuguccugaaacucaagagauccauuuguauuugucucuggaguguugggaguaaaggcgugcauugcaccaccacugccuaacaaaaauuguacuuuuugauuuuuuuggaugaaaguugaaaagaaugaagaaauucuugcuuuuguugacucuuagaauuuaacuagcuuggcuuggugagauguuuuucaaaaugaugucuuguguuaaaucaaaucuuuguuagcaaacauagugaagauuuucugagcauugcuauagcugaucuguguuacuucugcuuagcuguauuuucaguauugguuaaaauacaauagagauacauugauauuucaucuuuaaaguuuguaucuuucaaaauuaauauauuuuguuagugacaccacauuaacaagagucacaacucagauuucuguaguugcaucuggaguguucuuuauuccugcaguguccaaaucaaauaguugaaccuuguuauaauuuuaaaaacuuuuaaaauuugaaaacaucuuuaaaaaaaaaugccucaaccuggggguggggcggggcugagcugggccccugaguaaggcucuggccuacugggaaacaguaauugaccugugcuucugacagcccccugagacuccucuaggaggcugcuccuucccacaccccucaccccguggaugcauugacagggacagcugcuccgguucuaaugcuccuguuuucuugcuuuccccuccaaccaguucaaucucaucccucccagcagcuccccuuccacucccuggggaacugaagguuguccugaccaggaccugagacgaccuugaguggagggaagugaucuaugucucuucccuccagcagcugggaccagcugggggaguuggggaauucuugccaagcaccuugaaugggaaggguccuucaagagggccaggcugggguccagcaggggugggggagguuccugcucugucccagcugggucucacccagucuuguucucccauccucucaucuaccuccccaccccagggacagaagaucuuuuauuuucucauauuuauaaucucagacuugggcucccuguucuucuccauuaacuuuaguguccugugugagagacugacagaugccucaaggacuuuuacuuuuuauuacauaaaaauuaaaaaaaaaaauuuuuaaacuaaaaaaaaaaaaaaaaaaaaaaaaagccucagcuggguguagugucucaacccugucucgaacaccccccccccccccaaugccucaacuugaacuucuuuguugggaaauuguuccuuauucuuuuuuuguuuguuuguuuuuuguuuuguuuuuuucccagacaggguuucucuguguagcccuggcuguccuggaacucacuuuguagaccaggcuggccuugaacucaaaaauccgccugucucugccucccaagagcugagauuaaaggccugugccaccacacccggcuuccuuauucuuuguauccuuaguaugcuggaaauuauauuuauauacuuauuuauaauuuuguauuuguuuuguaugcuuaagacugggucuuggcuuuguauaucagacuaucuuugaacuuacuguguguuuaguguugaguggccucaaauuuguaaugauccuccugcucucaaauguaggaauuauaugagugcugccaucucaccagguuuaggaaguuagauuuaaaaggcaaggcagauugaaguauagcauguuuggauuauaucagagguggugguguguucuuuuaaguuuuauugugucaguagagacaguagucaguuucacuguuagugagacucagauuguuaacuagauuagaauacagaggcaugagucugggugguucccuucuguaaaacgaagguuuuauuuauguuuugaucagaaccuaaaucagccuuagguuugcguaugaacccuuuaugcuugguuaacagcugcuaaucugccugaauucauuucaugagaacaucuaccaugaugcuuuucucauucuaauacuuccauccaauaucuugguaguuugaaaaguuaaacuuugaacaacagaguagguauuauuugaaauaaaauccuauugggaaagcuauguagauuucucauuauguagccagaguuguuagccacucaaauggcgaccuuuuauacucaucauuauuaagugcguggauuucauagauaaguuguggucagggauaaucagauuggcuccuuugucuauuggaauguuucuugcuuuuugggacaguauauuccucaacuauguguguuuucugcuccauauguaaaacuagcguuuucacuaaaguucuuuuccauuuugaaugguguuacagacuauauauagguacaaaguauucauuauuguugaugugagaucauuuuucagucuauuuccugugggugcugguagguacuauuuauuuuaaucaguuugugucugcacuuuuaguuuaguuuuaucacaauuuuaucauucuuuuucuacaccaaaguaauuuuuuaaaaaagauuuauuuauuuuauuuauaugaguacacuauagcugucagacaaaccagaagagggcaucagaucccauuacagaugguugugagccaccaugucguugcugggaauugaacucaggaccucuggaagagcagucggugcucuuaaccgcugagccaucucuccagccccaaaguaauauuuuuaaaguuauauuuuauguuuaucuugcuugcauguaugucugcgcguguaccugaugcccaugaaggcuagaagaguguguuagacuucuuggaauagaguuacaguuuugagucaccauaugagugauaggaaucacaucuguguccccuggaagagcagccaguacucuuaaccacugagcauuacuacagcccccaaauaucauucuugauggugauauuauuacuuacuugauucuuucuauaguauaaaggagauauucucaaaaucaaaauaaucugcaaacuucuaaauauauuuaaauggucuuucucauuuuuacacauuauaaauuuauguguagugauucucauuucuaguguguuuugauuuuaugugcaguguuuuccuuuaguacuaaaucuaucuacuuuuugauauuaauauuuacuguguaagcucuuuuauuguaccuuuuuaaguagcuuuuaccuuaaacccagcagagauuaggagaacaaaucuuuuaaaaugagaagugugugugugugugucuguguguguauaucugugugugucuguguguaucuguguguaugauggaaauaugauccacauuguauuuuaaaaggagaaaguuuccucuuuagaccaaugcuuuagaucuuauccugaaggaaaggaacagacuagugccugugaaaguuauuuacacguagacaaaccuccuugguagaaaugaagcuuugaagcuguauuuggaaaaucuuuacugcaaccuuuuugucguuaagaaucuuuaacaguaaggaacuuauguuccagcagauggggaugucaguacacacaagagcauuuagugacuaaaauguguugggaagugacuuugucagaaaagaacauuuuauccuuuauauuauaagggaagggggguugcucaggaauaggaugaguuguaguuaauugcccuuaugaugguaaguaugccuaagguuguaucuuuaaagauuuagucuuuaagagacuauagguugacuauuuaauguaacuagcagauagauuauaauuuuuccuguaaugucuucuguuuuuauauuaguauugaacaguuauuuggggugauguaauauguuacauacuaagcaugcauuugcucauaauccauacuguccugaaucuugggucagugauugcuguauaguaauauuagaaaaaaggugagucguagcuauuauguuauaugaggagaaaguucuucugaggaucauaguuuauuacagcgauaaaaaguuaucagcaguuaaaccauaucuuaucucacuuuauugcuagaguuuauagcauuacaggauuucuuauuaguuuauuuuggcaguguuauauaauuuguuuuaaaaugugccuuaacaauuguugaaaaaaaaugcuguucauuacuguuugggaaaugugugccuuuuuaauauuaucacauuuuucuugguuauuguauuaguuuucuuccaguugugaaauacuauuucucagucacuugaaauuaaacucucaguauaaugaaaggaugugucuuuucuucguuggauuuuuuauggagauccaggaaggaagaaacugacauaggaacuuugguacaacuauaccaacuuguauuauacuuguugauuuucuacaaugcuuauagagaauugaaugcagucguuuuucaguuaggagcagaacuguauuucccuucagaagagagcaggagaguaggugagaaagcucagcuuuuaucguggcacaugcauuaaucccagcauucagaagguaggcagaggcaggaggaucuuugugaauucaagacaucccccucuccuaucccuuccaaacuccccaugcucuacccgguuuuacagggugaguuccuggacagccaggaccuaaguagagaaaaucugucucaaaacaacaacaacaaagacaaagaaugaggagucuggugugcauauuuugaacauuguuucuuaguguguaaacuuuugagaagcuugaauucuuuucucuuacuaauuaagaaguuguugaaagaacuagacagauguguuuuaauaacaaauacuccuuaggaaaaguuuuagauguaucagugaaaaccacguauaauuaacagguacugaguuuuccuuagcuuccuucuacgcuuuauuauuaauggauauuaauggauauaacagaauugaacgcucacuaaaauacuagcccuuuguguuucuuuaacacacacacacacacacacauuuaugagcuaaauaucuuuuuugugucuucuagcuuccaguuuuuuguugucauuugauguuguugaaguguauuaguuacugacuuuuuuuuuugugguagugguuuugauuuuuuugacaugccauuuugcuuuuaggauaccugugugugugugugugugugugucucugugugugugugucucuguguguguguguccgugugugauaaaugauuucuaaugucugauaguaagucccagaaaacuuuuaugacugggucaaugaauuucaaacucauagguuugcaauguauuuaauguaaagugaguguuuuuuggugaauuuaauagaaagugauuauuauucuguaguguuuugaauuucagaguacccuauuucacugcuaauuuuuaaugacauaacuaaaaguauguaugggguauuaugggggaauauaccagaacuuuagaauuauuccauaguuauugauaaccuaaacagagacuaaagccugguacuagaaagacuacuuuagauugggagguucaccagugguucugaagaagagaugaacucagaccuguucucaaaggacagaauuuaaaugguauaggaauaugcacuagaccuagaaacaguguccuuguacaaggacauuuuggauuacacuuuuaauaccugaaguuuaugcuccaaacaggagacaagagagcuauuuaaagauguuccuuucagggcucuuaguuguuugcaacuuugaucuaccacaguguuucugcuuuuaaccuagguuuucuuuaguuguauaagcauucaguuacagugaaaucccuuaaugagacaggcugcuguacuugauacugcuguuucucccuuucagguuuuuguaucuuuuggguacuggcauaucuuagauugggagugugagggagacaagaguuucauaauuggcccuaaagucacuguguacacuauaaaggaccugguagaguguggggugaccuggcauauuuaaggcuuuggauuuaaucuucugcucugcaaacaaacaagaguuagccuuuuucauagaaauacuacaauuccaaaguuuuggaauuggaaagaaucuuggaacucagucacagcuucacacacccacacacacacacacauacacacacacacacuucauugcugaaaacaugaagagauuuaauggucugaaccagcucucaaacuuuuuaaugcugccacucuuuaauacaguuucucauguguggugaccccagccauacaauuuucauugauacuuuaucacuguaauuuuacuguuuggaaucauaaauaucugacacgcaggauauaugaacccuugaaagggucauccaauacucaaagggguugcaauaaacagguugaguaccauggucuagacauugcugguuucaggaaugguagcuaaguuggcucuuuuguagaaaauaucuaaguuauauuguuagcaaguaaaaguaccuuuaagccugaucucuaagaaauuuuuguuauaacuauuaauuugugcuaucuucagaugugaagucucaauuauuuuaaacuuuauuuuguuacuuuacauauuucucaagucuuuuuuuuaaacauuucuuccaaauaagaacaaaauuaaguauacagugcacagacucauuauccuuaaaccaccauuaaccaaagacaaaagagucguuguuugcaguugccagcugucuacuauuuacaaccauuuguguugcuguuuuguauugucuguacuuugugggcuaagaugaaguuuuucuuaaucuuagaaaggcagugugagggcugagggacuguuuuggugguacuaucuucauugauagacuacuugccuugcacauucaagguccgagguucaauuuccaguacuggguuggaugaguaaauagaaagugaagugcguuggauaggaaaauaauuagggaagauaaaauaagauaugaauuuuaaaauccuagguuaguuuuucgguuauaggaaaauuguauauuauguugugguaaggagggguguggugcuauuuuauuuuuuacuucauuuucaucuauauaaaauuugguuuucagguaugaguuagcugaaugccauaggauauguaauaguaagcuuauuuuguuacgugauagcuaaaguugugucucaaaaucaacuuugaguauugaauuaugaguuacuuugugauuuguauagauggcuuggacccugaagaggggagaaagaacaagacagugcuggagagaaugcugguaauaaagaggacccucaguguguccugggcugguugguugguugguuguuucuuccuccuccuccucuucccuccuccucccaauuuggguuuuugaauauguucuacacuagcccaggcuggucuugaacuuccuggaaccacuucucuagggcuuugaucacagauguguuucaucaugucauaaauugagauucucuuuugguugucuccauuagcaauauuuguauacugacuguacaaacaaaaauucuuaaauguuaauaaccaagagaaauacuuugggggggggcuggugagaugguucaguggguaagagcacugacugcucuuccaaagguacugaguucaaaucccagcaaccacaugguggcuuacaaccacccauaaugagaucugauacccucuucuggugcguuugaagacagcuauagugaacuuacacuaguaaauaaaucuuuggccggagcaagugggguuggcuagagcaagcagagguccuaaguucaauucccaacaaucacaugaaggcucacaaccaucuguacaacuaaaguguguacucauauacauaaaauaaauaaaucuuuaaaaaaauacuuuguuaucaaaguaaaguauguaugucuauauguguauuuauauaacuaauaugaauguuuagcaaauguuucacuguuauaucugcaauacaauuuaguuuuugaaaaauacauuuagucuaaaaaugcugguuaauacuaauuuaacguuuuggcuuauaguuaucaaaaagguaauguugacuuuuguuauaguauauauaucuuauucauuuauuuauuauuuucaacaaucuuuccccuuaacaucuuacugggugcuauggauauagaaauaagugagauacaauggucuggagaagacuuaauggaaccaugcccaacuuuaaggagauaccagauuuucuagccggaagaugaacauuucuuuagagaacauauguuuuauaaucugauaauuucucuuacuaaagagauuuaguucugguauucucucuacauuucuaaaaugaaaaauaccaaauauguuuauaugagcuuugaauuuuuggcuugcuggccaaguuuguuaaaaguuaguuaccuagcuaaucuuuaaaauauuaaacuucacaaauuaauaagaauauuuuucuaaauauacugacuaguuuaaauuuaacuauuugagaaacauuucuuuucugacacccuucucccccaaguuugaaaaggaacugucagguagaaauacuauguaaacauuugucuuugacuauuggcccuaugcccagaugguaaaaguuaaagucugaaucaagccaugaacuuguaaacaauggaauaaaaaagauaagcacauaauuuuuuagugcuuaagaauagugucuuuuuauuagacuuuggaaauauuguagacauugacuucuucuuguaguucuuuacaaauuucagauuuggcagcuggaaguauguaguuccuugguagagcaccugccugucaguacgcuaauugugguuucauucucugucguggcaaaguaaaaaaaggauguuuaaaaaaaauaaaauugaaacaucuaagcugaaugguuaguuacguuuuauuaaaaggccuuaaaacaugguauuucuauaggauucagguuuuguagguuucucaguuguuagauuuucucugugugauuggcugcugcaguagguuaaggaaguuaacgucugugaggaugugguaguugccuuagaaugaucuugcuguuagcagugaaaaauguuuuucuuacaguuucugugcagcaggccauggaguaaagcacauuuuauaauaaaggugaugaauuuaaucacaaacuggcagccacauggaaacugcaggccuugaugcugggagaaaauugccuauaaagcaacucuugagagaagaggcuuuaaauuuacccacccauuucgacauuggagagaacauagggauuauacgauauuuugcuuggccugcuuaguucagaugaaugacauuugaguuuucuacuuagagccaguuuaaaguucuucagucagacuuuugucaauaaacuuuuacauuuuucuaaauauuucuaacauugccuuuucaguacaugauauccuaauuacuacugugcccuguauuuuguuucuuucauauuugagaaguugcacuauguaugugaggaacuauaccuagaagagacacaugcaaggcuuauaaauaacaauuaauagaaugccaucaguggcuacuuuacauuuguuuuuauucuuugaaaguuuuauguuguauuuugguaauagucacuacccuccuccaucucuucccagaucauucaguauccauuuaauuuucugucaucauuuguuaaaacccaucguguucuguagauaucacugcuguuuuggguugugccuaacuaauuuaugguauaaaauuagagcagaaugguaaaacuuguauuaugaguaaucuagguucuuauucuauuuucucuaaaugauuaaugcuugucauuuuugaggaauaacccaacccuugauaauaccauucaguauuuggagcguuaaacccaguuuugugguauauuguagcauucauuuugaaauacuucauuuacauucauuauauacauagccauuagaagauggccauuucagauucagagaauuauuuguggcaaaugaaaauaaaaacccgucuguaguggguuuggccuaauguuguuuguauucaaauguuaauuuguguccuccaaaacuguuugcaccagaguuuacauguuaagacauugagggacccugcccccaguuaauuaugauuaguaaguaaacauuauuuuaagaaaguuauuagauuuuuuuugaauauauacccuuguucuaauugaucauauuuuuuugaguaguacaguguaauaaguauggaaauccuguuuuuaaagcagacauugaaacuuaauauuuggugauuaaaaaaggauagaaggaagaagaggguccuacaaaugucuguagccaggagacaauuuauuggaguuguagaucaacuauaaagaugugaaaaucaagaaggaauaguguuuccuuuaaaaauacuaaaaaauggaccaguaauugcaucuuuuucacugaaaguuucauuuaauuaaguguuaagucuuuggaagagugauuauauuagaucuguaugaaagaagaccuuacccuguaauagugaacauaacccaucuuaccaucacugagauuugcacugagggcagaguguaaaccagucagugcugacauuccauaaucagugacacauuaauacuuggucaucuguuuacuugauuuuaguaagcuauggcaacuuuaagacuuagagccaggauuaauauucuaguuaugugaacucuucuguaccuggucagauaauugaugugugagaagcuuuauuuucacguugugacagaacuuaaauuuuaugauuuuuacauugaagaugaagccagagucagauguauucaggcauauaauaugcacuugcuuauauauacuuuaagaauagaaacguugcauguguacuuaguuuuaaauagcuucuguuuuguuuaaugggcuauaaauguaauguauguaauacgauguaaaguauaacuggcucaguauaauaaucacauguuuguaagcugguacuaaauucaguuucuguagauccugguuaauggccugccuaccuacuuaccuauccuucuaugcaucggucuauuuauccaucuaucugguuuuuuugagacaugguuucucuaugugaccccuggcugcccuggaacagcagucuuuuuuuuuucuuuuaauaagagauuuuauuaucuuaugccaaaucaagucuggaauaaaguuauuagcuauaguuuaguuucagauucuugaugccagagcuaaagcaucucaaguaccuaugaucuuguguuguugugaaaggauuuuggaaucuuguuuugaacagucauauaguucagguuacucagaaucacaguguccauggugugcugugaagacagugcuuguaguaauauuacaguuucauaucaauggcaucagaugguuuucuuuuguuugcuuuuuuuagguaaccauuuuaagguuuuuaguauguaaacauacauugcaauuuuauuauacaaauguacuuuauaaacuuaaauauauauugcaaacugaaauguuaaucccuacccuuccuuuuccccccauguuacucauuugaagcuaaaauaaucuuagacuuaagaaaacugauuaaaguuagaaccuggagcaaaaagcucugacccuuuagaaagaguaagaaaagugcuaaagagagacaaagaguggagcauagacugaaggaaaggccaucaguccaucauuggagccugaccaauacauaugcggaugcacgcagccaaacauuggacuuaagugugaggaccccaauggagaaguuaggggaaggacugagggaguugaagggguuuguaacuguaggaagaacgacaauauaucaaccaaccagacucccuauagcucccagggacuaaaccaccaaccagagagugcacauggagggaccagcugcacauguagcagaggauugccuuaucuggugucagugggaggggaagcucgaugccccuagcaaaggggaaugccagggcaggagcuggugggugggugagcauucucauagaagcagggggaggggggauggcaugagcuuuugcagagggaaaauggggauaguauuugaaaugcuaauacauaaaauaaccaauggagaaaaagaaaaaaaaauaacacccagauaauaaaaaugugugcuguuauauuuuuuaaaaaaagguguuaaagagaucauuugcccugaaaauuugaggcucuuuuuaaauaggcugacuguuugggguuuguauuucagugguuuauaaaucaugacaguugaauauguagguaacaugacuuugcuguauuauacuuuugcuuuccuguuuaugacucauuugucaauaguaugugcuagaugcuuucucucaguauucuuuaugcauuacaauaauuuacuauauaauguuuacagguugaacagccuuaaucugaacauucuuaaucugaaaauucuccaaaauccaaaacuuuguaaagguuaauauaccauaaguggacaauuucacaccagcuuaccacgaaaacuggagcucgcaaaaauauuguauaaaaucaacaugucuaagagauacuugaaacauaaaugaauuucuuauuuauuuagacuuugguuccauccucaaggcagucucaucauggaugugcaaacuuuucaacaucuguauauaccuagaaucugaaauacuuuucagauaguuauuaaguggauauucaaccuguacuuauagaccuacucuucaaaauauaagccuaugggagacauuuugggaguaauauuuugggaguguaugcacauagauauguguacuuaucuuauauacauauacauagaaucucaauauucagcauuguuucaguugggaacagauucauuauguagaugaagaaaugauacacauuaaacaaauaauguauuuuugauaguuuauccauuccucaccacugauuauauuuauaaccauucugucaucuguuuuguaaaaauuuuaggcuaucauggugguguacacauuuaaucucugcauuccagagaaagauacauguggauuucuaugaguuagaggauagucugguucauacuuaguuucaggccauccaaggcuacauugcgagacuuuuuauuguuuuuuaacuaguauuuuacuuaauuugugaacugauuguuuaguuacgaacauauagagucaguuuuucccucaucuuucuuguccuuccuaauauguacaaugcauaaaacauuaaauaaucuuuauucccuaauuacaccucuaaggauagcuugacuguaaauagcuugauuugacauugucauucugugaaaaaguacuuuaagguagagagagaggugcgugaaccguauguuuuacaguaucuacagugagauucagucaggccugugucuuuccucuuuucucaagagaaaagaacagcacaacauuuuuggaagauacacauugauugucuuucaacacucuuuacuccaauaguaaugauuuucuuuuuaaaaaucacacacacacacacacacacacacacacaccuguuuuuuuuuuuuuuuuuuuguggguguaugagugucuucccuguauguauguuuauggaagccaggaauggcaucagauguccuggaccugaaguuacagacagcugugagcugauaauauggcugcuggaaaucaaacccuaguccucuggaagaguggcuagugcuauuaauugcuaaggcuucucuaguauugauuuuuuaaagaugaguuaauuuuuuuauguuuugaugcuuggugcaccauucacugaugcuauugacaccugcgaauuggccugguuuugagagauucugccaucuuuuaucacuucccugcuuagaaauaaacauacuggagauugcuaauguaccuagaauuuuuuuacccaauuaaagaucauagacaggcuugguuguaauuacugugugguaaagauuagccucuaauucacaucacacccuauagucaucuuuggugacuggacuuaaauuaacuaguuauccaauugggacaguauuagugaaaucuuuuuuuuuaagagauggcuucuuccuagcguucagggcccaagauagaacagaacaccaagcuuuugugucuuguuucuauuaccucucaaucuauucucauagaagucaauuccuuuuuuuuuuuuuuuuugguuuuucgagacaggguuucucuuuauagcccuggcuguccuggaacucacuuuguagaccaggcuggccucaaacucagaaauaugccugccucugccucccgaguacugggauuaaaggcgugcaccaccacgccuggcuauggaaguuaauucuuaauuccuagaaaacucuagguacaaguuucugauuccauagaaaguauccaguccauacuagcugaacauccauuuuauuccagacauguauaaauacuugcuguucaaaauaauuuguucuauugaauucauaaguuuacccauagagugaucucaggucuugcauuagaucauugaacauggaugggcuguacaaagcuuaaaugauagcuugaaagaggcuguugugacuuggaugaauaucuuugauacagcuuucauuccaguuuuaaucauaauuuggauaugccauuccuugccuugguauugcggucucuuaacuuuucaaguuuaugucucuuuucccauuauuuuccucuucucucugucgcucuuguuacugguuuuccuacucguagcuauuugcuccgguaggaaccagauuuaauuuugaggauggaaaaguaaugcuggagauagucuguuguaugaaauaaagacuacaacuuuagagaaagcccagcuuugaaaccugacuuucaauuacuaguuaaaugauuuuaaauaaagauauucaaauuuccuaucucaguuuucuaacuuuaaaaucguaagaauaguccauaacuguaaggauauguaccuaaccacacuauaagaauaaaucucucaucuccaagacauaauuaggaagauguauuggaagaaagaaggccuugcuaucucuaauucuaaaaucucugcuguuacaacuaccacucuucaaguuuuuuacauccuaguuuugagguguaaauucuuuuuuaggaaagguuugcguaaugguaaaauaggguuagaguaguaguaguugaaaaauuggcuuacaaagaacaauuagauguaggggcuuggagagaaacuacuacucuguggauccaucucuugugcagugccuucucagauacuguuggacaugaguguuuuuuggaagcucagucuugaacauaaaggagaaaucagaaaaggagcucuuugaauucacuuuucucucugagaucucaguuucuccugagcaaugaagucuaagagcaccuccuacuuauauagacuacaagaccauagaaauuaacauaauacuuguagguauaaaucucucagauuauguuguaggcuuucccuccucccuuuuuguuguaagccuagccuuuacaguugagccgucuugucagccaggaauucaguaaaacauaagauuauuguuaugugauauuaggaaauaguugauacuucuuugaaagaccauaccucugugcccugcuucaacucuuuuuuuuuuuuuuuuuuuuugcuaacguggauucugguggaacagaaacuaagucuguauuuccauaccauuugccuauggccuugaccagugaauacacugguaccuguuuguuaaauagauguuugaaaaguuugcacuuaaucuggucugagauccauuaaaggaauauagcguugcuguugugaacauuuacucuuggcaaaccucauaaguccaauauaaagagaaugagcuuuguugagaagaaccuuuauguuaaggaagagacuuaguuugucaagcauauauccacuuuugaugcuugggugaagguguuaagaauguagcuugguauauuuuaguguguuaaguguguuacagagauaguuguggcuagaacuaguaugguacagguugaaguggugagauauuaauauguauucugaaaaaugagugcauauuauuuggggacaugaacuaugaggaugacuuugccuguuuugauagcaggaggaacagacguuaugagcaaagacuggaguuugauuucaaucgugugaaauugucauguggagaaguuggauaugacuggagccaugaggagagugggcuugauuagaauauucuuuaccaguuuuuuuuuuguuuuuuggcugggcuguuuuguuuuauuuuauauuuuaacuauuagcauuuacucucuguuuugauaaauuuaauguuuaugauuucaaaaaguuguauucugcauuucaacuaauuaaaacugcucuucgagacugcuguaguagagugugcacuucagaagacaauaacagugcaguaaaugcacugcuuccaacaaugcagcuuuauguagauuuucugauucuuaagcuagcugagguuuaauuagggggcuuucacuguaauugcaaugauauuuucaguucuaguuacuuggauuuuugagggcauacuuaguuggcucuugucauaaaaagaacuaagauuuuugcugacauaucauucacuuuucaaauuuaaucuugguguuuguuguaaaagagcuuuaugaauguuguauauaauagauuuaaaaaauaccuuaugcuuaaaaauuccuuuuaacauuuucauaguaugaaagagugcuccuauacuuguguguaauuuuauauugauucuuuuguuuuucauggcguuaaggugcacauguaaaagccugugggcauaauuacuagucuuagucuuuuucuuccuugaaacugcaucagauuuggaauacaaauaaaacaggguaaauaaaaagaaguaaauauguagauaaaguaacccauuauuccucacccaucuucaaaguacuuggaagguugugcuuuaguuuuacucugauuuuuaugacuuugaguauuuugugauauuuaaaacaaaauuuuuccaaaggcacuaaccuaagaauauagauguaaaggagccuggggaagaaagagaaagauaagcugcacauuuaaaaauuuaguacuggccaggcagugguggcgcacgccuuuaaucccaacacuugcgaggcagaggcagguggauuucugaguucgaggccagccuggucuacaaagugaguuucaggacagccaaggcuacacaaagaaacccugucuuaaaaaaaaaauacuguuauucaaacuuuggggaauauuauugugaaugacuuuaauuuccuaaguuuagcuaguaaauaaacuuguuuuguuuuguuuuuuguuuuuuucaagagaggguuucucuguauagcccuggcuguccuggacucacucuguccucaaguccuccagcccaugcaauuuccuccuuuagagccucuaauucugugggggucagcuccccuccuccccuccucucgcuuccucagcuuccuccuuccucccucccucucucucucucccucccucucuuccucccuuccuucacuuucuuucaugacaccacccuguccaacgacuuggguacuuuuuugaaaaguuuuucuuuuaaguauugaguuagucugauaauuuuuuuuaauuaaaugauuagauugaggucauguauuuugguaagaaaaacacaaaaauacuuuguugcaccaaacuaggaagggugaguaugugcuaauuuuaauugcuugguuguggugaguuuugguugacauaauucuucaccauaaaguuucuucucccuuuuauaauuaauauuaucucauaucccguguugcucacugauuuuagcauacacuuaauaaacuucuuguaugccaucacugcuauaaaugguuuccuauuaguggauuuagaaaacaauuuuaccuuaauuugacaguuauuaauuggaaucuguaaaucucuuuuccuguguuauaauaguugugguuucaugguucaauccacuacugccauuauucuggucaacaguaaaacacuuuuugagauggcuuagaagguaaaggcacuuugcuaagcaagucucaagcuuccgugaaacucuugguggaaggagagaacagauuccugaaauuuguacuuugacuuacagaggcgugcaggaugagcgucucuauguguaacagugaacaaguuaaaaaaacccaaaaaaccaagaaaaccaauuuugaaaaaaauacaaauacuaugagauagcacuuuaaucucaacacuccaggcagaggcagagaggcagagaggcagagaggcagagaggcagagaggcagaggcagguggguuucugaguucaaaggaagccuggacuacauagagaaauccugucuuaaaaaaccacucccccccccccccgcccccaaagggaagaaaugaacuugauuaaaaacucaaugguuuauaauaguacauuuuuaagaccuuuuaccuguuaugucuugaguauccauuuccuuugcuuguaaguaugaaggaaaggguuaauaaaacuagaguguuguaaguguuauguuuaaaccuggcuucucauguuaaucuucuaauaaucacugaccaacccuaugaguuauuuaacuucagguuucauagaauuggaauugcauaaagacuuuuucuuugaauauuaugaggaacucagugagcggcaaggucauuuuuaugaaauguuaauugacacuuaucauacaaaacuaaccauauauauauuuuuuguuguuguuguuaaauugagccaauuaagcuuuaagugaaaaaaaacugccugucucaauuuaaaagccugguuuuuauuuuuuuaaagaugauuuuuccauuucuguacuguucuuccuaaugacuuauuuuaccugugcacagaagcaacauuuguucauuccaauuacuuuaauuauuugauguauauggguauuuugccuguauauauaucugugcucccauguguaugccuggugccugagaaagucagaagagugucagauucccaggaacugaguuugcagaugguagugagaugacacaugggugcugggaauuggacccaagugcucuuaacuggugagcuauauguccaucccuugauuaauuguuuauaaaauuauucucuaccaugccuaaucauuuuaauucauucauauuacgaacacaacucauuucaccuauucauucuuccuuuuuccccugaugauccucuuuaucuccacuaguagucacuugcaaccuacaugucauauauauacacauguauaugucauauugaucucuauguuuauguccagcaugagaaaacaaugugguuucaguuugaaauuuauuucuuuauagcuaaauaaaacuuuguguguguguaaaguacauuuucuuuauacauugaccuguugaugaacuccuggacuaacuuugugucuuggcuguugucaucagugcuacgguaaaaaugggugugcagaucucugugguacucacugauucuuaaaacaguuuauuuuuaauuauguguaggugugugcaucugcacgagugcaguuuucuguagaaccccagagacaucagauccccuggagcuggaguuacugguagaagugagcugccugaccuaggugcugagagaguugaacuucaaucuucuggaagcauagcaagugcuuucaacuacugagccaucucucuccaacuccugacuuugcuuuuuugggggguugggguguuauauauauucagaaauggaguagcuguacuauucgacauuucuguuuugaggcuuuugaaaagucucuagugaguucgguagugccugcagcauucccaugaguggugugcaaggguuuguucuucccaccaguguccuugccagcacuguuuucuugaugacagccauuugauuggaagaagauggaaucucaguguagcuuugaguuucccucaggguaaaggauguugaacaguuuuucauauacuuauuggccguuuuuauucuugacuccaucugcucauuugaaugauuuguucuuuugauguuuaauuuuuuuauuuguggauuuuaguuauuaaucuuuugucagauguauaguugacaaagccuuucuuucauuuuguaggcuauugcuguuaacuuuuuucauugcugcucagaugcuuuuuaaaguuauguaaucccacuuguuaauucucauuauuuccugggucacuggagcccuuuucacaacguccuugucuauuccuguaccuugaaguguuuuccuguagcauuugagaguuucuggucuuacauuaaggucuuugauccaccuuacaggaugaaagauagagaucuaauuucauuauucuacauguggcuauccaguuuucccauaacuuuuguucugagugccuucuuuaauguaugauuuugguacccuuguuuaaaaucauuggcucuagcaguguugguuuauuucuguauccuguguauucuauugcuccugcugucugguuuugugccccugccauguagguuuuguuggugugauucuaguaaaaacugggugcugauacuucuagcauuauuauauuugcuugggauuacuuuguuuuauuugagggguguguguguugguuuuacaugaauuuuaggauuguuuuucuaguuccaugaagaaugccauuggaauuuugaacacaaguggcuuggcucuguaaauuaauuuuauuaugagagcacuuuuacaauauucuaauucuaaugucucaugagcaguauuauuuguucauuguauauuuucaguuuucauuuucuacugaacucuguguuuaauuuuuuuuuuuaagaaagaagguuuaguuuuaauuuugagguguagaguaugauuuaacuccccaauggcuuguuuuuuuuuuuuuuuuuuuuuuccccuuucccuuguuaguuuaaaagcaaaugccuuuaacuuaaaccagauguaacuuacuuagagcaaguaaaacaucuuacuaaguagugguauauuuuguaguaucuuguuuuaaaauucauuugcuccagcuuguagauguagcuucuuaaaauaagcauggggaaaugaugcauucuguggacuuucucuacucaaaauaacuaaacuuccuuuguauaugcuaaauuaugauuuggguuuuuguugauuguuuuuucuuuacagggcaaaauaggaaagagcucuguuaauccucaguacauauggcuacauaacagcuacuucuuuagggaggagaauuauuuuucagauauaaauagauuucuaauacuguuguucuaagacuuaguaagcaucauguuaagaagaauucacuuguuaagauuuuaaauauuaaacccuuaguuugcuguuuguguuggcuauguugcaguaauacccaucaaaagguuaauugcagauagaaaauaauagaaucuauuuguguugaaagcugaaaacauauuaacauuuuaaaaccugauuauaauuaaagcauguauuuauaaaauauuggcuauuaauuuacucaaaucaaugaaaacuguuaauuuaaaaacugagauggucaugaucaaguaaauuauaaucuuuucauaccuuucuauauuucuguguauuuagguauauuauguuaauguauaucuugauguauuugugaugcauaaagaaaaaguauauagcugcccagauaaaaugucuuaauguuaguauguccaguugagcuauuagaaucaguuaccacaacagaguguaaaagacaugcuuuauuuggaaaaacaaaacaaaaaccccaauauuuuauaaacuuuaaaaaauggcauuaguuuuuaaguccugaaacuuuaaugcauuuuguuuuucugugugccauuaauugcuuuguuaauaauuauuagcuaguacauacucucauaguuuucuaaguuuuaauuuguugaaaacucucaaucagaaaguuagagcuguuuuuauuuuauugguucuucuaguaucacguuacugaaucuauacauuuaugacuaguugagguuuuuaauuuaaaaauuucagcucuauuuuucuauccucugauauuuucuuacguuguucuuuuuuuaauuuuuuuuauuuuuaaaauuuuuuuauauauuuuuauuuuuuauuacguauuuuccucaauuacauuuccaaugcuaucccaaaagucucccccccccccccuucuugauacuaguacuuuaauacauugcaaaguagcuauucauguagcuauuauggucauauaccuguacaguaaaagugauuggaaagaaaaugccagaggcaaauagugaacugagacaugagaccugaugggaauaauaaaccuaauuagguauacuaaggggaagagacaaagauuaguggagaugauucaguaacagcaagugagaaacaaacaauccagcuucuuugguaauucucuguugggaacagaauaaacugacaguugagcuuacuuagaaaaagagaaaaaagaucaagauuauuaaagcagaggaguggaagaugacugcagauggcacaaccaguucaguuuuuaacccuaaacacaaauaauuuuguucauaucgaaauuugaaggaaaaaaaguacaguuacugacugucuccuugagaaaacauguaaaauaggagaaagccuaaaugcuauaaagaugaagguuugauuucugaguuuaauggcacaaacuaugaauugccuauaaugugaaccuagaggaagguggaguugugugugauagaguauaucuguaguccuagcucucaagcugaagaaggaucauugugaguuggacuccagccugggcuguuaaugaaugagacaguauaaaaaaaggaaccccuaccccaccccuacagaccagauaguauguaucuaguguugagauuuuaucagguagguaguuuaguaagguguguggauauuuugauauccaagcuagcaaaaugugcgauuuaugaaauugcagucaucuugaaugagaaacuaguuggugauaagagugucaguagauuaacaucauuuuaaagggauaugguaguagaaaagacacaagaaaaaaaugcaaaguguuugcugcugucuuaaugaacaguuguggagagagagggaggguagacuugccacaacuccacuagcuagcuacacgagcacugccuauuaaagcuggcuaaggaauuagugcucuuuacugaaggaaguagacagaguuacucuccaugcuucaucuuuuuguuuuggaauguuguguggcuuuauauuuuuagagaaaauauagggggggaguugggaggcggggagcaggagggaauguaucccaauuugcuuaugcuuuuugaaagaaaaguaguaacuuucuuagauuuagcaaugaauuaguuuguaaucuggaggccuacacguguguuuuagguuuuuuuuuuuuuuuacauuccugucagcacuauuuugugcauauuuguauacuguuauuagaguugugaaccuuaagacugaaaagucaggugcaacacuuauauuagacuuaacauucuuuguaagcuuaaagccaugacccgugcagcuuuauuuugggaccuagcuuguccuccuuuaauuuuuccacccauguacuuaacccaaguccuuauuuaagaccucuaugauccaggcaguauucuaggagcuacaaacacaguggguugcaggaauucauagaaauuuuaguuacugaucaaagaauugcucagguauauauagaaauacaagugaaaaggcuggugcauuauauuaccuaauuggaugauagucuguaauaaaguuuguuuuauuuguaucaauauuuuaaugccaucuuaacuaauuuuuucuaaucauuuauaguugguucucuuuauuuuucuaaguuuuuuuuuuuaauuuggaaaacucacaauuuuuucuuuccuucaucuauuuacauuaugccaguuucuuauaauaauagguuauuauccugagugagaucagugaauuuugaaacuaucuuaauagaaguuauuuugcaguagaugccaguuaauaacacagagacccuuagacuacagagugcuuaacucuaaauaggcucugcauaucucaaggcucugcauaugucccugaagagguuguggaaagauagugaggguaagauguaguagacaacuucaagggaacaguguuuucugacacaacagagcccuugcacauacaaauuuggagcaguuguaauaccuuaagccaggcagaaucccugaauagagggguaauaguggggaccaaaucccaucacaaguuuaaggaccuauuggcauuugaaagcuucuagaagauggggagucaguuuuccuuaaugauaggucagucacucaccagggcaagccccacucccaagaaguaguuggguaaauauuauacuugauauguuaaaaagaaaacaaacaaacaaacaaaaccccaaaaaccuagaaguuggguggauagggagguugaaucugggaggaggaaggaggaggagguguguguguguguguguguguguguguguguguguguguaauaagaucaaaaugaguugaaugaaauucucauaguuaauacaguauuaucuuaaaauaucaauauuuuucaaauauugagcuaguccugcaauagcaaacugcccuacucuugagauugaguccagggccuugcauaugcagugagcacccugcuucucuaccacaucucuagcccuccacuguguuguggugcuguuguccuuucucgauuauucagaacugccuuugcaucuagagcagcaaacaccauucccccucccuccaucucccaccucagugcugagaguugaacuaaaggccuucauugcugacuuacauucucccccacccccagcccucuacuuuguuguggugccuuuuuuuuuuuuuucuuuuuuagcuugucaguccuacuuagagccuuuccacuuauauuauaugcaaauuauagauauaguuuaagauuuaauuuuuaauuauguaaaugaaucaaucuguuaguaugugcacugaauacaggugugccuggaugccagaggucuuuaauuccccuggagcuggagguacauaggguuguuagcugcugcuugucugugcugggaacccagcucaguuccuguaaaaagaguccaugcuguuacccacugagucccugcucacgcugucccugugugugaauauguguauuguuugcauuugggcuagugugccauguguaugcuuggugcaugaggggcucaagaauggggaucaggcucccuggagcuggagcuacaauugugaacccguguguggggacugggaaauugaaccugagucuuuuccaagagcuauagguacucuuaaccacuaaaccaugucuccagcugaguucucaaccuuccuaaugcuaugacccuuuaauacaguuccucagguuauagugauccucaaccauagaacuauuucauugcuaccucauaacuacaauuuugcgauuguuaugaauuguaauguaaauaccugauaugcaggauaucugucuugauucacaguugaauauugcuugugugucauuuuuaaaagugaauuuuuuaucuggugguaugcucaugucuucacaaagaauggaugacuuugugaagaaauuuauugaugauaaauuaauaccaaccaauacuuuuaucuagagacacgucuaaagacuauauguauuuuaaauuuuaauuuaauuaaauauuagaaauauaaggauaacuuuuagagggguuggaaaggugacacaaaucuucuuuagccuaaucuaauauacucuuuuauucuauuugcugauuaucaaaagaggaaaauacguacuuugaaugguuaagauuuuauaacugauuaagaauacuuggauuguaccuuuuucuuguguuuuuacugaacaaaacugaguucaguaaguaguucggaaaauuauaguguauucauauuugggaguuucuuaauaugaauacuuuaaauuguacauuuggaauauauaagauauuuucuggagugauuuuucuucuccuuuuucuuagggaggcauuacucuauagaauggagaaacaguuauguaggcauccagcccgccuuaauaauggaauaccguauugaaaugauguauguucuagugugcaagccuaucugcugguaauauagcugaagcucauuaaauauuuuauggaagaaucuauuuucuuuauaagauuugauuuauuaaaauuuaguuuucacauuuuucaaaaauacauucauaguaagaauuaucauacagauaaugucagggguaaaugucauugguuuugguuaucuuugcuuuuuuuauuuauauuuuaucuguuaacucagugugguuuguuuucuuuuaccaucuuucccaugaaacuccuuugaugaguuuuaccuuaguggucuaguccaagacaccaucuuuacuuccuguuuguuccauagugucugaucacuuuggcuugcuugguacuugucuuccuuuguaccuccuuuuguguucucuucccuggaauggugcuuuccuaaggguucauucaguucugucaguccagucuacuguuuucuuuucauagcuuuaacugcuaaauguguacacuacacucagacuuuggcuaaacuuggcuauguauuuagucugugagcaucuugagugcauuagaaauaucuaaaucauucaauaagguaguauccaguuuaaaucuugcugaggcagauuguucaugaagaaaaaagagcuuuuuuugucuuauguguuuuauggcaauuacauaacuaaaacuaucauuuaaaaugacagaccucauuuuuaagcuugaaaauauuagguaaacuaaaucuauaugauuauggcuaagagucuguucugaaguuaguuuuaauaggauguguaauuugucuaguauuaauuugauuugugguaaaaaugaaggcuaucaucuuguuagcaggcucaguccagagaaugcccgaauagguugacagcuccucacuaaaguguuaauauuuuaucagugaagaaccccuccccccuuuccuggauuagcaagaauauuuuuugucuaacgcauuuaaaauuuuuacuuuuaacagaaauuagcagaguacggaaagacauguacaaugacacguuaaauggcaguacagagaaaagaagugcagaauugccugacgcggugggacccauuguucaguuacaagagaaacuuuaugugccuguaaaagaauacccugauguaaguauaucuuguuguuuuguucaugguuuucugcuucacauacuauauggagagauaacuuuugaguaaauguguagguauuaucagcugcuuuaaaaggauuguguaugaaguuagaaaugggacuaguuuuauguggcuaauuguuuucucuuuaaaguauauucccauuagaauuuugcuaugucacuuugggaaauaaucaugcagaagacuuuggaauuucaaaaagaggucaagaguugugggaagacuuuuauacugaaucuucaagaugaagugcaacucugaccacagaauccauagcuugaaccaugucauucuuucuguacgagagugcuggucauuaugguugcuuccagcucuaacguuuccgagaaauacucuuuuuagugugauuccuccuuauccuccaaguauuagugaguugcucaaccaguuuguaguaucuuguuggaaauagucuccuccuauacgugcugauuuuuaaguuccuccaggcucugcuuuuuguuacaaaacccuauaugauaaaauugauucuauuucucugcucucaucucaagugauuuuuuuuuucacuucucuucaguguaaucauauuggccuuccuuugacuuugagaauaagucauaucuauucccaacuucaagaucuuuaugucauuuauacaccauucacugugacuggcugcugauuuuccuuaagugugguugaguuaaauaucacuuuacagaggcuuuuccugaccaguuauccuaaaagccaucugguucuagcucuaccccucccccaguuucuacccccuacacuucacaucucuaguacuauuaucuaguguuuuuauuuuucuuucuccuuagcacaguaguguccaaccugugggucauaaucccuuugugggguaauguggggguucugaaugacccuuuuacaaggguugcauaucagauagcuuauauaucagauauuuauguuuacaguucauaacuggcaaauuuacaguuaugaaguaacagcaaaaacaauuucauggaugaggaucaucacaacaugaggaacuguaucaaauugguguagaguaaucuucuuaaagggagaacuugaaagagugcauuuuguucaguuuuguagaagaguuugaggcagauuaguuuaauucuuuaaauguuuggaauuuugucacuaggcuuuccuuuauugcaaauuuuugaauugcuuuguaaucuugcucuuugucuagaauuauucauaauaaucuuuaauuucuucuaauuguuucuucuucacuugucuccuuuggagguuuguuugaguucucugguuuaaagauuugucaaauuuauuuaagcuuuugaaaacuaauauuucuuaaaucuuuuuggacccuauuuuauuuauuucuaugcucuuuguguuuuuauguuuagaccugugacaucaacuguucccaaguggucuccuguuuauuuuauaaauaauuaagaucucacaaauuucucugcuaugagaaugaaaucaacuucauuuuuuguuggcaauuuuuccuuucucagauuucagcuguuuggaguauuuuugaguguuuacauaagcuugacuguguuaguuuaucuaaucugaagugcuauaaaauucaaaagauuucucccccugaaggugagggcaguggcuuauugcuauuugaaauuuuuuggauuuaguguuuucaaguuaggggcacucuuccuuuuuauggucuucauugucugaaaagguuuguuugcuguauuaauuuauauaugacuguauguauguauguauagcuugcauuacauuguguaaagcaggguagguuuaacaaaccuagaugauugcuucuaaguucagaaaugaccuacgagauuaucauaaagcacuuugaaaagggcugugagaggaacaagcaaaauuguugagaggagggggggaacaacccuguuuuuaggguucaagaacccuccaaggaaaucacagaaagaaacuuguguuuauuacugugggaugaauggagagaggagucuugaguuuuggguaggaauaaaggagcaaggcaacugagacaggaagaaaacuugaaguaccugauacuuuccagcagaauaagauguuacuuaagguuugaauaaaggagcaacagcaaaaauaaagcuuaagaaacuuauaaggcuuuuugucuaaaguuguuuuuuuuuuuuuuuuuuaaacacauacuguaauagauucucucaucuacuugugacauaaaaccuagaagacucaauuucauuuucuggucuacauauuuugcuucugaaaagacaaucaccugucuugcccaggucuguuuugaaagguuucagcaucuuacugagugaagauuugccuuaacuuaggauauuuuaauucaugugucaauuuaaagacuuguuccuaagccagguaugucgauguacacacacccuuaauccaaacaguugguuggcagagcaggugaaccuuugacuuuugaggccacccuagucuacugagugauccaggauagcccagucucugaagagaaacacugucuuaaaaaaaagucuuuuuaacugcuuagcaauuuuccuuugugguaggaguuaguuuuagugucuuuacuugaacaguuugguaagaagccuuuuauuuauuacauagcacuuggaaucauagcacauaaacacaaauguuuagaaauggccaguauaugaaugguuuauuaaaugcuucuuauguuguguaaaguuuuuccaggagaccuuggcuacuuaucuagaauuaauacgaaucuauaagugagauaagacacacucacuccccagaacccuccccaagacaucuugauauauuaauuuagauauuuuuggcuaaaaaauucaacccugguaaguauuuacccaaaaugagcuccauuguuguuaccuagauuagaggugaccauguuuucuuuucugcaacaaguucauauguguugcgggaaauauuaaaaaagcagcaacaucuccugcuauuuccagcuauucucugccccggcaaccccugcugccuccacagcugccccaugcagcagcuuaugaccaaucagcugugguucugcugcugaugacucugcucacauucccagcaucugcccccuguggucagcaguccaaaaucccaggaaccugguaaaaucaaaacuguagaagcuuguaauuaauaagucagauuuagauaucaauaaauucucaauucauaagauguccacacaauaauuucagagccaauugauaaugauauaagcugcccagcuagauuagacaaguuaucccaauuauucuauccuuuaugauauucauagcuaucuauggcuacuuaaagccacguggaaucuggaggaaucuggaucuucuuccucccccucccucuuccuuccucucuuuccuccuaucucuguuucugaaacuuuuagcuccgccuccccuuucccuguccaaucacaggcuucuuguauuaauauuuaaauuaauuggacagggaaaauucugcuauacacacacacacacacacacacacacacacacacacacacacaugcauucuuaugauugguuguguuuaauuucuacucuguugauuuugugcuauaaaauguaaggguuuguaaacuaucuacuuaaaauuauagaaaugguagacauagggcugguaguagagugcuugccuaucaugugugaggcacuugguuuaauuucuagcagugcuaagauaauaccaguguuaauaauaauaaacaggcuagguauuuauaaacauuacuuuuuauauaaaagaaacaucuuuuuaaguuuuuuuuucuuuuaaauaugugucuaugggaguuggugugaacacacgugaguucaggugaccucagauuccagaagagaaggucugagucccuguugcuggaauuacagauaguuuugaguauccagaccuuggugcuaagaaccagauucagguacugaacgucccccagauuaucucuuguacaaaaaugcaccccaaaauuugcauguucucuuauaacuuuaaaauccaaaaauuuauaacuuuuugauuccaaacuuuaagcagagauuacugucuagugauuuuuuuuaaaaacguuuuuuauuuuuuauuuauuuauuauauauaaguacacuugcugucuucaggcacugcagaagggggcgucagaucacauuaugcaugguugcugcgauuugaacucuggaccuuuggaagagcagucagugcuccccaccacugagccaucucuccaggcccccugucuagugauucuuaaaagugauucugacauacuuuuggaaauucaguuuuuaaucagucauuuguuuggauaugucuuaaaaggagguuuuguuuuaaauuguacucuuuuaaggaaguuccuggaguuuucacaguuuauauuuugucacugggaaaaaucuuuguauuuaaaauguagugagcaaaaaugaauagcauuagauaugauuguuaaaccuuuagaaacuaacaugccacuugguagaaauauaauuggugagcuggagcaaaggucuguagucaaacaguaagauuaaugaguaucuuuucuuuuugccuuuuuuuucucuucucuuucccuucuguuggcuuuucaaguugcacuuagcugaggguguuugaaaugauuuucuuugaaagcguuuugacauuguuuuaauugaaugaagcugcagaacugacaugauagaucaauacagaaugaguuuuaauguaaggcauagcacauuaaccuggaaauuguuugcaauagacaaagcagcugcuauaaugcaguuuuuuucauuccugcuuaaaacauuuugagaagaaugaccuugacaauuccaguuguguuauaguaccuaugguaugcacuucagcacaccucaacuauuuguuggcucauagguacaguaguaguucguuuuuuuaggguuaagggaauuuuaucugucauggacucuuauuuguauuaucugcuuuaaaaauaauuuuaauguaaguaauaguuguaagaauugaauuuuuucacuauagucuuauggcuauaguuaaagcaaaagauacuuauuaugucaaaagaguaggauaugccuuuuuuccguggacacaugguaggguagacuaacuggcuugauaaaugauguggguaaagcuucuuuaauuguuaaucaacuugcuaaaauguuuucauaggggcugggaagauggcuaaauagguaaaacgcuuguuguacaaguauaaggaccuaaguuugaacucccggaaccaaguacaguuguagcaaaaccuccuaucuuagggagguaggaggcagagacagcguccuuugacacucagaggacaagucuccugguauacagaguuucaaacagcaaagauacccugucuuaguuuggaagauaacugacacacaaaguugucuucugacuuuuauauuugacacuuuuaugcacacauaugaugugccuguacauaaacaccuucccccuacaaaugcacucagcuagacagguaaaacagguuucuguucagcaugcauucucagacgguuuuccuguguuugauauguaauuuuuuuaaaaaauaagaacuuuuaaagaacuugcaaauuaaaaaaugcauauucgaauuuagccagcaccaaaguguauaucucaguaaacuuauauacaguuagaauacccauuuugaauccauggagcacuuucacaugauugggucaaagaucugguuagugugcagcuguuauugaggaauaucuggcagaacugcuguuuuucagaagggcguuugcagacuuuugagcaaggaaaacuuggcucucuuucuuagacuacucacaucuguuaaguuacuuguuagcaacucuugaauacaugauuuguguucaguuugaaauuguaaggccauucccuguuucauugaagcauaccacaacuaaacaaaguacgugauggaauaagaaggugacggucucuguccagguuguuuuagaggaauagguauggaguauauaguauauaugaaaaugaggaacuuacaggugagcaggaagggcuuucuggggaugaacuuggggccaccuaugauugauuucuugugaugcaucuucucuuucuaccacuacucagcuaauucugaaucuacucagauaaaggacagcguuuaaaaaguuauacagagccacaggcauuuaaugccuacugagagggaagagaaucacucuuucccagauauguuccuuuuaauuagcuacccaauaccaauauuaaggggucaacccugaaaaaguacaugugagcacuaaauggacccagcacagagagccagggguuggggggccaggaagccaugaauuugagagugggggcacacaggaguuggggugaugauguucuugugaauuuaaaggauuuaaaaguuacaguggauuuuaaaggaugcagcuucaaggaaagugagcagguauguaacuuccaugcuaauaugaaaaagaaaauaaauguauauccugguauguuaguuuucccuugccaugauaaagggaggcuagguagaaaagaaaaaggaacacaggaagguaaaauauauagaaagcauauauuaguaagaaaguagauaaaaaccauguacugcaaaugggguuaguuaaaacacaaagacugauagauugagaaaaaaauucauuugauaauugauuauccagcacaagaacaagcaacaggccuagucauaguagacuuuaccucaucuuuaaucaccacuuaauaucuuuaaaagcgugacugggagcaauuauagguaaagggcucacaaaagcauauggaucugaguuugacucucuaacacccucauaaaagccacaugugguuagacugagauagucagauccugacccaucaagccuaggugaauccuugagcuuuggauucagugagugaccaugucagaggaaauaagguagagagcaauagaggauaccuagucuugcuuccacaugugcauguauaggugacugcgcacgcgcgcacacacacacacacacacacacacacacacacacacacacacacacacagaguuuauuuuuaauugacuauauccuguguuaaacacaucugaacaaauauucaaaguaaauaauucuagugggauuggucucacucaaugcguacucuaaaggguaucuaaaauauuagugaaauaaugcaggaauggaagauggcaaggaauagcuaagauacuauugauacacucaccaauuaaucuagaaggauauagcaagaauaaauagauuauauugcauaugccagaaagcuuuugcugaagggacccuguuauagcugucuuguaugaggcuaugccagugccuggcaaauacagaaguggaugcucacagucagcuauuggaugaaacacagggccccuaauggagaagcuagagaaagcacccaaggagcugaaggggucugcaacccuauagguggaaccacaauaugaacuaaccaguaacucccagagcucgugucucuagcugcauauguagcagaagauggccuaguuggccaucacugggaagagaggucccuugguauugcaaacuuuauaugccccaguacaggggaaacaccagagccaagaagcgggaguggguggguaggggagcagggcgggggaggguauagggaacuuucgggauagcauuugaaauauauauaaagaaaauaucuaauuuaaaaaaaccuaaauaauaaauagauuaauggaauagcauaccucaaacacugaucuauguguacuugugcacaguucauggcaugcucuaagaaguguguugucuugacauuugucgugugaacagcacauaaaaaaguauagaccuagaugauacagguugguuacucaucagauauggaaaauuuaagaugugugugagacugauacaaguguaacauugcaucauauucacagcaaacuaguguuuaccaguuaguagauguaugcccuuccuagugaccuuuaaaauuguguaaaucugaauaaugggaguuucuguuaaaguugcugagacuuuauuuauacaauuacuuuugucauugccuuuuucaaaggaaguguagauuccuuuccuaaacuuuuaggacuauaaguuaaaauaggaguggaaaaaagaaaaucaaauaaggaugcauaagauuaagaaaugucauuuuaaaaaguaugcugaaaagaguuguauaauuagcacuggguagaauccuaguuugagugguaaugcacuagcagcauguuaaauugucacuuaaacaguugucucugaagacagaauuuuucuugcuaugaacauaaaacagaacucuaucccaacuauucuuauuaaaggacuuuaauuuuguagaaaggauucaugauguacaugguacccaguguuguguuaauucuuuacucuggcugggauucucuguugauggacaacucaauaaaaugccuuuauuuagcuagaucauccuuuauaguuugcauuaauacauaaugaaaauucuguguaaaacaaugauuuacauccacuugccaagaaauuaaugaguucuagguuuuacuucuugguucauguuuaaaggagucugagugaacaaacgcauauguaugcuuucacauaacuuugauguaacuuucaucaagugaauaauuuauauuaucuuuccccacaguuuaauuuuguugggagaauccuuggaccuagaggacuuacagcuaaacaacuugaagcagaaacgggauguaaaauaaugguccgaggcaaaggcucaaugagggauaaaaagaagguaagucguugauuacaguccuaucuuccugugagugauuuguauuuuugccugucaguaauugucuuaggguuucuacugcugugaggaagcaccaugaccaaaaaaaaaaaaaaagaagcuugcacuuguacagggcagggaccuguagaaagaaacagaggccauggggcuguucugcuuacugucuggcuccccaugguuugcucagccugcuuucuaaggaaauccagggaugguccacccacuguggauugggcccucuaccaccgagaaaaauuccuaccucaacugaggcucuuuccucucugaugacaaguuugucuugacacacaacauuagcuaauacaaucaaguuccauaucucguagauguuaggcauaacccaaaaucuuuaugauuuuaaguaagaacuuuggaaccauuuuaagacauuauccuaguuuuuugcuuauuauaauucaagagcugaaguaucugucacuccagcaugauaacaugcuuugccacuuauaauuuagaaccagcuauaagaauuugacuaccauauuauauguaaagauauggaucuaaaacuuggggaagacuguggcaucuuguuuuugggauggaggcuugaguuacacagaacaaguacucuaccacagaguuaccaucaccagaucuuuagguuuuagaugggaucucuuuuacacauuuaaagaaaauaauuugagaugauaccuugauaagucacccagacugacuuuuaagcuuuuuaucaucuuuuuuuuucccccuuuuucggauagcugagguuguagacauaaaacuguguucaauuccuaaaauguuucuuucgauaaacccuaagugcgauugaucaggugaguugggguaguuaguuuuagcaauauuuuuuucuugacuaaaagugguuuucuagacaucuuacuuuaguaaaugaaucugcucuuuaguuuuaacuccuacugccauuucuacuugauuauuguuacugcuacuauuacugcuauuacuauuaauuauaauuauuuuguguguaugaucaggaaagggagggaaaggagagaaaacauguggggauuguuuugucaguuuaaucaauccauugaugcugaacuauuuguuuuaaauauuguuaggaagauuuuaguugcuuuucaucuggaauauuguaagguacauugcuuuaaaauuuccaucuuugaaaaaaaagauuuuaaauccuaugaguuuacuacuauuuauuaaaauuguuacucuuaagggugauguuuuuuucuuuuuuuuuaaauaacuuuuuuuuuuuuaagagcuaucagaugguaaaucuggggucaguuuauguuaggagacuuuauggaauuuucagaaaacaacaacaacaagcacagcaaaugugacuuuguugugaugaguguguuaccugagccucacaagcugacuucaacugccccucuguuuagcacagagaaugaguagcuaggagauuuguagcaaaguuguugaucauaucuuuaaauagaaucuuuuauauaguuuauagguauuuuugugggaauuauguuuucccuagaauauuuuuagauguuguacuggcugguuuugugucaacuugacacagcuggaguuaucacagagaaaggagcuuauauugaggaaaugucuccaugagauccuacuguaaggcauuuucucaauuagugaucaagggggaaaggccacuugugggugggaccaucucugggcugguagucuuggguucuauaagagagcagguugagcaagccagaggaagcaagccaguaaggaacaucccuccauggccucugcaucagcuccugcuuccugaccugcuugaguuccaguccugacuuccuuggugaugaacagcaguauggaaauguaagccgaauaaaccccuuccuccccaacuugcuucuuggucauaauguuugugcaggaauagaaacccugacuaaaacagauguauuuaauuuuuuuuaaaugaacauuuuaaacaaacauucagaaauagguguguugugaucugaaauuuuagcuuccacgagugacggaccauaggguggugacaguagccuugaacaguacugauacaguugcuuaagaacauugaaugcaaagcuuugacaauuuauacugaucuuuaccaaaaaaguaguuuauauccacuaguuaagaaauguuguuucuuaaagaaauuauugcuacuccuuuuuaaguuguuauuaauuuggauugaauucauuaauguaacucuggucauauaauacucaacaggugagaauuagaaauuuggaauuguguuuuuggauuugagcaaagaauauuuuuuccugccuuaggcacagccgaaugauagugagcauuacucagauugcuuagguuagaaccuuaauuccgccuuguauagcauuguggugcaaagcacuuagaacaaggcgaugaauaugagcaaguacucaaaggauaaugacaauaaauuuuguuuuaaacuaggcuagaggcaguguuuauguaauaugagaauacuacaauuauuuuacuuuuguaaauguuaguauuuccuguugucucguuauuuuacuucugaguauaacaugccauuguaggauuuuucucuguuguugggagauucuaauucuuaaccuuacugguaaacaguucccacauuuuauuuucuccuguuuauugagauacgaaacuuuugagauuauaaauguuauauguauauauauguuguauauauaauauguauuauauaucacauauaccauacauauacaggauaaacauauguauauauuauacacauguagaaaacaauaguaaaauaaaugaaaacacccgaaaaugaauugagcugcagaauacauuuucaguguuguuaaaaaugcuagaucgaccuguuaacuugaauugcuucuaugugacuaauauuuuccuacaucuuuguuaauugcucucugccuuagguauuugugucagagucucucauuugaauucuccacccuauauauugauucguggucucccauuuguuggcagaagcuaguaccugaauagcuccagggauucucugugucuucauuucauguguauuaggauuauagguggaucuuacacccacacgacuuuuacauggguucugaagauccaaacuguuucucccucuugaauagcuaguauuuuacccucugagccuuccucccaacccugaugugcucccuagaguguugauaaugaggugagaagggaagguguuuucauuugguacuugucuguuugguaaacaacauaaagaacagguaaguacuggcauaaacaauaauauaauaagaaugauaaauauguuuuaauaguuacaaaggaaauuugccuagcuuuauuccuuuuaucuacauaugauaaaauacuaacaaagcuagagaaacaaccuuaguuuccuuacugcuucauguacuuugaacaaaaauguuccguuaaaaauacugucuguugacugaauccuucacuaaacacaacacauacugucuuuuauagacuuuacuugcuauuuaguaaauacuugucauugaguaagcauuagaaauagacccacaaaugauuagcccuguaguucaagucauaagagaauaaugugccucucuuuggcucccugaagaagguuugacaaauagugaugauugcaugcucuaugugcuuuuaauauuccuggaagauagauaguagcauguaauucuaagauccucguuugaguaugugaguuaauaugccaauuuuauuuccuuuuucuuacuuuucuaauaauucauuauaauuguucuuaccagcacugauuuuuguuuuguuguaaaauucaaguagccagcaggacuacuuaacagaaaccauaggcaggaacugauagaacuuagaaugcucucaggaaagucuugccuguccugggcagcauauggauggcaguguuucuguagcugagcauguuugugguaacagcauuguuagaaaauauguuacaagugaaaaaaugagcuacuuuguguuaauuuuguccuguuuauuuuguauacuuugcauuaacucguucucucaguauuugacacacauuuuuucaacuaaucuugguuuuaucauuugcauuuuguaugugagaaaacuuuugucagggagguugaaugguuugccagaaaaaugguagucagaacuugaaacaaagccugcauugugucauuugaugucucacauuuuacucuaaggcguauccaacagugacugccauacaaaugcuucaacaaaggaacuuaggaagccaguugaacauuuuauugaauucuuucuugcuuucuuacuuuuucauaggugacaguauuuuucauacugucagaccacucaguacccccgauauuaggugucuagggaauucugacacccauaaucaauagucacaucuuuagggagcacuuacugauaucuuauaauuugcuucaauuugagcacuauuuggagauuauauuagauuucagaaguuauaggagugaacuccacugcagaaaccaagcacagaccaccuuugguuucuguugagcucuauggcauguuucuaaucucccucucaaguugcuagagagaccuacuuagaauaucauuuuaccuaggcuagcuuguuugcuauuaaaagauauugaagggauacacaugaacagccauauaaaaugagacacggggaaagguaggcuuucuuuucuucugggagugccauguuccaggguuuucuaguuguugagcuccuuuuggguuuuuaugaggcuuuucuggggaaaaacaauuggugacaucauuggccaguggugauaaggucauuuuuuuuaaaucaaucuuucuccccucuccuccuccccuccccucccccacuaccccucucuaccccccucucccccucucccucccucucucccucuccucuuggugggaacauuuuuuuagauuucuacuaucagucuauaaaucuguggguucuuuccuauuauaaacuggagggaacgaaaaguccaagccugugaauuccugccuuaaaccucauccuguuuagucaaauccuuccaugauugaguguuuauagaguugaugaagcuauguuaguuaaguuuguccuacaggaguuugcaaacucagcagucuuagaguccugcucacugugaggcuguaugguaggucugccuguccucuaggacugcuaauagugguggcucauagcaccggccuguaucacugugugcaauaccugacucaggcugugugucacccucaggagcuagugaguggcacuguucuaucucauaggauuugagguuuaaagggauauaguaauguauuaauuucccuguauugagcaaaauacugcucuaaauagaagaccaucuaucuccuugggcaaauucaucugcaccaugccauuuucuuuggaaugugggcuuucaagucaaaauccacacaaaacugguacaagcuuuaauuuuuaaaguuaaccuuagcuuuuuuuuuuaaauguguauuugacuauuuuguuuuuuguagagcugugcuuuuaaaaaaacaaaaaaacaaaaaaaaccuaaggaaguagaguauuuugugugacuaugacagggguauauuauguaauagaaaacauaguaugauuuuugaauuuucucucaaaguguuuaguauaacauaagaucauuuuaagauaacauucuuaaauagucauauacaucucaaaugaaauauuuucuuacauaagcaauuuauuagauucacuaacuuucuucugcuuuuuauuuaacuuguuuuguaaauauauaauacuguaugagaauuggaaagugccauaugaacuugagucauuguugcuaagauuugcaaccugaauucggucuccgggacucuuauggugaaagaaagaacugauucugaccuccacauaaugggcacauuuauaacacauauaaacaaaagcacuaaauauaauuaaaaaccaaaaccauuauucuaaaaacuguuucugacaguuugagauguuuucuggauuguucaaauaauuguucauauguacauaucuuuuauagacaguaaagugaaucaugguaauucauaguuuuagauuucucugcaguguuauaaucuguccuuggguauuuuaccaaguaguugagcuauaugcugagggaugugaaaauaccccuauaugaaauuccaaguaauauuaacaguaugcacaaucuaaaauuuccuccauuuuuagaggucuaaggguugagggguccccccccauccauuuauuuauuuauuuauuuaaaaccuuuuuuuaaaaugaaguuauaauuauuucaacauuuugaaagagauaaauuaguuuaguuugggauuacuauauuccauuaguucucaagaacucuuaaggauuuugcuaguuaacauuuucaugauggauuaacauuugucucuaucucaauggcguuaacaucuaguggcacaauuaucuaacacaaagacagcuccaaagaacuuguuuuauugauucuguuggauacucaguucuugguaaauuauaccuuaagcacagauaugaauuuuuuuaaaccucuuuuuauuguggaaaaaauugaaacagcaggacaaucagcugccuaauggacuguuauuugucuaccaaccaccacuacuucuuucaggagggcacuucucauucauugccuuucuuauuucuccccacugcauguuagcuuauuugaguaguaaauucuggacauacaguuuuaacuuuaaauauuguauuagguagcucuaaaauagacucaauaauaguaauauguuaauuuucuuuauaucaccaaauauguacucaauacucaaaguucaugucccaugaauguucuuuuuuaaaugcuuguugaaguuauacucaggguuagguauguuaccauacccuuuuaacacagcagcauuacacaggcagugaggcaugcaggucucucaauuugagggcagucuggucugcacagugagauccuauuucaaacaaucaauccccccacaaauccauaaaucacacgcauuucaaugccaucugcauuaugauugauugauagagcccuuaagcuaguauuucucaacuuaauggguuuugaccuuuuuggcaaaccucuaucuccaaauauguuacaaaucauaacaguagcaaaauuauaguuuugaaguaguaaagaaauaauaucauggucgggggucaccacaacaugaggaacuguauuaaagggcuacagugccaggaaggucgagaaacacugucuuaagccauuccuucacucagccccauuuucccuuccugcuguuuauaaaaagaccuuauaaaaaggaccuugcauuuuaaaaucauuuauuugauuuauuggagugcugcuggggaauguacccaagaugucuuaucuaccaccaagcuauacuugauuucgaauucuuuuaaaagcagaaauggggugaaaucuuaacugagaagggugagugagacagauaagaagguaaugguauaguuucuuagagugaguggcagguggagcacggaggaggaaggaacagggccuuuaugcgaaggacuguuaauuuguucugagauuuugauggcuggauacauuuucaugguagcauuuuacauagcugucacacauauuucuuggauauuuauagugagaagaguguagucauuaagaucuuuacuagucuucauuuuuguuccauauauuguuccauaagucugauuucucuaugauguaagcaaguacugauuuauuuuuucaauuuuuuuacuuuuugcaaaacagguccuauuuuuuacuagcaagauaagaguuuuuauguuaaaaguuugaagaaagcucuuacauagugaauugguucucagaaacucucuaaaggugaagaacaaggcuugcuuuucuuuuccuuaccacugugaaugcauauuaacaguugugauguguuucgguucauuguauguuguuuuuuuccccuccuuaauguaaaaugaugauucauuugucccaugcuaagauaaaacaaucuugguaacaggaaaaacagcacugcugcugauguugacaaugaaagcaauuuuaccccguuauucuuuuuaggauauaucugacuauauguauaaaucaguauccuuuaaaauacucagaauaguaguaguuaguaacaucauguacguccacagagaaauuuauuuguuguacuugguuucauguuuuaggaauugcuuaagcuagugucuugauuuaugcuuuaaaauacucaaugugcuuucaaaaucaaaucuguugggaaauuuuaagagaaauuuugcuuuuauccuauuuaccuguuguuuuuuuuuuuuuucuuuuagcauugggcagauuuucacauuugaauuuuucuuuucuuuuguaaaaauuuugauuacaugcauggggugggguauaggcaccauguuccugugguggucugaggacaucuugcuggacuuguuuccuagagagugagcccagguucccaggcuuggcagcagguccuuucuccacugagccgcccccuuacuagccuaguccuuucguccuccuccuuguccuggguguaguuacggaacggucacacaugagcccagguguuuaauuuucuaccuguucuauagauuacaauauacucaguauuuucuacaccuuacuuuguuacgauaaguuuaacuucacaccauuguuugacagcauuuaaaaggaacacaucuauauagauagcaguuucuuuuaauaacuacaucagauucacuugugguaugucaccacucaguuacauccaaucuccuacaguuauagauacaaacaauggucuaguguaugucuuuugugcuugucuuauauucagaaaauaauuauaaaaggacauuuugauauauauuauauauuugauaucucucucucucuauauauauauauauauacauacauauauauaucuccauugcaucagcaacagaauuaaauuucuguguguuauuaggagacuuagcaucuuuuucaggcaucagggaaaagcuaauuauauauaauuaugccuuagauuggguaaguuuugacuuuuucagagaauucuuaguuaaaaaaggcuguaucuucuuuuguguuuuauauuccuuauuccugccuuaucauaccacaagccacccgcuccuuuauugguuacuucuuuuuugguuacuuuuuaaaaguaauacuuuaugcuauuuuggggacaauuauaacuuggucuuauuggcucuaaauuauccuuuucuuagccuaguucuuuuaccacaucccauuugcacuuuaauaucacucuuuaaaaacuguauuuuuauauuauauauuauaugcaugaauguuuugccuucauguaugucugugcaccuugugugagcgugguauaaaaaucagagggugugucagauucucaaacuggaguuuugggaccaucgugagucuccagguaagugcugagaauugagcucaaguccucuggaaaaacagcaaaugcucuuuuuuuuguuuuuuguuuuuuuuuuuuguuuuuuucucuugagacaggguuucucuguguagcccuggcugucuuggaacucacuuuguagaccaggcuggccuugaacugucugccucugacucccaagugcugagauuaaaggugugcaccaccauaugcucuuaaccaccuagcccuucccccuuuuaaaugacucacugaggugaauuaguguugccuacauaucauggaugugguuucauccacagguguaugggcaaccuaaccagugggccaaauuucucauuuauugauuuguguguguguguguguguguguguguguguguguguauauagcucucuguagugcugauuguccuugaacucacagauccacccaccagugccuccucaccacacugggccuguugauaauuuugacaagaugaauuagugagugggaaaaguuaaaggauuuuucucauuuaaguggguuuguaagucaaauaugcuugaauaguaguauucagcuaugacaacaucaguugcuauagaacugaggcuguccaauucuacugcuaccuaauuuggcuuagaaagaaacugauuaggcuuguuagucuuaaccaucuuuaugguaaaaauugacauuucauuucuguucauaaugcuauagaugauuguuacuucguauuaccucuuguaguuaauaccaucuuuuuaaaauuauuuaaacaaauuuuuauuagauauuuuauucauuuacauuucaaaugcuaucuugaaaguccccuauacccuccccccguccugcucuccuacccacacacucccacuucuuggcccuggcauuccccuguacuggggcauauaaaguuugcaauaccaaggggccucgcugacauaugcagcuagagacacgagcucuggggguacugguuaguucauauugcuguuccuccuauaggguugcagacccuucagcuccuugggugcuuucucuagcuccuccauuggggacccuguguuccguccaauagaugacugugaacauccacuucuguauuugccaggcacuggcauagccucacaagagacagcuauaucaggguccugucagcaaaauuuugcaggcauaugcaauagugucugucuguguuugaugguugauuaugguguggauccccggauggagcacucucugcaugguccuuccuuccaucucagcuccaaacuuugucucuguaacuccuuacauggguauuuuauuccucauucuaaggagggacgaaguauucacacuuuggucuuccuucuucuugauuuucauguguuuugcaaauuguaucuuggguauuuuaaguuucugggcuaauauccacuuaucagugagugcauaucaugugaguucuuuugugauuggguuaccucacucauaauuauauccuccagauccauccauuugccuaagaauuucauaaauccauuguuuuuaauagcuucauaguacuccauuguguaaauguaccacguuuucuguauccauaacucugaugagggacaucuggguucuuuccagcuuguggcuauuauaaauaaggcugcuaugaacauaguggagcauguguccuucuuaucuguugggacaucuucuggauauaugcccagaagagguauugcuggauccuccgguaguacuauguccaauuuucuaaggaaccgccagacugauuuccagagugguuguauaagcuugcuaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccaaaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguagucuuuuugucuuauugacggugucuuuugccuugcagaaacuuuggaguuucauuaggucccauuugucaauucucgaucuuacagcacaagccauuguuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcuccccugucgaagaucaagugaccauagguguguguguucauuucugggucuucaauucuauuccauuguucuaccugucuguugcuguacuaguaccaugcaguuuuuaucacaauugcuauguaguacagcuugaggugcuuuccccagagguucuucuauuguugagaauaguuuuugcuauccuagguuuuuuguuauuccagaugaaauuggaauucaaauugcaauuugccguuucuaacuuggugaagaauugaguuggaauuuuaauggagauugcauugcaucuguagauugcuuuuggcaggauagccauuuuuacuauauuaaucuugccaauccaugaacaugggagaucuuuccaucuucugagaucuucuuugauuucuuucuacagagacuugaaggucuuauuaugcagaucuuucacuuccuuaauuagagucacaccaagguauuuuauauuauuuuuaacaauugugaaagguguuguuucccuaauuuuuuucucaaucuguuuauccuuuguguagagaaagaccacugauuuguuugaguuaauuuuauauuuagcuauuucacuaaagcuguuuauuagguuuaggaguuuucuggugguauuuuuugggauauguauguauguauguauguauguauguauguauguauuaucauaucaucugcaaauagugauauuuugacuucuuccuuuccaauuuguuugcccuugaccuccuuuuguugucuaauugcucuggcuaggacuucaaguacuauauugaauguagggagaaagugggcagccuugucuagucccugaauuuagugggaucgcuucaaguuucucuccauuuaguuucauauuggcuacugguuugcuguauauugcuuuuauuuuguuuagguaugggccuugaauuccugaucuuuccaagacuuuuaucguggauagguguuagauuuugugaaacacuuucucagcaucuaaugagaugaucaugugguuuuugucuuugaguuuguuuauauaguggauaacauugauggauuuccguauauuaaaccaucccaguaucccugggaagaagcguauuugaccaugauggaugauuguuuugaugugucuuggauuugguuuucgaggauuucauugaguauuuuugcaucgauguucauaagguaaauugguuugaaguucucuaucuuuguuggguuuuuauaugguuuagguaucagaguaauuguggcuuuauagaaugaauuggguagaguaccuuuuguuuuuauuuuuuggaauaguuugaggaaaauuggaauuaggucuucuuugaaggucugauagaacucuguacuaaugguaucugguccugagcuuuuuuuugguugggagacuauuaaugacugcuucuauuucuuuaggggauaugggacuguuuagaucauuaaucugauccugauuuaacuuugguaccuugugucugucuagaaaauuguccauuucauccagguuuuccaguuuuguugaguaauacuauucuaagacuuuuaccuuaaaauagcuuugccaaugggcugggugguuauugacaguuaguaaagauaucaguguggcuucacagugcucguagaguaugcuguucaaauccaagaaccagugaguuuucucauagguugaggguuuuuauggauauuagauaaugaauuuccagaaauuagaaacaagauugacuggguguaggugaggugcuucaucugccacaguaaaagguuugagauacaguuggagaaguuguauuagcauugaagacaaaguuggaugcuauguuaaaauuuacuuuccuuuuggaagcaguuguuuaauguuauauuauuuuuaagaaaauaacuugacaccauugaaagauuggcugaagaggcaauucacaaaugcuagugaagccucagauagcccacuuagaaaugcuauucuuagaauaaaguaagauucaugucuuucaauagucaguucuuugauccuuuuuuaguugucucauaauugauacauuuacgagguacaguaugguauuuuaauauguguguacaauuuguagccauccaaucagcaccauguuucuuuguguuaaagaaaauaugcuuaaccuguucagaaauuucccuagcaacuuuccucacaauagcuccauauuggaaauaacccagauguaaucuugcaaguggaugcuuaaacucuggugcacccaugccauggagcaaccuacugccacacauaaaaacacagagugagaauggagauaauuaugcauguagaaaagcugugcuuacugcaugguucuuuuagaugacauuccugacauggaaugaaauguuuuuagucaugaaggaggcucaggauuuuuuuugcugggaugauucuauaauguaauuagagugagauugcuauuuuuagaaugauuuuauaaugucuuuuuuuuuuaaauguuaacagugguaagaaaguuuuguuguuauuguuauuguuguuuuaacucaaacucacuguuauucccuaagaauuaaaugugauuaccuaagcauugcaaaacuaaaauuaaaaucuuucauccaguuuaaaaaaaaagaaagaaagagaaaagaaacauucaggauugucugucucagcagucgucuggccuuaauaucaauaacacuuuaaauuaaaauaacacaucuccgugcuucagugucuuuugccauaguccacaaugccaguguauuaaaggugucucuguaguugacuuacuuaugcacuggcuaguuuuaugucagcuugacacaagcuggaguuaccugaaaggagggaaccuuaguugaggaaugccuccauaagauccagauguagagcauugucuuaaguacugauugauggaagaagacccagcccauuguggauggugccaucccuaggguggugguccuggguucucguaagaaugcaggcugagcaagccauggcaagcaagccuauaagcagcacuucucaaugguuuccgcaucagcuccugcuuccagguuccuggccuccuugcuuucaacuauuauauggaacugugauugaaauaaauccuuuccucccccaaguugcuuuaugucaugguguuucauugcaccaauaguaacucuuaagacauuuccauccuauaauuuugaucaagcgaagacaugaugucuucuugagcuuuagaagugguuuuauuuuaaagcaggaagaagccuacuguauuaguuccuuuuaaauuccuguauucagauaacagacaaaugugacuuuaagaaaggaaaaucuauuggucaggggauacagucuuaucauagcauccaucuuggaaaauuccaggucuggcuugcucuccacauuucuuccaaagaauaaacagagaggucagaugaaagaggacuagguaccacuccuaaaccuacgaccucaguagucugugccauuuauaccucaccuccuacagguuccagauccuccccaaacaguguuaacagguggaggcguaagcaaguguucauacaugaaccuaugggagauauuucagauugagaccuuaacauuuauucuucugcaaaagacuaaaucaauucucuucaaagcaucuaugguuuuaaaaauacucuuaggaaaaaucaaacucacuggagacagucucuuuguuaaaugcaguaaaauuagcucucagagaaauggauuuuuaaagacaguuuaaccuuauuuuaacuucgucagcagauaaaauuagccaauuggaaauugguaaaaguuuuguaagcgugcgugacuuaaccuguuuacaggcuauaguauaacuuuuggcauggucugcuaguauuucaaggcugucaacuaguucuuaugcggccuguuugcuucuuuuuuuccccucauauauguuucaaaaauagaaaguacuuuagaauauugacuagguuauuuagcuccauuucuguuuauauguuauaaggacucugaggauuuuaaauaauuauuuuacuuugauguacaauccuuaaaagugugagacaguuuuuaaggaguaaaaagaugaacccaaacagaauuuccuuuguuuauuaaaaugaaguaacauuuuaaguaaccugugaacuuaaauuacgcugccaugggucuaauugcaggaugaguugauuguccgugucuagugaagucaggcaugagccucagugaaguccauuucaucacuaguugcucuuaaugagccuuuaaacauuaaagcuugagugcauuaccguuaguuaaggaauauuugaagaccauuguaguuuggguauauauggcacuuuuucuuucuacaacgcccuguuuaguagugacagaacagauaggaaagugccacuugucuauaucuugugcuguauauugcuugaucuuccuagccauaauauugcaacgaagaauaucaguuauaaaacaucuucagcuauguuaacagcauauuguuagguaauuucaugaaucugcugagcuacucagucuacccuaguaauuguauuuuauauuuuuuauuuaguccuuuagcugugcaauacuucugucacaauuuccuguugcucuucuauuuuaaaaugaccuuuaagacagaucaaauuaugucuguccguccgucugucuuguuggucugucugccugucuaucuagggacuugagagagaguucaucaguuaagagcaccuacagaugcuguagaggacccuacuucaguuccuagugcccauguuguauggcucacaaacuccaggguauuuaaugcccuuccuuuucuggaccccauagaugucaauacucuuguguauauagugaugcacacauagauacucaaacacacacacagagagaacuuaaaaauaaugaaaaagaauuuaaaaagguacucuuauccaauuccaagauuucauauuguguuaggcccuuacucaguagacuuucuggauucagguuucucucucucucucucucucucucucucucucucucucauuguauuucuucccucagcccaguucaauccacaucacaaacagcauuugugugcugcauccuuuagcuuccuacuuaaaauaggcuauuggucuucauucuaaaugauuugauaauuuuucuauuuucuugugauuaaaauucaagccaacuguuuuggcaagaauauuuuuuaaagugauuuuuuucccccuuucauuaguaucauuuagcaguuaaaaggguagguuuggcucuuuuuuucuuuuuuguuuucuuuuuuuggugguuaauauuuuggucaguugguuaagaauuuugcuugcuguauuuuuuccauauagcacaagauuuuaaauuuauagcuaaggauaggcuauuucuuuuccuuuccaacacuugccugaugguuucaggauugguuaaugacuugugcccaauuuuugauguuuuuguaauuccacuuauacuuucuaguuaaugauaucacuuucugauaggccaaaauauuuuucuauaaccucuauuuuuuuuuuuuuuuuuuuuuuagcuuagaaucuguauccuuuaucuaauuucucccaguaucaggucugcuuacuugauuuacuuuauaagguagaaugguguaaauucuauuuuuuuuguuuauuuguuugguuuuuuuuuguuguuguuguuuuuuugagacaggguuucucuguguagcccuggcuguccuggaacucacuuuguagaccaggcuggccucgaacucagaaauccaccugccucugccucccaaguccugggauuaaaggcaugugccaccacugcccagcuguaaauucuauucuuauguacuuaauuacuuuugcccuguuuuaaugacagaccuuuugaauuguuuuuauagugguauaguuuacuuguuucaauaugagauaaauuaugaaguugacuuggaaaguucuuagugaaauuuuuuauuaacuuauuuauuguuuuuauucuauagcuacugaguauugaguugagguaggugcuuacugucuuggaauuuacuuaaguaguuuuguuucaccuagcuuugcuacauuuacaucccauuuauauugggggaauaaaagacaugauuuguuuucaaacaauauuucugucauuccauuucauuuuuauagcuuguuuauauauacauauauauauauauacacacacacauauauguauacacauacacacguguguguguguguguguguaucauuauagguuugaggggauagaagggugauuuuacaucucaauuugcccaaaauauccuaagcugcaucccugcucugauguaauuaccauuagcuuuucucaucaugcccagagcacuggaaucugaaugaccuuauacagauacucacuaauuuaaccuauuaaguuuagaaacagauacuuaccauuucaucaguuaaugggauuagcuaaaaccauaagauuuucauguuuggucugucuuaaguaugugcucucacuuuuucauuuauuuugaaaauuugaguagaaaguguagcuguuuaguaaaacuucacuggaauuuacuauacauuuuuaaaauacaagauuucuuuuguagacuacuaugaacagaaaacagaccuacacugaauaacucauucuguuuauauagacauacagaaguaagugguguaagaauuuuuaaguaaaaauuuaaauauauauuugucauaguguuaggaaacguuuggugggaaauaaauauugauaauugucaaauacgguugcuguuugaaguggugcauucuguucuagucaaagcugagguacauuaaauccacagaaguaucccuuaaacugcaccuuaugacagucucugccaaaaaaaguuaacgauucuugauguuugucccuagucuuucagauuccccaaguccuugagugcugacuuuguacaguuagaaacuaguuuaugugguauacucaaaaagauauuaccagagguuuaccagcugcuguuaaaauaguccuuccuuccuuccuuccuuccuuccuuccuuccuuccuuccuuccuuccuuccuuccuuccuuccucccucccuuccccuuccuuccccuuccuuccccuuccuuccccuuccuuccccuuccuuccccuuccuuccccuuccuuccccuuccuuccccuuccuuccccuuccuuccuuccuuccuuccuuccuuccuuccuuccuuccuuccugguaaaauacuagaauuacuucaucaguaaggucagugccacuguaacaaaauauacgagaguggguaguuuaugaugaauagaagcuuacugcucuuuuugaggcaauuugcugagauuuuugcuccauuggagccucuacugcuguuaucuuccacaaaagagaaauaugguugaacagauugaaaggaauaaguauauuuccuuauuuuccuucuuuuaagagcaggauauuuccugaaagguccaacuggccauucuuuauugaacauuacauuucucauacaugaacuuggcagcaaauuagaccauaccacuagcuuacacaugacuguaaaaaugaaagcccaugaagagaggaaaacuaaacaguugggugguucaguuaaaguccucagugaagacaggugcauggcuccuuuuguacaggagaaaugggaucuauuuccacugauaacaucuuguguuguucaggaguggcuuuuucagagaaaucuguauagcagaucuggaaaauacaugcuuaguaauuagaaucuuuuuaacuugguauuuugaaauaauuuuaaaaauugaaagaacucuauguccauuguucaccucaucucugguguguauacaagccuuuuaaauucuggaccuguuuuuuauuucuuuuugggggcacauauaagaauaagaagucuuugcugucacgagguauaacuugagacagaaaguaaacaagugugugaacaacagcaucucagauaguuugccuuuugggagauugguauuugguagagguucuuuaaauaaagucaccaaagacuggaaaagggacauuuaaauuuuaguuguuguaaauuugaguuguggauucacgucaagggugaugguuguuguccacaguaggcucuaagaaugaauggauguuucccuggaguuaaagcaagugcagaaacagucaggugaccauacaauggaagugucugugauauagauugaucaguguggcuggaaaagagaggaaagaguguguguguguguguguguguguguguguguguguguguguuauauuauggggguugugauaaacuguuuguucuuaguauugccuguagauagcuuagggaguuugacuauucuugggaguagaagacugauauuguugaauauaaauuuuaaagaguucuuugaaauaauagagaguacauaacaguugaagaaagggaauggagguguuaggcuguuguagauauugaaguaggagaugaagucuuguuucagauucauuuuauuugaacacuuugagauuauuucaacuuuuacuggauuuccaaauagaguauugaucucuaaauagauaacucaguguuucucuugauuuuguuacuuacuuguguugucuuuacaaaggcuauauucuccaagaguaaucauuuauuuuuugauuucagugaauuguggguauaauugauacuuauuuuuuuccuaaggguuuuuuuuuuuuuuguuuuuuuuguuuuuuuuuuguuuguuguuuuguuuuggcugaggguggggacuggguagcucacugauagagccuuuccuagaauucaucaaacccuggguguaaugucucuuucucugucucugucuugcucugucacacauacaguuuuacuguauaauuuuagucaguuucuuauuuucugaagaguaggagugccagguaaguauagaaggaagacuuaaauuacaauuuuagauggcuaggcagauagcucaaucaguaaagugcuggagaaucucagcucacuccuuagaaugccccuuauaggagggaaauaaccaggacauggaggcauacauuuauaaacccaauccugggaagguggcaacaggaggaugcuuggaucucacugacuacucacucugcacuauugacagaccccagguuggugagagaccguggcugaaaauucaagguacaacugauacaucaggaaagauacccaaaguugucuucuuguguacaaaugcauagugugcacgcaccauccacacauacguguuuucacuaauggaacaacuuacuuuaacuuaaaaaaugagacaaugcaaagccagcacuacuuucaaggggcguucacauuaagcagaguugacauuucaaaaauaaaagugaaauuauuaauuaccaugugauaagcagaaagguagagauauuuuguagauaauaugagugaacauaauaauuuuccagcucaugcauacauuuuccuuuuugaucuucucuccauacugcacgauucuguacaugauaauguaaugugaacuuacaaauuuuuaaaugguuuucagacaagugacuagauuauuuuguaguauauuauagcauuuaauuaauuaauuaauuuauuuauuauuuuuggcucuguaucuaugugaacgguauguuuguaccaugggguugccugccugccuguguguaugucugucaucugucaguggauaacuuuggaguuuguuauuuuguuccaucuuuauuuguguucugugauccacguucaaguuggaucuuaugugacaggcaccuuuaccugcugaauuuucuugcuggacccaaauuuuaauguguuuuuuuucuuuuaguauauuauuuauugguaucauuuaaggcagguuugugcucuguaugucagacuagccuggaacuuacuaaauagcucuugcuggccucaaagacaaacuauaaacaugagcuaaaacaauaagucauaaaacuuguaguaagucguauguuauccaaccucaguaaauugguguugaggcuaggguauguaggcucuuuucuuggguaauuuuccaugcucuugaauacacauuuaggaagucacuaaaagagauggcagcugcguguauuugggauguuuaugacauuaccagagagggugggagagcuugaagcagagaugcuuugagacaauaguugguuaaugaguuugcuuguauguacaagagaaaagaaugggccugauugcucacaauuugaagccugaaaauguauuuuucuggaucuguguauuugcauaucuaauugcuauguaaucaaaacuaagugaacuguagcuacuucaaacuuuaaaaugaaaggcaaucauccuuauggggggaggggaccccuaacuugcacgcuagccugaauauuagcauuauaguccucuugugcuuaauuauaggugucuggcugagcaguaaaugccugcuuguguaauggagaagugagugugacucugacacaccaguggagcucugcugugacagagccugggcuuagaaagccauuacuguguaucuguucugugcauuggugauacggauggugccagaaggacugcuaauugcuugcuuuuuuugauauggaaagcagugguuccaccagugaccucacuacuaaaacuaaagcuuguauuaagcagcuagaauaugcuugguuuucugguggaaagaaaccccacuccccagccucaaguuguuuccugacagcuuuguuuuuuuguuagccuuuugggguuaaaaucuauuuacuauaacaugaguccuuuggguuauuguagcuuuuccuuuucacuguauuauuaauuugagagacaguauauucuuacauccuuaaaugucauugaaaauuuuauagccacuaauuuccaagguuuucagacuaauauaagcucuuuauauauuuccucauugaacuuagacaucuaacacagguuuaaaacauauuuaaguuucaauuagugucaaacuagcuaguucuuagucccugaggaaaagaugcauucagccugauaccaaagucuucaagacucaaggauuuggguugagcuagaggacuacugaaacgccuguacccucugccccaacacaacacaacacaucacuuuauacuuuuccuuaauucacuuaauucuguuuugccuuuuaaaaaguuuauucuaaguuugagaauuuaggauuaauaaacuguuuuuaaaaaacuaauugcuuuccaauguuuuuucucauuuucaggaaaaagcauuuauuuuuguaaaguguuaguugaaguggaguuaacagauacguaucagaagauacucucaugaaguuuuaccuuuuaaauuaagauuuaauuugucgaggccagacacagugacacacauacauauuuaaucccagcaaucuggagccagagucagguagaccucugaguucaaggccagccuagucuauguagagaggcccugucucaaaacauaaaauaaaaacauaccauguuagucugugugauuuuuguucuuuucagucagcauuauuuugugaaaaccgcuuaugagugaucaacaaucaaauccugagugugcuggaguucucugcgacuuagcuugaggucaucuccagcuguaggaaaugccauugaacaaaugaagaaaaaucagacccuuuauacauaauguggcucaugauuuuuuuuaacaguuaccgaguuucugauccauuuucugguuuuuacuugagcuuuuucucucuucuccucucuccucucuucucucuccucuucucuucuuuuuucccgagacaggguuucucuguauagcccuggcuguccuggagcucacuauguagaccaggcuggccuugaacucagaaauccaccugccucugccucccaagugcugggaucaaaggugugcgcugccacgcccggcuuugcuugggcuuuugaaguuguuucauuucugucuuaaguaauauuuucaucaaaagaguguuuuucuucucuauucuuucuauaauaaauagaucuauaauaaacacuugcuuuguucucaguuacagguuuaucucacaguaauuuauuuucaguaaccccuaaguuuuacacaugcaugacacuuagaaauuuaauauauugugaccuuucauauucugugcuugagccagccucuggguuuaaaaauauccuguugaauuaauuuguucuauauguacaguaacuauauguaguuauuauccuucaauacuauauuuuaaaauuauuauuuguguauguacauaugcacacaucugccuauguguguguacaugugugccaggccauacaugugcuauagcacauuuguggagauuagaagacaagucucaugaguugaaucuuguguucuacuguggauucuagagaccaagcucagguacuaggcuuucauuggaucuuuuuguuuuuaccugcugagacagauuucauaucuuuguuuucuuuuuguaugugugggagcguauucaugugugcgcaugugaaggauuaggugucauuccucagacacugucaguccaugguuucacaucaggcaccccagucccacucaucucccuguccuuuuguauuauccauccucagcucuugcagcuucacaccaaagaacauaaaauaagaguuaaaaaaaacaagacaucuugaggcuguaguaagucacagaaugccacagaguacacuuuuguccacacgucuuuacuugcagauguucauuggauuagucauuggucuguuuucaagccucugguuuuuacuacacugccaauacugaauccguaugaagacuaaucuuggauuuccuguugucauguccuggggaauacugcagcuuuggaucugcaagacaggccuuuucauguauuccaacagauccuagaugggauagauguugauauuguaggcauaacuaccaugccucuccccagagguguuucaaaagagcugucccuaagauucugauaaacuaauguagggagagauagacaauaccagaagaaaaauaaaagcaaucagaaguuuucaaacuucaguguagaaucucuuaauaaaauaaaugugaugacuggaugaucuugaguguguauuugaagauaggacaauggagaucuccuguuguagagaaccaagggaugggagccauuaggaaaaauugggguuugcauacuauaagugcagaucagaguucgagggacaccuacuuaauuuuuagcuucuuguguccuugaauaaagaacugugucagggacauaugacaaggcagugaaauaggagcaguuuauaagaaauagucccaggaaugggcaggggccuagaaugcuggggaaacacauguacuacaucccugggcuaugagguucguuaucauuaauuuacauuuuuuucuauguaugugcagguuuuguuuguuuuucccugcaugcucuuuuuguugcuuguaggccaggguaagggcuccccccagucauguuuguuccuagcuucuuucauguugauacugcucuucuauuccucagauggucuaauagacacacauuugacauucagaaaaacagauaagccuggaaaaaaauguuugaagaaauaaugacuuagauccucugaauuguauugguagacauaaauaggcagguuguagcuccucaaccagcauuauauagaaugaacacagaacacaguguauauacugagguguaucaaaacagaucuuugacaccagauaccaaucugaguguuguuauauuuccaauauuuaggaugcugaaacaggaagauugguaaaguaauaaauguaauagaucauuuaaccuuacaaacacuuucuagaaguauaguuaaaaagcaacugaggcaaaguuaaaaaguaaaauauagcccauguauauucauauauauucauguacucauacauagaaagacugcuucagaaugaaaucuugaugcuuuugaauauuugcuucccagaucacuagcccacccuuucuuccugaaggccuucauuucauuuuaguuuaguuuaguuucacuaucuguuuguaucgcauaaaaacaucuugaaggaagagagaaaagaaaauuauacaugaaauauuaaaugacugauuuuauuaacagaaaauaaaugggaagggaaaaugacuucuauaaugcuagauguuaaaauaacuaucugaauuaucuaacuaggaaagacugucucuuaaauguaaguaaaauaagauaaaagaacugauugccagaauauugauugcgcuagguaaugugaaugaguauucuuuuaggcuaaagaaaaauguuagucauuaaaaauuguuaacguaaaaggaaauggcuaauacuggugucuuagucaggguuucuauucuugcacaaacaucaagaagcaaguuggggaggaaaggguuuauucagcuuacacucccauacugcuguucaucaccaaaggaagucaggacuggaacucaaacaggucagaaagcaggagcugaugcagaggccauggagggauguuccuuacugccuugcuuccccuggcuugcucagccugcucucuuauagaagcaaaacuaccagcccagcgaugaucccacucacaaggggccugaaacccuuggucgcuaauugagaaaaugccuuacaguuggaucucauggaggcauuuccucaacugaagcuccuuucucugugauaacuccagcugugucaaguugacacaaaacuagccaguacaauugaccccuugucaacuugacauacaaacacaucacuaguaagccucaacccuuacauucuuauucauccccaaggucuaaauaacuuuaaacgucccacagucuuuacauauucuuaaaauuucaaucucuuuaaaauauccaucgcuuuuaaaacccaaagucuuuuuacaauuaaaagucucuuaacugugggcuccacuaaaauaguuucuuccuucaagagggaaaauaucagggcacaucacaaucaaaagcaaaaaucaaucuccaaccguccaaugucugggauccaacucacagucuucuggguuccuccaagggcuugggucacuucuccagccaugccuuuuguagcacacgcgucguccucuaggguccagaugccuguacuccacugcugcugcucuuggugguuaucucgugguacuggcaucuccaaaacacuccaugaccccuucaguccagggccgucaauugcaacugaggcugcaccuucaccaauggccuuccauggccucucacagugcugagccucagcugcucugcgugaccccuucaugccuucaaaaccaguaccaccugggugacccuuacacauuaccaagucccgcugcaacaggaguacaaacuuggcuaucucuggaacacagccucuuugugcuuucagaaaacacuucccagaagaugucaacucaaugaugcuggucucuucuuaaucacugcuaauuucuuagcuucagcuaaccagcaucaauagucccaguaaugcaaagguuuugcuuuaguaguuuugguaucuuguuaaucacagcugauucuucaaccccagauaaccagaaccacagaauaaucaaacuccaaaauagcaauggcccugaaaagagucuuuaauccacccccccccccccgaaauuucacaagccaggccuucaucuucugcacuguucucaacauuaucuuccaagcucccacacaacaucugacagagcucuuaacaccaaaugaaucuucuagcccaaaguuccaaaguccuccccaaaacauggucagguugucacaggaauaccccacuaugcugguaucaauuugucuuagucaggguuccuauuccugcacaaacaucaugaccaaaaagcaaauuggggagggaaggguuuauucagcuuacauuuccacauugcuguucaucaccaaggaagucaggacuggaacucaagcaggucagaaagcaggagcugaugcagaggccauggagggauguuucuuacugguuugcuuccccuggcuugcucagccugcucucuuauagaacccaagacuaccagcccagagauggucccacccacaaggggccugaaacccuugauugcuaauugagaaaaugccuuacaguaggaucucauggaggcauuuccucaacugaagcuccuuucucugugauaacuccagcugugucaaguugacacaaaaccagccaguacaguauccaaaguuaaguuuaaaaguaaaaugcaauuauagaacauacuacagcagugaggcuagagagauggccuaguguuaacagugcuuauugccugugcagaagacugggguugcauucccaguacccauggucacucacaaccacuuuuaaaccccaguucuaggguauaugaugucuuuauaccucugguaguuccuccauacacaccuggaacagacauacaacuaggcacacaugcauccauuaaaaauacaauaucugaauuaaaaaacauacaugcugcuggauuugaugugguagagaagaaauuguggaaaggaagcacaggaacagcagaaaaguugcacacacagacugugaaauggggcagcuguagcuucagcccugcccuaaauugcuuaagaaacccaccccagagcaucgagguugcucuuuuuaaauaaagcucaucaagagcuacuacccauaagagaaauacugcgagguuggaaauacaaacauggagacuauuucuagaagguagcaaacagugucucuauggauauaaaauaaaauacacucaagagaggaaauaaagacuguaaugguaaagguuaaucuaucaggauaaauacaacuuuauauaugagccaaaaaauuaaauauaggcacaaacaguaauuaauuccauaaucagaaguagguuuuuuuuuuuugacugaagagaagauagacuuuauucccaccaccucagcccuguuaaauauuguaccuaaccauuagaaacuuuauauuuucuuuuaagugcacuagaguggaaacuauacaugucauaggguaagaaaagaugagaauuguauaacuuugaucaucaaggaauuaaauaucaaauauuuugaaaauaacuaacgcaacuugcuaugacucauuggccaagacauauggaggaauccagaaaacauuuuaacugaaugauuguaaagaguacaagacagaaaaaauuagugagguaaaaacuuguuuaaaggggacuuauuuauacacguuuuacaaacacagaaauaucaaaaauaaacaaacuaagcucuguguaacuagaaaggagcugaaagauuuaagauggagccgggcagugguggcacaugcuuuuaaucccagcacaugggaggcagaggcagguggaucucugaguucaagaccauccuggucuacagagugaguuccaggacaaccagggcuacacagagaaacccugucuuguguguguguacacacacauacuauggaagauacugaaauugaaauaggacaauagagaaauguaaugaaacugauuauuuaucuuucagaauaucauuguaauagauaaaaaacuaggcugaucuauaacaaguagaaaauacugauagucaguaucugugaagauggaggauauacuagagauccuguauuuauuaagaaguucgugaagggaaugcaugacaggagcaauguuuugagacaaggugucauguagcacaggauaacuuugaacucuuaauccuccuuucucgacuucacaagcucugggauuuuaggugugugccgguaucucuugcuccaugaggaaauuuaggacaaaaaguuaggcaauuuauaugagaauagauucuuugaaaaacaaauuaucaccaagaagcaacaaauccuuaauaucuguauuuugguuaagguaugaguuauauuuuaaaacuucccuauaaagaaaagguuauacuuuuauguauuugauauuuagaauggaaaaauguaggaaaaggcucauaccaacuuuuuacagauaauaguuaauaaauucauauauuuauaagugacccccaucaccuaccaggaaacuaaaauuaaaaggagacacucucaacuuggugaacuucagcuacaaaauaauuauaauagcaucaaguaguaaaauacuguguuuucccuccuuugcccauaaagaucccaggauguuugauuuuuaucaugauggcaugaaaagauagccagugcaagaaaaacaaagagcuggagagguggcucaggaguuaacagugcuugcugcuuaugcagagggauuugcucuuaaggaccacaaucaggcagcucacaaccaccuguaauugcaguucccagggauccauuggccuugucuuuaaucuaugggcacuaauauacagauacaugcacacauaaauuuaaaaagaaauaauaauaaaagaaacaucacauagaacagaagacaauuuaaaacuuuucagacuugauucuuuauauaaaaaaaucuagagcauuauaaaugaucuauuuaccaaauaccaucacugaguaacauguaaaguagaaaguaccaaaaguaacaggaagguucacauauucauagugaagcaaaccaucaacaccauacucaaugaaguuggaugcuuggcauaccuacuaaauguuuguucuauaagaaaagucuugucagauccaggagccucaaaaguucuuuguguucuagaaauaagcuaaugauggaaaauuaagugucccucaaagugguguguuuucacgagguaguugaaaagcuaggaaaauaaaagcugugauaaguaugaaauuuauugaaggacacugaagguuaaaacucauaaaggauauuacucugaaaauuagcaaaauacuaaucugaaaacagaaacagcacauuuauugucuugaauagcagugucauuuuuacaguuuuuuuucuacacuuauucuuuucauuguauuccuugguaaaaugaauauaucaguguucacaguuuauuuuuauucagucauguuuuguaugccauaguagucugugcuguuguguguguugauaauguagcuguagcagugaauuguuuaaaccuccuuggcucccagauggucaagcauccacccaagagcucucuggauucaugaaugaaagacacacaugugccagcuaauuuugauaugccuugauuagcuccaugccugggcacuucuaaaccuccccucaacuagcacacauuccccucugguauuccuggcuuaacaccuucuaaaucuauauuuuaucuuugcuguccuguuaccuugugggcagcugcugcuccccacccucacccccaccuccacccccaguaggaccucuuucccuuuccaccuacauuguuggauaauuuucucucuugcagcucuuaaaucuuaucccucuuccuccaagucauggaaauuuuguuccuauucuucucucccuuggucccuugcccaugcagucuaaaagucccaccuucaucucccugcccagccauugacuuuaaggcaauuccaaaugaagacauagcauuagaaccaauucccaacauguagcaacuuuaagaauaaucauauuuucccccaagcuauuguaaauuguugccaggaacucuaaaaugucugggguuuuuguuuguuuuguuuuguuuuaaucuuaaucuuaccuaaccuuagcaaguuagcuuguugccacaauuucacagauguugguagaagaccagugcuuucugaauuagaagccaggcuuucugauugauguuuaaaaaaaaaaaaagcaagagcaauguccucauauuugcagcuagucucugagucuggugucuaccagugacguggaaggcuaugacaccugcuucugugacuguauuuguaaaaaggaacauuggccagggaccauaaccuucuaagcaagcagcagaaaagauuuuccuaccccaucauuauucagcauucuuaacauccucugugacuagaaacugcuugaagagacgacuaaaaguauucaaguaucuggucacagcagcagugguuaggcaagaaaggcaauacuguugcucuucagcauuaauaagauacgucaugcuucaaaaagguugcuauguuacuuaaaagaaugucuuagaauuugugcuugagaugaaugaguagguaacaaugcuuucugcacaaaucugacuauaugaguucaaccccaggaaaccuauaguggagaggagcugauucuccacaguuguucccugaccucccuuuauagggucuggcacaugcaucccauaugcaucauauauacacaacaaagaauaaaugaaguguaggaaagaaaugucuuaagaugagugaaaugcugcauacaaauaaguacaaaaaauugcagauacaguguagacgaggauaauauuaggaaaaguacagcgaaagauuuuauaauuaugaauuugaaaauguguacaauguuuuuguuuguaaaauacuguuucuguaaugauguuuaugauaaauauaucauuccuugauuuuuguugacuuuuuuucuguuguaaguauccaauuuauaauuguuaaugaccccaccauucuguaugugugugugugggguguguguguguguguguggguguguguguguguguagacaagagcaugaggcuggguaucuuuuucccugcaucuccacauuacuucauuuauuuauuuguuuuaugccauguguuugcauguauaucuguacucugugcagugccuauggggaacagaaaagugagccagaucucaugggucugaaauuacaaauaagguaguugugaggugucauguucugggacucaaaccagauucucuagaagagcagccaauguuguuaaccugcugagcugucuauucaguauguauguauauauguauguauguaugcaugcaugcaugcuugaauuuuuaagauagguuucucacugauccuggaguccauuguuugagguagauuaccuggccauugaucccucuagauccuaucugcaacacaugcuagcacccucuccccaaaacaugucuuuuauagaguguuagggaucugagcuuagugccuguauucacagaacaagcauuuuauuugcugagccaucucccagcucuuaaugccuguuaacuucugacuacauagcagcaaauagagacuuucacauuguuggaaagauuuuuuuuuuuuuuauuguaaaugucuuucaguuuuguucuaggaagugguuggaucaguuggaaaaaguuuagcuccuuaaaucuugauuuuuguaaauuuuuuaggcaauacuugaauaguggcucauacuaaguugaauuguuuccuuugagauacugaugaguuaugugauguuucacagucuaugauguggaguccuuuguaaacugauuccugaccuuuaaaauccucugcccagccuacauggauauguugaauuacaguacuugucuggauccuaacagcucuccagcagucuugagcccagccagcuuuacuuuccuggacucagauugcuauuuuuuaguaucuucuagugggccaagacuaaaacuguugaguauugucaaguugggcaguugcagcuggucccugucccucaccauuauuauuuuucuucaaugccuaaauuccaguagcuuggaauuguugccucauauacuuugauuguuuuggauagaauaagaaguuguuccugguucuuugucucgacuacaaaugauaggcucuuauacauauaugacauagaugguucucuaugaaauauguauuuaggacuuaacacaaugcaagagugaacuuuauaguucauuuuuauuauuucaaaauucuguauaaacacacauauauacauaugcacaucaaaucuaacaugcuagauccccuucaguucuuccaggauacccacauauauugacccccaaauuucauguucauguuuuauuuuaauuuuuaaaaacccacuaagcccauuuagugcugcucauaugugcauggcauacagcauccacuggcacaugggcaacagccauggccacaccccaaagaagaaugaugcuuccuugccuagcagcucuucauuguauauacauuuuuuaaaaguagaaaccgcuggaaauauaauuaaaccaacaaauaccucgucauuuguugugauuuauuguuuccauuuacuacuugaaaugcagcaaccagugcuuuauuuacaugaugagaucuauuuucaaaauacuuauucuaggguugacuggaaaccaguguuauuuaaaccuuuuguaaugaguggagguaucacuaaauuggaggaugaaaguuuugauucauuucccauauuggcagcuuauuugcaugauacugcuaagugacuugucuaaccuugauaaaaguaccaugcuucucaaauacucauuauacuuaaaaaauggcacuguguguuuucuagaguagcaauacuaucucuugugauugucuuggucacuuuuaucuucagcuggauauauaauaggugcagcauauauguuugcugaguucucauuugauugacuagucccauugcaaggcuuuugauuacuuuggaaacuuaauugaaaagcuuuguacugucauccuagcaaaauaauaaaaagaugguuuuaaguaguuggcacuaggugccuguuacaaaagguguauuuugucuuugggggaaaaaaaguauuaguaacauugcuuuuuucuuuuucuuuucuuuuuuuuuucuuuuuuuuuuuucuuuuaaaggaggagcaaaauagaggcaagcccaauugggagcaucuaaaugaagacuuacauguacuaaucacuguggaagaugcucagaacagagcagaaaucaagcugaagagagcgguugaagaagugaagaaguuacugguaccugcgguaaguaaauuuucaucuugaauuuuuuuuaccuuuuccuuuuuagauugacuugaaauuguaauguuaauaaaguaugaguuguuaucuguuagagauuuuauuuaaccacaaauauaaaaauaauguguggcucauuaaguauauaguguaaaagacaggauugcucaaaaaucccugcuuauuuuugugaaggaagugaugugguagagaaacaagccuaacuagccuacuuuuuaaaagacacaguagacuuuuaaauugcucuguuauaggaagaaucuagauuuaucuaucaggauauuaaaaguuuuugguuuguuuucugucuucuuuuucuuaaaaaaguuaaguaugcuggacaagguggcacaugcaugcagucucucccaaaaacuugugaggcagaagcaggcuaauaccugcaaauucuaggccagccuuauacauaguaagucuaggucagucagggcuauguagaaagacccuguuucaaaaaccaccaaacaagcaaaaaacaaaauccaaaaagauuacguaauagucauucaaaaauuaacuaguuacuaguguaacuagugcugugggaaaguagaguuugcucauaugcuagguucucuucuggcauauuuucuucuguaaauaaguuaauguugcacaguaaaacuuuguuauugcauagugaaauuuguguucuuucugaaaccugaguuuuacugauuucauagacacuacuccaaauauuucuuacacuuaucagcuaacaaacacuguucaaggucauauuuagaaaucuuaugucagaaauugaaaguaaaauuugagacuggcaucgcaugaggcuuaacaccucuuuccauucuuucucuccauuuucuucccucaacucuucuucacuuuauuuauauugcugcauaauaucagaguacuguuuuuccccccagugggaaaugagaagaaaaugauuuuaaguagauuaugaagccaucuuucucauguuucucauggaaauauuucaguuggcugcucuuaaagaagcuaggaaaaucuauuguuagugugcugucaccaaagccauuuuguugcuuccaugaaugucuuugggaucuacuguuguuuauauccuagcaaucugaucuuuauuguccucauaguccacuuucuuuuuucuuucuuuuuuuuuuuuuguuuguuuguuuguuuuguuuuucgagacaagguuucucuguagcucuggcuguccuagaacucacucuguagaccagucuggccuugaacuccgaaauccaccugccucugccaagugcugggauuaaaggugugugccaccacugccaggccauaguccacuuucuaagugaccucauacauuagaaacauuuccccauucauuugacaaaauugguuucuugcaaagaaagaauuugauacaaauucugucaauagauacuuaaggaacauggacauguagauuguuuguaaauaugcacuguuuguucaaucuuauccucuuuccuuuccuuaguaacuguguggucuugaaaagcagugcaaaggggacuuguggguauuuaguugcaguuucauagacaggaaaguauuacagugcuguguaucuaacaacacauguguuuaacuaauguagcaaaaugaaaauggucuaauaguuuacuauuuacccauuuuauuuuucuagucauugcuuuuguaauuuacuuuuauucuaaaagguacuauagaagaagaacauugauuuaggagauuauuagugaguucuagaaaauuuuagccaguuucuuuaauuuagugggggaauaacuaguggugagauaagauuuuggaguacccacuuuuucauuuauagaauuucuuguugauugaugagccugacuugaguuuggucucagguucaacaguggugggagaaccaauuucuggaagcuguccucugaauuucacaugagagcuauggcacauuuuagaauauuucccccuccacuucugcaaaguucccugagcacagaaauaagagauuagacggagacacuccuuuuaguacugagucucccaagcaagggcucuuaucuguauauuguccaauuguaugucucuauauuuguucccuucgauugcuucuugauauuggcugggcaagacacuuaucuaugaguauagcugaaugucauugaaagucacuuuauuguuguguucuuuuaucagaacaguaguauuuggauuucuugucucagguuccuggccauguggguguuccaucucaugaagugggccuuaauuccagucagauagugguaguuacucccauaauguuuguaucacuauugcacuuguguaucuacuaggccaccauuauagaacaaauagaucauacuuggauuggugugaaccugucuccucuuguauacaguaugcagaguccuucuacuaccaugaacaccagucaguaggagugaaggcucuagguaggcacuaaccuaccuucuuguugaaugaguuauuuaaauauugccuccagcaauaggauauuacugucaguuugugaagagcaaacaguaaguagcuucaguaauauauucuggcuguugggguucuauagagcuccuuuaacaagaacuuuagauguaaugcauuucaaagauuggaugucucauuugaugaugagagaugucuacuuggacuuggucucccuguuauuuagugacuccauuuauauuucuuucauauauguauauauuuugugacuacuucuacuauaguagguuucuuuccauacuauuccucaagugacccugaguuuuagcuguuucuccucuuauuccucucuuauucucccugacuuucccuuuuuuucacuuuagauuguuuucaguucuuuuguguuggaaaucuucuagcuguuuauaaacaauaaauucuuaaauguagccauuuuguuguuaggaagcacuagaguuuauuccucuuaucuaacucuaauuguguaccucuuaaaacugcccccccccccccccccaaucuucugucucuguauucacuauccuacauucugggucugugaaaccaacuguuuuaaacuucaucaugugagggagaacuaaaacagcauuuauuuguauuagcuguauuuguugaaaagaaaauucagaaauuuaacuagaauuagaugacuuauacuucaaaucugauguuaaugcuacuuguuuacuuucuaagugcauauuuuagaagcuagaauauuuuuuucuagugugacauuauacaacuacaguuuucuauguugugaaagagucauuaauaguguuauucgugguuuccccuagugacauguuuuuaggcauagauuuauaacaauacugcauugaguguuuacuuacuuuuguauaucucuaaggcacaauaaaagggauagagaaccauggguuagggaaaugcugcuuuaguuaaugauuacaaaaugcuuuugaagagaugauuuugagaaauaccuaacugaaauguguaguacaacuauuugcauaucuuaggaguuuucucaguuacugagaacugaagugguccuguguccuguuugaaaaauaccauggugcccaacaaaguugaaugagcuggagauaugugugagguaauugggaaauagguuaaggcauugugucuguauucugaaguagguuguugggagagauugacaggaauggcaugauuugaugccuguuucaauggauucuucugggugcuuagcuagugggcuuugagggcaguaguggaagcucagaugcuacuuagcauucaguucaagugcuuauucagaauaggucauggcuagauacacaaaaauuguuuggacaagaguaaaggauguuggagguguuugaugaaggguuuauuuugaaggugaaauuaguugacaggaauuuugauuagacuugauauaguaugauaugugauuccuuaaagcaauugaugccuuuuauuuacauuguuagaaacaaagaaacuggauuuggaaaugugaaaauugagaaaccagaugaugaguuuuuccacauggcaauaauaaaugggaauuugaugagaacauggaguuguuauaucacaaacauuuagagccaaaggauuggaagugcauaucaucaaaaaacuggauuaaaauuacuccuaaguuaccuucuaggaaguuuauacuaauguagcagaaaaugccuauugccuaauggucucaaaccuggguguuucccaggguuuaaauccauggccaaguucuguaggaaaauaggaauaauuuugcuuuguuuuguuuucuagccaugcuuggccuggagcuggcaaucucagauacugagaauuacaagcuaaugcaucaauuucuucucuucucuucucuucucuucucuucucuucucuucucuucucuucucuucucuucucuucucuucucuucccuucuuucuucuuucuucuuucuucuuccuucuuucuucuuucuucuuucuucuuucuucuuucuucuuucuuucuucuuucuucuuucuucuuucuucuuucuucuuucuucuuucuucuuucuucucuucuuucuucuuucuucuuucuucuuucccuccccuccccuccccuccccccccucccucuuuuuucucuuucuauguuuugaggagauauacugcagucucuggucucaucucauugcaagggacuguuaguuugcuuaugauaucauuuaaagauuaaauuuacagcuaaagcccaaaauugucuuguuuuguucuuacacuuggcaucagucuuuucuagaaagauaaaaggacaauucugugcccuuuuuuuguggagaaagcugaaucuagggggugugaggugaggcguggaacacugucagcauugcuagaucugagcuuuauaauuaaauggaauuaaguaucauguuuguaguuuuaucucugcuggguuuuaaggcucauaaaucugacaaacguuauauccuuacuuguuauacaguucuaaccugucuauuuuuaaaauguuaaauguaauauuuuaguaagucacauuugguuuuguguguguguguauguauguauguauucuaaauuugaaaaguuguuguauguuguuaugugugugcagggaguguucauguguuugaauugggggugcagguaaggaggugagagggcagccucuuagguauugguguacuccuuuaaccuuguuugaguaggguuuguuguuucugcugaguauaugguauuucuuggaauaugaagguccaggagcucuucuguuucuuacucuugucuccccauaggaacacagggaauacagacaugugccauuauacccaguuuuaucugcauuugcaggguagaaacuuggcguccucaugcaugcucagcaaauacuucccuaccuucuggagcaauaucuaaaacccaaaaguggguuuugguuuuaccuuguuuguuuuuguuuugauuugagacagguuuuuacaguguagcucuggcuaugaagacucaccuguuccuagaagcucaaaagauuuugccucugucuccagaguacuaggauugaaggucuaucugauuaaugaugcugggcuuaaauuuggguuuuaaaacaaccuuaagucgauuucauuccuuuugccaguaagcauacaacaaacaauaugccaaccccccccccccccgaaaaauagcucaguauuaaaaucuaacuucauaauuaauaaaaguuuugcaauggccacacaucuuuagaaucagauauuuagaagacuuguuuuguaggaaauaauguuuuuguuucacuuuuguuugcuagaguacuuuaauccuuuuguuuucuaauuuacuaauagaccaugcauuaaguaggcaugaguagcuuuuuuucauuauauauaguauuuuauugaucaaggccguauuuauugucuaaguaucuacuacaaauauacucagaagucauuagagacuuauccucaauagaaacuacuguugaugugggccgugguagcacgcacaccuuuaaucccagcgcuugggaggcagaggcagacagauuucugaguucgaggccauccuggccuacauggagaaacccugucuugaaaaauaauaacaacaacaacaacaacaacaagagagagagagagagagagacagagagagagagaaaagaaagaaaagaaacuguugauaauucugcuuucguuuugaggguagacacagaugggguuaggaggccaggcuucccugugugacccagccugagcucaggcuccuccuguuucagucugccacccugaguucuaauacuaagaucugaaaccaucaugcugggccuccguaagauuuccuuggguuggaagaguauccucacuugucauuuucacuccuuccuaguaguccucccuaguaagcuaguaaaguugauauauuuuuaaaaugucaaauaucaaagaaaaucauucaguuuuaucauuuuacucaaguaaaacucaaacugcaccgcacucucucuucugaaaguggaagaggaaaugagcuguuugguuugaaagucuuugcuguauaguacagucuucuuugacauuuuaaaaauauuaggguagguuccuuuaaguuuucuaauguuucuuguaaauggggggaggauuuuuguccucucaaagucuagaccugugaugauaggaagguggauacucuauuauugaguuaucuauaauaagcuuugaaaaacaauuucaaggcacuagguugccauagcagauauuacugugugaagauacauuaaacagagcuuauauagggagaaauaaugccuuguguuagggcgguacauuauaggagaguauuaguauuacuuagaauuauugggauauacgauaauuggcaaacuaguuuucaugauguuuuuccuuuuccuaaguggacuuuaaaaauaauuauaacuuuugcaaaauguccaaggaauuuguauuugcuggccaguuagggucugggcaaaaugauuauuuguaacuuugauuuucuacaaauuguuuauauuaguaauuagaucacacaaauuucauaaggcccuuaauaucaauguugaacuauguucuuagaacuagaaaacuugaccccuuuaaaaauaaauuggucuguuaccaaauuugggggggggggcaaaguucuucaagucuuagcauagcaccccucuauuuacaagucaacuacaauuauucacuuccauguuagaccuuucaaauugguuuuuuuuuauuuuauaucacagaaagguuguauauuaucucauguauagguuaucucauguauuuguuauuuuuuguuaccuugacacaaauuaaaaucaucugagaagaaacucaguugagaaaucaccuucaucagauuaaacugugggcaugucugggggauauuuucuaguuauaauuguuguaagcaugugguaauacuagauauguaccugagcaugccgguaagcagcauuccuccacggucacuguuugaguuccugccuggugguccugcauuggcuucccuagugcuggacuguaaagugcuauccaaguagcuuuccuucucaaguuuguuuuagucugcgucuuaucacaacagaaaccaaauuaggcuaucucccaauucuguauucaggguuuucuuuuacuuuugcuacauuaaugcugucauacauuacaaauuucuagcuuuguuuguuuuuuuuuuuuuuuuuuuuuuuuuuugguuggcugguugaucuuuuacuuuuguggcauagaaucgugaccuguuuucaguucuugguauuucauguaccuacuaaauuaguugguuuggguuaugccuuuaaguuaacccagcuucuugucucuuacuggguuucucaaaguuuauuuuacuuuuaguuugagucauaucaaacaaauacuucuuucuuuuuguuaugugccucuccuguucuuguauuagcauaaaggcucuuaaauacaaauaauucugaauugauauucagaauuucucuuguguuucuaauauccuacuggucaaaauauuuaucguaaaguucauuuauaaauuuuuuauccccauaaggcuguaagaucuauaauagugcucguuuuugucaugaugucaauuugugauuucauuuuucuugaucaaauucauuagucuucuaaauuuuacauucugauuuuuguuaacuuuucuguuacuguuucauuaccucugcuuugcuuuucuucuacuuuauuugaacuuggacauuuuaaagcaaggcuagugaucugauaccuuucuuuaauagguagaaauaugguuaugguacauauuacuauucauuucaaaguauuuucuaauuucuuuuguaguauuuagaacuuuucuuuguaucacauugguuguuuuuaauuuaguguaguucuugaugaauauauucuaugugguuuugucuuuuaaaauaugauuacuauacuuuuuacauuauuuaccuauuuaauuuguuagguaaaucuagggcucuaugccucacaaguaugucuggcagggacuuaccucugaauuguuaucccuaacccucaugauagcccagugauauugucuauuuuaaugaacaucucauauuuacuuaaguauauauauauauauauuauggauguauauucugcaguaauugggucuuuggcuuuuaagucucauuuagauaaaagugguugugaauguaucagucuuuucauugguuguaaauauucuccucuguggcccucaaaggacagauggacuugaugcacacaugcaugcauguaucucuagcugacaaaaccugucugaacagggguuggcauuaguguuuauuguucugcaugguagcagcuuuccucuuguaauccugaccuuuauucccucccgcccccaaacaccaauuauuguauucaguuuucuauagauaguaccaagcagugugacuuaccugccuuugauggguguuguaaaagugguuacuuuagcugugugaaagugugagaugugucccccuuccucuuuccuguguuaaaaggauugguuaccucaacugcagcauuggagaagccaguagcagauucaguugaugauaaugggaggcacuauauguaaaaugaaucuaugcaguaauucucuuccugguccacaaaaugugaaaaugucucagugaaacccauuaugcaccaugcuaacgcuaaugcaauuuuuagaaaagaaaauguguggggggaacaguaggcauuuuuauacaucauuauuucagaagggauucaaaaaauuccagaugagggaaacaggauauuuuuguugcugauaugaagacuaagaagaaaguggaacuaagggccuucaucuccuaaucuuuuucuaaaggaaaacaguuuccauguguuaugccaggacuaaacuggaaagcugaacugaaaaguacuaacuucugacuggagaaauucaugguaccaagaaacaggaauuuacacuucaaucucuuuuguuuguuuguuuguuuuuuuugagacaggguuucucuguauagcccuggcuguccuggaacucacuuuguagacuaggcuagccucgaacucagaaauccaccugccucugccuccuaagugcugggauuaaaggcgugcgccaccaccgcccagcuuuacacuuaaaucuuaagagacucucuacauacauagaugucauuacgcucagacaguucauacaguguuuuggggcuguauggcuuugugauagaauccuccuguuuucauauuuacucaaggguauuuugaacuuaaauaugaaugaguuuuuaauauauauuugauuuuuuuagaagcauuagcauccauagggaucuaaguuaauaugaauuaaauauuugguuuuaauauauuacugcaauuuuuccagcugagaaauuugaaauuuuaagugugcugauuaaucaaggaauauuuugaaauuuggaaauauauuuaucauaacaaaaucauuuuaauuuucuuuuuagaaaaaccaguuaucacugucauugaaauugagaaaaaaauaaagagaaaauaauauuuuauaauauauauuuuccuauuucucaggaguucuucuuugcuuaauguucuauggauuugacucaugguaaauuguuuuaauuauaaucugaaaauaauaugaaaguaaugaugauaguaagaggcaucuggauacugaaauaguuucuucaagacauuuuaaagccagauugucagucaguugcugcucuuggacaaguacuaguaacugaaguauaugaacaaguccuagugacugaaguauguggcauuuuggcuuuguuuguuuuggugagaaaaagaaauuaaaagauguuuaaacaucuaaccaaaaugcaugcaguucaugauaagagcaagagagagagagagagaggagaggagagaagagagagagagugagcacuugugaagaggguguuucugugcucgcugccauuuucaucugaaugggacucaguguuguaauuagcagucucuucagagugucagagcagaauuaccauugugaugcuuagcugugggauaaaagcauuggauugggucugccugucugccaaacuaaaugaguugcaaugggaauuuucaaauguuugaggcgguuacuuauaguaauuugauggguuugaauaaacucauaaauuacagauuuagaaaaaagaagccaguccuucuauagaugagauuuuuguagaggcuuauggcuuuauaaguucuugaugagagugaauugaucccugcucacaugaggccaguuuauuagggcuugugacccccccaccccccccccccaccccauuaaccccacaaaugcaugacaagcacauguaaggaaagaguuuggcaucucuggggaagagugugacaguucuggucaugauuuuguucuguauucagcacugcagagcguuguuggaagaauaauuuguuuuuauaaacaauaagguaauauuuuaaguucauacuauauguaaauaguaaauaauguauuuuuacaccuaggagacacaaaggguagaauaaaauuuaaaaaaaaaaacaaacauuuuggauucaaaugugguuuucaggcuucaauaagugguauuauucagguuucauguacauguucucagaauacacuucaacucucuccugagucuccaaagaauuauauguuagcguaauuuugaauaaguguccaaaguggggaccaucauaguguguacaauaccauuuguccucaggacacugaccauaauaaucaguuucuguguggucuuuuuaucuguuuuuuagauuaaacacucaaagcugaaguauuuaaauuuucaaggcuguauaauugauucauaaaauagauaaaguauuaugggagccuacuguaaguaacuagguugcuguuucauuacgaaaauagugaaauaguauaguaauaauaaucuggauaccugaaaauauuguugcaucuuucaaaauacauuauuagggggacacaguuauauuagaaaaagaauaauuauuuaguugauaagugacaaaguaaaauauuuuuaaaguaaaauguuuuuguuaaucuuuauugcaugguguuuaguugcauguuggcaugucugaguagcaucuuguauuccuaauauuuuaguugacccaugggugaaacuugaaucaaugguggguacauuuuuaaagguguacuugaguguaaaguaaagguccauagaggaguccucccccaccagaucucagaguuucaguagagguccuuagaauccaauuggcauaagacugugcuguguaugaggcccucugcugugugcugcuuaagcacaugugacaggacagaaaaggacuuacagaaauugacauagacugguugcuccccuccccuccccuccccuccccuccccuccuuucaacuuuuaaaauuauauuuaauucauuucugauucaguuaucuuuuauaccacuucacuuuuagauguguguucuacuuagggcaagaacaacuagaaucaggguuacacauaguuuuuucuuuucuuuuguuuuuugguguuguuguuuuguuuuuuucgagacagggauucucuguguagccuggcuauccuggaacucacucuuuagaccaggcuugccucgaacucauaaauuugucugccucugccucccaagugcugggaucaaaggugugugccaccacgcccggcacacauuguuuucuucagucauuggcuauuaacaaucugguuacuguuuguccuguaaugcuaucaggcucaggcuucuuaaaacaagugggagcaccuuucugcacacuugggaguuuuguacuuggugaagcucuguguugucugucgcucagugucucaucuaugauaauacugaacagcuugcacaaagagccauuccugugucaacuuauugaaggacaccucaucuugacaugugauugacaguuuaguuuagauagcuuauaacucaagauuggaguuguuaacaaauagaggauaaugacaacagagcaguguauuuauucuuuaagaaaaguuuuugugauacauauccagugcccuguuuucaacuguguauucugugcaucccuccgaauuugcauguuaaauuuacuauauagaacuucauacgugguuguuaaacaauauuuauaucccauauuuaaauaaguacuacauuuacuagguuaauuuuaguucuuuuacacuuaaguguaugauauacauccuggauucuuuauuuuuuuaauauuuaaaauauguuuaauagaagaaacaugaauaaccucucuguguaucuccuucaguuugguuguuuucauacucccuuuaauuuguuugcaugcuuuucugaugguuggugaguagccuuguguuccuuguauuagguagaacauuguggaccacacacuguguuaacauccuugacacuggauugacaaaauuaggaaaaucaaaugucucccaacaguuuauacuuuuuucacucucauuuaacuuuuugugacauuucauuuuuaguaugugauacuuuuauugaaaucauuaauaguaaaucuagcauuuuaauauauuaauguacagauaaguauuguaauuugaauucagguaagcuuauuugguagcacugguagcauuauuuucuaauuucauuuugauaaucaaauuuuaaauuuaacucagaagugacuuucagauuaucacauucauuaguaacaagauuccuuuauggaaauuaguuuugaaaccauaguaaugaauugugaagaugauuuuuauuuuauugugccuuuauggggacagaagacauuuacucuuuauaaaucaaauacgucaacuuguuuuuaguuaauccuucgagcuucauuuugauuaacaguauuauauaaaaucugagcaaguuggcaaauuuucagaauagcuaacuuuuugauauuagugcuuuaauaaguucugugagauggguggugauauucucuacuaaaagaaaaggaaacuaugauugcuacacuuagaaauuacauguguaugcggauaagauuaaaagcagcaguaagugacuggaaaacuaguucuuuucauaaaccucuauugagaaacuacuacuuaccaggcuacuccagugcuacaacagcauacagcaaagacuuuuacucacuaauacaagugagaaaagaaaacagauagaauugaauuuccuaauuccuugguuuggucauaugguguccacuguagagaaguguuauacuuucauugagucagaugcuuuccagauaaucacaucugugaugaucucugcaguuaucacugugacuaaucugauauuccaacacaaaaugucuuuucuuugucucuaccuggacaccauaaagaugucuuaaacauaauauuucuacaguucuucccucucuuauauucagugauccucccuuguuuucuguaugaaugacagcuuugccuaauguccuccacuuucauucauuucugaugcuccuaguuucuuuuccuucccaaauucuccuuuugguagcaguagcacaugacuacaucguuucucugugucuuuuucuuaugguacuuguagauaaagcuaacacacacacacuucagugagucuguucuauuuacuaccaguggacacuuauguaacuuaaacauuauucuagaccuugaagccuucagugguccuuuuguuacaauaguauuugaguucuuuuccuuuuacauuuguuugcuuguauacacagauuaauaggucagaggucaacuuggaggaguugguugucuguuuugacugugugguuccuagggauagaauuuaggucaucaugcuuggcagcaagcgccauaacuaaucaaaccgucuuagcaguccuccuugauuucuugaugugcuuuuuaguucuuuuuaaguacuuuuuuuuuccugauaguauguuacuaauuucauaaauucauuuagugucacauugauugacaugcuguacuauauaauauuauaaagucucagaauacagacuagacauagcacaguguguacaguuguggccagacacaggugaccuuauauaauuuuccccuuuaaagcauaguuacucuggugcugcaggcaucacguuuaaggugacacuguucaggccccgaguuugagcucuagacuugauguauacucuaguagcuaacuuaaaugguugcaucaagauagauuauuuacagugcuaaguaauuuuacacuuaagaacuugaggaauagacaaacguggugcauauguuuaaucuauuacuauuacuugagaagcagagacagggagaucucucugaguuugaggucagucuaaagacugucucaacaaaaagcaaaaauagccaacuuccccuuccuccuuucccuccuuuucuucuuccuccuccuaguacuaguacugaugaugaggaugaggaggaggaugaggaggaugaggaugaugggacaauuuggauuucaaaaauaaaauguuuuacuuuccuacagggauguguuauuuucauccuaaauuugccucauucuucaauugugacuuaacuauagcuuuuguuacuaaggaaaguaaaugcuucauuaagacaaugauacauuuuuuucuucuaguuucacuguaaaacaguacagucaguggcagagcuaauaauggugcugagugcuucacaaguuauuaagauuaaauuaaauaauaaaugcuuaguucuucauaagcuauaaacaucuaagacucuuugcaugcgaaauauuuaauugaaugauuuuccugaccaaggaaaguuucaacagucuuggaccaaaacagcaguacacaaaaccuagccuugccugauaaugcagucaagauacaaaauuguucaagccuucccucagaaguugugugauguuuuaaguaacuuuacuguuugugcuaagccgcauucacaacuguccucagugaugugagcaguaggcugcauguugaacacacuaauagauggagcauuauuuacauguggguuugaauguuuaaaauucuucugguuagauaaguguacuucaugcuuucuaccauaacuugcugauaaauuguggccacuaagacagguguuacauuuaaggagaaagucagagggacuagaaaauaguaggugaagcuuuuuucuuaacaugccuaggacuuuugacucaugaauuuguuaaugaaauagcaauuuaaccuaugcuugaauugaguugaggacuuucggcaaagauaagcaagguucuauaaccugguugaaaugaugacacucugcauucuguaggaggcuucuucagucagaaggaugaagcuuuucuggugcucaguuugugaggguccuuuaguguuagauuuagcacagaaagaagcuucauucuaguaggugcuuguucaucauuucuaaacaacuaaacuagaagaccuguaaaggagccaugggaagggaagaggaagcaauugguauggauucuuaguuuuauugucaaucuuuggaugagcuuagcacauacaauuaacccucuuuuggacagacuucugucugugaaagcuucucaggagacaugaagguuuugaaaucaaggaaaguuuaaaugaccuacaacaaauaauugagcgugacugucaaauuucauguaaccuuaaauucacagaaugagauuggugauguaagaaaagaagauguaaacauggucacaaaaacagucugggaaguucagguccuguggagugguguugguaaacuacuuaccuucugugucagucaagaaaaugugaaccauaguagguacuaauucaacagagaacuuagaaaggaguuagccaaagaacuccuguaaacuggaaagaaagaagacaggcauacuauaauauagauuuagaagcagguauaaccccagcgcuagaagaugaaacguaagagguuuuacuagguuuuacuaugauuagaucuuagacucugagaaaguucuaugcaacauugguauugaagccucugauguguugcuguuuagccucuggagcuuaagggaguuaguuggacauagcagaacaagggaaaguucuguuauuaaaauugcuuauaacuuaaaaagagaccaugaguuugagauugaggugugguaggaauuuuauaauuauguuuuaauuuaaaaaugaaaaagaaugaaaaugagauuucuaauaaaaugccaccccuuuuccuuuacucauuucauugucuuuuacuuccuccagucucauaaaaauuccuagcuuuuuauaugagacagucaguguuuccuccccccagacucccuuccccaacuucuacucucucacauaaacacaggaaagggaauuugggggagaguuguuugggaaauauuuacugguuaugaaaaaguaaaacugaaaaggcagcaugugucuguguauaaucgaucuuuucuuaacaaaacagcauagauuucugugagugucaucagacgagucugcauucuguaaaaguacaauuugaaggccauugaaagaugauagcaucucauggugcuucuaagcaugagccuguucaguuuugaggcugaaaagaaccccacuguagucaauucucagggcuuugaacuugaguuuugguugaagaaaacauuggaagugaggcugcaagagaacugucuccaucuaccauguagauccuaggauggagcucaggacgccggacuuggcagcaaguauucucaccuccugagccaucugaccaguuuccaguucuguuuuaaaucaccuaaaguacuaauaaguaaacaugauuuuccucauuuuuuuuuuuuaaauuugaagccuuugauggauucagaagauaauucucacauaaagguauuguaggagugcugaaugugguaauagcacuguacggcuguaaugguuaaagccugagggcucugucucaggcauccugcuuaggagccuguucugcaucaugacuuuguagagaaguuaauuuaucugagucuuggugauaaugugugucaguaucaugcuuuauuaugaagcauggcgcuuugaugaugaagauuuuaugucucauucuaauaaagugaauagcauuuacacuuucauacuuuacaauaguaaaacccuuuuaggcccaugguauuugaccuguuauuacuuugacauagcuuguugccaaaccucacgacaugcuuacaucucauuguagcauaugcauacauuuaaauauaugcauacauuuaauauauauauuuauauauuuauauacacauaccaaucugucauccacaauuccaaaaaguucagaaaauuguguuuguaacuguuuauucuauguaguauauauguuuauauauauauauauauauauauauauauauauauauauauauauauauauauauauauauauauauaugauuaugcuguuuguaguguucugauaaucuuuguauuugcuuauggaacucauuuguccuaugacuuuacaauaucacauuucgauacuuguucacaacaaaagccugugagaauuuucagaguguuucuuagacuagaagcaagcaaaagucuacagaaugaauaaacaacaaacuacuacuuggccauuuaagcauucugcugccacagacagcauggaucaguaucauaaacaguacacugagaacauuugagcuuuacugaaauuaccauucuuccaacuucuagaacugagaaacugaacugugguuuaagagaagucacacuaaugcuggugcuuaaacuuuacaaggagguuuugcuguugaaaaugccaugucuacguguauguucaucaaaacuggccaaaugugucacuuuaaauuuugacaugucauugccuguaaauuaugucuuguuuuuaaaaaugauauuaaagguaggguaaauuaaaaguaaaacauuaaggagauggagaauauagcauaaacuguaaaauacacuuuaaugaccugauugaaguucuuaagagcagauuucuuuguuauccaucccucccaaaauaauuauuacaccugacauaaauaaugcugguuugauaaaauauauuguaaaauaucuacaaggucuauaacuugaggguguuaugucugaccauuucugagaaguuuuacagaagaacuagaugcgagccuuuaacaucacaggauaaaacuuuuuagcaaguaaauaugcuaaauuucuguaaaaaauggggcaguaaagucgaaacaaccacuuugacaugaaaauaauucuguuacaacuuuauugucuugggaggcaauaaaacccacucuagcucucuuuggauguagaguuuaauaguaggugguagggucauaaaaguaauaaagcuuauuuuggaauaugacaguuugguuuuagauucuaauucugccacauaauucugugccuucuggcuuaggguuuuccacuaacccacugcagugaucucugcccaggcuuaguguucuggauccuaaauaugacauggccuuguguacauauguugauaggaacacaaggauuucuucuaccaucuuucucuuggcugucauccccacaguugacauaaucacuucuuaauaauaauaaacagucuaauucaaauguuuucccaagugcaucgucucuuugcaguuucuuucuuuuuagauuuuuugauggagguaaauuugucccugacucacugauauucucaaauuugagcaacaucuuucuucacuggcugaaaguaugccuauugcuuuuuauuuucuuuuuuaaaauuuuuauauuucauagauuaaauucaaagcaacuguugauaaauuuuaacuuguaguauuaauauuuuuaaugaacaaauuuaggaacuuuaauaauaaugucaacuuccuuucuaauaguagcuuguuuguuuuauaucuaaccaaauaagucauauuuguuucauuuauuuuuauauaaauugaugacggucaaggaauaauaauuaacagguaucuucauuauuuauugcaacgacgacuuuaaaaguuuucaguacuacaucaaauguuuucguaaugguuucacuuacauuuuucuuuaauucucugugguuuaguaaauacccacucagcaauuccauuuuguacaaauuagaguauaccaaucucuagucuaaaaaucuuugugucauuacaguuguaauagaaauagaagacugagggagaaacuugcauguguccuauguuucaaaugucaaguagacuaagugauguauuaaagugcagggcacuuaauucuauaaucuuuaaaggacaaacuuacugguacuucuauaccacuuuauuuugcuuuaguuaaaaauuugugcuuaggaaguaaauuugauuuccaugccagucauuuaaaaauaaacaaauaaauaauuucugguaagguuuagugguguguaucuuuaauuccagcacaugggaugcauguaggaggaucucugugaguucaagaccagccagggcuugaacauuaagacagggcuuuuggaggccugucucaaaauauuauuaucauuauuguuauuauuguuauuauuguuguuauuauuauuauuauuauuauuauuauuauuauuauuauuggauccaugcaugaguauuagaugugauaaauaacaaguugagacuagucuaauagauccuacuuugggaguggugacauucaacaguucauggcugaaauuauagaauggaggguggguccuggggaagucaacuuuuuuuuuuuuuaaguaaaggugcugugaguaaguagggcuuggaaagagaagcauauaggaacauguaaagaacauuuaauaggcaagugggaagauacacuaagacauuaauggaguuagucuggucuauugcuuuacaagauaugugugaaagagcaaguuaauuggcucaccuuggugugguaguucaaagaggguuuaaaucuuuguuuauauaguaagaaaucaguguagaguuuaagacaugagaguauuacaaagcauuaagguagacgauguguuuagggaaguuuaucuggcccuuggaucuagauuguguguuuagauuguguauguacuaaaugacagacacugcugucagcugaauucaauaguuugaguaguauagugaaugaaugaauuauuaagaguaguguguuaguuaguggaagagggugaaaccaagcuguggccaucuugguuuauguuuauguauucuaguuagucuuagugccccuuucaguuguaaauauugccuauguugauaguaaauuauacagugacccuaaagauagagggccaaagauauaauagcccuuguaguuagauugagggaaaaaccaagaacaguagcauaagaaaucaggaauaaaaguuuagaaauucagcgaugauugcuaguugacuuuuguaguucaaagucacaugguauaugcacuuuuuaguuauauguauacagucucaaauacuuaccacucauuucccaugugcaggcugaaggugaagacagccugaagaagaugcagcugauggagcuugcaauucugaauggcaccuacagagacgccaacauuaaaucacguaagaaugagccuagggcaggauuacagcuccugguguuuguuuguugguaccacagccuaaaaccaauuagaguugaaguaaugauaaaauuuacaaagaggaccauuuuauuuaaugcuucuguuuagcaguggucugcucaauuuuauaucaguauauaaaguuugggguuguaauuuuucucuucuggugaagggggugguggguuucaagaaauguccugcagcauuaacuaucaaguuaagaccuuaaauuuuuuguuugugacauuaugcaaaagacaaacuuugaaagcuuuuuuuauuugaagcgaagugucuaagugaaauggcccugcuacucaagucuuuccucuccccuugcuugcauguuugcuauguuccuaugcaaguucacaaagauuacugaguggcagcuguuugcagacuacgcucgcccugaauuguggcauaacuuuauaagcugugugauagaauaguugcugguuuuguuuuguuuguaaauuguauaguuugagaugagcuaagguuuacaugucauuuaugugaacaagagccuacacgcacacacaugcacacacagccacacacaaaauugaauuuuaaacucauaaucaaaauugccaaaaguuuagcaguacuuacuuuauaaaugguuggcuuugauuuacccuuuauagucaugaauuuagcaauaggacuguuucuguauucuuuuacucauggaauaauuccuagcaugcugggaacauguacauuuaguguuuacuuaucugacuuacccagggaguuuuauuuaaacuugaagccaacauugugcuuuagaaauauaccaaaaacuaugucuauggacucagcuuaguagauauuuuguugcaucuuuuaauuggaauguuuucuugcggugguuuguguuuuuuuuuuuuuuuuuuuuuggaugcucuuucgucucacaagauguuguaaguggauauaucaucaaagauaugaaaaguguaacguuaaauggucaugcucauuuuuuacagugguuuuauuuuugcauuuugugaaucauguugggggggaagcuuauuuauugcacuugguugguuugcuuuggcauuucuguguggucagugcauguacuaaugauuuccuuuuauuuuucuucuuuccugcuuuuuccuuucuuuuuccuacuucccucucauuuccucauguuuuauuacugcuaucccuauacuucuuucuaaauuucuuugcuuacuguagcagcccuugccuuuucucuugcagcaacugcccaggcugcuccaaggaucaucacugggccugcgccuguccucccaccagcugcucugcguacaccuacgccagcuggcccuaccauaaugccuuugaucagacaaauacagaccgcugucaugccaaacggaacuccucacccaacugcugcaauagucccuccagggccugaagcuggguuaaucuacacacccuaugaauaccccuacacauuggcaccagcuacaucaauccuugaguacccuauugaacccagugguguguuagguaaguaugauuccuguacuaugugauuaaugcauuccuaaauuuugguacuccagacuuuggaaggauaguuaucgauuucagagcgacaguauaaguuuugauuagcaaaaguugaaaacuaaauaugguuuuauuugaguuccucacuaaaguucucccauuaaguaauuacaccuuaauuugggucacuuuaguaucucagaaucauucuggguaaacuugccacguauagucucagugagauuucuuaggugacuaaacuuguucuugaguuuuauuuaaaccauucuuuccccuuuauccuaauaggcagagcuucacuacccaaaauuagguuuauuuuguaucagagauugcuuggugaauuuuaaauuucuaucaauauagugagauuuuuauuaaaauucuguuauuuguguauguguuuaaguauuuaugaucacuuaaaagauguaguuaauaguuucaguuuuaaggguuuucagcuuauaucuuuuaaaguccugaauaacaugaacaauauuuuauaauuuccauacuacuguggacuagaugaccacauaccaauuuaguaaguuuaaucauguuggaggcagaaauugaagucauauaacuucaugcguuuacaugaugaaaaagcaauauucuugaaaaagacauuacugaugccuuuuuuuuauagaguggauugaaaugccagucaugccugauauuucagcccauugacuugcuggaugaaggacuagaauacagcagcuguuauaacacgaccagucaauguggaaaaaacaaaaaacaaaacaaaacaaacaaaaaaaaaaacuguuucugugcaaccccacuguuuuaccagacagaauuugaaacuuuuuuguguaugaccuuggugcugugugccugcuguugacuccuaggacuuugaucuuuuaaagguucccucccccauccuccacuuaauauuaauuuugaaagucuuuagugaacuuggacauuaagauuuaaacuugaaaauucauuguucauuuaaagaaagccgcagcgcucuguauguuaucugugugugugcaugcacuuaggugccuuuguuuauaaacauuuuauuguacauguuuucugucuuaagucauuguauaaaauaauuauaagucagaauuauacaacagaaguguuaguaagaggcuguauucuauugcacauuacuugaagcauuuuaaaaaaaaaauaacauguaaccuauauauaaccuuauuuaaguuuuccuuucuauuaauucucuguccuguggcccccgugcaugcuccuuccccagaacuccucucugccgcacucacagaagcucuuguuccugaggaguuagggcucucagcuuccagcugcugcuccugacuguuagugccuaguuuugccaaauagaauuacuaugcagucugcuuaucuaaaaugaaaaauagguuuucaaccaguuuacugcuuagagacagcaagaggcacugcuguaaaauuucuccauuauaaaguaacaugucguuugguuugguuaggacauuuauauauauaaagaauugauugaaaccaacacuauuaacaaaauaugcagauaccaaauuaacaucgucaagguucucaauaaguaccaaguuagaaauuauuaucauuaucaucauuauuauuauuauuauuauuaucaucaucaucaucauuauuucuugcuuugccaccuaagcaguaaaacaaugauauuaguccuuuggagaacugaggaaauuacuuuaaauucccaaguuacaguaaauuugcacacagauaacaugcauguuauguaucaaguuucacauuauuuuaaaauaagcagugccuuucaaaacagaugcagacauauguguuggugguagugaggagauugguauuagcaucaaaucuucauugaugacuaauguuuaauucccuuccuuuuaucuuuagguauggcuuucccaacgaaaggcuaagaauucaagaacggucuuaaccgaacccucaucagaucugaauuuaacaaaugcuuagucucagcagccuccgggaaaaaccuuagccuagcagucagugacuuacuugcacuuuuugcacauagauauaaaguaaaaugauacuauuaauuuggauuagucuguaauacugcaaagcaacaguaauuuauaaaggaguguauagaaguaaacugacugcuaaguguacuguacuguuugcuuuacuaaucaccuaauucauugcaguucauacuuauugacucaaaaguuuaaauccacaaucuguaggcuuuaauuaagaguugcuuuuuaaaccuuuuuuaagugauaaacucugaaaguuaagguuagcaaaauaauugucaguauuaaauguggcauuauuuaaguaguccugcugcaagaaaggcacuucagugaauaugugacuaguaaagcucagacacgucugguucuaauagagcucgugagauacugugacuuggggacugucaaugaagaggugaaguagguagaaggccaaccuguuugaaaugaaugcaauauugauagauacaugacauacuacaguugauuuuaaaacuacugugccuuaacauguuucuuaagcuuuuguaguaagugaaccuuugagauccauuuugauaaaccugcugucaauguuucccuuauguauguuuucuaacuuugucuugguaauugcaauuuaacuaggugcgguggcuacuaaaguucgaaggcacgauaugcguguccauccuuaccaaaggauugugaccgcagaccgagguuaguuuaguucugcaguucuuguuuauaagcaaugugcuggguguccaaaaaguuugcaacaccagaccugauggaaaaauguaacugucuaccugcacaccauuuucuuuucuuuuucccuuucuaaauuuaauaauugauugauuuaagguugguuugguuuugugguuuuguuuuugguuuggguuuucaccccuccccuuuacauuuuaauuuauuaaaucuucuauuacuuuguccuaagauuuauuccagcuaaaacauaaauuagucuauuuggggagcuauuaaauuuuuacauuaucauagcaauguuuaguaauaauuguugcuaaauuuuucccuuuaauuauucugaauauuucaguugguacugcaaaaugaauugagcagaugauguuuuuaugagagaaguaaaaaaaaaaaauuuugcuuccauguaauuuuggagaaaacugaagauuuauuauccauuuuucuauauuauaaaacauugagccacuauauaaauaugaggguauaugugucaagaacauaccuaaaaucaacagucaggacugugaagauaauuuuaaucuaaguggauacuuuaugaauagaaaacaaguucccucuuacucuauuuucuggccaaaacggaugcuuugaguuuugucauuugcugcuaaauuacaguaccugaacguuaacuguccugcaguucugugguaugcgagguccagcuccuuggauauccuuuuuuacuaaccugugacuggaaacaagucuucauuuuucucacuuucauauuuguaacuugugcccuauauaugcccuuggacccauuuuuaaauuauuuaugcuuauuugaguaguaguaguuuuguuuggguuuuuuuuuuuuguuuuguuuuguuuuuguuuuuuuuuuuuuuguuuugacuuuuuugugugauucuuuuguguuuuguuuuuaauugaaagauuggaaucccaagcauaguagaaaaggagcuagcucacuugacaugguuacucuacucuugaauaaccacuauaaauacggcacacaguugccuuguguauuagaaauaaaauaaccuuccaaagacaucagugauacuuauuuacuaucacacuaaaauagaguccugaaaacuuuaccuaacauauauuuuuguagugguuuuucauugaacaaaaucugguggcauaugcauaacaauacuacuacaugcaguugugccaagugugagcauaucaaccauuguaucagagucgcauagagaugaggaaguuagaugggaaagguuacuucagaugugggcagucucauagauacuuugaagcugcaucauacugcaaaagucuaacauaauuauuuuacagaguguuuugauuuugaaguaauuuuucccccucuuugguuuuucuuuccccguguuccuuuuaaauuuuuucacuaacacaauaauccuuucucacuuuguacuccagagccuucagauaguugagaauauuagacuaagaucuuacuguauuuggaaaaugacaacacauuccaugcauggcucaucuggagcuguguuuauuuugauuaguucuguuuguguucaaaaugcagugucagcaaaccaaaacgguuuuuauccccccugcuccaucuccaacuuuuccuuucuucuagagauagaucacuuaggaacacgaucaccacauguacucacuggguccaagggagaggaccgaagcccuugacuuacauuauuuuaugauacuacuguuucucucucucucucucucucucucucucucucuuucucucucucucucucucucucaucuuuugagaagauuauuauuagcauucauuugaugcaaggaagcagcccgaggacauauaaccauguaacugucuguauguaagcacuuagaguaucuaguugcuuacuaaaaacaaacccacuuccauaguuauuucacaauugguuugaaacuuaaagaccaacugacuuuauaguuguaacgaacuauacgugauuuugcacaguuaacauuaccuguguguacuguaggaguccaggacauggcagaggauguauuuuagauguacuggauaugauaauguacuuuguuaaguaauccacacucaaauauaaucagaaauuaucuaaguaaugauuugaccaaaacauuacuuacacaaauuuaagacuaugggacaaccguuuuuguuuuaaauaaaagucugcuuccuuuuaagaaauucagggaagauuugauuauauugaagauacaauauuuuuguaguauuuauaaacuguccuaauugauagacuauagaaaccauuuuugucauacaaagguaaauaggucuauuauauagaacauuuaaacccugugaacaugacaccuacuagguuugauuuaugaaguggcauagacucuaaccuugcacugagcaucuuuucauucacaucucuccugccuuugucucaauggcaacaguacagaaaauucugucaaaccucagaauauaguagaaauaauuaagcuguugaaugagucuuaaaaauuauacuacuguuaaguggaccaaguuugaugaaguagaaugugagagguugauuaaagaaggagcuacucaaggacuuuggagugauaacuuuuccacuugagaacuacuuuauguuuuacuguaauuuuuuaaauuuuuuuuuguucuuuuuuguuacuuugcaaaagaaaauaguauuuacagguggcuucuuuuaaaauauaaaaauauaaagcaggaauguauaugaaaugucagauuuuauuguauuugcagaguauuagcuuugaaauugaauaaagaaagcuguuuguaguuuuaaaaaugccuucuugguaucaguuagaaauuucuucuauuuuuuauguacuuagaguucuuugagguauagaguuuuaaauggcaggauuuuacaguguuuacaugcaagugcauuuuauaaguguucuauauguguaaauuaguauuuucaacuggaaaauguuggcuggugcaaaaggccuggccuuuuuucugguucccaugauguugccuacacugcuagacuacaguauugcuuuguaucaugaggccaagaaauuccauguuguuuguaaauagaauaauugaaaaagcaauaaacauuuauugaacaaaagaaacuuuguuuggcccagaguuuauguugaaccaaauuguucauagcaauuuaaauuucuuuagauccauuucuguuaaucaucaguuauuaauaaucacauccaucauuaauaguugcuuuauugcuugcaucugagagaauacuaaugcuuaauagcagucagauacuuauaacugcacugacuguucagaauucuuuauaccaaaccuguucaucauuguuuccaauuuccuucauugacugcuacuaacuauuaguuguuagcuguauuuuauuucuauuuuuuucuuuuaacaagucggguuuuucaaauuauuuuuugugggagugggcucuucuucauuuguucaaaucaugauaugaaauugucaugauuuuuauuguauucuguagauggugucaaucaguuugucagaauucaacaugccuuuuuuuuauuaguugugauuaguuuucauguugucauuaagcugucacuagcugaaacuaaucucuucucuaucuuuucuuuucuuuuuuuguuuuguuuuuuguuucuaaccacccagccgccaccggcaacuaaccuaugaccuucugaccucugaacucuucacccaaugaugaccugaccaugccugccugcugaucaguuaacugguaaucgccuuugcuugccugucgucagugcagcgagcugaggcacuuguccguucgucuuaccaucuaaccaaacaaaagacaaagaaauuguccuccaacucagcuuuucccccccuguuugggugaaagugguucuagaaccugcacugaauaguaguaaagcaauaaggcccgauucaucccacagcacugaucaucucucaaugccccaccccaagcgaacgguaagaaggccucucuuaagaaggggagacagauggcccuaacuacucagugacagaggcaguuacugugagagacuuguaggaauuuuuuucuucuccuagcgaagucaaagcucucucugaauguacugugugacaaugcaucaugcaugaaccuucggucagggaugucguuggggaagugacuucaaaaguauucaaaauuugacaugcuguuuguuuagucacuacagugcccucaaagggcagacauugcagccuuuuuauauugccugccaaaauuugaaguauuagaacaaagugugccaugagagaaaaacuuaacaaggaguuuugaaaagaaaugcaaagaacaaaacuacaacacuauuuuuuaaaaaguugaguaucugaguuaaaauuuccaaaucuuuauuuuacaccaccuuaaaaauuauaugagaacaagguacaugcauuaugugucacauuacugggcaaacuguucaaauauuuuuuuuaaaccucccuguauagaaaauaucauuaaggauguaaaagccaugcuugccuauuugcuguauacauguaaugaaauuguagauaaaguguagugcauugaaacaaaugaacaaaaaaguagauacuuuuacuauacaagggugcuggugcagaaaaaaauauauauauuuuuggaaauguagcauuuuauacuuucaaguguuauaaaaaaaaagaaaaagaacaaagaaacccuuuauuucauuaaaugauuuuuucuggugguugucaagaaacaaaagaccaaaagagccuuuuugucuuucuuuuuuauuuuuuaaguauuggaauaagucuaaugaaaaagaaagugccuuauuuuucuucauggucauuuagucaaguguccuguaagaucagcuccucccucagaauaaaguuacugcauguuccucagucgcccaguaugugaaaggagauaugagaggagacaaaugaguugauggucuaaauuauaagauuugugucacauuaucuugaugccaguuugccaaaucugauacugugaaaaaauuugauagcuuuucuaaugucugacuaguaaauuuuaaaaugucauucuuuuacaaaucauaauuaguacuuuugguuauuaccgucuucaguguuagcccaaagauucugagguuuagaaaaaaauuauguaagaucugaacaucaguuugcagacaaaauuaaauuagagcuuuauuuuauuuggagaagagggauacaauggaauuuuuccuuaccaauuagaaauaauuguaaugccuaaaaaacuuuuucacaaaaaugaaucuuugaaauuuuuuauuguugaaaaaguguuaaguaacauaaaucuaaucagauaucuuauguaguccaucucugcuggcuuuaguaacugcuccuaaacuuuuuaacucuaaaggagcguggaaagcccgcaucacaguguucagugacugcucugcuccauucuuucuccucuccaguuucucucuugaaagucaaacaguuuuguaguugaagcaguccgugugcaaagccugcaucuaaacacuugcguuaauaagucauuaaccgcucaguaccagauguggcaaaucucaagugauuguggacuccuggcucaucaacucaugcccucuuccauacccucauggcuucacagucaaggucagcaggaagcucauuggucaccuucauggugaccucuccauuauucugucucacuuggaaccauuuucaguuuauuuacuaugcaauagacaguccuuguuuuguacucagcuagcuuugauuuaauguaccacugcuuugucuuucuguuacacauaugguuuugauuuauuuacaauauaugcugugccauuuugauuuuuauuuugguugguugguugaauaaauaugcgacacucagaacacuugaggugauaguuuuaaaaaaaacaaacaaacaguaccaguauuugauccagucucaucucagcuguguuauaccuggacaauuuagauguuuaucaaaggucuuuuauggggaagaaagcaaauguguaaaacaguagacgugugacguuuaugaguaaugcuggcucugaacaaacuuuugaaaacuuaguugacaguguuuugagucaacugaaaaaaagcaugacuuuuggaaucucugaaugccuugguucucaguauuaucacucuauugaauuuuuuuuucuuauuaaaguauguaguuuaaaaguaagacuuuuuuccugacaguauuauguaauuuuuagcguggguagaugggagugucgcuuguauguuaccauacagcugacauguauuuuuugucuauucuuuauuaucuuaguaguuucaugcuguguauguaccauaaccaaccuauugccuaugagaaacauguaagauaauguauuuacagccauuguuacaaguuuauaauguauuuuucuaucuuguuuuauauguauguuauauaacauucaaaagaauuuuuuucuugauugagaaaaggauacaaaaugcaaaauccacaauuuugauaacugaaaauugccaauuguuuugcaguacuuuauuauauugggugucuugucuuucuugggcuuuuaguuagcugaugaaugaauacauuagacacuucuggguuuuaguugggauuuuacauagcuugcauuuuaguucuuugguucuuugcuguuucuauuaacccauagcauuauuuuaauaaauguuauaauaccaaccuacuaacucuggacuauguuuguuuauuaaccuuuccguguuuaaugaaaacaaacagggauaaauaaagucuugaguuccuggacuaacacugaagaacgugaucagagauaacauaguguga

SEQ ID NO: 8379 - RNA, 2682 nt, Mus musculus
cgggacgaagauggccugcggacggaggagcgggaccgaaccguucuggcgcggcgcccaccucgcggggcgggaaacccggccgucggaucgcuuggggugcgagguggcggcggacugaguuggcgugggcgcccacaccgcaagugucuccggcgguagggacuccagugagguuuccccuggagccagcgccacgcgugacgggccucgcguugccgugggcugcgaggcggccccggaccgugggcggagacggcacacgcgugcgcacccacgggcgugcgggcgggcucuguuccaugcggcgugacgcgcgguuccguuaauccucaccgcagguuccagucccugguggcggaggcgcuggcuccucagcggugcggcccccgcacaagggagccugugugaggaguacauauucggggaaaaaacgaaguggccaacgccuauuuuuaccuacuugacaaaaauaaauaaauaaaugacaggcagagggccaggacaggggcuuucuauggcguguagaggaaguucugccgguuacauuuguuucggaaacaauguuccgaauugcagcaaugaaguccugcgauuuauagaagcugucggucauuaaaucugcaucaucccuguuuuguugcaaguucucuauaacaugcuccauuaaaauguagacaagauugucaaauuaaccauuuugagaguuggcccuggcuauaauuuucugggaaucaucucacuguauuuuaaauguguacguaagcaggcuaguuggauugcuuuuuuuguuguuguuguuuuaaacuuugauuuacgcgauuucuaaagagcauuuucgaaguuugugugguaccaacgguauuuaaagcaauuuuacucuuuuccuggccaguagcuucugauuauuuuauuuaaagacuacaguuuggguugguuuggguuuugguuuucuaguuguccauuaaacuacguuuuuuagagcaaaugaugaacaaaguuaacauguaauugaaauaauuuuaauuuuccaacaauggcuauaguaguucuuaguacuauagauaaucccuuaauuaucucuaaacaauaaauuagugaaagcauggaauaauuugaucaaaaagcuguuacuacauuuucuaaaucuuucuucagaaucuagaaaaaaacgagguuucuuucuuguauauuauuaaaaaauauuuugucacugaauuauuauacauugucuguguuugugcaagagaaguccccuuuguaaguuggucacacuuauaggcccuuugguaacugcucucccucuauagcucaaucagagcaguccuguaccuuaggcaauccuggcagccccaaguuuuacauaagaggaaaccccugaagaggaagagggaaacugaauaauuuuauccagcacuauagccaaugagcccuaucugcuguucaaauccauguauauuuuauaccagagugcccccauccccauuuuacugacccuauccaguaaauccuuugaauucauuacaguguuacauaauuuuugacccauauguccaaccacuuuuauaauguaguugaaugaaaauaauaggcaauauucauucaccauggcucaaucccugguggacccaucacuuggaaauaguagccauuuagugcauuuucucuuccccugcuuaguuuugccugauuucucagguuaagaaaaaaaauauccagaguuucccaagaccuauuaggccccaagagauguugcugcccaagcucacuagauggacuccucaugugucuugaccucuacacaugcuuggcaucuguagggcucugggcuugguguacccuuguaaaguuuucccuaguugcccaaaagccccacuccagcucccauaugccaccucuauuuuuuguuaaauguuuaguuguuucugucacauuucucacaugccaugucagaucugugcgucaguuuguuugccaucagagacucucacgcuuugagaguuccuaaccccaacaacagcacauguguaggcucucaugacuuugguguucaaagaggagugucauuagcuaguugcauacuugagguuaaaauucuuaccugauuuaguuccuucagugcuucccccgacacguggggaggugugaguagccauauuugaacugagaugguugguugccuaggaacagcuuaguggcuaguggaggcaguccaggacuguacagcaagugaacacauggccuuuggggccacugaccuugcccaggcacucauccauaggcucccaucuuugucugucucccacucuucugcacauugugcacauguauugaucacacaacaugaugaaugcaauguagacuacaaaguuuauugagauauguaccuucaagcuuacaaucucagcaauuauuauagauccuucaguccuguuauugcaaacauucuaauacaguuuucaaaaugugcaggauaaauguacaugaagauagguauacacagguauaugaagauccuuguaauagcucuuucagugaaaacucgucuauuaacaauaaaauuggcucuucauuuuuauacuaauuagcuaggaguggaaaugugcuuucuguucaauuucauuggcucuacuagcuuguugcaucucuccacauuuagaguaaaaacuuaacaauauucca

SEQ ID NO: 8380 - RNA, 87993 nt, Mus musculus
auauuaucuuuacagaauaauaaaacuuuguaacagagguggugguacacgcuucuaaaccuagaacucgguaggcuuaaguagagggaucugaacuccaguauagccugagcuacauaguaagcaaucucacgcuaaaaguuuuuuuuuguuugucauuugcuuguuacauuuugguuucucugcacacugcauauuaguccaccagucaccuaacuugcuguagaaagcccugcuugggaagucacauuuccacagagcugcugugaggcucuccggggcaugagucggaaacucccacgcgggauucuagaaagacugaccucuuaacccugcauccacuugcaacacuaaacaucaaccugggcuuuuccaccuaacuccaucucggccaccguacuggucucgguugaagaagagagaguuaggaagcgcucaagcgcagacgcaaccugggugcuggacggggaaacugaggucuggcucugaggcgucaccccucgccgcgcgugagcaacccugggguugucaggccucgaguagguaccuggcgcucgugcccggcccgcaacacuuccugucccgcgcgcgugcgaugcucaugugacccgggacugggcggagagcaccugaacgaggacgucacgugagcaggaggcggggcgggggcgggccgacucaggucacgugacgcuccggggacggccacggagcgccuccucgucgcacuccccccuggcuccaguucucucuccucuuucucccuccagcucccguugcagcuucgacuccgcugugguggcgcgaccgugucccaggcgcggcuccaaacggccagccgccgugagccccacgccacacgcgaugcgggccguucagcugggaccggugcccuccgggccgcgcgucgcgcuccugccgccgcuccugcugcugcugcuccuggcggccgcgggcuccgcgcaggcccaggccgucgacuuggacgcccugugcaggugggugucuugcguggcgggcgcggagccccgaggacacgcagaccuccgccccgccccgcccccgcgggaaaguugcccgcgugguggccgcggcggcgcaggaggacgcgccgccguggcacuggcccccggagccccccgugcccggccacuuguggcugucauaagucgggcggcuuugugcgacucccggggcccgguguguccgucggaaguugcagggggcagagcuaaggcugggcuuuugucccgcugcacguuuccauugaaguuccagccguggggcuucggaggcguccccucuagugugcagucuccagggagugcgaacccacgcgaugcucuuggaguuggguaguggugguuucaacugcagauugaccccuucuguggcaacucucaguuuuccuuauuuaaaguagccauuugucagugguugaagcuuuuucuucuuuugacaaggguugagagguggucaucucuguaggcuuucaagacuuuacccuucacgucucucaguuagcuuccugugugguugcucacaugaugucauugucuccagaguagauuauucuaguggagucuucugcucugggauccaagguuguauaauuuccaguccugucgaaguuuguugguguuggacacagacuugugggccuagggaacuuccaauaccauuaguuuggagacaggccuccucugggcucuuuagggugaagggaaaccaaaucuuuucuuguuuuaaaaacuuugauaagaaggaagcgggaagagaaucuugaagccagcuuuacccuugacuuucaaaagugacucagaaugagacggggcugagccaaacuugauguuucuaaugguaguccaggcucuuuaguccuuuguaucagagaguuuuguucucucaccuggaguuaauaauuuguaggacuuguuaguguaagaaugagcugaccagaauucuauuucucauuuuggagaguauuuggagggagacacugcugcacugcggcuuauagaccaauuagcugcccaaagauagauugcugccccgguaacuucaugauauggaggaagggugccccuuaaacaauaguaggcccaggggggaacauuuagaacagaaaauuuuggauuuagggcugcugugaccaagaauuaacacagcuggucuagugcuguggaagucacggucuugcuagauaacuggaauuuguuucuuuugaaggcguugguacaggggauccaaccuagggcccaggcaugcuaagcaaguacucuacuacagaccugcggccuuugccuuagaauucacuuuuuuuuuuuacaccauuauuuuuaaagugugugugcgcacaugcguguccauugugucugccaugcagaggccagaaaagggucucagaguccuuggagcuggaguuacagguugugagcagccugcguggcugcuaagaauugauccccccccccuccaaaggccaacucucuagcuauaguagguuaauuucuucgaaaaaauuaagagaauauuuuuuuauucuaugugugugaguauuuuguucgaauuuaugucuguuuaccacauaccuuacgguguccuugaagaaggcaccagauuccccugaaacugaaguuacagauggcugugaggcuccacguggaugcugggcauugaacauggauccugugcgaaagcagcaagcacuccuaacugcugagcuguuaacugucuagucuccuagaguuaaguuuuuuuuuuuuuuuuuuuuuuuuuuuuggugaggggaaggaggggagauaggguugcucugugucacccuggcuauucuugaacucacucuguagaccagacuggccuugaacccauaaaucugucugccugugugcucccaagugccaggauuaaaggcggcacuuuaaucccacccaguuuagaguuuauauuuuaguagaguagaauuugucaaggagaacugagcgucauggagucucagagcugcucacuugugcauggucaucucauugucuugaacuuguggucuuucaccucaucuccaguggagaugcugguccuuaccuuguggaaugaauggccuuuguacuagucuacuggggccacugucucacauggugugacuuugccagugcuagagagggucuaagguuguguuagaggugcccuucacagcuucugacgucucuaagguucuucuuccucuagcuuuccucaggaguagugaacuucccaguccuucucaccuauccccugccuguaacuaugcucuuucuuagaaacauuuugagugucuuggagccugcagaguguaguuugucuuguauggucuguuuaguuuuuuuguucugggagcuuaaacccaggagcucaaagucaggggcaagcuaggcagcuguuuucuuccagagcuggacucacagcccuuuaagagucucugccacaggcuuuuagccucuuccuugggaaugugggcaguuacugcuagaaaacgucaccugcaaguuccuuaggguuagcgcacacacaaggagguuagcgauucuuucuaaauccaguauaaugcccauaacguaucaagggaguauggcguguuuguccgccucaccgccuacagacuccauggcugagauguaaauagcccccuggggucuccugagugaacaguagacuccuguaguuggugcccuuguguuuguuuuuggcaccuggucacuuggaggcagcuccuuauguggucaggacuguauuccagggguugguaaaccaacugaaacaggggcuacauuuucccuguugaaaaaaaacccagauggauguggugugguuuggugcccagagcacuaccggaaauuauuucuguaaagguauuggccugcccaggcaucaugggacguuccugagccugggcaguugguucuuggacuugugggagaacagccucuuucaagagaggauacuuuucagagagcaggaggggaguccugacccauuucuggggugucugguugguguggagcguugggaugagcuagggcucugaccacugggauaggggugcaguuucuacggaaucuggcuuugggggaggggucaaggaacccaaguggagggaucauuucagcagcaggucucaggauauuugcacaguggagaggccugcucugugaacuguauguacaguagacacagcagaggggaguauagguuacuggaacagcacgguacacagccugcuuacucuuugaagagacuggagagauguacaugcacacagaugcagucacacagauacugggcaccaacugacccuggguccucaugcaugggagggaagugccaucccuucuuuuaucuuuuguucugagacaaaggcuugccaagcccagacuggucuugaacuugccaucgaccugccucagucucuguuguagccagauuucaggaacugcuagaccuggcugaucauacauauuugucaaaugucuggagggaagugugcuguagaagaaguuacuugggucucucaagaugugggaugcugguguaaagaaaaggucacuagacugaugagccugcuggugguggcacuggccuggauaaggucugguguagggaacaugugaaggucaguggggcaggauaagugagaacaacacagggaggggggaagaggccagguaaugcaggacccucagaguggaccgcaugcacuggugcucuuggcugguuguucagugguucagcuuacuacuuuaaacuuugcagaaugccguguuaaguauguaaaaugcuucccacccuugauuuagguguucacaguguuuuuuggggaaggcuuaacaguuggaacugauuauaaagugcuuggucuggugguuaacuacuuugaaauuuauaccggacacguuuucuccaaauuguuuggguaugaauacuggagaguuuuuauuauauugaggacaagagaauaaugaagccagcugggaguugcaguagguuuaguugcuaucucuagagauuuuuccccccuucuccuguaacucuucgcaaagaauaaugcuuaugugccuaauuugggccacauguuagccuggaucaccuccguuuguguacaugcauuuccuuuaaccauaaaaguguguguuagccuaggauuguuaauuaugguuccaauaugguuuuuguuuucuuuuuugacaggauaucacaaugcccucacuacgaccuugaacuccugguccucucgccuuuaccuucucucaguucuuaaaucacaucuuaaccaggcggugguaguccaugcccuuaaucccagcagaggcaguuugaggccagccuggucuacagagugagucaaaaccaaaaccaaaccuaagcaaccaaucaaacaaaccuagcauuuuaauaaacucccaggaaaugaauagcuccuuaggcuucuaucuuuuaucaguguuucacguauagaaagaguuuuagaagcuggugugacucacgccuuuaaucccagcaccugggaggcagaggcaggcagauuucugaguucaaggccagccuggucuacaaagugaguuccaggacagccagggcuauacagagaaacccugucucgaaaaaaagaguuuuagaaaauggaauuccaaaaauaaucaggaugucuauucuuuuaaacguuuugggguugcugggugugugauguggucuugcgugcgugcuaggcaagcagucugccacagagucuauccccagacccaucuccucucuucugagcuuggcacacagcauauugugcugugcagagauuucagcaauguccagagcaaugugcaggggcccacagugguccaccacuuaguggguuacugacauuacuuuguuauugacaucauucucuugggcuugucucagugaauggggccuuucuauagugcugcaccuggugguuuuggguggcagaagcagagcugccucacugugugaacugccaaucuggagcccaagucggcuguaccguucugcacccccauccacugcaugcaagaauucuagcuguuccacauucuugucaacauuuggucuuagcaguuuugaaaaggcaucuaaucucaccauguuuuugagucucuuuucuucacucuccacuccccccuuuucuauaaggucuugcuagaguaggcuuggcuagccgagugcucuuccugcuucagccuccuaagugcugguguuacaggugugugcccucacaggcucaugguguaagcagaacugucccugucuucauugcuagacuuaaugacagacuuguuuauuagaaggacuagguagggcuuuuuuuuuuuuuuuuuuuuuuuuuuuuuuuuguaaauaauaauuugacuuuugaccccuuggcaguuuguuuuuaucauguacuuauggaaacucaggaguuucucaggugucgagggucaagaucuuagauauguuuccuucccugccucccuucccucucuguugcugaaacaccauggccaagaccauccauagugguaggcgaagagacuguuuuggcugggucauuguggcagcaaguggcggcuuuaccugaagcaaagucugccauauguccucuaccaaggccacauccccuaagccuccccagaugucacaaucaacuggggaccaaguguuuaaauaugggagccucugggugcuauccucauucaagccacagacccuaagaaaucauagcuguggcagaauuccaucccuggaggagccuuccugugcauuguuggguguuaggcaauguuccuggcccauacccaguagguccagggcucuucaccauaugcccuuaccuuggugacacaaaggaaaaugucccuagacauuucggaugaaacuccaaccagacaaaaucucuccucuuugggaaucacugggcaccccaaggacacagauuuccuuauuguuuaacucuaggaucugugaggggacggggaagguucauuucccccuaacugucauuguauucaccauccuggaugcugaggugguuuguuuguuguuguuguuguuuuuaaauuuauuuuuaucuucuguguuuugccugcauguauaucugagggcagaguuacagacaguugugagcuaccaugugcaugcugggaauuuagcugggguccuguagaagaguggccagugcucuuaacugcugagccauuucuccagcccuggcagcugagauuuaaagugguaucaugcuguaauuuuuuuuuuuuuucugacuguguuaccaugaauaugacaguuuuguggaaucagccaaccuuuuuuuuuuuuaaugcauugggaucaauuuuuguaugaacuagacguuuuccgguccauacauuuuuguagaacuuagcaguaauguucuaguaaucugguacuuugggagaggagggguaaguaggggggaagacccugugcagaguugcaaggcuuuaccuuggggucccugucucagucucuggagucacaagcgcuugaugccuuacucaggcuggcugaccuuugagcuuccagggaccuuccuaccuccucacucccaggcucucccaucugugggauuguaagugugugcugugccuuuuuaacaugggcuccaggggcuggugagauggcucaguggguaagagcacccaacugcucuuccgaagguccggaguucaaaucccagcaacuacaugguggcucacaaccauccauaacgagaucugacucccucuucuggagugucugaagacagcuacaguguacuuacauauaauaaauuaaucuucaaaacaaaacaaaaaacaugagcucuggagcuccaacuuacguucaagugcuuugacuggcaaaggcgucuucccauccucaaaaugucuuuaaaacguacauuagggcuggagagauggcucagugauuaagagcgccgacugcccuuccaaaggucccgaguucaaaucccagcaaccacaugguggcucacaaccaucuauaacgaaaucugaugcccucuucuggagugucugaagacagcuacaguguacuuacauauaauaaauaaaugagucguuaaaaaaaaacuuacauuaauuagagauagaggcugcugucuagccugggcuggccaacuugagaucugccaucuucagcaguuuuugcagucacgccuggcuuucuuuuucuuuuuguuuguuuuccuuauguuaacauuuuuaauguguauagguaucuugccuguauuugugucuaugcaccaugucuuuguaggccucagaagaggguguuggauccccugggauuggaguuacaagcaguugugagccaccaugugugcuggcaauagaaccagggguccuuuagacccgugguggugugaaugaaaaugguucugucggcucauagguguggccuuguuggagugggugugguuggcguuacugaggaacugugucacugggccugggcuuugaggucuuagaagcucaagccaggccuagugugucucuuuucuauuuguugcuuucugaucaaaugucagacucugagcuaccucuccagcaccacgucugccugccugccugccugcuugccugccugcuacuguguuucccauugugacaauacuggacuaaaccucugaacuguaaguaagccagccucaauuaaacguuuuccucuaagaguugcuauggucaugguguuucuucacagcaauaaaacaauaagacacaguaagacaauguucuuaacugcugagccaucuuuucagccucuaaaaauuucuugacauuaacuugugggcaucuuuaucaaaggcuugucaaugcagaagcucuaguauucugauucauauauuguggacaccuuuuuucuauuuuauuuaauacucacuugcugaccucuaauuuuccuguguuuaguuuaauugaaagcuuaaaucuuuaaaauuaauuuacauuauaucaaggcaugucuuuggauucuggaaaaagagcuacuuaagagugccuggugcagaggaugugggcuuggugcccaguauucauaacaggcaaagucaacccauggauauauaauuccaggcccagaggauccuggguguaccugcacauacauagacacucaggcaugcacacauccacaugaaauaguaaaauguaaaaaccaguuaaagccauaugucuuccccugagcgccacagcagucugacagucuuuaagcucuccguuuccauuuucuaguuuuaaccuuccugggccuacugagauguauaguccuccggaagcugugcuuuaaacguagguugggguccccaaagcuucauuguugacauuuaaaucccugucaugaggaauuaacagguagauguuuaaucccguauugguguugagagguaaggccucuugggaggggauuuggauuacgugguacuuuaggguggggccugugaccgagucccagagacuuuauaggaggagggggaccacacacaccaccugggcgcaugcauauucccauaccuugacgagugacacuacauguacugaaaacuacaaucgccugugucacccugaccucagaccuucaagaacugggagccauaauauggccugcuccagucauuucuuuauggcaaaaugugcugauaaagcaagaaacgacuuuuaggggguuuauuuaucuuuuccacuguggccagugaauggaauuucccuuguggccugccaccuagucaguuggaagagccauguauguuuggaagaaauggucucuauuugggucagaguuauuaauugugcugcccagcugccucugcccugaguuauuccugucccacuugaguuuugucuuguuuacuuuuuguucauggcucuggguuuggauggggugugccuaugggcuuugcaacuucccuugauauagacccacagcuuugugguuguuuuguuuuguuuuguuuuguuuuguuuuucuuuguaggaaaaaaaggguuucucuguguuucccuggcuguccuggaacuuugaucaccaggcuggcuucagacucacagaaaucugccugcuucuccccccaaccccuaccauccccaggacugcucagcuauuuguuuuuuugagauaugguuucacuacauagccaaugcugugcuugaacucagaauuguucuacuuuagcccccagaugcugggauuacaaucaagcaguaccaugccuggcuugcccaacuuuuauuuuuugucuugggcccauuucuguugguuguugucuuguguucauguugcccucagcuggcggcucuugauugugcucauuuuggacaucugucguccuugcagcugcucagggcagggcugggaacauuuguuggaacuuggcuauaaauugucuugggggagaugaggaaugggcgggacaugccagagacuggucuuuccuuauucuccugugggucaccuaccucgugcugcuguuccugccaggaggcagcuguuggcuccucuugauaguuggcagagcguugugugcugccuguuggcaggccguguaaguccuaucugagacagcuggaugacgaagcuggugucagaucaccuuugggucuuugucccucccccacacagcugccuuacuuuuugagacuggcucucuggccccagacuugugauccuccugucuuaguguccugagugcuaggaauguggggcguacaggaguaccaccaugcuccacuggaagccacuguuggaagucaccgucuuuuugucaccccuuagugccccaagaguuucugccucagugagugagugcuugcucaugagguuuaagaaaggguucuacuuucugaaaguauuugaagcuguggguuugugggucacuagucccaccucacacucaguucugagauacugagcuagcagauugcaagacuuuuuccuagcaccagaacuugugggcacaauagguguggggugugggcaggugccagugccggugcccccuauugggcugggucccguucguuuuugcuuuauucuauuuccuggaaguagaaagaggcagugguguguguguguguguguguguguguguguguguauguauguauguguguguaugcgcgcucgcgugugcaugcauauaugucuagagaucagcguagccugccucugucucccaagggcuggaacuaaaggcaugagccaccaagcccuguguuguuuguguauaguggaggcagcacccuagagguugggaaugucugcuguacauauagccccaagagguuagugggaaaauguuuggucacuucaccuugcucuaaaacuggaagucggcuauugcugacaagauuuugaggugccaaagauugugucauguccuauuuuggacucugacagacccacugcuacacacacagucauuacaguggaggaaaaucccguuguccuguucccucgggugugaaacaucagaucagccacugaccuuuagcaguuuucccuugcucaguuagugcuggagggcaaguucccuggggccuuacugauuccugcaggcauuugugacuacugauuguagcugugucuuaaguguaggaaacaccaagcgaugugcuaacaggccuggcuagcauuuuaaaaacagaugugaccagugaagaguggccugcaagguaaguuucaaagguggucuuuuagguugagucuuuagguuugugcugccacauggccacugagcuuugaccaaauguaagauuguucuaauuccagcucuucccuucucuuuuggggcaauaccagggauugaaguuagggccuugguauauagguggcaagcacucugagcuguaucuccaaucuguauguauguauguauguauguauguauauauguauguauuuauugaaaacuuugagacagggucucccugaguuaccauaagacaacucuugagcuugugaucuuccugacuuagccuccauugcaauugguuuuaccaaucuaugcuaacaggccuggcugucagcugcacauuuuaaagcagauguuuaguguggaaaaacucccuacuccuccgccuggccugcaaauagaacagccaccaaaccagaaaugacccagaagagggcuucuuagaagugacaagggcagugcccacugagucaucacugcuccuccggcucccuccugucaccucgccagcucacacgcgcuacucucuacucccaagugaaagccaccaucuguuccuguaucuggucuuuuagaggaaguguggugagccaguggugucaugaggcuuggcaucccuuaauaaugagagagaggauugaggagcuuuugggaauaaacaaggguguggguccaaaagggcucaccaugccuaggcucuucuguaaggugcgaaucuaaagggggccuggaaggaaaugagggguauguguguuacuguauguaauggggaagagucuuugcaggaucuaagugugccuguuugagaccaaagggucaaugugguugaaguggggugggugguggaggggguauggacagggacuggacaggaugggguggggcggggcggggcggggcaggacgggaugggaugggacgggacaggagagaugucaagaguuagcuggggcuggaucccagacgcgaccauauugacuuuggagcuauuggaaaucagcuccaaaauuggaaugaagcacaauggcucauaucgauaaucauuuggcagcugaggcaaguggaugagccugaacuuaaaggagacugaaaaacgacaaaauaaaaaaugcccgaaaguucugauuucuuugcuuuugugcagagggcuucuuaucguucagguacugaaguuggugacaguucugcagccagaaugcagugggaagugguccgugcugggagcagagggcauggcaaggcucuuccugcuguguuuggucacuuggugaucugggacugccugccaaguuacacccacgcucuaguuucaagucuccaaaauggggagguuggugugcuccuugacagacggugaggacuaagugauuauguucagaagccguggauggcaugccccaggugugucacuguuucuaagugaggugcagcugugcugcacaggauugggccuugggagguucucuuugcccaguggaguuucuugcugagccccugguaugaucccaguacuugcagagcaggacucuuuagacaugucauauggugguccagguuggccuugaacucaaaguaguccuucugccacaggcuaccagccugggauugcaaguacaaguccuggucugccuacgugguuuuugugaagaaauagcauguguagccucugauaaccuuauuaacaucacaaaccaacaagcugagcugacuguucagcaguuaaaaugccagcccucccuguguccagggccauaaaggaagcacauuggguccccaaagaauuggggccuugcuagcaagaaguuuugagugggucccugugcuagcauugccuuccugcauccucacagcagagccugugccacacacuggcuucucccuuuccuucuuugggacagucuccuguugcucagguuggcauugaacuuaguggucaagggcgacccuuaacauuuggcucuuuuguccccaccugguucuagcuucaugucacugcuccugguuuauacugugcugggcaguauugaacccagggcuucuggcauggcacucaugcacucccagagcucuucuguggagcuaggauucugugcacuggguuccagcacacagcuuugguuuuuuuuuuuuuuuuuuaauuuuugguacuaaaaaugaacuuaggccgacacacauugagggaaaugcccagccguugaacuuuaaugcagcccucuuucuuucuuaaguuaagaauaaagcaagagagcauccagaucauuacuguuuacgaugagaaacuaaccuuagucuuagauaaaugcaccaguuuacacacacacagggaacccacguggaguaggucugcagucugagugguggaguugaguugagcaaagccacauuuugggagauuccugguagcugugugucuuagagggcggguauugcuugcuuauuagaguucuggcuccugaguaaccaggcagugcagguuuaccuggccacuguuugugguggcagcuguuagugguuacauuuggauaguuuagggucggggaggcucagcugcuggccuguccagaggagacaaccaggaggaagcugucugucuuuguggucuggugucguguaguccuugguuguguugugugucaucuccccccucccacuucagaugggguguguguguguuugugugugggaggaggggguggggacaggggcagggguggggacgugggugggggugguuuagguaugaaguguguccccucucccuccccugaaaagcuuuggucucuagugacagaugaagucacugugagguagcuggguuaucaaggaccuugauguaauaagggaauuauucacagaaacauucauaguuuuacagcacgccugggagacaacggcagugcugagguggugccuagauggaggaaggggaucaucagggugcugucuuguucaggccugcccaugccuuccacuuucccuuauucccuguguuuuguggcucagugagguuaguagccucacccaucgaauaccuguugcagugauauuuggucucaacuuaggcuauagcaauggggccagcugaccauguacugaaaccuuagaaaccaagagccaaagcagccccuuccucuuuuaaauugucucacauguuaucacagccaugcagaagcuagcacugugugugcaugcauacgccaugcuucagugccucuggaguuguagcuggagcccagaugcaucagcauccugguggguguggcccaggacaagggucugcccuugccucuccuccacccccuucagugucauguggcauuuuucuugggaggccucaagccggcuugucuuuuuugugaauucagaucuuaagcaaucuaaauccuugugcuagaucacagugcuguguuccucaucuagguuccuccuuauucgugaccuuuugguuugcucgguuuguggacaaggaaguauauggauuccacucugcccauaggcccaggucuguguguucuucuacugugaccauggugccuuuccagaggcaccugggcucccucuuccucacaaugccucugcuaaaccucccucaugauguggcucaaagacauuauugggcccugguugccugccagcccugucucucucugccucugaaaauggacuuaggugucacaguugauuuagggguucaggcuagaccccucuuuacccaauugauuccugcauucagagccugugcagcucucugggaaggcagacuaauaaugcccagcacucccaucugcaccuucucucugugauuaggcuucagaucuuuauccacagucuuguggguugguuagaauaggaagugaaguacuuccuauauaauccugggcucugcugugucaaacucaugugcuuuccacugucaucgucuggucagggugagucacccugccagaccagauuuuguucuuauaguacacagcccacaagauacacuuuucucuaccugccuugcuguaggcccacuagggacccuaucuugucccuuccugaucucucaguagagacccgugugcugaauaugagcugaaacacuggugcugaggaagaguaagcagguugcagcuugugugcacugcuggagcauucuggugugugagcccgaagcacagucacauuuggaaguucagguugagucagauuugugcucacuauagagucagaaagcacccccagcuagugacucuacugaguguguacuuugcuguguggaccacuaacuuguuuuuuuaaaaggaagacagauuacagauucauacaugcaaauggaaaggucaggagagaaccucugcugccagucuuugccuuaacuguagcugugauacaagguccuuguguuucucucuugugcacaccaggucucaaucucuuaaaggggugcugagcugacagacuuuuggcuuuagguggguucuggggauuuuuuuuuuuuuuuuuaagaaguauguguguguaguuuuguaauuuuaaaaaauacuuaaaacauggugcacaccuuuaaucccagcacuugggaggcagaggcaggcgaauuucugaguucgaggccagccuggucuacagagugaguucuaggacagccagggcgacacagagaaacccugucucgaaaaaaacaaaaaacaaaacaaaacaaaaaauuccuuaaaacaauuuguuauuuguuguguauguguuguguaugugauaucuguuucccauggcacauguguggaggucagacaauacuaaggaaauuguuucuuucuacuuugugggucccagggaugggccucagguugucgggccuggcagcgagagcauuacccauugagcugucuugccuuaacugcccaguuguuaggacacuucaccacaugcaguuuauuguuuguuuuguuuuuuuuuuuuuuuuuugcauauagauucuuggggaccucauaucuguuaguaugaaagcagcccucuuuuguguagcuauugccuuagccuggcuuccuuucgaaugcuuuguaaguaguaguucccuggaagugaagugcaggugaccuucagaguaguuguggccaggcgcucuuaguaguuuagacugaagaacuuaauugaagaaagcaguuucugugucccagaaccauccuguuuuguaauauuuuugagacagucucauauagccuaguaugauccccaacuugcuauguugcuaugacucuaccucccacaugcuaggauuacagacauguaccaccgugccuaguuuauaugugcuacuugggauggaacuuggggcuucuggauuaguuacuuugauaaaaugucaagaccaaagcuggguguggcugggaauccucaaagccugcccccaguaagaagguucuuucagcaaggcuccaccuccuauuguuucauaaucugaccagagcaccacuaacacgugugccuaugcgggacuuuuuucacucagccaccauagccucauguaugguagguaagccuuaauacuggcugagcgauguccuuagcugagaaugggcuguguguuucccugcuggcuaggguucuagaggcaggaguuagauuccagaggaacgaugugucaggucacagacaccguauaccugugcuaagaucccucccacuucuacuguguggcuuaguggagccauuguggcacaugguaucaagaauuggagcuuuucaaggguguaugaugaguugggaaauuggggauuuaguuugcuuuucuuuacuuccauuccuuuuuucuuuuugaaaugaugucuucagcccugacuggucgcucagugaugcccuugccuguguguccugcguacugagauuagaggugugcacucugccacuucugagacugaugcucacguucagugccaagguuucucaguagagcuuagugcucagaaggguaguucuagcuacaacucgguguucucauuugaggagagugacugaauuucucaauggugggacaacgggaucccugggccuugcagguucucccuacuccuccuccucaaugcccaaggcaguuccucaaaugagcuggaacucagagaggagccagugacaguaagcaguacugugagcagcaggugagggacuugacuccugugcuguggcucugcuguuguagcaggucugccugcuacuugggugcgaguggagcccgcccgcccgccugcacagcacagccugcaccgcgcuuuucucagagccuuguguguuaagguuaaaagcuucacuuguguaaacuuggguaaggguggguuggggccuuucagcuaaggggccuuucuugcucagcacugaacuguuguuacaggaugggauuuuaauuuuggcuauccauauucucuguaaauagagauuuuuuuccuaaaagacaaaauuuauugccccuuaaagaugcaaccgcacacuuuaaugcccucacuccgggguucuuuaauauggucauacugauuuuucagccuuuuacaaauaucauuuuaagaaugauugcagcccaggccauuuuggcugcuuggccuuuguaugccaggaaauuuacagucaucuaguuuguaauuucaaaugugacaacuucuacuguuuauuuuugcuuucuuuuucuuuucuuucuugagacaaggucccuggucccugguuguccaagaacucugaauguagaucaguccggcuuugaacucaacagacuaucagcuuccagagcaucgggauuaaaaacaugcaccgcucugccuagccugaaaugguuuccugccuagucugggcuggccuaggccucacuguguagccagggcugucugaacuauugacccuccauccuucacugccuguaccugcaccauuacacuuggcugcaaacaugcggcccucuccuuaauaaacauggcauuuguuuaaaagaauugucauauauuccuaccacucuugggcuuauuauaaacuaauuuuaaaguaauaguaccagagcacauguaucugcauguugacucacuuucacuguucugcagaacuaauuaacuauuuucccaugagguuccugacacauuauuucaguugccugauugugcucaggagccaagcauguuggauuguuuuaaagcagcugcaauguuugcuggaauuaggccuucucaaguguuaauagccugcaggucaucagguuucaguuuaggaaacauugcaacuguuucuuugcucuugagugaugugacuaagccaagcuagugcccuaccccccacccaccgggaacugugggccaauuugauggggcugagugcaugcgccuauggagggcuggcgccuauggagggcugccugugagccgguaagucaguuccagagaaagucuauucaagaacuaaaguaggugauaggcucugccuucuguauguauaucaugacuuccauuuugauuuuguaugagacacagauagaagaaaaguacgcuuucagaaagcagccuuuccuccugaccucugugcagcucauuucacccuuuucaguuuucuucugucugcauuucuuuagaccugguucucauugcuaacuucuuuucugugguacaggcaggcacuucagucaucggacugggaggagcuguaaugaugacaagcuaaggguuucagugaacugccugccagcuuggaaaaacuuaaucacaggcucccaaugagaguuuagcauuucuguaacagaaauguacugauaaccuacaaaucacuaccuaaacguuuaaagaaaguuucuaagugccgagggcugcauuuguuucaaauauauuuaaagacugcaggacaggcguggcuucuguggccuccacaccugccgcugacucaguccugcagccuaggucaaguagcucuccuuucuuuuuucccccaccccuaaagcucugcugcuugucugucagggcucagaagaguaaguuucccagccugacauaguuacggggucugucuguuaccuucgguaaugugccugcucaguucccagcagagcuuguccugugccgaguucacuuacuuuccuucccuuacuggaacagguuagcaggaagcuggggaacuguugccaucuuauacacuuuauacacuguugcguuucucaagcaguaacguagaagcucgguaguggggagacauaggaggaaggacauuuacaauuccaggcuccccccccaaagaaaaacaguauacaccgugaaacaaauuaaguuuccugcugcacccccuacccccccccccccgccccccaaaggaagaaggaacaaggcuuuauugaugguuuucucugggucagcuagauugcuugagauuuuuuuccucuggcauaaucguccuggcucuggagguaaucagucugucagaguugaguaguuccugcuuuaaagccugacaucaccccaggcccagcacuuaaguaaccaguuuuucagguuuguaguaucuuaguggccacaaauucccugguccugccagaugcuuggauagggaugcuuuggggugggaugggggagggguggaggucugauuggacuccagaccuaagguuaagugaguugucuaauagcuguuggugcuggggcagggugggggugguggggguggggacggugggggacagacaggacagugccugguagcuuugggaacuucugugaggccauacuuaaaagagccaaaugugguccacugggaaugggugggagcuggcucacuucccuacuucuggguaaguuuaucccagcaaaucugauuuagccgcucaggcagcuuuguaccuauucucuuccuuuccuccuuguacucuugcugaggaaaugagucccaggaagaguagaggauugaggaugauguacuuggggcagaaggaacaccccucacugauuuuaccccgguguugagguugauagauagcucuuagagugccuuuggcugagcucuguagugaggcagccugcaguagaucuuaccucaucgugaggcagauggcaguucuuagcauggcugucacgucaggacuguagucuguaccaaaagcaggccugcuuacacauuacagcuaguuuucaagaacaaaagaaucccaggacuggggaugaagcccaauugguagagugcucgccuaauguucaacuaagccuguguuugguccucagaccacuuaagucuagguguggugguguaagucuguaaucucagcauucaggagguggaggcaggggcaucagacguuucaccugucucaaagagguuaaaaagcuugagaguuaagaacagucccguggagggacuggagagguggcucagcaguuucccuggcugcuguuuuaggagacuuagguuugauccuagcacuccuuggaaccucacaaacgccuguaacuccaguuccagagggacugacacuuucuggacuccuuggguauuguacauagguggcgcacaauagacauguuggcaaaacguccauacacauaaaauaaugauaauucaaagcaaacuaaaauaauagucauuugggucuucagaacucuggggugacuggaccagucccacuuuacacacaguguauucuaguaucugcuuaauggcguugauguucuuagaacaaacaugggguuguguagucugagggcuuccuagccaucuugaacuccuuuccaaaauguuuugccgaauuugacuugguaucugugguuaaugggaguaacuucuuauuuguaguagucaaagcaaauauggcuagaaugccagacuagagagaaggugauuauugucagaucaauaacaaugacaagcuugccuccuuuauuucuuucuaguuacacaugggaagcuguugacuccaaaaacaaugcaguuuauaagaucaacgucuguggaaauguggguauuuccagcugugggccuacaagugcuaucuguaugugugaccuaaagacagagaacugccgcucaguggguaaguaaagcuguccugugagcaugcccugcgguacagcuguguacacagcugcaugguuaugauauaguaaucaaugcagugucuaauagacauuuccuaaaagagcauucuggcugcuugccuuuugaguucaggacucugcuggggucagauggagcuggggcugccaggugguugugaauccccaggccugggugcugggaagaggaucaagugcugugccugcagagccaccucuccagcuccuagguauuagaauaccuuaaaaaaaaaaaaaagcaggcuaugcuuucacugaaagugucccaccucuuccacacccagguggcuuuuauaauaguuaaaaaugguaaaagacaguuuagggcagguucaaugcucagugguuaagaacguuauuguucuuccagaggaccugagguuuuuauccagcacccauguuggauggcucacauuggccuguuuucuacuggcuaccacaugcaggugacacacaaacugggaaaaaauuuauaacuuuaacuugauuuuucacuuugaauauccaguaugcgauaacaagguuauuuccaugcagugaguagcaugcagacaauaauuagggaggauuauaggguggauauugaauauggaaggauguuuucuaccuguauggcucuuccuucucaccuuuuuccuuaaauuucuuauuuuauauguauggauguuugcuuucauguaugccuguguacccacgcguaugccuagugcccuuggaauucagaagaaggcauugacuccuuggggcugccauguggguucuggcaacugaacucugguccuguccaagaacaagugaucuuagccacugagccauccaucgcuucagcccuaaauugccuuaaauuguccuccuccuucaccuccauuuccuuguaccucuuggaagcgaugguguuguggccucacaguaaaggacaguuguuggacucaagcccuuccuuucuuguuuccuugguucagucauucuagaguauccuuuuugagggucaggaccgcuuggugaggaacagguuccacugagaugggucaaagcagaugugcucaggaggagaggacucugggucuuagcuaucuguggucaguuuugcccagggagcgggaauagugagauuugcacauaauuaacagauuaaucugggaaagagcugaaggcagccauaguagguuaugaguuagggugaugguccuguaguccaggcucauuuuauucuugaccuacaccaucaaaacuuccugagagauaguugugagcucuuucuccuguugauaacugcguucucugcuauuuuuuaaaaaauguuucuuuuaaaguggggugguccaaguuauuacuacuuuaaauuugauuguaaucaucuuuuugucauuaaaaauaggagcauuuaaaauaucaauaguggccauuuaucaauaucuaaaaauuaaguuugcuaaaaauggacuaguuuuucaguaauuauauuaaaaggcauaucaaaaauaggcagagaaaaauagacaaacccauguuuauaguaauugugccgugacuuuagacuucaguaguacauuaguaaaugguucacauuuaaaucacauuugugauuucacaguuuugauagaaaaaaauaccucuuaccucagagggauuaagagacaguuuauuauggagccaaaugugagugacagugccaaugcuaaccuugggcagcauguucccauguggaacaguaaaucaaggcaaucaagacacagcauggugagcgcagaggcagggugcagcagcaggccugccucaguugucaccugauugacucccaaagguuagggcugcugcagagcugggcaaggaauuuuuuuuuuuuuuuuugugguguguguguguguguguguguguguguguguguguguguguguguuggugcugaggcuaaagauagcccccaaaagaaauuauaauuaggcugugggauaggcauccuugcauacuguccauagucauacaaguuuuuuuauuaguauuuuuauuaguagaucaguuuauggggagagauucuuuccaggaauucaugauugaaguugucccuguuggcaaagcaccacaguucaugcugggguggaguuggcccauuucaggaucugagagagaugaggcugagcugugggcagcacacgagucuuuaggaggagcccacaucugaucagagccauuauggagccuaucagagcguguguaacuguaucuaccugacggaaugaagaagggacacuggauguacagaaccaagauuuacuuacugacugcauggcucccuccauguaguuugugcuccauaaaccaucugaccuaaacuuuuaagugauuagaagugaaaauggguccuguagugacucuggagucucuacaggauucauuguuuuaauuagcaaaauacaaauauuguuuuuaguauaagguaaguaugcucuaggacaucuuggugggcauuguaagaagugagggaagaacucagacuccaucuugaguggcugaggcugcucauugaaacagaaugaagguuagcugccuuugaggggcugagggaaauaugcacaccacauacacacagcgcacgaacacagagcuaucaggaaguuacagcuguucuugugguuuaacugggaguagggugaguugugcuuucuauacccagcauauuuuuguuguugcuguugcagguggagggauaggugaggcuggguuaucucccaguacagccugacucaaucccucgugcccugagggcauuacccagcauccuggcucaggagcaaagggaaaacguuucugggagacuacugucuucuaggccuuagaaucuagagguuggcugugauggucucaaaggugguaggggcucauugaccuucuggguuguauaaggacugguacccuuuggccaugaagaguuugugacugucuuggcaauaaaaacuuggagccuuuguuggaggaacuuaguuagacagcugaaaaggagggccaaacagcaaagcuguaaaagugaacauuuggccugccacaugguccccaaauaguccagguaucucaaguguuuucuacucucucucuccuaauaaucguuuagccuuuccccugccgggcuggaugguccugugagccagcagucuucccuaggaaggcacagaugcuccgcuuccagcagcuguuacaucuagugcccacucuucuggaggaucgcuguagccagggcguguauuggauuuuguaaggugaccauacuuugcuauacuggggucaggucuuuccuagucuaacuggucaguugucuguguuauaccuguuggagcccugucacuggugugcucguagcugauggcccugcuaggucuuucccagguggacagggaauagcuugaaguuucucuuucucugacuguuauggacagauaagaugucuguagacuucccaccccuggaacaucuuaguccagggugagaaagaguauccucuggaguagcaaucaugugaguguuguccugaugugcacauaagucccaaguucccaaggcaaggcaaauggggacaauuuguuucugguacugaauuuaguuggucuccccagcugucccagccagggguccugcuaacagauuuauauguucaugguuggugugucuuaaguugaaugccuacccuaguauaaguuauuuggcagcccucagacaaauccaggaguccuuccccagcccuggaucagagauggcuggaauuugccaaugguaguguuucuaugagaggaguguugagauuaaagaaggggugacuguccuugacucucuuugugguaucucagucuugagguuuugugcucaucggaacagaaaugacaguuguaaaguuuggaggaggcucuuugccccauggauguauaagcccaauuugaaguuguagguaccccacguggaggguuuuuuccugggcaacucccaaauuaugucauccuuauguuacccccuuccuguaugggacucaacugcuugccccuuuguaggugccucugccuguacuccugggcuaacaaaaucaacacaacaguauuugaggaaggacuaguaggugucuccccauccacccuuauguuuucaagggacuguagguugucauauuguggcccaggagagguguuggcuccaguuccaauaccacuggaaugaaaaauugcagggcucuuguugagggaauaauugguugggauccaggaaguggguggcccauaggagaauaaggcuguccaaguuaauuugguaauuauucagucacaggaggguagcaguggaagaagguuccagacaggaaugucaacagggggauuucaggcguuggggaggggccugggccugagagccauuuaaacuuagacuguacaguguugcagaugauaugcucaucugaccagagugaaggggaugucaagggguuuuggaaaagcugccaugguguguacugggcccagggccaguuauaggucuuucuguauuguauccaggaaaagcagaacuuggaauguacucaggaaagggagcagacaaagaaguuggugauuauuccucagcgauugauaggaacugggaagucuguauauugugagcuuaaaagguggggcuuagagguauggaaugaaauugggggaaccuucuugagccuggaaagauagacaggguuuuaacauuucauuuuguggugguaggggccugccauuuauguuuuagagaggagugggaugggucugagacacacccuauuuggaucucagggagaggugaguaggguaggauggugucuuacuccagguuucucuugcugugaugaaccaccgugaccaaaaagcaaguuggggagaaaagggcuuauuuggcuuauuuccacaucauaguuaagcaggcuaggaaccuggaggcaggagcugaugcagaggccgguggugguagggaugcugcuuacuggcuugcuacccauggcuugcucagcuuccuuucuuauagaacccaggaccaccaaccaacccagagauggcaccacccacaauuggcugggcccuuccuuauugguuacuaauugagaaaaugcggccuuacagcuggauuucauggaggcguuuuccucaauugagucuccuccuucucuagugacucuagcuugugucaaggugaucccaagauguaccagccaguacaacagaggaggugggaacaauggccugauuaauuuuuuucaggguuuuggaccgagugauaagaacuacuaaggcuuuuuaguaacugagaauaggaguguugugaugagaacugguggguuguuaaaagagcuguuuguaguagccacuuagcaauagccuaaagaccguagugggugggguaccacgugggugguaggcaugaggauaauaauugguccuggugacaaagucagaagggucucuccagguucugaaaaugggaccagacuagagggaauaggugggcccagauauagaaugucacugagaggucgaggguacggauaugaccggacagauggcccaucuuccauuagccccauugucugcagcucagacaagccuuggguuaaaggcacuccuuagcacaauggccaacuugauugcaucgaauacaauguacagucccuugcccagauuugcgcugaacccuagcacaacuaggcaacauaacaugaaaccugaauccacucgaaaugcgcucugaggguccaacccuuugaacucucccuuuguauagaauauggcaccuucaugugccccugagcacagccuggauagugcagagcccucugaauccuccuguccgcuaguggggcaccuucauuugcauggccaaugaggaacccuaaucuugcgcaggaguguggcacccucaugcauagccaggauagcgccaaacccugcccuucccuccgucuccugcaacgcggcacuuuugagcuugccucucuugcaacguggcacuuuugaguucaucucuccuguaacauggcacuuuugagcguuggcccugaucacagaacccuucgaauccuccccuugugcaguuugcacccucaggauaccucggaauccuccgagccgucucuuccccuccccucgcgcaacuuggcauaaccagaaucacagcccaaccggaaucgcauuaaaacccuccgaaccuuugggcagcgcggcaccggggcucacgcagugccgcggaacccucggaacccugcccuugugcagcuucgcacccucaggauagcucggaacccucugagcuuucccuucccuuucccucaccgcaacucagcacaaccaaggaucacggcacaaccggaauugcuccgaacccucgggcagcacugcggcgcagugccgcggaacccucuaaacccuccgaauccccuccuugugcagcuuuucacccuuagccucucucgcaacucggcacaaccagaaucgcagcacaauuggaguugugcuaaaauccucugaacggggggggggggggggggcagcgcacacgccagcacccuggcucgcgcagugccgcggaacccaccgaaccuucccccugccccgcaaaccgcggaucaggucguguagaaauccuccgaucuccacccccccccccaacucuccagcagcguggugcccuagcgcgaaccccugcuccccuugcgcagcguggcacccucgugcucuagaucgcccguaaaccccccccccccccagugcagcagucggcccgcgcuggacgccccccucccuucuccucuugcugacgcggcauggcggcagcgcggcuuucggcuuucuaccggcccuaucggcccucguguaguucagaacacuggugagcaguggggcacccuagugcugaguuuucuuguagcccagaaaucuucacccuagcgcugaaucucgcguaggggaaccuuugagcggccuggaacucuuggucggagcccucgagcugccggaucaguggaacccucaccucgcguagagcccuucccuccuguggaacccuuccuuugcggaauccucuaacgcguggaauccuccccuugcaacggaauccuacccucaucugcagaauccuccccucgcauugccgcgcuucacgcggggaacccuagcuuaccucaguuccccaggaugucugcgugguaacuggcggugcugugcuucuugcugcccgcuagagcaaggagggauagauauaauguugaagccucggcaggggguggagauuauuaaguuccgccccaacugugucacuuaauccccccugcucagcccaaccucaccaggcuuuggcuccuccucuugcuccagccuggagccuguguuuuagauggccuuacaguccuggaaguguuucuauaaauugccugcugagcaggucagaaagauuuagaggaacaccagagagaccagauauuucaagcagacuugaauaacagauauuacgguuauguuucuucuucuucuuuuuaaaagcuguugucuaauugaguaguccuugcuugucuugaaccccgagagagauacacuucucuuagucuuuccauugcuuggaugcagaguaugcagugccacuccugugaagguuuuccugaccaccaagccaccaaaagcauaguuuuacaggacauaaacaggcaguucucuuccacacaacucaguugccaguauugguucaaaauuugagacuuacaguuuauuuuaggcacauuuaagcaaagcacaauuaaaaaaaaguucucugguuuuaauuaacuccaucccauguguucaauaaaucuuuacuuaugacuacauugauucuuuugugagguucaagugagucuucuguauagauagauucuauagauuaaggaaguaggcucaugggaggagucugggggaagcaggcucaugggaggggucuggggcagcugcuguggccuggccuuacagaaauagcacagaggucaccaggcuauuaaccaccccugcccccagccuccugggcuggaaacagguuaucuacucucccuuugaagagacaacccugcguguuuaacauuccuggcuugccuagugcuuaucugugagaaaagagccuacgugcuuuuauguuuguucauuguguguucauucuuauccucuccaaacaggugacucacuuuugagaaguucagccagaucacuccuggaauucaacaccacuaugggcugccagccuucagauucacagcacagaauccagacuagcauuacauuucugugugggaagacccuggugaguggggcccucuucaagcucuuuguuaagaacauuuuccccuucugguguucuuguuacaggaauucugauccuggaggacuaaauggucaauuucccccuccccccaauuuauauucacaucacgucacuaccacccagaaccaccaacuaaaugugucuuaaagauggugagaauuggagugaaacuugaguuaggaugaauguuaauuuuagaccaaccuauaaccacacuauugugcaaauugagaucuuaaagucuguuuguggcagcaugaaccauggaggucauguugcagagcaagcuagcugcugauuuacuucuguugauuguucuuaagagcuugguguuuacuguaggagaaacaggacuuggaggugaacaccuuggucuuucucaugggcuggggaagguagaaguuaacuguugcucugcagggguuaacuagaguuaacuggucugguugccagaaggggcugucuggggugggaucuggugccucugcccaggcucugcugcucgugggcuccucggggaccuccuuacaggauggaugaagucauacuuucuggcccugauuuugcuguuuuuugguucagagaccauuuggcucuugagaagaaggcgaaggauaauuucccaugaguuuacucugcuuguggaauuggggcagcugggcagucaguuagacaggaugucuggagacucucaucucccaacuuacuuuucuguuugggcggauauucuuggugaacuuguugaaguaaggcaguuauguuuccucuuguugcacccuuauuuucaggagauuuuacaauguuucagguuuaaaaacaaacuuguauuacugagugguguguuaacauucuuuuuuuuuuuuuuuuuuuaauagggaacuccugaauuuguaacugccacagacugugugcauuacuuugaauggaggacuacugcagccugcaagaaagacauauuuaaagcugauaaggagguaaugggguuugagacuauuuggucaugaaaucuacucuggagagcuugaaagucaggguguggauucugcuggggaggaggugagagagggaaaccauaaucagaauguguccugaaaauaaaaaucuauuuuucaauaaaagaaaaaaagauagaaaauuaaaacaaccucuuacaaagaagguugugacuuugcgauggaaagauuuaaaugacuuauuacagucucuugaggugagaguuuguuucuguggaugugagguuccauuugcacagagguaccacgagauuuaauuguuaaaaacgucuaggccagcuucuggugcacacagcacagcacagcgcagucuguuuuggcuuuaggguuugcccugcaccccuugggcccucaggaaccugacugcuucaucuuccucuguaccugcucccuacccaugaaacaucucacuuggaugauucguucucugccaguuucuuuucuuuucuuuuuuauaaaauuuauuuauuauauguaaguacacuguagcuuucuucagacaccccagaagagggcgucagaucuuguuacagaugguugugagccaucauaugguugcugggauuugaaaucaggaccuuaggaagagcagucagugcucuuaaccacugagccaucucuccagccccuuucuuccaguuuucauugucagagucucauguaaccuagguagccccagacuugguauguggcuaagaaugaccucagaauuguaaucuuucugccuucaugguaugauuaaaucaugaugguuuacuugauagaucuagaauuaccauggaaauaaaccuuauggguaugugucaggguuucuagaguagauuaauugauguaguguggguggcagcacgcuaugggccgggguccuggagugcguggaaaacagaagugagcugagacuagcauccuucugccuugcacuuccuuguagauuaaaugugacagugacuucccacuccuguuuucuaccaugaggagccuuguucugaaauccagaaccaaauaaaucccuccuuccuuaaguugcuucaaaacugagaaaaguaacuaagauacucugccuccugagugcugggauugcacguaugagucacugugccuggcugugcucugaaguuuacagcucuccucucuucucagccaggggccuggaaugccuguugaguagaacucugucacaguuccuggggacaguuuucccugccuuccauucucuacacugccaccuuguugcuucugcuacuggcuuccuuccuccuggcuggagggcagcugcuuguuuuccauccucauagcagauagcuuguugccuucugagugaauguuucuguguguucuugcuuuugguggugacacugaauugugggauuuggaguacuuggguuugcuguucuuucuggcguuuuugaaauugucugggagucauuacauagcauaagcuguccucaaguuugcaggauucugucucuucuucugaguucaggaauuauccgugccuugguugcucuugacugcagcccaaauagaaaaccuuuuugccaccauuuuucaaggaauuugguauuuaacuggaguucucugccugcuccuggcugucacagguuacuccaccucuagugugugucagggaggcuauuuggcuguguggaggaggcuggcagcccuguggaguuuggauuuuuacuuccugcauaguaaggaccuuuuaaagcaggcaauguaugcucugguuuuugaaagauucaucauguaauugugaugauguaaugggcgaggaaggggaucaaagcuggaauugugggaccuguggcgacuguuggauucugguaguuuggacaaagguggugacucagguggaggugacaagaagugaggacaugaaggacugacagaacuagccacccuuugaaugggggcugaaguuagaugucaugguuuugacccaggucacuuggugacccuccccccaucacugacugagaugaaggagagcaugcuguugggagaaaacuguaaacauacuuuaguauuuugaaaugauuucuguguccaggcagcaauguugguggugugguaagagcaguagauccuucagaugugggucaucuggcagguauuugagccaggcaaaggacagccagggaugacuccuggaacaggacaguaggaucagguguaaauuugggagcacuucuguauuauuauuauuauuauuauuauuauuauuauuauuauuauuauuauuuugaauuuuguuuauugaauguacacgauaugugugguugcaugugucauggugcacauguagagaucagaggacacuggaguugguucucaccuucuacccuuuaaauucaggucuccaggcuuguauggcaggggccuuccuaccggaaccaccucugcauuuagaaucagaaggguggugggguguuuccaggaugcauuugaggcagcaggaaaccagguaucucuggccaggaauccaaaguaaagggggaugaagggcuuuauugaggcugugguucugagaucagggaagccuaggacauggcguucugaucugguaacaggcaaagucagcugucagguaugguuuugcuguggugaagggcagguacccagauauaacaguguuagcaagaggagacaaaggacaggggugguucaggaguuuuucucuaagcuacagagaugggaagguagcugagggagagccaggaacuagaaaagauccuuguaagucaguggauguuuguagcugcaggaaguggucuaggacugggaaagaagagggauguagaugggaggagguacuugcagacauaagccuuaagaaggggagagagaccuugggaaugguacagagggcugaacuguuuuuugagacagggucucauucacuuuguagcccuggcuggccugggaacuugcuguguaaacuagguuggccuugaacuuacagagcuccuccuaucuuugacucuugagugcugggauuaaaggcuugcacuaccaugucugacagaaccauguuuauucuauauauaagggacagaaaucacuguucuguauguucaucacaaguuugagaucuaucagccccauggggugaaggaagugucucacuucuucucugcuuccucagguaccaugcuaugcauuugaugacaaguuacagaagcaugauuuaaacccacugaucaagcuaaaugguggcuaucugguagaugauucugauccugacacgucucuguucaucaacguguguagagacauagguaagaguugguuuaggaagaagggugggguguggucagugccugcccugaccccuuugacaugcacauccucauuagaucucugagaacgcuauuguccugaaaguguucucuggagagcuucguuugucucccucagcaaaucugauccuuuccuuccaccaaauacaaauucuacucaagcuauugauggagguuuucucugccagauuaucugaaaaccuucuguuugacauuuccucuaccagacacucugggauuuggggcuccauggugagcuuuguuucaauuugcuguguuuacccaaaccuucuggcuuuaaguuggagaguggguaaaagggcugagggaugacaaagacucuaagagugugguuguggugugugcuuggggugggauaaccccucugguguucuccguagaacuaugcgagaggccagcauaucucucuuugauagacagaggcuguaaaugaaggucucuaucuuagaagagggguacaguuuuacuauguauuuauuuauuaccugcuaaccucacuaguuuuugugcuucccuuguggguucaauacugggagcccuguagaucaggacugcucuuucugcuguguuagcugugaucacgccauaaagaaauuauacugccaaguaaggaaauuuuaaaaagaaagaaguaaagagggcauacauuucuuauguuucaaucuuacuuucucucucuguauauaugagauguugggcuuaggaaaaauuugcaggaguauaagccaguucaguauaugauacuuagugggugguaggaauagggccgauuuauaguucuuuauauuguauacauacacauuccaucuuacuuguauauucuaauuaauagcuaaaaaaauaauaauuacacucuacccagaacugccagugacaagugguaauuucagguuucucaugcaggguuacagcaacuuaaguuugguuauaaacuucugcaacagugcacuguuucaauuuggaaaacacugagauuucuaguccuuaaauuugauuaggaaaauacauuucuguuccuuaaaagcaaauccuucggaggcuuauuuuaauucuuauuuuagaccccuccuccccaauuuucuggcaguuugggagaaaucagccuuuauggucuuuaaggaggguuguguguccccacugcgcauucuucagccccaggaaacugcucagaggcccaagcuaacuuugaaggugcuccugcugccauguauucacgucugacccgugacugguauuuccugucuugagggggugguacuugccucuccuccuccucugggguccaggcagucucucugcuauuaagguccgugggugcaguagccucgagugaccauugcuguguguggaagcaggcggcuagaucugaguuuucggaggcuggcaggaggcacgguaccguuccuacuguggcugagguggauuuugaguccuggggaugugcagugguguuuaagacucuggccugaugccacuuuagugguucagucguacagccuuaauuguucucaaguuuccuggagcuuugggcugggaggagcaagcaucuggagcgggagugaagugucuggugggggaggcagagauggggaagggagggagggaggaagucauccuguaggaugucagcagcccagaccuaucugugguuucuuuccauugacauaggaguguuuuaacccgucccuagaaugccucauuuucuagugucucaaacucaaagggauagugcuaaaguuagacuuuagggccgacggggacauuucuuaaacacaggugacaaaggaaugucugucaacugggccucuuaugugccagggcagagagguaccugguaaccugcguguuacauggaaaggugguggucucauccagagugagccucagaacgugaagguggagaucgugaagucugucuauggaagagacuggacccgagaauuccuggggugcugcuucugugacgugugcuuuaaaaucaucugugacguuuugcagacucccuucgggaccccagcacacagcugagagucuguccugcuggcacugcugccugucugcugaaggggaaccaggcauuugacguuggccgacccaaggaggggcugaagcuguugagcaaggacagguuagucugugaccaccaugguggcucauuuuagguccucaacaagagaaccugccuuauagccagacuaauagagaagagaagggagugugagcuugguaauggguggcuggcaugaucaaagaaggcagugugugugugugugugugugugugugugugugaaaaugccauugugagacccauuguuuuguacaauuaauaacugguaaauuaauacugguaaauacaacuaauacugagaaaagauacaagaaagaaagacuuugacuucuugggaggaaagcauguuccauuuccaacaggcguauuggucauugucuggucuuaggcugguguccuguugcucacuuacuucacuuauuggaguuuggucccugcucgugguuuucauugugugucacuugccggguuaucuguaaccuuucuuuuagagugauagguggggcagugugcugguggccuuccagcaaugugguuucuuucuaguuggggcaugugggcaccaucgcauaccacuuuuuaauauauguaaguuccugugucacccaugggccucaaugucaagagccuguuccccucucccguccccaaaucccgaccuauuguuccuguauagacuaaaacuuuuuuuuuuaaacuaaauuuauucaauccaauaucagcucuuccucuucucccaguauccacacaugucuucccccauuuccccuuugcccuuucuuuugagaaggggaagucuucuucuggguguuacccccagcccucccccuucgcccccaauccugcauaucaaguugcugaggggcuagguucauccucucccauugaggccaggcaaggcugucccuuuaggggcauggcauucacagucaggcaagcaacaggcuuagggacagcuccugcaacaguuguuuggagaaccugcacgaagaccaagcugcucaucugcuacauaugugcagggggcguagguccagccuguguucgcucuuuuguuggcgauucagucucuaaggguccagguuaguugacucugcuguucuuccuguggagucucuguccccuuuggguuccucaaaccuuccccuaacucuuccguaagacccccugaccuccuucuaagguuuggguaugaguuucuguaucucuucucauuggcugcuagguggagccuaucagaggacaguuauguuagguuccugucuuugcaggcugucccaggugccucugauugccuugugaugguuguaggaaaugaugcaguacuagauugcagacuugugcggacuguugaagcagggccugaauuggaaaaugcugggaguuuucugugucuguauuaaugugcucacaaugccauaagcaaauacuacaggguugggccuuugaacaauaguaguuuauuuccucagcugcaauuucagagacuaagaccugguaccagacagguugguuuccucuuguuuuguuaguggccaucuucucccuaugucuacacagucuucucuggucuguguucucaucuucucaagaacaauagaacuggcucgugagggucccauuuguuaaccucuuuaaugugccugugguccaguaguuucuguugaagcauguuugucaaggcugcaccauugaaguugagagagauugacgagagugacaaguugguaagagagggccccaggugaugccgaggguucagggaaacguaggaugccaggcuuagcaugacuugucucuugucagcacacauguggugguauaugggagguaggugugcaucccgugggugaagcagaagcuaaugacuaguauucgugcuuccugguagggacaugaguugggcuuugggggcagcaauucuagcuuguagcuguuguaucugccaucuugaucagucagccacagguugcucuuuuguuuguacguagauguuagagggagaucaugggaccucgugggcacaguuguauuaugucuacucagcuaugucggucuuguuuuauuaggucucuuacaaaacuguuccuuuaugaagacagcucccuuugguauucuuaguuugcauacugaucauguucauuugacuuucuacaggaagauacacugaaguuuauacuauguucuuguuaauacguggaaauauaguuguaguuguauuguuucuucugcuaccccacccauccuaucuaccccugaggugcacugacuagggcagugcaucaauuggaaaguaaccuacaaguauguaauauaacuucuccacauggcuuuucugcaggcucguucugacuuaugugaaggaagagggagaaaagccagacuucuguaauggucacagcccugcagugacaguaacauuugugugcccaucugagcggagagagguaaguggcuuguuccuaagugacuuuaaaguuagugauccucagccacauuugcccaagugacgugucccuauguaugaguguaguuugcguguguagguaguacaugaagaucagagaaaaccuagggugucauuccucagguucccauaaccaguuaugccagcugauuugcucagugagccucagggaucugccugccugugccuuccccguguugggacuccagcugcguaccacagugucuaugcuuccccuauguauggcuuuguaaaaaguacggguucuggagaucaaaauugaauggcaguaacauugaaugcuaagcuaucuucccagcuugggauuccuguagggagaaaauaaguccggucucccauuuuguuuccugucugccauuccucucacucacagcuauaggcagauugaccucuuagcugcuuuaauuuucauuucauuuauuuaugugcuugcaguugagguugagagccaugccuugggcgugccagcagcuucuuugcuggagaguuguuuuuaagucuuggagagagguagacagucaggugucucuuuugaaugcauaguugauuguccauacauaauaaaggggguggggauaacucauguggaauaaaucuaacaaccuaacagcccaccucuuaagugaugccaccaauauccagaggcagaguucacuuagggacacuugcuagagguaguggcaucaggcagguuauaagucugaugucccaaugcgcagucaacccccauguccacauccaguguuggggaggucauugaugggaugcuggcuccacugcagaugucccuugagagugacgaggcuaacugguaacagccucaguugugcuuagccaggucagccugcaugcuggacacucaacacccacaagggucagagccaggccauuggcagggcaucugcugggagacacggucaccuaaagggucucuuguuagagucaaagcaugguuccuggagccuggauuuuucuugcagccccucugguccaugcucaugaguguuaugggucaccugaucgcagggcacugcugguuacacuugaggcaugcacaucagcacaucuugaugucaggacagagcagaagggccuccauucuaagucuuucuuuugaccuaaguguucacuacaccuugcaaugucaugagucauuccaguugucuucacuugugccugccaggcucguuugcuaaucaagugagaaaagggagggcucuuuuuguuuguuuguuuuggugugugugugcccuuuuguaguagaaauaaagagguuugaauucuuuugucacugaccuguugguaccuguguggaggucauugaacaccuugccguugagcaccccgucugguuuuccuaucucugucagcuugauggauacugucagauggucgagauguaugugacaugaggggcucauguguacucugcaguuggaucuguagacauggacucucuuccuggugagcugcucugguuucuaccaggaugauuaaguaccagcagucugcuugucuccugcauccucagagagcuccaaagcauuucuuggugcuguuugugggccuugagguucuuagcagcuauuggacagaaugugugcuuguguugacucugcuugccuaccauagcccuuggggaguuuguacauuuuuuuuguuguuguugacuuguugaaugcuuuagcagcugguauuuuuuuauuagauauuuucuucauuuacauuucaaaugcuauccugaaaguccccuauacagcaccccaccccugcccugcuccccaaccuacccacuccugcuuccuggcccugacauuccccuguacuggggcauauuaucuuugcaagaccaagggccucuccucauaugcauacauaugcaacuagauacacaagcucuggggguacugguuagcucauauuguugcuacuccuauaggguugcagaucccuucagcuccuugggugcuuucucuagauccuucacugggggcccuguguuccauccuauagaugacugugagcauccacuucuguaugugccaggcacugucauagccucacaagagacagcuauaucaggguccugucagcaaaaucuugcuggcauaugcaauagugucuggguuuggugguuguuuaugggauggauccccaggugguacagucucuggaugguccuuccuucugucucagcucugaacuuugucucuguaacuccuuccauggguauuuuguuccccauuuuaagaaggaaugaaguauccacacagcagcugguauuuaauaaauauuuuucuuguuauauucuuuuugcaacagauaauugaauuuuuacauauuguaaaauucaaaaauucaccuguucuggguccuagcauuuuuuuucccuuaauuuguauccuuuaccacaauuuaauuuuagaaaauuuccaucucuccccucccuuaggaaugcucuugccuguuagcaaucaauuauucucuccucuucuucucacaacauacacacuugagucugcuuucuggcugugaaugaagcuguguuguaugugggucucugguguugaccucuccacucagcucugcaguuccuuggcagcucuaccgagacucaugcugggaagaagcaucaaacuuuaguuaagcaggggaggguugggccugcacuucugccagcuaauugugugaucuaauaugaaccauggcuggccucuagcaggugcuuaggaaauacugagggaauuuaggugccuagaagcaguacugcuuccugguccucagcccauggcuuaguuucuccaaggguuaaaaaggagacacugacuugugugggaaaccugcuggcuuccucuguaguucccaccaaagauugaagaacaagauggcauaugcugaacuggagaagucuucgcuccaucuggagcagcuucuuaacagaauuguuaaaguuacccuuguuugugugcacaugcauguguaaggguguguguacaugugguaccuggacaggacagcuugguucucuccuaccauggguguccuggagauggaacucagaucaucugccaagaguagcagcagggaccuuuaccugcugaaugaaccaucucaccugcuacagaagaacucuugugugugugcauguuauguguguguguuguaugugcacagugcauguguauacgguagccagaggacccugaguguucuuccgucgcuuucuacccugcuauuucaagaaagggucucucucucacugggaccugaggcuugucagauucacccagguuagccagccauugagccucaguacuguguguccaggguguguacuaucacaugugguuuguuaccuggguuuggguauucaacucggguuuucuuguuuuuguuuuguuuucuguuucucuuucuuuguucucuauaucucaagugguuagaaugcucaucuaaccuuguaaauagacuccuccucccccacccccaaauuggguuuucauacagcaaacacuuuacugucugagcuaucucccuagcccgcauuuuguucuuuuuuuuucgagacaggguuucucuguauagcccuggcuguccuggaacucacucuguagaccaggcuggucucgaacucagaaauccaccugcgucugccucccaagugcugggauuaaaggauuaaaugugugugccaccaccgccuggcccccacauuuguucuuuugagagugucuugcuuuguaggucagcucaggcuuaccucagacuuacagaguuagguuucuagugcuggcaaaaugaguauguauguccauacugggcucagagaggacaggguuuggagccacccauaaugcuugccaggguggcaaugauucuccacugacacaguucagaguggacuugguaagggaagcugguguuacucaaggugaucagaaacgguguaggcuuauaacuaagugcaguuacaaguucaauggaaggaaaaagguuaacgaaaguuuuagauuauggugagauggcccagccaacaaacugcuuucugugcaugaguuugaaccccagucaccaugucugcaucuucagugcugggaauaggguguguuaggaaacuggaggauccuugggucucauugaccagcuaguguagcagaaacagcauucuccaggcucagugugauauucugccugcaaaaaaaucuacacacacacacacacacacacacacacacacacacauaaacacacaaaaaaacccaaacaaacaaaaaaucaaggugagaaauaugagaggaagacaucccagguugacccauagcucauucacaugggugagugcacacacacacacacacacacacacacacacacacacacucccccaccuccugcucucaaacagcacacauaugcacacccaugcaguuaaacgcagaauucuaacagccugucuuugggcuuuccaggaauaugggaaguauggaugaauuguaucuaaaucucugccuccuuucacaucgaucccuauaggguaccauuccuaaacucacugccaaguccaacugccguuaugaaguugaguggaucaccgaguaugccugccacagagauuaccugcaaagugagagcugcucccucagcagugagcagcaugauauuacuauugaccuuagucccuuggcccaauauggagguaggugugugggccccucuguucucucccaugcuuuauagaggagccuagcugggagaggggagagaugggcuuggguuugccuaaaacaccacacuuucuggguuuuguuuguuuguuuguuugagacaggguuucucuguauagcccuggcuguccuggaacucacuguauagaccaggcuggccucgaacucagaaauccaccugucucugucucccuagugcugggauuaaaggcgugcgccaccacgcccggcuagaacaccacacuuucugauggugaacaaacacugcugcuuugugcuuuuucuagggucccccuauguuucugauggaagagaauauacguuuuuuaucaaugucuguggggacacaaaggucucacucuguaauaacaaagaggcugcuguuugucaagagaaaaaggcggauuccacucaagucaaaauagcaggaagacaccagaaccagacacuccggugggugagagucaagugguuguguggacuugugagccauggcucugcccuucuuuuccucuucccauuugcccugagcacaagaaagucagagccuagcacggcuuccugugcacuuuggcaaguugccauuugucccugagcaguuggacggucuccugacuuugauaagugcacaucugcuaggacuauggguuuguaaauguauuguuucugggagcauauuguagagaauuuagguaguuuacaguuuauguggcuauuguuuuuguccccccucuucugugccccccccuuuggcaauuugggaaucugaaauacuauuagaauuaugcacaaguuuaaaaagcuaaaacccuacuguaauucuuagaaccuuaagcugcuaguuggcuucacaaaacuaggaacaagagacaguuuucugaaauugagucuuagaccaaaucuuguagauggugguuuuggacguugcuagccaggcugucugacuggcauuauuuauguuguauaaagucccagagugacagcaagagcagcucugcuugccagcagaguggcugccuucccuccaggccguuacuuuacagcaaggccagcagccugagcauuuggaacucauuuccgcagggugcugcccagcuggcuacggagccugcuguuuuaugucaguagugauuugugggugguaugcaaaaggcuuaacaaagcaguuuuuuaaacuucaaauuuuuucuugguucuauaaaacacuguauguucacaaccuagguacucagauggagaccucacccucaucuauucuggaggugaugaguguagcucuggcuuccagaggaugagugucauaaacuuugagugcaacaaaacugcaggugagugugugugugugugugagugugugcugcccaccccugcuuugugugugugugcacugcccaccccugcuuuguguuaguggcuuguguguguacccaggugucuuccuggaaguggggugcugaguagggagugaguuggcugccuuugggccuggccaccuucaguccucaggguuuucuguugcaguaauccucucccuucucuuccccuccaggaugcauacauacauccuguuuccaucuuucucugcucuccauguuuguuuugggaaucugcccagcccuggguuugcugggagagucugugucuuggacucugcuucaggcacacucagcagaggagggaggcccgguggaggcggcuuuggcuucaaccagcagcuucaaguguguccaccuucucauuuaacaaucuuuucagagugauggagugguagaguuugaauuuggaaaucuugggauguuacuggaagaguccaagcugaggucaugccuuccuuugggugacuagaagcaccccugagucacuggcuugucuacuuuucauguccugauauuagguauuccuggcaccuguagagggaugauaaaguuagagaucugucuuguuuaagcuccuuuggcucugucucaggcaccccuggcugacuugcuucugcacuaggcucucauccuguggcugggccugguuuccauuuucauuuguaugcaauuggcccaagcucucauugccuguugcccuugaguguguuuguuuuguauguuucuauggucaaccuuggacgauuugaucaugguccaguuccugugugauucauaguaggaucuggaagcaaccacugugccuagaguuaaguucucacaaacuugcuaguuuuuaagcagaggguagguuaggagcuggacuagggggcucugaaccacaagacucagaggacccugagggcuguggcuuacuggggccuucuuuuuccauugacucuuucuuaucacuuacagagcuugcaugcuuucaugccuguuugcuaaggcacucuccacaggguccugauggugacagauggcucccugggaguucacaggcuagaaacagagauaaggguuuuuauggcugagcacaggguauagugcuaaggcagaaacacugacugcagaguuuuguuaucuggaguucuaggucauucaggucagugugguuguggacagggggagcugguacugggguagccaagggacagauggccagaggagauguugcuuuagcugcccgauggugaagcgcguguacuguagggaagcucacucccaucuuccguagggugaagccaucucuguauggcuguaaugugccccuggcugagugagaaaauagacuuuuuguugggugccucuccacacccacauccaguuuccuucugcucacuucuuuggaaugggccuuaggcgacuugcuuggaauucuggauccuguucugucccugggccacaaagccugcuguugcuucuguguccucagccagcggacaccaggcugggugcuagcuucucugaucuggucucucuugcugcuugagucacugucaggugcugugacuccccaagucuuuucugccucaacuuugcuuccuguagucuugcucagggcuuuuacuaaagcuugagcugagggcucguuuugggacgcugggaagguggauugauaaaccaggagaggacaggucagaggauagaagauugauagacuuauuuauuguugagaccaugacaacguggaacuaaaguccacugaguuaagauuggaauuuaaugcaaaagccuuuuguuuuucaucuuaacuuuuuauuacaaaaguuuucagauaugcaaguaggaagaacauuauaaugaaguuuauacaguugucucuauaaccgugguucucaaccugugugucaugacccuuucacaagcgucacacaucaguacccugcagagcagauauuuacauuacagucauaacagcagcaaaauuacaguuacaaaguagcaacggaauaauuuuaugguuggggucagaacaugaggaacuguauuaaggaguaacagcauuaggaagguugagaaccauggcucuaaaacaaucauuaauguuuuuccacauuuguuuugcuuuaacuguuacugucuggcucauauuccacuugggaugaguuugcuuuuggucguccaauccuagugauuuaguucaagacuuuauagaaauuacacuugagaacucauuugcuuuuggcuauaaaaccuaauuuccccuuuccuuagaacaugaaacugcucagacacaccucaaagauacaggcagacacaugggaggugcagccggccgggauuaugaaaccaccaacgguggaaaaaagggcagcuuugugccaguggccgccgcugggaaaggccgagggauaggguuuccagagggagggcaguucuuugcccaauccuaggccagggagaaguggccugcgaggagcagagccaucgugcuguucuggguagugcauggggccucuguggguggaggaggaugugguguugacucuaguagggccuuacagacacauacacugaaagguguuggugcagccagcauugggaaugugccccuacccuuguggaggaaugugagguccugccuuccucuagcugaacaaggaacugcucugugcuuuugccucuguuugccuuucuggauagguguuggagagacaucaggucuugcucacucacuagucuguguucuuggaacuuggguuccggggccuguacucuucucuuuguacucuggugaguucuuugccaugugacugcagccuggagcagccaaacaucgacugugguccauggcccucauuaauucucucuccaccuccucccugagauacggaguaccacugcacuaagauggucucuggacagcuaggugauuccugggugugggucaugucaccaaauugugugcuuuccuguggcuuugcaugucuagguaaggaugggagaggagagccuguguucacaggugagguggacugcaccuacuucuucacaugggacacuaaauacgccugcaucaaagagaaggaagaccuccucugcggggccaucaauggcaagaaacgcuaugaccugucuguguuggcucgucacucagguauugcuugccuuuccgaggacagcagucaccguguucacaggagaugaccccaaugguuuggggaaacauuuuuuaauugccaguugagucaugacccccauucccgucuagccacaguacaaaauauaaggaacacuaguuaggaggugaacuacuugcaucugaaccucacuuuuucuaguugaguugucuuggcucaccuuacugguucaguuagaauguccaggaccugcuaugacagguauugugcacugugcuuagagacaguuucuccagcaacuuuuuuggguagugacugaggagguugguggagcuucuguccuuucauauggcugccucuuuacugccacugaaagcgggucagcaugccucugaucuauaguccugggaggguuguccagcauggaugacauggugaaucagugugucagugacaagguucauugcagaaacuggcagagccuguguuauguugaaggugcuggguaacugacuaccacugagagcccacaugcuacaccucagaaaugaguggcaucuugccgaaaaucaaugagguagaugagaguaggcuuauaggagccuuacauccccuaagacagagugacuugcaucaguaccaguuguaacugucuguucuauugucuuuggaggcuuaucugaaaaguacuguuggaggaauaucuccuguauguccgguuuaagaucaggguccacaguaaaugauuuguguuagcugauugcuuuaacaguaagacaucuuuaugguuuacgaguuaagcauccuggaaacuguagaaacacaggaaauuucuguaggaguuaaaauagcuucaggaagcugggacugaaucuuguguaugugugcuaaugaaagguuggguuucuacaauguggaagacguucuaaucucugaacuagaacucugccaagacauguguagcucuagccaauguggacuuuagaaagcucucuagucccuagaaaagagcaggaccauggugggaggacucuagugagcaccgcuccucccuucagcucauguguguagcugaguuguacacagcaacacagcauuuucuguuuuuugauuuuguuguguuuuguuuuuaaaguaaaagggggugcauuacuuccaguuuaagaagggauauagucuaucacagcgaggaaggccuggcaauaaggagugcaaauggcugaucacauugcaacucccauuaggaagcagagagagaaacacuuuuuguuuuuuaaguuuuaagugucuguguuacaagacauaaacugggaucuugagaggugauacagaggcacauuaaugcccuuagcagacuaugcuauagucuggcuuuugaggaaucuggaguguuucuguagcauuugcauccagagagcccagaagaugcugugagcugaauguuccgaaagucccacccuggagauugcagcacacacccccuccagccaaugcccagugcuuuuggggaaacuugggcacacaugcugucucucagagugugucugcaggcucuguguggacuugagaaccuagcucuccaaaaacauuggcaagcugugggauuuuacuucugguuaccaacuucccaaaggaucauuucagacaagaaugugugccagcucuggguguccuucagggcagugucugaagugauaggcacauucucaugacuacucuuuucuuugccugauagauacccuuaauacccaguggugguucccuugacacaaacacacacacacacacacacacacacacacucacacacacucacucacuccacccacucacucucuacccauuaggauccauccuuaccuucugugagccagaccuuccacccugcucccagucauccuguguagaagagguagacacucucuuagcugcacaggcccuugugggaucugaagcuuagcaugugaccugugccccuucacuaggcucaggacagcaacugacuuucucauguaguucagaaaacauuguggggaauggucuguuccugacacagucagugaggaaguggagacgccaugacugucuguggaguacuagagauugucugaccuuggcuuagucgcuguuuuaagauaggacugcaagaaaauguuacugccuuuggcuuaaaggacuuuggguuugauugcagaaucagaacagaauugggaagcaguggauggcagccaggcagaaucagaaaaguauuucuucaucaacgucugucaccgggugcugcaggaggggaaggccaggaacuguccugaagaugcugcugugugcgcugugggugagugacgucaguagggacccucucucuaaggugugcagauucccacugcuucccugggggagacauaaaaugugguuugcuuaugucuccugccuugcauaaauacuaaggacgauaaagcguuuuaaaguuucagugucaaagccacugaaguccugauacuggcagaggcguuacuaggcagaaagaaccauguuggaaaaugcuccacgaucuaucuucauuuuguagacauuugaagaauaauaauacugucaguacuaguaaaacuaacuuugaguuuuccacagccccuggucagacacuuaggggaagcaggauaccugcuggugcauucaguggagcagcauguccgaguguuguucuugcugucauuguuggucuuguaugucacauagagguguucgucuuagagacacugagguucgguguguggugugaugccaggaggaggguaaggagaaucuguuacaaauauggacgagagauuagugaggcuugguuggauuuuggggauuacccuggcauucagaacuagagacgcaucucagagugacugaggucuguuuuugucuuacuaagggcucaggcauagacaucuucagaauucaguguggggugccacaguggggugagugccacacaggugugaguuucugcuuggucaugaguaaagcuugugacuugggccgugcuccucagcugcccacguuuaagggcagcugaggcucuagaugcggaauagugucuuuuacagauaaugauggugcccacacaacccuguccuucagaugccuuugggggaaucccauguaucauuuucagcauggcaggagguggccucgaugugauugauaaauuuuuucuuuuaagaaaauugguuuccaucacagucagguuaggugggcugaaagaagguccuggugacccgcuggcauucggcugagucuugguauacuuucaaauguuuacaugaugagaauuuucuacuccaccuucuuuuuuuucccccagauaagaaugggaguaaaaaccuuggaaaauuugucucuucuccuacaaaagagaaaggacacauacagcucucuuacacugauggugaugacuguggcagugauaagaaaauaucaacuaacaucacacuugugugcaaaccagguaaugucacagaagaagagacauacccacauuuuccaucauuucuguaguagagcugggagcaagggcggugcugagcacugcuaguacuagucucuggugaugggaaucaagucguuuggauuucagccuagaaauggagaaaccauaugcucuccacagagaguugugcugacacacuccaaaggagucgugagucucugcaugacauccuguucauaaggacugucagaagaucagggguguggagugcugaguuuccuccacggggggaucauaaacggcuuagaaauauuuucuugauugcagcaucucacccguggcugucccuccccucuugaguuucugcauuugugcguguauuucaguguucccaggaugcuguguuccacacuccacaguucuguuuaugauuucuagggauuuccuuguugacauggcauaguuuuacuauuuuaaagcauuuuacugcugggaauuuagauguuccauauccucucuacacccaccccguaaaguuuccuuuguauaaauucgcagcugugggaaaaggacacaagcuaggaauguuuuguuucuuguuuuauugugguagacuauauauagcacaaaacuuauagauguuacugucuuaacugguuucagauagguagcugagugcuguugggcguuuguggcuguuacugcuguucauccagagagcuuucucaucucuccacacuuaaaccugccaucuuggaaauaauaguacucccagaguucuguccccugcaucugacaccuaccuauuugccugucuguggaguugcccacucuaggcaacuccuaucaacaaagccacaugguauugugggagacuccuuuccuauccacaaagccacacaguauuguaggagacuccuuucccuguggcccccuuucuugagacaagauuccacagagcugaggcuggccuugaauuucuguguccccauuuccaccuucugaagcacuggcauuguagauaggcaggcccugcauaucuguguuagacagugcuggggauggagcauguggcugugcuggcgaagcacucugcuguaugagccagcuguaucuccagcucuguacggccguucuuuaaaccaccucuuuccuaggacuuuuaacagggaaaaagguguuagaaucggcaaauaaguguuugaguguuuuucuccuccccccccgcccccccccgguccuccuuucccuguugacaggugaucuagaaagugcuccagugcuaagagcugcaagaucugauggcugcuucuaugaguuugaguggcauacggcugcugccuguguacugucgaagacagaaggagagaacugcacgguccuugaugcccaggcaggucugugccuaagcagugccucuguugucuggugugcaugacuuagcauggcuguuaggaguaaccugaugcagaacuuuguucaugccacuggacagagccccaagcgucuucuugcugugugcuugagcugcggcggcagugcccaucuugaauuuguggcucugcuggauuuacugguuccagcacaggaggauucccccccuacagucauucaaaaggcuuuuagaugcggccucggacagacccccuccauaguggaguuuacaagaaggccaucauagugugguugcuuggcuaugccacauuugugagaccuggagcuacagguuugaacaggguuguagggcucacacaguggaaaagggcaacggcgaggaccuguguccagguaggagauagucacugcaggaaugguagcuuaaaggcaaagugaccuuucuccuucagcgcuguuuugcucuggcaguaguuucugucugagaagcuugcgugguccgcuguccccugugccaugacuggccugacauaccuguguuguguuuauguuacucaggguuuuccuuugauuugucacuccucacgaagaagaauggugcauauaaaguugagacagagaaguaugacuucuacauaaauguuuguggcccuguauccauggauccuugucagucaaacucgggggccugccagguagcgaaaaggcaaguaaccugauucuggguuugcucuuugggauugugggcuagcaaauguuucguacagagguaguuagguuucucuuggacaccauugcuugacaggcaucuaacuacugagaagaccuggucagaagaaucgcaggaccccagagaaggggccaagccuuauccuuaggcugagagaggccugggcuuauugaugcucaccugggaacuugagcuuuacuguuguugcauacuuauguauguaguucuccuuacuguauagaauagguuuaguuguaaugaauugagcugcacuacaggccaggaguacugagagaaaguugugugugugugugugugugugugugugugugugugacuuuucucuuuccacagccaaaagagccacauaugagauucccagggacugcagugucuuggucuggccuugcuuuugccccuauuuguguagccuuagagaacagaacuccugccccauggcacucacucccagagugacauuucuguguucauuuuagugguaagucuuggaacuuggggcugaguaguacuaagcucaccuacuacgacggaaugauccagcugagcuacaggaacggcacucccuauaacaaugaaaagcacacaccgagagccacacugauuaccuuccucugugaccgugacgcuggagugggcuucccagaauaucaggugggaauuaucuugggaaauuuuccuggccauaccugagccaguugcccacccuuucuguaggaacagagcuauuauuagucugguuuucuugccaaacuaucacauaaccauuccuuuuugcaguuuucaggguaccuaggcaguauguaguuacugguuaagcuguuuauucagaggcccauuuaucuuaaugcuaguccacagcucuguugguuguauuagaaaacaugcagaagcgauuucccuucccccaggccaggcuccauccuagugcuguuguuaagcuaaggccaguuuugcugugggucuuuggggauguuacagauguagguuguuugugcuauccuuuccugucuccuucuugucuugggauuaggaagaggacaacucuaccuacaacuuccggugguacaccaguuaugccugcccagaagaaccccuggagugcauggugacagaccccuccaugauggaacaguaugaccucuccaggugagcacuuguuuuagccgauggcaguagguuugugguggccccagggugcaggguguggucugaucucaccagucugugguaucaauugaucuuugucauagcaaacacucauuguuuaaaauacuaacucaguguaaggugaagguguuggcagggcccucugcauguggagcuucagacuguccaaauguuaugacauguccugugagucauucaccacauaguuugauucauuauccauugauagugucuucauuucucuagugacuaaacaugaacugcugacuuuagcuaguucaccuuuguaaaagcauacuuuugugugaaaacuagucuagugaagucugaagguggcucuggaggaaacugguaugcuauggaaaacucccgggaacauguuacacggaggaaauacuaccucaaugugugucggccucugaauccugugccaggcugcgaucgauaugcaucugcuugccagaugaaauaugaaaaucaugagguaugugugucuuucucauguuuucucucgacucugaggccuggugugugaaggcauagugaucuggaauucuugaucagaacaggccugcugccugcccaggugcagucucugaggaugugccuccuucacagaaacacaucacuugaaucuguucagacgggcacuggccaugguugauccaguacuuugcagggaaagcucuuagugguuaugcuggccugaauucaggugccugcgggauucugcagacauccauagcucagagccuccggugcccuggagucagucgcaugugagaguguugcuccaagugacccagaugcacgugguaaugccacucugggcgcugagugcuuuaucaucuacuggcagagcguucacaucuuuccugugguccuuauauguggugggcuuuggaaguugcacacagaccccagaaguugacuucugcaaaaacaacgugagcaauugcuuuuguugcauaugcuaguggugcccucuggugccucagaggcauuugaggcuguauguguaugaguguguguucucuaucacaacagcagcuucgggguucagccagcccccacucagggcuucccccccacucaaggcuucugcauuuuguuugccugcuuacacaguucuuagcuguggcuucauuggcaauaacuacuguaaguagcaaguugacuuccugaggaaggaagccaaauccacacucuguugcagggcuccuuggcagagacuguauccaucaguaacuugggaguugcaaagauaggcccugugguggaggagaguggcagccuccucuuagaguaugugaacggcucugcuugcaccaccagugauggccagcucaccaccuacagcaccaggauccaucuugucuguggucgaggauuuaugguaagugcugcacaggagaguggcaaggacuucagaaaagcaccagggccaguguguacgauucuauacuuuguuuuaaguugcagcaaagucucuagggcucgaaauuggucauuuuaggcauuaccgaguuaccaagaacauugccuuuaucaugaguguugucccaccaaaauccauguugagaacuuugugugggggucauuuuuuguuugagauuugcgucucacuguguggcccugucuagccuggaacuugcuauguagaccaaacuggccuugaacuuguguagcucugccucuugagugcuauggcaccuaccucauaucuagagcuguuauuuccccaauccaaccuaguuccugcugccaccuuuuuccucuuccucguguauguguguguguguguguguguguguguguguguguguguguguauguuuugggggacaagauuucaggcuggccugaaacucacuauguaaaccucagacucagagcagggauuaaacguuugugccacuguucuuuguagacuccuggauucuccugagcucagugcaguggaugugagaccugguguccaggcacccugcagacaugaaauucauuuuguccuucucugagguuacgaaaugacugaggacagugucuauccauggguggcagacaugcucccuuaccuacacgauccugggcugcuggguguuuguuuguuaguucauuuuguuuugucuuuuccugcuuuggggaagagugcugcccccuuagguuggucucauuucauagccuggcagcugccuccuaggugugaggagcccugccaucgaccauucuuugcuuuuccuuuuuugcugucauuuagaaaaugcauuuaguuccagaaaauucuuuacaacacuucuuaguuuuccaaguauuuucugacaguggcugagcugguuuugccuaugggcuugguguacaguguggguccugguaugacucuugguggagaggagaggaggccagguucacagaguguaccacaggcuagagccugggucuuucuuauccuuagggagccaggguccuuggguugaugagcagagugggugggacauacagguagaaacucugggcugugggcugagaccgggugaauaaugccaguaaagucuuggugugcuguccaguuagcuaacugagccacugcugucuaugauggagacagcacucguggaauggaaugaggcuuuuguggggagacuuuuuguugaacccccauguaucauaagacagcaguccucacaaauuagcacaucuguguaacugaaaccugagucacugacacacagccauuuuuuagaagauuuauuuauuuuuaugugcauugguguucugccugcaugucugugcaagguucagacucuaguuacagacaguugugagcugccuugugguugcugggaauugagcucaggaccucuggaagggcagccagugcucuuagcugcugagccagcucuccugucccacacaagucaguuuugccuuauuccagcugcugucuacaacuauguauaguaacuuucuggcugcuuugucagacucugguuguacaggcuuggauucaagcugagcuuuuccauguacugcuggcuugagcccagaugugcuaacuaaugucugugcauaugaugcccuguagggguaauaagaacagugugguauaggaaggaggugcauaucaggugcugacccauugaagacugccaguggauucuagccugccugacauacugaugcucaacugcuaugcugauguccugcugauuucucuaugcccugugaccuuucagaacucccaucccauauucacuuucaacugggaauguguggucaguuucuuguggaacacggaggcugccugcccuauccagacaaucacagaaacagaccagguauguguguugucacauugcccaugcgcacgccgguuuugaguugcuuccuagccuccuuucugacacaugugucaccaugcucugccuccucccuacuguggguaccuagaucuucaggaccacccauuucacuucuugcucaccacagcccccuucaacugucccuuuccaaugccaaugcauccuagugagcucuccauaacugccaggaucugauggauucacauugcugcauuccagaacauuccaguaucuggcacagugaugcuccugaaguccuuauccacaagauggagcccaguacuucaugugaugucacugacagaguaaagccaugugucugcugugaccacccuccugguggaaccuagugccucaugggauguuacaguuagcacccaggguagggcuuagugaucaugggacccgagccugggauaaagcccauguguccgcucugcccuuccuuagcuccagugugcagccaggcgccucaugcugaugaggucuggacggcagacuccuuauccucugcugaaggccaugcacuuuguuccuagcaucucuccacugcuggcugcucuugucugggcgcuucuccuggcugcauucucugcgguguagcagcauagcagcacacugcucuuugggcucuuugcuacgcuccugggccaggaaguuguuuuaugguacugugugugcccuucuuuauggaggaacauguuucccuccccauccuuuuaauuucuuaccagacuacagagucuggaagagaaaccuggccugauacacaugaugaugaucucagcucugggccaguaguaucuuaggcacccuguccuuggucagggccaugacugcuccccugaccuugguggacauuggaggcugacggcaaacuuagaggaagggagggacugucugugaguuaaccugguuauacucccauaggugcacucauagcaaugagagguaauucuucaguuuuauuuuuuaauguaaaaaucacuguuauucuagcuccaccuacccuucccuuuccccuuaggaauuagugguagccuuacucugcuuuguaguagcucagcacccaugggguguguuccauuccuccacacauacaucccacauugaugcaggcaagggacugcaugagcauacugcuguucucauagagauuuaaaaugagcggcaauggguuucugcagggucuucaugucuguuuugcucuuguagaauugguuugaaugcauuuccuuucuuguuccugauaggcuugcucaauaagggaccccagcaguggguuuguguuuaaucuuagcccacucaacgauucugcucaaggacauguggucuuaggcaucggaaagacuuuugugguaagugaagcaguaaauuucuaguuugcuuuaaacaaggcaagcugcauucaagucacgugggcuguggguuugggaaucaggcauccuuagugcugagagaaggacggcugcuucaccacaagaaaggaaauccagguuggggggguggguaaugagcuaacaucaucaccacaguccucaugcaguuagaugggcaguuuucccuccuuaccugcugcugugcaucuacagguuuccaagaggcagcagcauggugacaguuaggacccgagcuacauaaagaguccaccagaagcaacccagagaggcccugccucguguacuaaccaugcugucaggagccagcgugccgccgaggcucuugguugugggugacagaccaauguaauaauagcagaaauggagcugccuggaaggccgcccgagcuuguggcuugucugcugggccacaccgcccaccagccccucucuuagcaucacagcgagggcuagacuucugcuccuuacucucccuaucuccuacccuacuggguucagcugcccugcacauuugguggcuuuguuuucagucagacuccugcauacccuucucugcacgauuaaagacacaauaaagugauuuguuuugcuucuuaguguaugcuuuauaaucacguacaguaauuauaucuacagauagaaggcaguaaaauaagaguauaaaacacugugcauuuaaccuugaaauuuguguaguuguuauuuggauuuguguuuuugccuuucugacuuaggaccgagaugcccugaaguugauaaacugcuagugagaaccagauacuuagcccauuguugcuuuggguucuaggaauuuuuuuuuuuuuuuugacaggguuucucuguauagccuuggcuguccuggaacucacuuuguagaccaggcuggccucgaacucagaaauccgccugccucugccuccgugcgccaccaugcccggcgguucuaggaaucuugucugugguaagucuuggaaucuaaaugggccuguaaaauuuuuuuuuucccuguuuggcuuccaguucaauaucuguggugcaaugccugccuguggaacgguugcggggaagccagccuauggcugcgaggccgaaacucagauagaagauauuaaggaccuaaggccacaaaggccggucgggauggagaggagccuccaguugucugccgagggauuccucacucugaccuacaagggcucuucucccucugacagaggugagcugagggucacuuggacauaugcauaucucccgccccuucuuuuuacuugcaccucuagcucuucagagguggguguugauuguccuucucuaggugcuaaggaggggaugaguuuauuuauuuauuauuuauuuauaaguuuauucuuuuccuccuguuuuuuucuuuuuaaaaaauuggugauaugguuucuuauguaacaguuuggguauguuaagcuuguuaauacuuauuuuguuaguaagugaaaggccaauucugagcccuucaucgugucagcagcugugacaguggauagccccugcaggugacguguaccacgggugcuauauguguguugucuggugaauucccacgccagcucugugagucuucucuuuuucuuuugucccuuugagauaggcucuuacugugugguccuggcuuucuaggcugguuauguagaccagucugucaucaaacucagaggucuuccugccucugccuugcugggaucaaaggcuugggcaaccacaccuggcuuauacuucuccugugcucaguuaaugcugcacuguacaggugcagcacuggaaggcagaaagucuuauaccuaggacagagccugugcuucaugaggggcagcuucagagugagauccaggggguuuggauucuguucuagguucugccaccuguuuauucuguuuuacagauaaggaaauggaucccagggugagguuacuucacaguccacacuguugauaggcagcaaagugacccucugaccccagucagucccauugaacacugggguguuggugguuugugcgauggguugcacaccaugcucaagcugucugaggggcacaggaggggguggagucuuccaugcuacaugguuugcaccgacacugcagucuuacuuuuucuacuucacuucuccaguuagcagauacuggaauuauaacacuaucauaacuguauuccguagaauacaaaugaucauuaaggacugauguaaacaacuguaugccaacagccagacagagucauaccuucauaucauaucuucauaauaaaaucccccaaaauagaaauacagguaggucaugaccacaccauaugaaacagggaaaacugaaauaauuugcucuaaauucaaaaacaagacagaaugucaagaguuaauacuacucaguuacagaucucagaugugaauuugaggaaauccuaaaauauaggcaacaaaggaaaauucuuugaauuuauuacaucagacuuauacaaauuuuaugcaacaaagacacagucaagcgaggagaaucaaugggaugguagggaacacuacuuacaguuacuucugaauauagaaauaacucagcacaaaaacaucagucagagugaaaaugggcaagggucagaauaauaauacauuaaaugcuaaaauguguguguaugugucugucugucugucuuauuuauuuauuuauuuauuuauucauucauucauucauucauucauucauuucacauggggguaaugcaaguccaaaaauaagggauaagggauggauucucucaucagccaggacugcugcuccugauagaaaagcagguuaugcagggagaaggccggguacggcagcugucaaggaagcagcuacaaauggagcaugguuacaaugcccagugcuugugagguggagaggcagaguucaugucugaggccagccuggaauacaugcagggccuuguuuuaauaaguaccuugugccaaugagauguuugacucaguaaaggcgguugacugccagaugccagccaucaaguuguccucugcccuccgcaugugcaccauggcaggcacacucacagauacacacaaauaguaaaaaagaagaacucaaguccaaaaucaagaaaaccaguuauguagaaacauuguuuaaguucuauagcagccccagugugguauauaugcccagagguauugagcucagcacaucagauacuguacguguauuaauugcagccuuguucacagcagcccauguauaaaauugaccaaguuuuccuugaaugauggguggauacauagagaaaaugggcacacaguggucaauuacuaaaaaugagugaaaaccucuuauuagaagcaauuugcaugucuagaagccguguuuagugaaguaagucagacacagauccuccuguuguuggcaguugaaagcuaugguaaguacuugaucucggagcagacaguagaguagagcuguugagagucugggguggggagggguggguuugaauagcaggguuagcggugugcgggguaggaagaguaaugcucuaaccagcccaggaguuaaguugaccacacugauugugguucugaguagcuaguagagaggagugcugagcucggcuugaggcugcggugaccgccugcuggaugcuuuggcugaaaugugaucacaagucccaugaauaucuaguuacaguguguggcaguuagaaauuaaagauaaaagugaauugaaaauguuuugaguaagcuucugcaaauguaaacauaggaagggguuccagcgcagaaggaggugaggcuccuuggugacaaauaucucuaacacgccauuuccaggcgcgagugagccagcgacuccaguugggagggaccauugugguuggcuaaagacauagucagagugcaguucgugaauauguuugcugccuugaggguggucaggccagccuucaguguccuccacguggguguuuugaagggcugugugagcacaugauuucccagugagcacugcuucagggccuccugaguggcacucuuggaacccuuuccuuggguagaagggguuccgugcucagccuaggaugguucucugggagggaagcucaguuagcacgugcggagggaccacggugggcagucucggcaagcugcuacuguguaugaaaccucuccgucucaguauacaaagcagggugcuuccuuuuguagcuacuuugcucugcacuugcugaccacucguuuaaacuaggaaugcuuaaucauuuuucuaucauguucuuuugaggcuugaguuuugaaagcauuucccacccagcucuauuaacauuggggaacauuuaaugacuggugaggcuccaggcuuggguagcgccgaggguccaguccacuuacaugccuccuuaauuuguucuuaccucauuaacccuguaaagugguugugggggaggaguagguguguagaguuuguggaaacaaaaaagucagaaaacaaauuugcuuuaucugauggaaugauaaacuugugcgagaugugaauucauucugauaggaagagagguaagaucugaucccuggccuaagcuugucaugccacaccagucaauggugcugggacaguccuugcacuggcuccccuuugugauuaccccaggauggcuaugaggccucuugcugcccuugcuguccuaagugugagacccuccugacugguggcuuucuugucccacaggcacagcauucaucauccguuuuauuugcaacgaugacauuuacccaggagcccccaaauuccugcaucaggacauugacuccacacgagggauccggaacacuuacuuugaguuugaaacugcauuggcuuguacuccuucucuaguggauugucaagugacuggugaggccuaggaguugguaggcuggguuucagugaggggguaguguguguguguguguguguguguguguguguggguggguggguggguggguggguggucugucugucuauauuucuuugccucugagucucuacgugcuugaaugugagcuagccguuuguagacguggcacauaugcuuugcuccguaggauuuauagcgauuguugccuguuaaaugaugcuuagugauuauuaaaugaugcuuagugauacaagugcuucucuugaagagaccccuucccacuuacagcaacgguuuaaauugugguuugcgggucagaugcugcauagcaaucuugaagaaaacucaaguuaaaaaaaaucaaauacagauguauguccaaaguucauaugaggaaggaaaaagacauaagaccuaagagcugcucaguugugcccugagguggcugugugcucugacugcuuagcgugugugcugugcugcugugguuuuuacagagggacaguuuggacagcagggcaggaguaugguucugcaguccagguuuccuguggguuuccuugugucuucacacgguggggaaaguggucccagaacaaacaggaaagcgugccuccuuuuguguuuccuuccaccccagacccagcugggaacgaguaugacuugagcgcccugagcauggucaggaagccauggacugccguggacacgucugcauacgggaagaggaggcacuucuaccugagugucugcaacccucugccuuauaucccuggcugccacggugcgcuggaguccuguuccacuacuuccccggggucugacuggaacccaaagcagccuuuccucauucgccauucuugucuguucaggcauugcauugggguccugcauggugucagaagacaacaguuuuaacuuggguguggugcagaucaguccucaagcuacuggaaaugggucucucagcauccuguacgugaauggggacagauguggggaccagcgcuucuccaccaggaucguguucgagugugcccagacgucggugagugugcaccucagcaggaaacgcuugcuuggugguuaccucuauucccauuuccccuuaaucuuggagucuucugugcuguuuaaagucuguguuuauagaaaugggggcauugcuagugucugacuagaguauacuguuuuccucaggcuuauaaucguccgucaguacugaacccuuggcuuaagcgagcgagagacuggagacuuccugaggcucuugcuuguuuucacaaaguagcauacagugaauuguuggcuuguguugcagggcucaccuauguuccaguucgugaacaacugugaguauguguuuguguggcgaacaguggaggccugcccugugaucagagaggaagguaagccacagguugcugccccugaguugcuguacauaucuaguggaauauaugugcuaaacccaggaugucucacauaggaagcccuguggugguggcugccuguggggucaggaggugccagugucugggucaccccuuauccuugaggucuuuauuaagccacuuguuaauuuuuaccacuggccuuucucuaauauacuuggauuggauuuuguuuuuucuugaaaccaguaaagcagucaggaugggcuugguuuauuaaucugugggugucccugggcucgcuccaaaacugucugucuuauacauaaacaagacaacagagaggcagaccacuuucugauagccauugccugacuaaaacuuguaaaacuugccuggucugguggugcaagccuauaaccucagcuuugcaggaggcugaagcaggaggagccuuuguucaaggccugccucccuaggcugugagugaguuugaggccagucucaguaacuuaaugaggccuagccucaaaucaguaaauagagcuaagaauguagcucaguggcaggauaucugcauagggugugcugucucagggucucaguauugcaaagcaaauaagaaauuuuauuuuaaaaauuuguucucauuuggaacuacgaaugccugugugauagcauuugcucuuggcuccuguauguucuugaaggagacaacugccaggugaaggaccccaggcauggcaauuuguaugaccugaagccccugggccucaaugacaccaucgucaguguuggcgaguacaccuacuacuugcgggucugcgggaagcugucaucagaugucugcucugcccaugacggauccaaggcagucucaucaugccaggaaaagaaaggaccacagggauuccagaaaguggcagguacugguguuuucugucuucagcuguaacacgucaagaugugacgccaaggaccacauuucucuaacucgggaggagcacgugcugagugacagacacaaggaagcaagcuuccaucugccuguccauccgcccguguaucuuaucacugagcacaagugcaggucagagaacaauuugcaggaguugguucucuccuuucaccaugaggcuccugggaaugaaacuuaggucaucagauuuggcagcaagugcccuugcccacugagcuaucgugccagaucacugaggacaauuugguuagaguuuggaaaaaacagcagggcaaggcaguuggaagucauggcacuugccaggagaaggggguuggaaaagaggagagaaagcuaugcuuuuugcauuaugcugccauuuucagcuggaggcuuaagaagcagccauaaggcagauaggcagcucugccuagcaacugggaguggggcuucagagaaggagugaggaagcccagaguaccagggaaagcagagaaagaaggcaaaguaaaaguuaggacucagcugaguaggccaugaacugcagggccacagaguguuucugacccuaagcccauagguuuuucuugggacacaccacaugaggugaugaugagugccuccaagcagucuaucccagggcugcaucaaagaagguuagauggaaaacugacaaggcuguacuuggcucaguaguuaagaguauggccugcuguugcagagaauugggauuccauuccagcacccacaugguggcugacaaccaucuguaacuauagucccaggggaucugagacccuuuucugacuuuccaggcauaaacauacaugcaggcaaacacacuaacacacaugacauaauaaaccuaaaacugacagaguugacaugguggugucuguuuuugcauguacacugucacaggucuugcauuagcaccgcagcccaggagccuuacagaugugcuuugucuggagccuuacagaugugcuuuucuugagcaggacuccuuagccagaagcugacuuucgaaaacggacuguugaaaaugaacuauacugggggggauaccugccauaagguguaucagcgcuccacaaccaucuauuucuacugugaccggacuacacagaaggugagccccuguggcacucccacugccgucccacuccagcugcuguucuuucagggcuagucuacucucaacgucuauaagaugcauuauuuacugagcaccuguuugcauggccauccuucaccugggcucccauguuuacauauuuucuccuuaaccuuuccagccaguguuucugaaggaaacuucggacugcuccuauauguuugaguggcgaacacaguaugccugcccaccuuucaaugugacagaguguucuguccaguaaguucacauaucuauuggcuuuuuguguccuuccuuggcaaaauuuugcuucacagguagugucuuggucaguucacccacuucuuuucacacuggguagauggcuccagauagccacauguggggcugguacaucagacgcacauggagaggaggagucaaggacagaaacagagguucggagccuuccugguuuguaaggauggaguggcuucaggucuagagagcaggaggcuuggugaggcagcuuuuggaaauggcugugggugcauacgcuccgagugccaggggguggcuucugcuggccacugaguuauaauugucacuggccuguguguggacagacuuuuccaaacuuggcuuuucagauagcucauuuuguugaagugaacauggacucaucaaagcucaaggcugugccuugcucacucugcauuuggaaaguuauguucugcaguaaagcuugauucacaggacaucagggacacauugaugcuugagcccucugaggagagugccagacaugucauuggagcuaacuggacccugauugugguguucuguucccugcagggaugcggcuggcaacuccauugaccucuccucacugucaagguacagugacaacugggaggcugugaccaggacaggggccacugagcauuaccucaucaauguaugcaagucucugucuccacacgcuggcacaggugagaagugacccucuucuuguagggugguggucagguccuuguagggagucuucugggacagacagagcaggagaggccucaguggaaggaguuuggccuaggagcagcaggggaagggccugagggucuuggugauugauucccauauggcccaggcucuguugauacugaagacucugcagggaacauauuagccucaugagaaccugacuauggguacaaagaaagcaggaugggacacaggaaggggcccacuguuuauccuaucaaggacuuguaccguuucgagagcauucucccugagccugcgaugagaguggagacuagaagacacaugguggucagcaguuuuccagggaauuccuuggaauacugaaggggaaagucacccacagucccaccucagggugaugcuuuuuuaacuucauucucaggguauagggcacaggugccuggagaauaggaaugcugaguuccuaguaauguauugacuaaagagugagaauguaggcucugagagugcucccuugcguugaggacucugaccuuaccuugcgcaguguuuugaaaugauggcgcgggguggguguggagggguuggauaauaccauaccuugagcugcacuuugcacuguaggagacugcagucaccccaggagacucugauuguaucuuguguugcagagccaugcccuccagaggcagcuguuugucugcugaauggcucuaagccugugaaccuuggcaaggugagggauggcccucaguggacagacggugugacuguccugcaguauguggauggugacuugugcccagacaaaauucggagaaggucaaccauuauucgcuucaccugcagugacaaccaaguggugaguuaauggcacccaguagagugugggacccugagccagcgacaaugccaggcugcuuuugggugcaaguucgccugcaugucaggguggcaugguuguggugcaugcugguugcgaggucugugauuuaggguccaugcguccccuugcugucugcuuaggcacacaguccgacacuugcaagugcagggcuaauugacucuuuugagucuacucuggauccuuaaagaacagaagggcagcuaacacuuggcugcuugucccauguuugucagcaagauguagagaggagacuggaaguucccgcaugacuggugcagguguuaugacuggcgaucuggcugcucuccuucugagcugccuccuuacuugguuguugguguuggcaucuagcagguguggguagcauggguagcuucucugacacagaggaacuucuuucugugcuucuguuugugaugggacacaucuguauuggagaagcagggucaucucugaaggagcagaugccuuaugggccaggauacaggcugauguacuggaggguggcgggccugccucugugccucagugcugagaacugugcaggaaggagguagaguugggcaaauggucucagcuccauaaugaugggaaagaccaggagugaucgguagccagugaccagaagaguuaguauuagggacccacucuuugcuggguccuuuuguuuuggcuguaacaggcauuugcuaagcauuggccggugauuugcucauggaguucuuugccugggcuccuugggucuaucauuagaaaaugucuggcucgcuuagcuagcuugugguggucccugggguauauugcugacuuacuugugugagguccauaagaacuuacucaccuuugauuuuuuuuuugaccugugcuuaccucacagagacaccccaagacuugcugugcuuggcuuugccaagcaguguuguggggcaugaguggguacccccuaggcguaaucaguuauucugaagugguucucucugcuugcccuagaacuccaggccccuuuucaucagugcuguucaggacugugaguacaccuucuccuggcccaccccuucugccuguccugugaagagcaacacacaugaugacugccaagucaccaaccccagcacaggugagggacagacaaccacagccccguacagggagggcccuaggagguacauccguugguguuuggcaucuuuggccuuuaaagagaaaaggaucuugugcucauccuauggaggcagcuaccuugugccugggaaagccagucuccaucuuguuuuguacuaugcuccuggcucgcuuggcugaugguacaugagugcuaaggucuacaaagcuggccaccuuucagagccaacagggcagccaccagaagacuucugcccuuccgcuuugcugaguaucaagaggaauguggguggcaggcugcugaccauuggagagaugcgucaggccaaugaugacagcgacaguggcugcuggggcacacagaggacggagaccgugguccagugacaggcgcugcuaugcuaguuggaguauuuuagggccuugaugagugugugaaggaagagucagaguccccacugguuggcugaugugagcuggcucgucacagcccuccuggucugaagcgcccucuucuucucaccuggcaggccaccuguuugaccugagcuccuuaaguggcagagcugguaucaaugccuccuacagcgagaaggggcuggucuucaugagcaucugugaggagaaugagaacuguggccccggaguaggugagugccauagcuccugugcccgcugcugucccuagggcuggccucagccccauucccacuucuaagacccacacucccggcccuugcaguaguuaggagacacugcguucuucugugaaauuaaucaguuagucacugaccccuuaccagcucuuucuuuauccuuccaugugcugcaggggccugcuuuggacagacgaggaucagugugggcaaggccagcaagaggcugagcuacaaggaccaaguccugcagcugguguaugagaauggguccccaugcccuucccugucagaccugagguacaagagugucaucagcuuugugugccggccugaggcuggaccuaccaacaggccgaugcucaucuccuuggacaagcagacgugcacacucuucuucuccuggcacacaccccuggccugugagcaagcggugagugacugcgacgcagcugcacccacuccaguuugcugguuccuagcaguccaaggcugggcggucuuggucaguauuccuuagguuuuuauuuauuuuauuuuaguuuuuauuuuaauacuacuucuuuuuuuccuucuuuuggggguaagguucuuuuuuuuuuuuuuuuuuuugguuuuuucgagacaggguuucucuguauagcccuggcuguccuggagcucacuuuguagaccaggcugaccucgaacucagaaauccaccugccucugccucccgagugcugggauuaaaggcgugcaccaccacgcccggcggaggguaagguucuuacacuuuauccaaaguuggccuucaacucacucuguauuccaggcuagcuugaacuguggcaauucuccugccucaguccauugagugcugcuggaacuguagacauguucuaucauaccuagguuuagcuuuuaagcugucauucauggucauuagaaaaaaaguuacuuguagacucaaauguagucuuuucuuuugaacagacggaguguacugugcggaauggaagcucgauuauugaccuguccccucucauccaccgcacugguggcuacgaagcauacgaugaaagugaggaugacaccucugacaccaccccugacuucuauaucaacaucugccagccacugaaucccaugcacggagugcccugcccugcaggugccucaguaugcaaaguuccuguggacgggcccccuauaguaaguguguaaggucgggguuggcaaguuucuagucauagccugugugcugggcucagacagcuaagugugagaucgaaaguaugagaguguacauggagcgggcggccaaccaacaguacuggccagggagucugagcugcuugaaaauugaauaguugcuuccauuugcauuuugaaaauacauguguaugugugagugugugcuguacauguauuuagccuguggaggcuagagcagggguuugugugagugugagcuguacauguauuuagcuguggaggcuagagcagggguuugugugagugugaacuguacauguauuuagcuguggaggcuagagcaggguuuuugaucuugugggguuggaguuacaggcacaugugagcugcuugaugcagugcuaggauggggaccugagcauccucuggaagagaguacaaguagcccccucauacauuugguauugguggucacaugaccggcauuaacugcuucaggguacuuuugauuaguguggccaucucuccagauagcccagaugcaauuucuuuuuuaagacuuuauuuuguuuuuguuuuuggguacauguauauguuugugcauggguaugugcaaguagguacagugugcagcagacauuggaucccuuaagcugugcuuacaggugaucaugagcugccugaugugggugcugggaacugaacccagguccugugcuaaagcagugagcacuuuagccauugggcuaucgcuccugcuucccaguuaugcuuucuauguuaaaccugaccaagagagguguuaacagagcgggcaucaauagcacuggcacagcacaugcuucucuuucaagcacuuguauaauugaaaggcuuaagugacacaaguucuuucuaguaacgagugacaauuagggcaaaaccaauuaugaauaauaaaaaaauacucugcccugaaaacuuacaguguagauuuggauguguggaguucuauuugugguuugccaagcucucgugagguuuuaaacuauaaauuccccucuguugugaguuccauugcaggacaguagguguccuuuuaaauguucugugaaguggaguaucucgcagaggaccaccaaggcaugagcuacauuuuaauaggaaguucuuuauggcacucugccuggccaucauuucccagaaguccgauuggcuaaguuuucccacuuggccauccuuugucagguuaaacuuuugcuugaguucuuugauuggugaaggucugacuucaucugcuccacagcaaugauccacacaguacacaugcucaugcaugcacucuugcucauacugguaugaacauacugccacauggcacuucauacacaugcacacaugcaggcauguuuccuguccaccugccuuuuauucauucauuuauucagaagaacugacugaagagguauuguguaugucugccgcuguccuaagcaacaacaugaguaagcgagaguuguccccucuguggacauucccaucagacacugcugagaugagcaagaggcaaucucaggguaguguggauaucggaacacuaggaagggccuugcccaggcuccugccuuccuccuucugggcccaggacuguggaauucaugcugugagugaggacagaaguccuuagugcucagaaucugaaagcugaccaugaguaggaacacccuuggccuuuguccaugcaucucugguaucucugcaugcuggugaccuuuuugcaugccaaucacaaagcaguacagguauuucucuaaggcugacagugagaacugcugcaguuccaugugaauuccuaaucugccaaccuuggcaugguuguaaagcaccguucacuucuucuguucuaggauauuggcagagucacaggcccuccaauauucaauccuguggcgaaugaagucuaccugaacuuugagagcagcacucauugcuuagccgacagauauaugaacuacaccucacucaucacauuucacugcaagagaggagucagcauggugagugcccgcccugucagcuucacuggaacccugcuuugggcagugugcugaaaccacccgagaacaugacuuggggcgugaguaagucugaguuaacauggaugcuuucuguuguucaaagucauggaagcuuugagaguagaaaucauuuauugagcacugauucugaacacauuaaaagguuggguugaaauaucuuuauuuuuuuuuuuauuuuuuuuuuaaaagauuuauuuauuuauuauauguaaguacacuguagcugucuucagacacuccagaagagggcaucagauuucguuauggaugguugugagccaccaugugguugcugggauuugaacucgggaccuucagaagagcagucggcgcucuuaaccacugagccaucucgccagcccccauauuaaaaaaaaaaaaaaaaaaaaucuuuauuuuuuuaaacuauaaggugaucgguuuucugauuagacuuauuuuuagcaugugccaucauucauuacauagcuuuauuaucucucaggaccagaugagcaggugggacuguugucugcuccgaccugcugacaucugggaugcacugagggcuugucauucacagggcagcaguguccugagcagcugacgcucuguccuucucaguguuuuccgucuuuaguagaagcucuuuccccauauggcucaguauggagcucagcagcaaguguacagaguuccuacccaccuggcggcggcggcuguggcuguggcugcugcugcugagugauggagagcuaugcucucauucagaguucauggccuguggcacauguggcugaaauacuuuugcccucauggcauuccuggugucuagauaugcaggaugcagaccugcucuuggauucugcuaugcuugcauuuguacuguguggcagggguguaugucuucgcuauucccaggaaagaauaugguggaucuuguccucacacggugguuuuuaagacuaauguuuuucaccaguugugguggcuuacaccgguagaaugugcugaaggaggcagaggcaggaggaucacgagaucgaggcaaaccugggcuacacauuuuuuaaaaagacucauguuuuucuuggccacagggaacuccuaagcugauaaggaccaaugacugcgacuuuguguuugagugggagacuccgauugucuguccugacgaagugaagacacaggguugugcuguaacagaugagcagcugcucuauagcuucaaccugaccagccuuuccacaagcacuuucaagguaagcuugccuucccauagccuugccagccuccagagggcuaagaugcuuugacacagggcuggacaagaaucaguaaccugugaggcaggcccuggaguucugugacacaaguggauaauaggcagagugacuugaggacaugcauuggaacacacaccucugggccagggcaagauuucuauaguuacugggagccacagaggaucacugaguugccagacuuagcucaagguaaagagaugcggucugccaaccacagagacaagugggagaagcagcaucgugcgagccuuucaugcaugagucugugggcugggggcuuucacugagccuggugagugcugaguucugaaccuuucucagggcuugcugccugcaguucagggauaguuuucuacaugagcgcagugagugaggaaagcgaggcccaugcgcacgugggcugucugcucugcaucccaaaggaagggggaaccugggacucagagcagcagccucaggcuggagaaagcagaugguggcugccugggccaccagggagaaggcaagauagaaaagagacuggcccaggaugacuucugguguucucuggagguggucuuggccaggaaaacagcaggggucaugguccgauucaguacagggaugugaacugugggagccugugcucuggucacagcagucaguagccacacauugccauuuguuguccuugcagguuacucgggaugcccgcacauacaguauaggggugugcacagcagcagcuggcuuaggccaggaaggcugcaaggauggcggugucugucugcucucugggaacaaaggagcuucuuuugggcgccuugcaucgaugcagcuggauuacaggcaccaagaugaagcagucauucugaguuaugugaauggugauccuugcccuccagguaacucuucacaguauggucaaguucaaauuucuuguaaauagauugacuuagcagaaaaauacuugaggaaugaagcuucagaccugugagcacuguacccugccacaucuccuucccugguaugaaugccugugucuggaacaugaugcugucuguugcuugucuguuugggugaauccugucuagcagggcagguacacagcuucuuagggagucuuuggguggcaucuaaggcauggcugauucauugacgcuuguguauaauccaugccucuuuccuuccagaaacggaugauggcgagcccugugucuuccccuucauuuacaaagggaagagcuaugaugaauguguauuagagggacgagcgaaacugugguguagcaaaacugcaaauuaugaucgugaccacgaguggggcuucugcagacagagugaguggguagcugaauuugggggaggggagcagguguuguucuauggguggccaagcuaauuagugauuauuauguaaguuuuguucuuguuggcuaaggaugauguucauggagagccaaauuugagcaccauagcuccuuugcgacuuagggguggaaagagaguggcgugaaggcccacacucuguaguucucuacaugaucgaggacaagcauuugacucaugacuagcuccaagucuucuauggguggcccugaaguuuugagguuguuacagaugcuuggcugauucuuuaaauucuugccauuauuaauguguaggcaaguauugaaugcuuucccaggagggauuuugguguggucugaggaacugaguuuguaaguggauagauuaaggagugagacaaacuguggcuggggcugcacuuggggaaacagccaggaguaauaaagaggugggagaagucaagguuugugccccgcccuaggucugaccuuugcacacuauugcuccccagccaacagcuaccggaugucugcgaucauauuuacgugugaugaaagugaagauauugggagaccacaaguguucagugaagaucgugggugugaggugacauuugaguggaagacaaaaguugucugcccuccaaagaagauggagugcaaguuuguucagaagcauaagaccuaugacuugcgacugcucucaucccucacgggguccugggacuuugugcaugaaggaaacucgugaguaugccacacugccuguggucccucaaguuuucaaagucaggaauaucacauagcugugggguuugaggcuuucauugagacacagccuagauugucaguguauggggaguucuggugagcacccacagagaccggagcccugacaguugcucagguuugagggcaggauagguuuucuaagacuuuugccagcucuuuuagcacugccuuugcuuuuugaacuaauuacccugacuguuccauguggggagugccugcugugccagggacccugagccucacagggucugcugcaaaucagggcugcuaugaauugggggacuuaggugagugccugcuaucccuccauagccuuuucuccugucuguacugugucagggaugcauggggacaugccacuacaugugagcccguugagucagcuacucuguauggcugcuucacucuccguuucuucugcacccccaaggcuaucagggagucaguuaccuuccaagguaguguggaguccacaggucuguccaguguacucgaaguagaacuuucauuugcccuuuuuacaccccuuugugucauucuguagguacuuuaucaaucugugccaaagaguauacaaagguccccuggacugcucugaaagagccagcauuugcaagaagagugccacuggucaaguccagguuuuggggcuuguucauacacaaaaauuggaagucauagguaaggcucugggguguuuguacuugacucaguugcugcaucaagauuggcaaggugaggcugucccuggugugauggagaaagugccugagcuuugguggaaacccggugacuaguugaagcauuucuacccccuuccuggaacaugaaguccaugcuguuuugauacucugaggcacagggagccuguucaaagcaccuucgcugaucauguuccggaugcacauuggcuucucaauguacaucuacacacaucuaaaaaagcuauggucacacagggcgcuguacagauggcuccguguucccuugagcucuuggcuaggaaucaugacacgaucaucaagggaaggaagggaucggcuguuagaggacaggcacauuuucccaacuaagggagcacacaaggaccaggcuguguuggggguuagacauucuacucugccucuaaggcuagaguaggaucccgauugcgcuguuugaacuacaaggugacauggauauugaaauggagaggggauucugagggaauucccauggccuuuaauaacaaacucaaucaagaaaguggccucccuuugagaauuaaaaucucaacacaugaaccagcugggcaaacucacaucuuaggaauucucuauucccgaaguuccugacuacuguagagcuggaugcuagucauauagguguggccauggaggcuuagcauucauuccugaggauccaggaagcucauggucuugcugcuuccuuacuuauggugguauggguugaguguaugggccaguaacugccauugaguauggagggcaccuuuagacagccggcacuugccuuugcaguagauuuuuaagccccgauauuguucugcagugcacuagaaauaaugccaacucauugucucauguuucagaugaaacggucauuguuacuuacucgaaaggcuauccuuguggugggaauaagacugcaucgucuguaaucgaauugaccugugcgaagacugugggcaggccugcauucaagaggugagccacaggcgagcacacugugcucucugccucccccauuuccacgugggaguugggaaugugcacacagaggagagggugucugggacuggcacuguguguggcagaaaugcccacugagacugaggccuuagaggacagauugucucccacaggagguaccccuacuccaucugagggcuaaggccaccucagcuuuuuuagccugguuugccuuaagaaacauacuccugaaucagcuuuggaggugcugacgcuagccugagcagugcagaucuggcugcugccccucaucaugggagaauuaagggggugcugauugcaccaccaacaagcagguucuggguguugcaggcaguuguugggugauguuagagggauuguggccaacagggggagcaugugaacugcuguuuuggaaacugcuuugaaagggucuuuaauuucugagacuaagagacuauuuguacaagucucgguucagagcuuccagcuucauaugcuaaggcauuuuuauugaguuugguuuuucucuguggggauggggguugaaccuagggcuucgagcaaaccaggcaggugcugugcucuugagcgguaguuccagcugucuuguuguuugacacaggaugacacuaacguguccagguuggccuuggauuuguucuguaacugugacaggaacuugccaccuuuuaccucugucucaguggcuggagucacagguuugugucccuagggugagcaggcacugcauccucgucugcuucccacguugcuaauguuauccucguacugugcugaagcauagugaccaggacagucguccuggcccagagcugucacucacacaguccccguggggaccaacagcgguggcucccaaggacccuuaagaacccgggcgacugccucuugcaggccucuccagcuauguguguggcagccuugcuguguguggccccgagguaaccgugucugcucccucucagguuugacagugucagcugcaccuacuacuuuuacugguacucacgggcugccugcgcggugaggccucaggaggugaccauggugaacggaacgcucaccaacccugugaccggcaagagcuucagccucggcgagauuuauuuuaaguaaguggaagccugccuguuuggcugacacacacuccgagggaacaagaccguaagucuugcccuguaggcaugcugccagguaggcagucuaggcuucagugacaguugggaagugaccaaguuuggcuuacaccaagcaaaaggacugcuucuuugucauuugacacucaguggugaauuucuuauaaaaagcaguuucccucugcccuuacugcuggagccaagagucucgggacacagagagaacaaggaacucugggcugaccagcauguuagcuaaaaguaagguccaucucuuagcggugucacgggcugucuuggggcaagugcacugcaugugcuguccgcagugugugagauagugcagucauuccaggaggcggggcugggcaggccgauguagcguuaacggcaaggaguguuagagaagggcuggagcaugcagaggaaggaguaugaccgcugugcucuccucugccucaggcucuucagcgccucuggagacaugaggaccaauggggacaacuaccuguaugaaauccagcucuccuccaucaccagcucuucuuacccugcaugcgcuggugccaacaucugccaggugaagcccaaugaccagcauuucagcaggaaaguaggcaccucugacaugaccaaguacuacguccaagguaacucgcaguuuccuguuagugguuccggguacagcuuuucacagggagagcuucccgugcucauccacacacccacggcauggcugucucacacacccacggcauggcggucucacacacccacggcauggcggucucacacacccacggcauggcugucucacacacccacggcauggcugucucacacacccacgcauggugagcucacacacccauggcgugacaagcucacacacccacagcauggcggucucacacacccauggcguggcgagcucagacacccauggcgugguggccucacacacccacggcauggcgaucucagaccuaugucagcucccuuuacgagcuggcgcuacucugaugggccaaggcaggagacgucacagggcacacucacugcggccuggcguuaacaugcuacauccuccuucagaaacggcaaggaguguuagagaagggcaagagggagcuggucaguggggaagggcccucccggcugccaagcccgaagaccugagcuucacuccugagacccacacgauagagggacacacacacgugcaugcgcacacacacgcauacgggcgcgcacacacaugcacaguggaggaauccuggcaagcucagugagaugggugugggaagguuguagauggcaccaggcauucuugugcucuugugacuauguuccuggcaggucacauguguaucuguauuuuaaauaacuuaccauucaccauauaauucuuguaauuuguuuuuuugaacuguguggcccuaugaacuuuuaaaauagcauuuugagaugaucaagagaacauggacugauaagagugagguuagaucaggguccauuuauacaccaaguacuagcucgguggauuuccacuucagucccauuuggaaaugugauugaacacucuuggaauuaacugaaaacugcugucuugaugcaugcaguugaucacaguagauguuuaguagaugguagucacucaugacaagaugcucauggaagggguggggucauguacagcucuuccucuggccucuugcugggcugcaaccacuguggggacacagugaggugugagccucuccuguggaccgaggcugugcugcagccacccccauagugaggugugaggcccugcauguauugcuggccagcugaguuuguucgcugagccucacaacuuaggaccuugcugaauuuaagugucuaggcacaauugguugguguccugguggucagucuugcucuccagguagaaugagaccuccuggccagccaccauaaauuguccuagcagccaaugagguuaaagucgucccuugcuuagggugcuguguaaagcugugaaggcagagugcacacaugggccuuugcggguuugcaccuuuaacauuaagccugugccagcuuugacagaccauugaagcauccucuuggugggugcuaauagugcuugcugucuccuuuccugugugacagauggagaucuggaugugguguuuaccucuuccuccaagugugggaaagauaagaccaagucuguuucuuccaccaucuucuuccacugugacccucuggugaaggaugggaucccagaguucagccacgagaccgcugacugccaguaccuguucuccugguacacuucagcuguguguccucuggggugagugugaugcccaugucccucucacaugacuguucaggaguaagcaugugugugucuccuagguagaacacuggggagguugugggugugcccacaagauuggcuugcugcuaucuggucuguggcaugguuaccauugcucuuugucccagguagcauugacugugcuucccucagcuguuggggagcagggcuggcuguacccccuucagcauucucugugugcucuagugugcacuugacauggcgaagccaaugagaagcucccucugaaugccugucgaguguacuccagaggcuggguuugguggguagcaaggggagugcacuucuguucugagaccuccaggccagagaggaggaaacugguggucuuguguccagggccauauuacaugugaaaacuaaaacccauuuauuuauaaguaauccuaaguuucaaugagaaaucaaagguagaauuugaagaaauuuuaaagucaaccugucauagauauccccucuacccagaagcccugggguuagguccuaaggugacccaguauaggagaagcccuacuuuugccuggcccagaggguuuugcagggcugggcagacccaaaagaaaugauguccuuggcugguccacgucuucagcuccugguauuuauuuccugaucccuaaagcaguaccaucugcagucggccuguuccugacugcuuuaagugaagucuccaggcauuccacauguuguuuucuaugucugguggauggcguguccuggggggccuggcucagcuggcauugguucaguaggcagguccuggucccugggcuccugggagagcuguucgacacaguuccugacaaagcucccucuccucccgugugauuucuuucuaguguggacuuugaggaugagagcgcagggccagaguauaaaggacucucagagcggagucaggcuguuggggcaguccucagucuucuccugguggcgcugacuggcugcuugcuggccuuacugcugcauaagaaggagagaagguaaggugggcagcacaguaggaggacuggguggggcaaguagcacauugaugcuuggacacaggcuuggguuuugagccugacacagcaagcaucuagauugagaauuccaggaguggggcucaugcagagcaguggguguauuucugugggaggggccagugucagaguaggcugggcacaugcacaguguguuccuacugccagccuugggaagcuuaaggugcagcaagacucauucaucugccucgugcugggcccugugguucuguuugugggacacagcccuuaggaguugcacagacucgacucagggccagcuagcugggucccuugucccugcucauucugcuguggacuuacugugcucuccauuuugacagggaaacugugauaaacaagcugaccagcugcugcagaagaagcucgggcguguccuacaaguacucaaagguacuguccgcugagucgggcagcugcuggcugagggcugccccgugcugccucagccuguucugcaugcugggaaggaagaguguguugguggcuuggcauuggaaagaaaccucucacccugacaccacuucuguggacuuucugccuucaaguuucucacagcacaguuccuuuagaugaccugauaucagucuguucccaggcuuuggaggauuuuuuuuuuuuuaaggggaaaaaaaaagccauagugcuggaauuucuguacuccuggcauuuggguaauuucagauaaacuuugauaaacauugaaaagaggccggucagaggauucagaugugcugcuaguuuucauacacaccgccaaaucacuucuuaagcuaaguugaggcugggaagauggcaugguugguaagcgcuugaaaaggaccagaguucaauccucuaggacucaaauaacaacaaaaaccacaugcuagaagcccagcagguagggaauucaaaacggguggggcucugggccuguguggcagccagccagccucgccugcuuggugagcucuaggacagugugagugagaccuucucucaaaaccaaagcaaagcagaaggaccaagguggauagacacccaagccucuccuaugugugcacacuuaagugaaccugcacacauuuggaauacacauagauaaauacaauuuaaaagcuaaaugcccugauauaagcccuuccugugucuucuccuacacacuggacgcccagucccuagauacaguggcccaggagagucccucucugccagcacugcucaacagucaugagcccugucagguccugucugccuggccagcucauuuggcuaugaggcucuugccacaggcucuacuuugcagguucucaucucauaccccagagagaggcccugggguggccuguaucaggagagcucuccugcagcagacaggucucuuugcugagucucauggucucugcuucuguucccuguuaggucagcaaggaggaggagacagaugagaaugagacagaauggcugauggaagagauccaggugccagccccaagacuaggcaaggacgggcaagaaaauggccauaucaccaccaaggcggugaaagcagaagcucucucgucccugcauggggacgaccaggacagugaggaugagguccugaccguuccagaggugaaaguucacucaggccgaggagcggagguggaaagcucacagccccugagaaacccacagcgcaagguccugaaggaaagggagggugagaggcuggggcugguccgaggugagaaggccagaaaagggaaguucagacccggacagcgcaagccaacagccccugccaagcugguguccuuccaugaugacagcgacgaagaccucuuacacaucuaacuccguggugccuacagaagaagguggagccauggacagccaagcaccuccaaccaaauaagacuucagcucgaugaugcgucugucauuuugccuuuaacaaaacugcuucaaagggaagaguuucuguaaugggggagaggaugggggaggugggcaccacuccuucaugaucguuuacagucaauggaacaagguguugcuugaaucggccaaagggcgguacuucgugcccagggguuugccccaaguccucacuuacgaucauagcugcugugugcuuccaacaggugcccaagccacaugcaucucacaacagagggcuguguuugaaaaaaacccuugcugcuuuagacccuacggggugaccauuuauauuuuuagcauuguaauucucuccccuauuuauugacuuugacaauuacuacucagguuugcgaaaaaggaaaaacaaaaacaaaaacaaaaccaguuucuuuugccagcaagggcauaaggugaagcuggccgucugccggagccguuguccauggcuccugaacugguccuugaugcacacuuagugagcugcaguauucuauucuucgcuuugcauuuugugagggcacacacacaugcacagguccccgagugccuagguuugggaaggcccaccugcuccgugcccuaccucaucucuguaguugcagcucuuugcacgaaucccucuggguguugcucuugccagcuggugacucccagcagcucacccaggcgggcguucgcgcacacgguggaguggaggcucuuggggaggagcugcgcuucagguuugagcuguaggucucaucucuucagggucucauagugccaccuuuacugugcuuuuugcuuuuuuuuuuuuuuuuuuuaagggggaaaauguuuaucacccauucgaccuauaagaagccuuaauuugcacagggugacuuauuacagacaccgugaaacgcggugggccaguguugguguagggccaguguugguguaggggcugugcuagggcagugucccaggauggaagggcaggcccaguccacuggcuguggauucuuuucuugauguguucagugacuugucacauuauagaguuguauauagguggcauuuacauacccaaaagcaaaguaccccgcagaauuucuugguuuaugccugauuuugcuagcuuauuugauuucacauugaguguauuuuuaaaaauugauuuuucucuucauuuuuaaucaacuugacuguaauaugaaguauucaauuucaauaaagauaaauuauuaacuaggu

SEQ ID NO: 8381 - RNA, 1401 nt, Mus musculus
cucacccugccccagugacuuggggacuggauagacugagcaaagccagcaucuccguugggugggauuuugaccagaggcaggggagggucuugucuuccaugucauauugguccaaugauacuguguugauuugaugucugugggcauguacuuccugucuggauugcagaucuucaucucccugcuggaccaacccagguucacuguaggguauugaugcccaggggaaggguggaaagcuguccagcaccuccugaaguuguucacagcccucuuucuccuaaggccuugccauugagguccagcuucuccagcucagccuugccagccacagccucagcaacuagguaucucucuugauuucacagaugacaaguucagcuccuucggcuugggcagacccccauggacagcaucugcgaaggcaacagugcccuuagagcgcaccagauaguauccaaaauugauuaccuccacuugucccagauucuucagggucucagccauggccaccucacccuucucaaugaagguguugucauuuagguugaugacccacaacaggggguugauggcaaaugccugagccagggccaugacgccagggugguuaauuccauucuguggcauacgaccucuuccagagucccgagaaucccaaaagcuucugccagagcaguggcuccauaauucuccaggagauuuuggucagccacaaaugccuucauggccagugacuugcuuuaggcacuggacuugcggugacacucagucagagcugcugccagaaucuugccaccaucgauggccgugccacaguuguuaagcuugaguuccugcagggugaagcaggcugggcucuugaggagggccucaaagccucgcacuccaucagguccaaaugcauucucacugaggucaaguucuaccagcugugcuccuacagugaugagucccuccccuagugagaucagagcuggugggaucccaggcccaccagaugaacaugucacucucauggcaucacuucagcuccgacuucucuaagcccuugacaaugucucuggccguuuccgugcccaccauguugcccuccaaucguagagcuucgaggcugucaaacucuucaaucuucuuaaucacaucuuuagcaucuucugcaguauuuaguuugagacacuugcccuuaaaauguagcuuuucucuggcuaccuggguuuuggccagggucucugccaguuuggcaauguuuucagaggccaugacuacaauggugggcuacccuggaggucuguaaacucaaacuagccaugcugccauguugggccggggggacggaaaaugagucuguuacugcuugagagcuggcaugagggccaggccugucaccgagccucu

SEQ ID NO: 8382 - RNA, 1139 nt, Mus musculus
uguguaagaacacuaagcaagcugcucucauuuggaggugacucuuuuuucagcaucguugaagauauuacaagugaaaaaacccaccauuuuccacaaaacagucaugggcagaaaagaaaaaggagaacaacuuuaaugguauccaggguugaccucugacuaaauuauuucaggcaaccaaaucguguauuuacaaagcagaucaaaugugugcucucaggaucucuagcaguuaaccccugaggugguuaauacugucagcuugacggggucuagaaucaccauggagacauaggaguuucuaaacucgguaaaccgaggcaggaagacucacccuaggguuuuagaccucguggaaagggaaggugaauauacacauucaucucucucugcauccugauaguggaugccacgucauguggccugccaccccucacuccagcugcuagagcaaaccccuccuuccuuaaguuaucuuucucagggauuuccucaucacagcaagggggaaagcaacagauccaggccuacuaccuaguuuaucacaaguccuguauccauguggcaaaacugggugucgcucugaagguccagagucuccaugcaaagccaguggguguugugggaaguagugcccaugacccaaggacacagcuuccagcaguuuaugccuuuucucuuuguacagcugaugaauaucugcaagggaaaauuuagaaguuauauuucuaugaaacaaugcugaccaaguaugcagggcugaauccagggaaauauuuagaacagccacuggcguggacagacucugugcccccagacaauacuccaaaaauacucuuucucacaacuggacguuuuuuuucuugauguuuggauaagcacaugaucaaaaucuaggcaagcggcaaggagggcaaagugcaugcguccagucaggcaccugcagaggacaaggagaggaauguuuauucccauuucagagcucaccuguccgaguuugcuuucucucgcugugauacaaauacugaccaaaagcagcaguggggaggguuuauuucugcuuacgaauccccaucaugguccaucauggagagaggccuggacaggaccucaagucaggaaccuggagcaggcug

SEQ ID NO: 8383 - RNA, 1811 nt, Mus musculus
aggucaugaaggcagcgagaacugugucacauucucccucgaggccaccacuggcuuuuccucgaagacuuucugcagugcuucuuuuagggacuuccuacuccucuuccuccucaggcugccuaccacaaaguagacaauuggguugaugcugcaguuuauaguggacagcauguucagguaggggagggagucccauacagaaucaucaagagaacuagaauaguagccgaugauaagcaacaccuucaugggcauggcgaagacaagaaacaggaugaccguggucaugaugaucacauagagcuuggucgguugacguggcuucagguuacagcagacuuggaugaagaggaucaaauuagagaagaucaugagaggaacgaagaccaggaaagucaagauacaggagaauauguacacguaucggcauucugggaauuggggcuucacuuccagaaugcagaagaaguuuuccaaaccagacacgagaacagagagggcccacagcagcauacaggccacagcggacugguguuuugggcguuggcacugguaccagauuggauaaagcacggagaggcaccgcucuacgcugauggccgugaggagguggagcccuguguuguagccaaagaucaugaagaggauggcguagcucucuaaggucauauuguagaugugaaaaguguucacuagcuucaugauggacgaacagaggaggaccaugaagucugcaauggcgagauggaggauguagauggugaauggcuuccucuugauacagaagauuaggaaccauaucaaaaggccauucccagccagucccagggaacaaaugaccagggagacuaagaaguaaguguggucauccguaugcucugaagaccaggugguuucauuugggguuuuguuucugguggguuguguggauuccagaggauacaaggucauugccaauggcuccauuccaggaagauggcuuucucuguggccuccugugaucagaaacagaagguggugaccggcgccaucuguucugcaccucagaacgguuuuguaucauggggaggcuucucucccaugcugagggacagggacgccagagucccccgcccucucuccucaucuucaugcccuggcucauucccccuuugucagcucuccacucagcagacgcuacugaaauguccacauccccucuacuaacacuagggcugacucccagccucagccuacaacaguuccucuuuggucacggcucucugggaaagcucucuguguuucuuaugucuaggaguucuuaccagaacgaggugacagaauuaggaguuuuaaagugauacauggcaauacauugaaaugauuuaaacuguggcuggggacacagccccaagaaaggaggaggcugcugcucuccuccugcugcugguugugguuugucaagugguugugagcaaaguugaugagaggaagaaacuggauauccugacaauggagaucaaacuugccuguaggaacucggggucccuaaucagcaggaaguagccuaaugaggccaacaccuccuuuccccucuaaccuucuuucuugccuacccagugcugugggguuugaaggaauggagguggagaaggugguggguaaaagaacccaauaacguagccaaaaagagugauugauuacauuugcagcccacugaaggaugagaaaaacucucaguggggcuuuccccuccuuucucuuuuccccauguuggccuggcuccacuugugguccugucaguacuuggaucugugcggugguucuug

SEQ ID NO: 8384 - RNA, 28060 nt, Mus musculus
acagcuugcuguacuuuaaugugagacacccaaggcuacggcauugcaccugacacuguuauaaauaagagggaaauccaaucagucaucaagggcuccagagugaacagcauuuucauaacuuccauguuuaucgucuuuacuuucuggguguaauuuucucugaucauuguuuuuuguuuuuuuuguuuuucuuuguuuuugaguuagggucucaccauauagccucaaaaucguuuuguagaucagguugacuuugaacucccggagauccaccuuucugugccuccugaauacuugaauuaaaggcaugcaccauuaugcagggcccccaaaaugauccauucaaaacauggggauucggcuucuguuacgaacuucaggcucuucacuuuaacuaugguugguucaaacgccccugcgugccugucucucgguuucccauugaucaaaucaagaccaauccuguagugaaagucggauucagugaccucuuccaggcugaggugggguagguauuccagcuguucuagucagaagacuggcagugccaacaagugugccucuggauuguugaaaggugggcagcaagcagcauccacguacuuauuucucugcuugacgggaugggauguuaccugcuucagauaucuaccuugacuuccccaaaaugaugacuggaacuggaacugacagucaaauaaacucuuuccucccuuacauugcuucuugucagugaguuugaucauaacaacagaaacaaagccagagcagaggauguggugagggcagccagcuucaacagaaaagccacaguuuacaauauguucauuugugaucguuucuaauaaacaauauguuacucagaugaaccugcugggagguaugcauguacuauggaaaucauaagcaaacuauaguagagauagcuugcaaaagucagcuauuuaagccaggugucacaccugcaugacuggucaggugaugggccaagugcacaacagccauccccuaagaguaucauggauagaaaguaccuacccaagggaugucccagcagcuguagucaggguggugcaucccuaacaaacaggacuacagccagcaugguaugcacuaaccuccauagccggaugugucgcugcauagcaccuacagucugaugggaaguagucuugccaguccugcacgcccagggcuacacuucaggaacauguucugccucugccucaggaagaugcaauggaguuguacaaaaagaaauuuaccaggaauaagccaagauuuauuuuuguguguuuguguucccacguuuguauaugcacauuugagaaccggagggcaucagaucccuggaauggauugugagccaccaugugggugcuaggacugaacccaaguccccugcaagaacuacuaguccucagccacugagccaucucgcuagccccauuucuaguuaaaugguggggugggcuccaugugaauaaccggagggagccaggggcaauggcugcuccugguggugguaagccagugcugggugcugcgaauugaacuccaauccuagggaguuuaaauagagaggaccagucugcucauagacaacuaaguuaaauacaaggauuccagaguugucagcgagaccggugguuacugaagggaugggguggacccgauguuucccuagagcugcugcaaaguuggguaagggacagaguaagcccacaaagggggcugaagaguggccagaguguaagggggaaauggaauggaaaccgcaugaaacugcagaagcaaaccagaauggcuauccuuucagaacacugggaguccguccggcagccagccugugagggagggggcaggggguggggagaauagccagagggagucugcaaaaggaagauguacauggaacauuacaagauuaaaugagaccaaggguguuccaucuuuaauuagauaagacauguucuggcagaaauaccuuccugcucagcauuuuuuuucucagauaauagugugugcccaagguuacaucugcuuucaaaaguuacacuuguaguuugccuugaguuaggcaacuauguaauaacaguguaaggcuaaagccaggugcuaaagccagguaugggggcacccagcuuucaccccagcauucagggaguaaaagcagguagaucccuaaauuccaggccaaccugaccuacaucguggcauaggucagcuaagggcuacauuauaaaaucacgucugagagagagagagagagagagagagagagagagagagagagaguuaaauuguugggaccugaguuaguucccagcccccacauagugacucagaaucauccuaacuccauuccagggaauccaaugccuuuuucugaccuaccuggggaacuaggaacauaaacggugcacauacauguaugcaggcaaacaaaaacucaaaacacugauauacauaaaauaaaucuaguaagauuuuuuccuuuggaaaaauauauauacauguauuuaugcacauauauauguaugcgcuugugugcgugcaugggugcguguguuuguguguguggccaagcucugaagugaagcacacuggcccuuccugucugaaagcccagccucaccccagccuguaggauuuagaguaguugcguggccucugcagaaauaacuucugcuugcacacauucuguggauuauuuggaccgcuugugggaggaccgauuucuagcaagguagagguaauuagaaaguccagacaaauucugacuuuggcugcagguguuuuaaacagccgugaucuguggcccuaagggaccuuuaaugaauaagaucuucagaucaccuuccauccucggccccugggguucuccucuagccaagaacacgacuuuuagcaaccaagugaacuaggguuuacagcgcccaggcacacuuggagaaaucucaaaguuccugcgaauugaccgacacuguauccuguuccuucuggcguguucgggaauuauagccagggcauuccagucccggcugaaucaucagagguagacuuuuagucacccucauuguuucgaaaauacacaaaaacagacagaaaagggauacagagaaagauuccgggauuguguugcaagcguucaaaguccacagcuugagacuucccccaacgcugaucgcucucacucuaacacccggaacccccaggucucuaucuaugucacacucuaagaccccuagaccuugcacacccuguucuucaccaucccugagcugaggaggaguggggaucaggggagcugcugagcaggggcggggcggggagggcggggcggggcggggcggggcggagccguugaggcuccaucuccaacucagccagaauuuagcaaaguuugcuucagcugcagccagggcugugcagacgccaggggagagcaacaggaugaacacaagauccgacccaguggucaucgucucggcggcccguaccgccauaggucaguguugcggaggcuucccaccugcuacccuacaggugcacagagaacccugccaacugccugcuugcaugccugaugguucaucugucacccugugguggcagauacuaguggucugaauuugggcagcccugggcuuggcaaagcacugauuuaaaguccccacccucccccucggugguccucagugugcucuugguucagauuccuucccucuuccccauuccauuguaggcuccuucaauggugcccuguccaccgugccuguccacgaaauggggacaacugucaucaaagaaguccugcagagggccaagguggcuccagaagagguguccgaggucauauuuggacaugucuugacggcagguaacuccucaguagcccaggacagaucugguucacuagaaacagcauuuauuuauaugugugugugugcgcgcacacacaccaccaccaccauacauugcuuugcuuggaguucucucugcuaggauucuuucugucccuccuccuuccucuggcugaagucacagcuccuuuacaagccuuuucggugagugaucuuagaccacgggacuguaucgccuuugcauuguuagaagcacagcaaaguauucacaguccuccacauaccccuaacaugucacacagucaauaaaagugugugggccuggcacugugccacagcugcgaguggggcugcagcagagcagcucuacccugguccacuuugucaggagaucagcugucccucacuccaggggacuguccggagaaaggcaggagagucuaagaaugcuucaucauagcucugauuccugcugggcuuggagaucagugacuacugauguugaugauugguuuggggccuggguguauagaucaguggugaaguguguggugagcaugcauguggucaugaguucccacuccugcccugcccugugcucccucagcacacauuugaaucaacuguagagaaaauuguuaauauucaauaccaaguucugcucuuacucugucugagaccauuuguaugugugccaguugaauauucuguauuuuuuuaauggguguuuugucugcauauaugucuauauaccacuugccugccuggugcuagcagaagcuagaagaaggcauugucuucccugguccuggaguuauagauguuugugguugugagcugccgugugggugaugggaaucaccacccccagccccccagagaagccaguguuccuaaccacugagccaucucuucaaaccccugaacauuuggaaaguuuuuuucuuuuuucuuuuuucaagacaguuucucuguguagcccugacuauccuggaacucacucuguagaccaggcuggccucaaacucaaaaaucugccugccucugucuccuaagugcugggaauaaaggcguuugccaccauugcccaguggaaagguucuuauuucagaauuuacaaccccaacauacuuuuauuucaauguauauuaaauuuuaaguauauguuggauagauguaauugaaauuauauauauauguauauuuguguguguguguauauauauauauauauauguauauaugauacauauaaucagcugggacccaguucuguguagaaauuucauuuaguauagacuuuacauauauaagcugaagguaauacaaaauauuuaugauuuuguacuugaacuaaauagugugcauccauguaaaggggcuagguggccuuucacagugaccuaacccuguuauacaccugcauuuugauuucugccugacaggaacucuacaguggcaucaucucagcauccagaaaguuccacauugcccagccugggggugcauggcuauaaccccagcacucuagagucugagaacugagccuuaugagagugaggccagccugagcuacuagccagccucuuugucaaaaaagaaaagaagggacagaaggagggagggagaggcuggcguugacacuauagagagcuuucccagcaugcacagagcuugaguuuaauccuuggcacuaagaaaaaggaagcuuuguauucugggucauugcugauuuugagaauaggagcgcuuacuugaccuguaguuucuuguguuguuuuaggucuugaaguuugguuuugauauuuuucuuguuaaaaauguuaacuuauuuauuuauguauuuauuuauauuugaaggaugcuacaguggauguauggggguugaaggacaacuuguggguguugauucuguccccucuccacacccuccacacacacacuccacacacacacacacacacacacacacacacacacacacacacacuacaggucccaggaauugaauuaggucaucaggcucagugucaaaugccuuucucacccagagagcugccucucaaguguuugauuuuguugcuguuguugacauagaauccaaaguuuauguguagcuaggauaaugaccuuacacuuuaaaguucuugauguuucugccuccagugcccaagugcuaggguuuugggcauucgccaucauaccuggaguucucaucuuuucugacccacuuuguccucauggugcuuaaacucuggguugagccacaccucuuucucauggccauccaaggucugacugugaugccaucagcugucugugguccaccacugcccuccuccccucuucccagaccagugacucagaacuuuuccaugugucaaaagacaucccaucauuugguaaucuaagagucaucugguacuaguuuuuuguuuguuuguuuguuuuguuguugguuuuucgagacaggguuucucuguauagcccuggcuguccaggaacucacuuuguagaccaggcuggcuucaaacucagaaauccuucugccucugccucccaagugcugggauuaaaggugugcaccaccaccgaccggucuccuauuucuuuuucuuucuuucuuucuuuucuuuuuuuuuuuuugagacaggguuucucuguguagcccuggcuauccuggaacucacuuuguagaccaggcugaccugaaacucaaaaaucugccugucucuaccucccaauagcauccaucuccuuucuuauuucauuuaagcauuuguuuguguucuugaauauaauuauaaugauuuccuaugucuggagugucaucuaacucacuaucacuauauacguuguuuuaugaaguacaacaaacuccaagcuuaucccugacuagcuuacaaaugaaugagacucggccuaugguuauuuuacucggcuuugacaauuacuuggggggcaggggguaaucucuaaucuauucuucuuuuuuucuguuuuuuguuuuuuuuguuguuuuuuuuuuuuuucgagacaggguuuuucucuguguagcccuggcuguccuggaacucacucuguagaccaggcuggccuccaucucagaaauccaccugccucucccucccaagugcugggauuaaaggcaugcgccaucacugcccggcuaaucuacucuucuaacugcuggccaggcuacuuccccaguggugagccccagauacaugcuguuucuugugaccaugucaucuucccccauggcagcuucucuccucucccucuccccucccucucccguccccuucuccuccccuccucuucuccuccccucuccuucuccuccugguuucuccuccucugaccaggucacuccaaacccacccaccucuaaucccuccaguaauugguuguagccaauuuuauuuaaccaguaguuuuaaaucaaggaacguguuugcacaacacaagcuuguaaaugugagaaaucgcugguaaguauagaauuuagcauuacacuccacagcaacgcuccaaaucucagcaaggggcuggccuuuggagggcuaugucuauguccuguauuggugaucgagguaucuggcguuauuuguuuacuuaccuuuuuuuucuuuuuaaaaaucagcucuauucuuucaguugaaguauuugcaguguucaagggggacuuggagguacuaguguugaguguguaguucugaaaacaauuacucaguccagaagcuccggaugcugggcaaaagaagcuuuauauauucccuaggagggcaacaacuguucgcuagaaucauuaagcaauuauuauacuagccaauuaguaacaguggcacuuugacuucaauagcauggagaacaaacaaccacggauagcauggaauguacuagacuccaauuaauaagauuaggaggggggagggaaguaggguggguaaagauaaaggacaggaguuaaaugaacccggagaggcaagcaugcguaggaugacauaagcauucagguggacuuugagaaggcagaguggguaaagauuaagccuuaaauugacuuuggaaagagagggggaaaaaaccuaauagcuaagaggggaaaguugagacuguuauacuccacagauguuagcuucuguuaaagcuacagaagguuauaauuaagaaguauaaaagagaagagggcagggaugagaugggagaaagggcauaggacuaggaaggguggugcaugaggcauguccucagaguggaguagagcaaacugggugaagaaacccaacaaaaugggcuggagagauggcucagcgguuaagagcauugacugcucuuccagagguccugaguucaauucccagcaaccacaggauggcucacaaccaucuguaaugagaucugaugcccucuucuggugugucagaagacagcuacgguuuacucauauaaauaaaaauaaauaaauuaaaaacaaaagaaaucuaacaacaggccaaagaccuaauagccauauacagaacaaacaaaaccaucauuagacaugcaagaauaaaauuagagacaaagaauacuggcacagcugggcugagaugaaagaugaacaagucugagaacauacggagcaggguauguggucagcaugacauugcugagucaaacuauuuucugugucaaugacuggcaggcaugggacaaaauggcuucagcugugcuaaaggagccucaggagagaugaagaugcacuguuuauggaggagggagcuucucucugagaaaaccuauaaauuguaauguaaauaucugagaugcagcccccaaagaggucucgacccacagcuugagaaccacagacuuggaggcuucuguguuccuuguguuccagguugugggcagaauccuacucgacaagccagugugggugcagggauccccuauucgguuccagcauggagcugccagaugaucuguggcucgggccuaaaagccgugugucuugcagcccaguccauagccaugggcgacuccaccauugugguagcuggaggcauggagaauaugagcaagguaagugcagaggugcugcucaucacccuggccaccuagagggcagguccugcugaggaacccacaggagaugacucagccugaccccugacugaaugcccacugcucuucagguuggaucagaaaucccaugugaagaacagucuaucagccaggcagcuggaggagaacauacuuucucuaagcaguuguucuagaagcauacagugcuuucugaaaugaacccacaagaucauuugguugcuauuccugcuugucauguagcugaggcuagcccaagacuugcuauguagccuaggcuagccuuaaaugcuugccucuccugcucugcaucuagagugcuaagaauaucuuuggauauuuuccaacucaucuaaacuuuuuaaguugucuuccuuaaaaaucuuaaaauuuugagaaagcuccuuuucauuaugcccaaagaguuaauaaacaugccagguacagcacauucauucugagaacacaagaaagguaaaagauaauacacaggcaacuaacuucugagggugucauucuuaggaaggucauuaagacccugagucauccagacuuauaauucagcucucuacucauuaucaacgaaugaaaauuagaugaugcaauaaaggucaugacuauccuggugagguucccaaauuuuccacuugagaugcugucgauggugaguuguuucccaucaugcacuacacuaauucuccacuucuuuaaaaaaauuucaggaugggguguggugugguaguguacaacuuuacccucaaaacagaauuaauaauuacaauacacgaaauaaaaacauuuauuaccccuuuuaugggggacggcacaugcacccacacuuauggaggucagagaaugacauccuggagaagacucucuccaucucaccagauggggauugaacucagcucaucaggcugggugcaagugccugugugcacugacugagccaucucaccagcacugccugcuuacauuucuuuuucccugugucuaaaaccuauauguguguauguauguguauauauguguguauauauauaugugucucucuguguauauauauauauacauauguauauauacauacauauauauuguuuguuugucuguuugcuugcuuuugaaggcaagauuuuucuguguaguccuggcuuuuuccuggaacucccuauuuuuuuuuuuaaagauuuauuuauuuauuaaauguaaauacacuguagcugucuucagacaccccagaagagggcaucagaucucauuacagaugguugugagccaccaugugguugcugggauuugaacucaggaccuccagaagagcagucagugcucguaccugcugagccaucucuccagcccccggaacucccuauuaaaccagacuacuggccucaaauucagagaucuaucuuugccuccuaagugcuaggaucaagggugugcgccccaugcccuauccucccaccccccaaguuuaguuaagauccuguguagcuugcacuagcauggaaaucccuguuuaccaggcuggccucaaauucacaaaaaucuaccuaucccuguccacaauucuggcacucccccccccccacacacacacacuuuuguuuuugaagugacuaaauguucuuugagugggucaguggaacauaagcugugcuguuagaauccuaguucauccuccacugaacuucuagagagacugucccacggcugaaaguauagggcaacugaacccaaacaagucagcuaggauucuuugaacugggagcuuccuguucuuagacucagcucaauaaaucagggcacagcccaucccuacaaaguguucuucuaauuuugaccuggagccagagcccaggauaauccaggccaugaucugcacacagagcacaaggaucuucuguugguguaggauuugcucucuuaguggacucuuauuccucuacuccccuuccacccuugugcaccagcaucccuccaacccccuacugcuaggugggagagaaagaaggccaggggauaggagacauggacuucuuuugacugcuuccugcugacuccuuagggcauugaguuccuuagggcauguccacuuuuaucuucaggauaugucccuucaucucucauauaucuucucaucagaccacaacaacaacaaacagcagcaacagcauagagcaggaggcuccucagaggauacacaugcgagagcgcgcgcgcacgcacgcacgcacgcacgcacgcacgcacgcacgcacgcccacccacccacccacccacccacccacccacccacccuaccuaccuaccucuuggggcucuggaauuuauucccucuucagaguccacaaaauuuaacuacuugcagcuggcaaaaaucaugcaucuucuagagcgcaagacaaucauaguuaacagcugugggcaaacugaauuuaauuccauaucccaaaccuagaauuaaaacaaaaaaaauucacauuauauaacuuauuuuuuguuuguuuguuuuuuguuuguuuguuuguuuuuguuuuuugagacaggguuucucuguauagcccuggcuguccuggaacucacucuguagaccaggcuggccucgaacucagaaaucugccugccucugccucccgagugcugggauuaaaggcgugcgccaccaagcccggcucuauaaugguuuuaaaggagccaaaacuuucacugcaagccuccucaggacagauuuccacuaccucagaucccagacuggagggagacaggaaucaggcugagucaguuuggacuuguuuucccacugugaagaagagucaagucacacauugccaguuuuccuucuugucaugguucuuggucaggacagaccccaggggucagacuucugaucucuuaggggguagguagaacacguaaaagacaccuguggugaagcaugcaggcccaacuguucaggagcugaggcugagaagcacgugagcccugaugcucaagaccagccugggucacauacaaguccuugucucagaaacugaaagccuccucccggccccccugucuugcuggcacugcagcggaacagcaucuuccuccuaugcuggagggcugaccuuggaauccacuggucagaaaccuagugagcucaacuucugcagagcucaggaggaggcaggcuggaggucacaaagugagcggagucccucugguuagauguacauaccaguacccagggcuguugugcguggucaccagauccaauauggagucagugcuguuauucccaauuuccugugggaauaacagagccacaacuuaaauguucguuuuuguuucuuugcuucuuaaaaauaauuuauauacaaaauuaugaguuuaauuguaucauuucauuuuuuuuucuuuuuaaguguguguguguauguguacauaccuacagguaucccuuggagaccagaggccucaaguucccgguguuagcuagcugaccugggugcugggaaacgaucuaagguccucuggaagagcuguagaagcuucuaaccugcagagccaucuaucucuccagcccccaauuaucauuuuauucauaguauacccauuuauaguacuauaauuaauucaccugucuugacuccuuguccauucaucuuuccauuguauccuggcugccuuugaauugcugaauguuaaaaucucuucuacucagaaacccuccucucagugcauuuuacagccugaauauucuccgcgugggcauuuugucuccuaccaaaacagaugcuaaaugugcuggagcgacaggacuguuggggauugguucuacugcuuugaauuaauccggccccuaaaaucaggaaucuuuguguucaaaugcugaagguccuuguccccaguugguuuuugaucaaucaauaaagaccuaauggcuggucagauaaacaaaggcaggacuuuugaaauuugccugggcuaggaaccgggagagaggaaagacgacagaucagauuuagagcugcagaaggaaauucauccaaaauguauguggaagggauaguggccugcccuaugggaggggcugcccagcagcagguaagagggcagcaaagauaaaacauagauuuagaagguguugagccaggaguaccagaggaaaaugugugcuagcuguguggacaauuagaacugcucagccugggggcuggagagauggcucagugguuaagagcgccgacugcucuuccaaagguccugaguucaaaucccagcaaccacaugauggcucgaaaccauccguaacaaaaaaaucugaugcccucuucuggagugucugaaaacagcuacagugugcuuacauauaauaaauaaauuaauuaaaaaaaaagaauaaauaaauuaauuaauuaaaaaaaaagaacuacucagccuuugaauuagucaggcauauuaaaauuaacugguguguguguguguguguguguguguguguguguguguguguguguguaugugucuuuuauuaggaaauccauauagcuccugggcgaguucauuaguuccacccauguggaucucagagagagcuaacuacuguaacacaagucaguggugaagagccugugccauucuugcagaggacccaaguucagguccuaacauccauguccugugccucccaacugccagcucuaaggcauccaauacccucuagucucuuuagcacacacucccauggaacauguaaacucauccagcccccccacccccaacaucuuuuugaaaguagaacaggaguugcuagguuucuaugccauccuguuagguaauacuugucuaucuauaaggauauaauagaaucauaagaauuaaggcacagaauggacagguuugaucaagaaacaaaaaugggcaggugauagaggaauagauggcuaagagaaggcaggugggauugucugcuaacaccaagauguuucagguccugaucuggagagcaggggauggggagaaggccugauggguaaugaagaaggaggaaguacaaggcagagccuccugacucugagugggacccugagagacaagugacaccccuccuaaaucuguucuuccucccuguguccaggcuccucacuugacucaccugagaacaggagucagggugggugaggugccacuggcugacagcauacucugugauggucugacagaugccuuucacaacuaccacaugggcaucacagguaaggccgauaggucucuaaagcgcugggcucuaaggucugugccaccgugucugguaaguaaagguauuuucuuaugacauaauucccaugauuugcugauuaguuuuaaauggaaagauggaaacuuuucaauauagagcccugagcugguauggugauagauacccauauccuagaauaagagugacagaggcacaugugagugagcucuggcuagccugguauacauagcaaguuuccagcuagcaauaaccucguaaaacaccaccaccguacaaaccuggcacauacaacuuauguaagaaagccagcacugccugagaagagcagauaauucucuacucugccaguguauucaugucuuuacuguccgcgguuaugaggaaacaggagcaauguaacagagcaggcagcccuugcucuuccaaaacaucacacuuagagauucaaagugaagugcaacagccacgcaagcucuggguccucaaccaugggaccaauuacuguuuuguuuaguuucuuugagacaagguuucucuguguaggccuggcugucauggaacucauucuguugacugggcuggccuuggacucaagagauccaccugccucugcuucccaaaucuuggaaugaaagugcauguacccugcuucuggcuuuuguuuuguuuuguuuuguuuuucgagacaggguuucucuguauaguccuggcuguccuggaacucacucuguagaccaggcuggccucgaacucagaaauccaccugccucugccucccaagugcugggauuaaaggcgugugccaccacugcccagcuguauacaaguuaauucuuguuuaaaugugaguaacccgagcuaccaaagcccagcucaugaauuugcuguuuuugccuuuucuucuucucagcugaaaacguagccaaaaaauggcaagugagcagagaggcccaggacaagguugcaguucugucacagaacagggcagagcaugcucagaaagcuggccacuuugacaaggagauugugccagugcuggugucuuccagaaaaggugagcguggaggccacaguuaggaugaggccguguguaggcacggaugacuccugugaggaugauagggaggcuugguggauuuuggucuuuaccgcuuguaaagguguaggcauuauacaucugaaugggggagggcagguugggauguguugcguucugagacguggucuugcuguguagcugggauggccuagugcucacuguggaccaggcugggcuccaacugcugggugauccuccugcuucuuccugaugagugcugggauuacagguuguagcaacauccuugucuggaaaauacugccaccacagcaggauacggucacaugggaaacugucaucuucaaguguccacagcugcaguguguaucccauggguuucaugagaaauggagcaucaguuugugguugucagaagaaaacagcuuuccaaaccuuucaggaauggcaucugaucaccuaguugaucuugcaugucucuuaaauucacauucuaaaggggacacuuuuaggauaucugucugucuaucucuguguguauaugcacacaugugugugaauacccuuggaggccgucuaaaggccuuggacccuaggagcuggaguuacagguguuuaugagcugcugaagaaaugcuaaccagucucuagaguuccuuaaggacacacucaccaugaucugaagcagaaucugacauugguucccagcucagacaaggugaauugcuccacuucugacccacucaguuguaccuagaugaaugaaugcacugacccaaaccuguguccauacaauacaaagagcugcuguccuuaggaagggcugaggauuugaaacacagggugagcgacucaugaagaguucucaugggagagcaugcaguaauucuagcaauuccuacuagaauggaaguggguaaauggucauagaccuuucuuccaaaugucacuccuuguuucugagaaguccccagucucagaacucugccuucucuguacucauuccaaguaacuggcuuugcucucugcaggucuuacugaagugaaaaucgaugaauuuccccgucaugggaguaaccuugaagccaugggcaagcugaaaccuuacuuucuuacugaugggacaggaacugucacaacugcuaaugcaacaggugugaguucugaggggcacugggggaaauaccaacucuguggaggucuaccaagugaauaugucuuucuacacaacaugauuccuuucuguuuuuguuuuuuguuuuuuuguuuuuuccagacaggguuucucuguguagcccuggcuguccuggaacucacucuguagaccaggcuggccucgaacucagaaauccaccugccucugccuccagagugcugggauuaaagggcgugcgccaccaaugcccggcuacaucugaauuugauguuggccugguuuacaaauugaguuccaggacaaccagacaaccagagcuguuagagagaaaacgucaggacacucaccacccccacccccaaacuaaaacaccuguacuuccagcacuugaacggcaaaggcaggugggucucugugguuuccagguuacccuggucuaacagaaauguaggcuagucaggaacacauaguaagauacugucugaaaacaaaacaaagcccuccaauguucauccacuucauauuucuccaauuccaggaauccccaguaccugugaccuaggcuuguugguuuucuuugaucuucauccccauaagcacacaguuauuuugggacuaucauaauguauggccacuaucacauuugacuugacuauuucuaacuucacugaagucugauggaucacagcaaacagaacccuuuggcaagaugucaguagcuuaaugcuugcaggugggcagcaggcccuggguccauaccugaagcaaaggagugcuguagacaccaggucauuuguuuucaggaaugaacgauggcgcugcugcugugguccuuaugaagaagacagaagcugagaggcggaugcugaaaccuuuagcaagaauagucuccuggucccaagccgguguggagccuucuguuaugggaguaggaccaauuccagccauaaagcaagcugugagucucuuuagcaauguguguguguugguggagaugugugacaggguuuggggaagcccagaguguagaggauggccuuaaauuucugcucccccagcaguacucucagcuuaccuuuaauaugcuuuucugaggguacaguguuguucugcacuaagcucucuuuaacaaaccuuuccacucugaagaugugaggaugugcuuuguuucugcuaccagguuccauuugcuaccaccuagcucuaagaccucccaccccaacacagggauuccaagucuccauggcuggcucucuuagaggauuggccucuggugccacguaaaauacuucaucuguagucacuuugccaguucaagcuuuuuaaaaauaguguuguauuaccugcaauaacaagacaguuuggacuuuguaccuuagggccauuuuuuuuuuuuaaugacacaggguuucucuguguagcccuggcuguccugaaauccgccugccucugccucccaagugcugagaucaaaggcgugcgccaccacgcucagcaccguagggacauuuuagacgccauccuuuugaggcugagcuuucuuuguagcccaaccuggccucaaaugagaugucuccaccucauaaaugcugagaguaagggugugccacuggaccuagagaagcucuacacgauggaaucacuaaagaagcccacuauaaugcucuuuugggaacauuaugcuggcuucuuagauucaacaccccggcagugguggcacacaccuuuaaucccagcacuugggaggcaaagucaggcagauuuauuucugaguuugaggccagccugguuuacagagugaguuccagaacagccaggacuacacagagaaacccugucuuguaagaaaccaaaaauaaaaaaauaagauucuucaacccuuguuauagucagggcccaaucuuguagcugucaauuacuaaugguuuaauuaaaguuccuuuuguuuuuuuuguagguugcaaaggcaggcugguccuuggaggauguugaccuguuugaaaucaaugaagccuaugcagcucucucuguugcaauagcuaaagaacuuggacuaaaccccgagaagguaaccaacaugaaguuguguuugccagugaacuugcacaauccauguucaaggcugcuucugccagguguugacuuuucacaguaaauaacugaguguguuaguucacaucagaaucagugggacaugccagaaacaaaaaaagacagcaggagccaggcagugguggugcacgccuuaaauuccagcacuugggaggcagaggcaaaggcaggcagauuuauuucugaguuagaggccagccuggucuacagagugaguuccacgaaggccagagccacacagagaaacccaggaggugucacauaggccuauuuauuccuaagguuuacagugaaaguugaguuugaaaggaugguuugcuagcauaacacugcggggagacauauaaaacagucaguucacagaggacugacuuaggcucuucuucucuauaggucaacaucaauggaggagccauugccuugggccauccucugggagcaucuggcugcaggauucuagugaccuugcugcacacccuggagagagugggcgggacccgugguguugcagcccugugcauugggggugggaugggagucgcaauguguguucagagagggugaacugcaugacagccaccaccuuggacaguucuuguuaaaucagugcaacacuaagcagaaagggaaaccagaggaccaaacugaggacaggaacccagguggucagcuugcuguacuuuaaugugagacacccaaggcuacggcauugcaccugacacuguuauaaauaagagggaaauccaaucagucaucaagggcuccagagugaacagcauuuucauaacuuccguguuuaucgucuuugcuuucuggguguaauuuuaucagaucaucaauccgaaggauggugauugcagccucuguugcgaacuucaggcucuucacuuuaacuaugguugguucaaacaccccugcuugcuuguugucucgugguuucccauggaccaaaucaagaccaauccuauaaaggugaaaacuggagucagugaccuaauuaauguggugagguauuccagcuauucuaguccaaaagacugugggaguuacaacaagcuugccucugggagaagaauagcugacaguguagcagggaaaccucaucuaucgaacacuuagcaaauagugacauguugcauacuguucugguugguguaaauaugcuuuaugaaucuuuauaaacaccagggugucuacggauacaauauucugaaacuguauucacuguaagcugagagcugccuaaaaugagaaagcccuaccccaauaucauccucucggcccuuucuauagacuacccaaggagucagaaugggaccaaguguugcgacaccuagggcagagcacuaaaacuuaucagccaccauuauguaaagauguuaucucgaaaacgaugccugugauguuucaauaugugacaagucccuucauauauuucccaaacguggagggagggacaaagguacuauuaugaacuuacaauagacccauggaaguugacaauagaacacaaggaaaucauauacucaccacuuuagauuuuuacguuccggguucacuugagccucauugugaaaagcucuuaacuuggcaaccaggucgguggaguccugggcagcauucacugccaguguauuaggaaucacaagcagagaucuugcaaacucugcaauagcaagcuguucccgagaucccuaaggaagaaaccaugaggugugcccaugaaaggagucaaagccuacagcgggccugacaggguaaaacccuacggugaacccaacaccgcacccuaugccuuugaaagcagccuuaccaugcuuguugcauaguuuuccagguauauggacagggcagcuucuacagcaccuccaccugggaccacagauuucaacuccaaaacucucuucaccacacaaagagcaucauguaaagagcgcuccauuucaucacacaugaaaucauuugcuccucguaagaugauugaagcagauguacgagccuuaguacuacaaaaaacaaacgugaggcuauuagcauuuuuguuagugaaaacaguaacugcagacacguugauuaaaucccacuaauaagauauuuagacaugccgggcaugguggcgcaugccuuuaaucccagcacucuuaacagaggcagaggcaggcagauuucugaguucaaggccagccuggucuacaacaaagagaguuccaggacagucagggcuacacgguaaaacccugucucaaaaagacagaaaaaaaccaaacaaacaaaaagaaagguauuuaggcauaaggcaccaggaacaaugucuagaccauguacgagagacaaaacacauuucaucuccauguacaauggcccaauauuguuuuaucccaugcguauaaccgcuccuaucacugacagacuagagcagcaaauuaaugggaaagaauuauuuuuacaacacaaucugcauugcucuguaacuuacaaaagcacuucuuacuuuuugauuaagaucagcucaucaucacaaauucucuccuguacgaccucuuccgcuugucccaacaucgucacuucaaaaguuucuucgccuuccaaauuggccagcguagacaggauacuugcuauaagagucauguaagauacauuuuuuucucauaguuuuaguauauggaaaagcagugcauuaucucaagguuccagacaagccacuaccguaacccaagacaauacugccaccuucaagguaaaaauaccuuaguuuacucauuuccaauaaauucagcaucaaagaauguuuucaacuaccuagaaaauggcucuauaaaucuauuagagcacagcaaagaggaaaaauauuucuaaaauuuagugucaauauuucacuccaacccuucugacccagugacaucuaucucuaagcagccgcgugucccggccaggagaggacguaccuccagaagcuuuugcaacaugcuucaggucucguuuuaaaacucuccuaacagccauggcaccagcuuccacaaaauacuugagauacauaucaucaaugccaccagugguuagaauaacauuggcaccaguugccaggaucuucugaauucucuccuuggugauauccgauucucuacagagaauguuucaauaaaccaaaauuagcaacuucagguuuuuaaacaaugcaguguuaucuuucacugguuauacaugaaauuacauuaacuauucuuucucacuaaacccaaagguuaagucaguccaauuuaugugaguuuccaggacuugaaaauaacuuuugcucuuucuauuauuugaguuccuaagggcaguuuaaaaagaaaaaaauacaaaaaacacaacccuugcaccuucuaucuugaagaugcaguagagauuuauuauuaacaaucucaagacugcaucacuaaagcuguaugaagccaagauaagaacaagacagaaaaucaagccccacauagugggauaagaaaauaguucagaguugaaccaacagaaaaauauugagauauguaaguauauguuaaaacauagauggcaaagaugcuuauguucugagacaaggcuaugauugucaaaauauuucuuucaaacgggccuaaguuguuaucaugaaaaugacuagaaagaugaaagacuucagagacagaaaccagagguacagaauguaucaaggacagauacagcaagacuccugaaguugggcuggccucaaacucagagaugcaccugccucugccucuuuggacauaugugccaccacugcuuggcuaauuugugggcauuuacaaaucaagaggcagucauaugauguacuauggaauaugagacaguaaaugccuauuuaagcuauguuacauguauauaacagacauauuauaaucacacaacagcaguccccugaaaguaagaggaagugaaagcugucugcuggggugaugucacugcagcuacagucagcacuguguacuaaugugcuacagaggcagucuuaaguggacgcugucauacacaguaucuaacacuugauaguuuguacuuauuugauaucaguuuuguuugugacaagaggcuauaccaugaugcccauaauccuugauuuuacuuuauuauuuaucuuuuuauuuaugaguacacugcagcugucuucagacacacacuagaagagugcauuggauucuauuacaaaugguuguaagcuacuaugugguugcuaggaauuaaacucaggaccucuggaagagcagccagugcucuuaacugcugagccaucucuccagcccuuauuuuauuuuacuuuaaaaaaaaaacaaaaaacaaaaaaagaacaugccucuucacuuaccucugucuaauuugguccaauuucucagggucuguaauaaccaccuguacaccaagcuucauuuuuguuuucugcaggcugaagucaagacaagcaauuuuugcauuaacuauucucuugggcaugccuauaaauaaauaaaaagguuaguuaauuacacuaaaccuuaaaguuuuggucccaaaugcacauaauuccuuuuuuccuuuucuuuuuaaaugcaagguuucacuagguagacaagaauggccugaaaauucagagaccugccugccucucauaacuuaaugauagaaucaaaugucugagccucuagcccagcaccuaucacaacauuuagaacucauuaagaguauaguauauaaaccagagagugacucugauuuguaaauaacagaaccccacuuacccugagauccaaccacacaauugagcgcauagccauugaucagcaugcuuucuaucugacuucucccaugggcuuucagaauauuaacagaauugacuggauagcgaggcuggccucuggcaucuguguauuuaacagcaagcacagcaucuacuaccauauuagcaaaguaaucaccauuucugagacaacaguuaaggauagcugaaacaacaaaacaaaaggcccagggaccaaaaagcuacucaacuagacuuacuuuuagcaaaauaauucaccagugaggaaaaguauuguaacuacaaucaaagugacuugugcauauauaccaccaccaucuguacuucaaaugcaguuuucaccauagaaauguuggaaaggugguagcaggaucaguuguuucucucuaauaagaucaauuugcaauaaauggcacuuuaaauuuuacugcagaaaacuaauauuccaaaaagucauuuuuuuuagagcaaaaggaguuagggccaaacugcacaggaacauucaaggauacauuccaauaauuuuggaugacauggaugucuuagcagcauugaucagacagucucuuccaaguucgucuguguuaauaaucagguucucauugauauaacgcaccgcuucccuguuaagaauguggaaaagaaaaauagaaacacaccacuccaaaguuuugcaucucaccacauuuaacacauugucaaauaucacagggaaugguuucuguucagccauuucauauagaggaaagacacaggacagcucccccucuucagaucauggcaccuuucaucuaucccauaagcauagccacuaaacucuauuaggagaaaaaugugguagucaaaugggaaaaguacacggagcuuaguacuccaggugagcacuugaaugcuaagaugcaacaguuccaacuuaacgcuuagcuacaacauuaagauacaauuuacuacuauuccacaaaauaacauguuuuugaaagcaaucuuacuugcaggcaagacgauagccacuaauaacugauguuggaugaauuuucuguuugacuagcucaucugcauuuuucagaagcuccgcugcaaugauuaccuguugaucaagcauugcuuuaaauaugcauggcacucaauaugcacaacaggaaaacaugauuauuaagcagguauuauuaauaccacaguagacaagugaguagcaacucguugaaaacacaacauagagaccacuaggaaguauucugugccaggcgugguggcgcaugccuuuaauccuagcacuugggagguagaggcaggcggauuucugaguucgaggccagccuggucuacaaagugagcuccaggacagucagggcuacacagagaaauccugccucaaaaaaccuaaaaguauucuauggaaaugguccaagcuggaaaagccagaaaaugcuaaaaaucuaauacagcagaauuuauauccauuacauuuacagacuuacugcaacaagagcuagauagcaaucaauggaaaugacugguaucauuccaguaauuucaauaaaaucuuaagaucauuuaaaauagagaacacugugaaaaaccaguuuucuuaauaauaaaacaaaacaaaaucuccaaaaaacuuuucuucuuucgaguggaauuaagguuauuuuuaaguuacauugucuaugaacaaauuagauaaaguccauuuucacuauuuaaaaacagauucaauucuuuccuaguaaaggguaagucuauaaauacuuuucccucaccauuuauuuugccaggucuaaaaucugccucaccaaacaguauuuuacuacuuaagcaggcuaacucacaaaauguuacacuauucgccauguuugcugacuagccauuagcacuauaugguagcaaauuaacuucugcaaauuucuauuuugaauuccaaagauuucuuguucacauuuaaaauacaaaaguaucuauuaaacaacaaagaaaaaaguccaaaccugguaacauuuucuacaugaacaucaucaugguuaaguagguuuaaauaaggcuccaaauucacgagacuccaguauuuaaaacaagcuuguauuuauuuaaucaccuuaaguucuucccuuacuuaaauuacacaaacuaguuacaaugguuaguuuucaaaaguuugugagacugccuuaaaaggugacuuauuucugaccuagaguaugacucucucauggauucaacucuaauaaauugacuauucucuagccauuuccugguagcgucucaccacugagguaguuccaucuccaacuucuuugucuugcaggucagccagcucacacagaacuuuggcugcgggauguucuaccuccaguaacuucaggaugguggcaccaucguuaguaaugguuacauccuaagaaauaugaaggaauaaguggucaacacagaaaccaagcucuaggaugccauccauacucagguaaaaacaaagacuuuaccaaagauuuuuuuuugaaauuuaaaacaauguacuuuuaucaaggcaagcaagagcaauuagauauauacuuacaccaauaucauccaccaacauuuuauccaagccaacuggcccaaaagaacuuuuaacaauguuggcaauagaagcugcagccauaacuguagaugaacagugaaaacuaauuagaacaacacauaaacuaugacacucaacuaccuaugauuugcuaaaaucuaaagucuguaauuacuauuuaaaaaaaaaaaaaucaagccggguguggcggcgcacgccuuuaaucccagcacucgggaggcagaggcaggcagauuucugaguucgaggccagccuggucuacaaaguugcuuccaggacagccacagcuauacagugaaacccugugugugugugugugugugugugugggggggggggggaaucacuuacuuaaggaccagugaagguuaacuauucuuuuuucuauuuaguauugguauaucaccgauugcaaagauuuuaaugccucaaauuauaagcaaucuuaaguucauuccuuacuacuacacuaggggggaaaaaacccuuuaaguucagccuuucucuucagacucuggcaaguuuaguaagaauauuagauaguucaccaggauaaaguaguaguaauuucuaagagaguuguuuaaaaaaaaaaaaaaagcacaacacagaacacgguuccugcaagggaaugcuuucaagaacaaauucaaccacagcaaaccacgugcuuacucguauuaaaguuaaccacgauaaaggcagcuaaaaguaucgcuuaauaacguucaguuugcauuccguuacguuuuacugggggagcagcugucaccugcagauucugggcauccaagaaccagaccagggaagggaagcaacgcaaaagccaccuagauucuaugagcaucuucucaagggccaauggaaccggugaaagcuacucuuuucuggcuaugucagaggugcuccaaccggcuuggaacccaacaaaggagcagaggggaguggcggagaagucuaucuggagcuccucuacuagguauuggggcacggacgcccacacccaucuugaacgccucccccaaccgugugcauucucgaacauucuucccuuacacgguagggcgcaauggcgccgagccggccgcuagugagggcggauccgggauggcugggcuucuccugaaggaacuucacugggcccggcggacagccccggccuacggacugcggcugggcuucggccugcgccgccgcgagcuggacccuuaccauucucucgcccuuaccauucugggagcggaccgccuccccagugcugcgguccccgaacacggacaaaggacccuccaucuucaggaaacgaagcaaagcucacuacggccgcagacaaccgauagcuccgcucugagaccguuuaacggccaccacggcggggaccacggcguggaaaggcccgagcgaugccgcggggccugcuggguaacacgcccugcgcgcucuccacgcuccaccaaccgcaaggucugccgggaaagcgguagggauugacagacgagggcugggcggggcgaaaaacugaaaacgccggaaguagggggcugcgggacgcugggucaacuagagacaguagaagaaaggcgcgaaaguggaaaacggaagucaggcucuuggccacggcuagcgugucccgcccuccgccucaacgucugcggugauuggugagccagggauaccgaucgcucacucggccacucagcaccagggagcuuguuaguuccggguccuugagacaccgagguacugccggcccuuguagcuuuacccacaguuaacauggcugcgacuaguuguuccccgagacgacccugagcaaaggaagauagggcacugugugacuuugcccaggucccgucagccauggcgcuucggccgcgguucuggaaaugucugucaguuugcaggaaacuggguaacuaaucucgccccaccuccuugccugcgcucugugcacaguacgugugcauuugcaaaugcgauuuuguaccugaugugggaaagugaaagaugcaugugaucuuuuucauuuucuagaguguggguucgcagcccucucaaccaguuccgugccggccgugcagcccgacguggagaguaaggaaaacgaagcgguggccccggaguucaccaaccggaacccucggaaucuggagcucuua

SEQ ID NO: 8385 - RNA, 17862 nt, Mus musculus
guucaucugaguaacauauuguuuauuagaaacgaucacaaaugaacauauuguaaacuguggcuuuucuguugaagcuggcugcccucaccacauccucugcucuggcuuuguuucuguuguuaugaucaaacucacugacaagaagcaauguaagggaggaaagaguuuauuugacugucaguuccaguuccagucaucauuuuggggaagucaagguagauaucugaagcagguaacaucccaucccgucaagcagagaaauaaguacguggaugcugcuugcugcccaccuuucaacaauccagaggcacacuuguuggcacugccagucuucugacuagaacagcuggaauaccuaccccaccucagccuggaagaggucacugaauccgacuuucacuacaggauuggucuugauuugaucaaugggaaaccgagagacaggcacgcaggggcguuugaaccaaccauaguuaaagugaagagccugaaguucguaacagaagccgaauccccauguuuugaauggaucauuuugggggcccugcauaauggugcaugccuuuaauucaaguauucaggaggcacagaaagguggaucuccgggaguucaaagucaaccugaucuacaaaacgauuuugaggcuauauggugagacccuaacucaaaaacaaagaaaaacaaaaaaaacaaaaaacaaugaucagagaaaauuacacccagaaaguaaagacgauaaacauggaaguuaugaaaaugcuguucacucuggagcccuugaugacugauuggauuucccucuuauuuauaacagugucaggugcaaugccguagccuugggugucucacauuaaaguacagcaagcuguccaccuggguuccuguccucaguuugguccucugguuucccuuucugcuuaguguugcacugauuuaacaagaacuguccaaggugguggcugucaugcaguucacccucucugaacacacauugcgacucccaucccacccccaaugcacagggcugcaacaccacgggucccgcccacucucuccagggugugcagcaaggucacuagaauccugcagccagaugcucccagaggauggcccaaggcaauggcuccuccaucgauguugaccuauagagaagaagagccuaagucaguccucuguggucacagccuaaugccuguuuuauaugucuccccgcaguguuaugcuagcaaaccauccuuucgaacucaacuuucacuguaaaccuuaggaauaaauaggccuaugugacaccggcugucucucuuguuucuagacugucccacugagucugaugugaacuaacacacucaguucuuugcugugaaaagcaacaaaaaacccaacugaaaauuaacuuguauuuguuuaucucuagccaugguccugggaaaugaccccauuuguuauauuucacagccuuaaauaugaacugugcaaguucacuggcaaacacaacuucauguugguuaccuucucgggguuuaauccaaguucuuuagcuauugccgcagacaccgcugcaaaggcuucauugauuucaaacaggucaacauccuccagggaccagccugccuuugcaaccuacaggaaagauuaaaugaggucaaacuguucauuacuaacauaaagauauagaugaguugcuggagagauggucaacaacacuugcugcucuaucaggaggaccaaaccucugaucccaccgcucauugacggguggauggcuccccaaugccugcagcuccagcucuaugguaucauauacccugugugcacacacacacagacauagaaacccacacagacagacagacacacacacauaaacacccacacacccacacagacacaccagaccaggaggucauucuucagugacaggguccuaaagcagaugaccaggagauaagaaguuaaagaagauagaagccuuggccaggauguucugcacaagcuauguccuauacuuugcaagcuuauuaauaagcacaggaccuuauauacagcucguaggggagaaaugggauaaugaaggccgcaggaagcuaaccaaucaauuuuguacaagaagaacacaggguaucuucagugcacaaaauggccuuaugguugauaauuuugucucuucagggggaaacaccaugcuuccaagaacugaaaccuuaacuucuccaggcccugacccuagcucuagacuacaucuugcaagucuguuccugggcaaggacauuaaacuagauuuccuuucuucuaucaacccagacuuugagaagccuuggauugggcuggcccucaacacaaacacacacauagacuuagggaccgauaaauacacagacauacacacacaaacacacauagacacagagacagagagauagcuauagacacauagagacacgcacacagaugagaacagacacauacuaaaggauaucuguaguuuauuuuuaaauguuuauuuuguaucuugauguuuugccugagcacagguaagcaagugccuccaucccacgcaugccuggugccugugauguuagaagagcaccugagauccucuaggacugcaguuacagaugguuguuaucuuucacaugggugcugggacucgaacccacguccucuagaagaacagccacucuuaaccacugagccaucucucuagcccucauguauguagacuuuuuuuuuuuuuuuuuuuuuuuuuuuuuuuuuugguuuuucgagacaggguuucucuguguagcccuggcuguccuggaacucacucugcagaccaggcuggccucgaacucagaaauccaccugccucugccuccccagugcuaggauuaaaggcgugauauguagaguuuuguuuuuacaagaugaaauaauacucaauguauccucugccuucauacaaacccaaagucacaaauacauauacaaguaugugauccaaauguaaggaaacaaacucaauucacuuuaggugugcauacacaauguuugacaaacagcaaaucaaaccugguggaaguaacaaagcccagcacaucuuuacacuucagaggaaaggggaguggaggggcuuacaagggcuuaauacagagcuacaggucagcugccuucaaggucaacaaagccaagcugaggucugcaaagaugagacagaaagacggccaggcacaaaccuguggucuuaguagcugggaggaagaggcuaaaggccuaagagcucaagguguucacccaaguaugaaggcagcuugggcuauuaggaacacugucauaaacagacagacagacagacaacaaaacaacuaaaagucuacaguguaagacucacagcuugcuuuauggcuggaauugguccuacucccauaacagaaggcuccacaccggcuugggaccaggagacuauucuugcuaaagguuucagcauccgccucucagcuucugucuucuucauaaggaccacagcagcagcgccaucguucauuccuggaaacaaaugaccuggugucuacagcacuccuuugcuucagguauggacccagggccugcugcccaccugcaagcauuaagcuacugacaucuugccaaaggguucuguuugcugugauccaucagacuucagugaacugagaaauggucgagucuggagcgugauagauacugaccacacaauauuacaagauucccccaaaagcaacagagagggagagagggagaaggauacugaagaaacaagccuaggccucugagauuucccaaaauuugaaaagugugaagguaaauaaccucuuuuuagccuucauggccuggaauucccgaugcagcccaggguggccucaaccucacagagcucuugugcaaagcugggauuaaaggagagccucaccaugccuggccacuucaggggcuuuuuuuuuuccuuucuucucuauguagcccugcaguaaauuuguagaucagguuggcuucaaauucacagaguacuaggauuaaagguguacaccaucaucgcguggauuuaauugucuuauguuuaaacuuguauguuuagucuagaugucaagaaagcaaaucacagggcuggagagauggcucagcuguuaggagcacugacugcucuuccagagguucaacucccagcaaccacaugguggcucacauccaucuguaauggaaucugaugcccucuucuggugugucugaagacagcuaccguguacucauauacauaaaauaaauaaaucuuaaaaaaaaaaaaagcaagcaaaucacuucauuuaguaugcaucaaguaacuagcgaagccuggagaaacuauaaauguucccuaaacccaguuuuaggaaucauguuguguagaaagacguauucacuugguagaccuccacagaguugguauuucccccagugccccucagaacucaaaccugaugcguucgcuggggugacaguuccugucccaucaguaagaaaguaagguuucagcuugcccauggcuucaagguuacucccaugacggggaaauucaucgauuuucacuucaguaagaccugcagagagcaaagccaguuacuuggaaugaguacagagaaggcagaguucugggacuggggacuucucagaaacaaggagugacauuuggaagaaaggucuaugaccauuuacccacuuccauucuaguaggaauugcuagaauuacugcaugcucucccaugagaacucuucaugagucgcucacccuguguuucaaauccucagcccuuccuaaggacagcagcucuuuguauuguauggacacagguuugggucagugcauucauucaucuagguacaacugagugggucagaaguggagcaauccaccuugucugagcugggaaccaaugucagauucugcuucagaucauggugaguguguccuuaaggaacucuagagacugguuagcauuucuucagcagcucauaaacaccuguaacuccagcuccuaggguccaaggccuuuagacggccuccaaggguauucacacacaugugugcauauacacacagagauagacagacagauauccuaaaaguguccccuuuagaaugugaauuuaagagacaugcaagaucaacuaggugaucagaugccauuccugaaagguuuggaaagcuguuuucuucugacaaccacaaacugaugcuccauuucucaugaaacccaugggauacacacugcagcuguggacacuugaagaugacaguuucccaugugaccguauccugcugugguggcaguauuuuccagacaaggauguugccacaaccuguaaucccagcacucaucaggaagaagcaggaggaucacccagcaguuggagcccagccugguccacagugagcacuaggccaucccagcuacacagcaagaccacgucucagaacgcaacacaucccaaccugcccucccccauucagauguauaaugccuacaccuuuacaagcgguaaagaccaaaauccaccaagccucccuaucauccucacaggagucauccgugccuacacacggccucauccuaacuguggccuccacgcucaccuuuucuggaagacaccagcacuggcacaaucuccuugucaaaguggccagcuuucugagcaugcucugcccuguucugugacagaacugcaaccuuguccugggccucucugcucacuugccauuuuuuggcuacguuuucagcugagaagaagaaaaggcaaaaacagcaaauucaugagcugggcuuugguagcucggguuacucauacuacucuuucccuuccuauaucuguaaacuuccagaaaucuguguccagauucaccauugauauuucuaccucuuuuacuuaacaucuccuauaggaaccuucugggaaaaaguacaagaacacagacugcccuuucccucuguggacuguccacaggauaaagauaccagcugccaugcauggugacuugaguuugacccugggaugaacaugguggagggagagaacuauagcagguuuucucucucacuuuuuuuuuuuuacaucaggaaauguaacauuaguauuaacuccuggguuaucuugaaaccuuaccuuuggcuguaauaagacucaggggcaaagcagcuugacagacaugauggcccagcuaggcagcagguuugugcgcuccaggccccuuccugcucaggaccuggugcuccucaccaucagcaucuuuccaucuccagacauuaaugcuccguaagcuugauauucuuuuuuaauuuuaaaaagauauauuauuccuuuuauguguguaugugucuauaugagcucuugcgugcaguugucuguggggccacaacagggcaucagaugucuggaacugagcgcugacaucgcugcugggaacugaccucuguuccucucaaagugcagcaagcacuuuuaaacagugagcugucucucuaacccauggcuugauauuugugaagagugauaagaaggcccuucuuucaucacauugucuagguuuccuaacugaauacugaauaauggcuucuuggcauacaugauaaucuguuaugcuuggugccucuggagaucagguuucuacauauuuuuguuuuguaugaaguccaagaaacugcacacacuaaacaaauguucuaacacuaaacuauaccccuagcuucaggauauguauguguguguguguguguguguguguguguguguuaaauguguuucaggggccugugugaggguguccgauccucugaagcuggagucacaggcaguugugagcugacaugugggugcuggaaguugagcccugguccucuggaagagcagccaguauucuccuaaccacugagccaucucuccaggcccaaguccuaaauauuuauuaaucaucuuguugauguuugugcagguggucuggauaucacuuaagaagcuggcuaguggggacuggugagauggcucaucgguuaagagcacugacugcucuuccaaagguccagaguucaaaucccagcaaccacaugguggcuuacaaccaucaguaacgagaucugacgcgcucuuuuggugugucugaagacaacuacaguguacuuacauauaauaauaaauaagucuuaaaaaagaaaagaaaaaagauauacugucuuauaauaggaacaaggagcuggcucuuugggaguggaagugcagaggugguacaucuuuaucuuuuggagguagaacagguagaucuuugugagcuugaagcuacucuggucuaugaauauaaaguauguucuaggacugacaaaacuacacagagaaacucugucccaaaaaaacaaaaacaaacaaaacaaaaaaaaucaaccaagcaagcaacuggcuagcugcucgggcaaccaggauccaugaugccuucuaucaucucacugaagcagagaaaucuugagucccuguuugucacaucccaagcccucucuccuuauauuugcacaaguugucucuugugcuucugcguguagccuugucccuauuuccuuauucacaagacucauacuucucauagaaccgaggccacugcugccagcucuucaacaaugagcuucacuucucaguugacuucacucauagucaaaugcuacuucuguuuaaguuauauuuacauucgguaaagguuuuguuuuggcuucccaauugcuucaacuguuaacacaggaaacaaggaccuagacacaugaccaaugguucaauuguguguaaccagagaagcaugaguuuaucugacagaaccucucugacaagacagccuuugauaaggugggggaauccauccagaagaaucaaacauccuucugcaccaaggacccacaacugcagaguacugacugaggaaagcugaggagcacacuggagaguguacacaccgcuuucagcuugaccugaggucuuccugagcuguggcucacacaacugcugaacuuccuaagggcguggugccccccaucagcucccugcacaggauaaggcuuugggaauacacccuucuuuccuuuagaaauuaaucuauuuacuucauuucauugcauguauguuuauguaccauaugccugcuuagugaacucagaucagaagagggcacugggccugaugaaaucaccuugugggugguaggaacugacuuggguccucugcaagagcaacaagugcuuuugagugcugagcccucucuccagacccugaaguacacacaguggugaccuuuuaaauuuuguuuuguuugcuuuuugaguuucuauuuacagacagguguucauuagcaacaugugguauaucccuaacaggccuaaaaacucacugagugccauagaccagguuaaucuaaaacuuacagaucugucuauuacugcaucucaggugcugggaauaaagguguguaccauugugccuggcuaaauccuuaaaaaaaaaguuuuuacuuauuuuucuuuauguguaugcuauguguauaaggcugaguuagcucaugugcacccuagguauguagugcuuauccaggccagagggcauaggacuaucuggaaauggagcugcagacaguucuuagccacuugauguggguccugggaaccacacucagauccuuugcaagaacaacaagugcuccugacugcugaaccagcugauauuggucaucuuuguacugguaguucagguguucauuagcaacacagacuuuucaggaagucacuugcugccccuucggguucaaaaguucauuuucuguuauagucucacauuuuuugcucuuaugacuuuaaaaucugguaaaaaucugucauccuugccuuuccuuuuucagauuucuuaccucgucuugugacuauuuuauauugguaucuacccucugccaguaagaugugggugguauuuuaaguaggcacuguagggaacuuuaaagauagaaugagugagcuacauacaucuggaaggcaugaacucuucuugccuguguacaugauccagccaccaaaguccuaugcauaccaaugacacaauuacagcuaacuuucugcaucuggucaaaacuaaaguacaggccaucuagggaaguuccaggaagcuuccaacaccgcacauauccuaugauucucuggguacuaugguuugccucagcuuccugaccauauagauggucgacaauguacggaggugagacaccaccagaccagagucuaugcaaaugagccucacugucccauauucucaucaaucuuuuuaaagcuaguguuugcaggcauaucggccuuaccugugaugcccaugugguaguugugaaaggcaucugucagaccaucacagaguaugcugucagccaguggcaccucacccauccugacuccuguucucaggugagucaagugaggagccuggacacagggaggaagaacagauuuaggaggggugucacuugucucucagggucccacucagagucaggaggcucugccuuguacuuccuccuucuucauuacccaucaggccuucuccccauccccugcucuccagaucaggaucugaaacaucuugguguuagcagacaaucccaccugccuucucuuagccaucuauuccucuaucaccugcccauuuuuguuucuugaucaaaccuguccauucugugccuuaauucuuaagauucuauuauuuccuuccagauagauaauuauuaccuaaggagauagcauagaaaccuaacuccuguacuacuuucaaaagauguugugugugugugagugugugugagauggcagggguugggguuagcagugugugugugugggggccugaaugaguuuuuguguaccaugugagugugugcccaaagagaacagaggguauuggaugccuuggagcuggguaauaggugguacacacaggacauggaugcuaggaccuaaacuuggcuccucugcaagaauggcacaggcucuucacacacugaccuauuucuccagcacaucuaguaucuguuuugguaggagacaaaauacccacagugaaaauauucaggcuguaaaaugcacugagaagaggguuucugaguagaagagauuuuaacauucagcaauucaaaggcaaccagaaugcaauggaaagcuuaguggacaaagagucaacagagguauuaaugaaaauaaugaugucuaugaauaaaaugauauaguuaaauaguuuuuuuguuuuguuuuguuuuuuccugaaaaaggguuucucuguaucacccuggcuguccuggaacucacuuuguagaccuaacuggccuggaacucagagauucgccugccucugccucccaagugcugggauuacaggcaugcgccacuacugcccagguuaauaguuuuuuauguuucuuauuuuuaagaagaaacaaaagcugugcauuuaagugguggcucuagucaucaguauucccaccuuuaaguugggaauaacagcacugacuccauauuggcucuugugaccacacacaacagcccugggugcugguaugcagcuuaguacaucuaacgagagggacucugcucacuuugugaccuccagccugccuccuccugagcucugcagaaguugagcucacuagguuucugaccaguggauuccaaggucagcccuccagcauaggaggaagaugcuguuccacugcagugccagcaagauggggggccgggaggaggcuuucaguuucugagacaaggacuuguaugugacccaggcuggucuugagcuucaggguucacgugcuucucagccucagcuccugaagggccugcaugcuucaccacaggugucuuucacguguucuaccuacccucuaggagaucagaagucugaccccugggguauguccugaccaagaaccaugacaagaaggaaaacuggcaaugugugacuugacucuucuucauguguguguguguguguguguguguguguguguguguaugugugugcgcgcgcgcucgcauguguauccucugaggagccuccugcucuaugcuguugcugcuguuuguuguuguuguggucugaugagaagauauaugagagaugaagggacauauccugaagauaaaaguggacaugcccuaaggaacucaaugcccuaaggagucagcaggaagcagucaaaagaaguccaugucuccuguccccuggccuucuuucucucccaccuagcaguaggggguuggagggaugcuggugcacaaggguggaaggggaguagaggaauaagaauccacuaagagagcaaauccuacaccaacagaagauccuugugcucugugugcagaucauggccuggauuauccugggcucuggcuccaggucaaaauuagaagaacacuuuguagggaugggcugugcccugauuuauugagcugagucuaagaacaggaagcucccaguucaaagaauccuagcugacuuguuuggguucaguugcccuauacuuucagccgugggacagucucucuagaaguucaguggaggaugaacuaggauucuaacagcacagcuuauguuccacugaccuacucaaagaacauuuagucacuucaaaaacaaaaguguguguguguguguggggggggagugccagaauuguggacagggauagguagauuuuugugaauuugaggccagccugguaaacagggauuuccaugcuagugcaagcuacacaggaucuuaacuaaacuuggggggugggaggauagggcauggggcgcacacccuugauccuagcacuuaggaggcaaagauagaucucugaauuugaggccaguagucugguuuaauagggaguuccgggggcuggagagauggcucagcagguacgagcacugacugcucuucuggagguccugaguucaaaucccagcaaccacaugguggcucacaaccaucuguaaugagaucugaugcccucuucuggggugucugaagacagcuacaguguauuuacauuuaauaaauaaauaaaucuuuaaaaaaaaaauagggaguuccaggaaaaagccaggacuacacagaaaaaucuugccuucaaaagcaagcaaacagacaaacaaacaauauauauguauguguauauauacauauguauauauauauauauacacauauauacagacagagagacacauauauauauacacacauauauacacauauacauacacacauauagguuuuagacacaggaaaaagaaauguaagcagguagugcuggugagauggcucagucagugcacacaggcacuugcacccagccugaugagcugaguucaauccccaucuggugagauggagagagucuucuccaggaugucauucucugaccuccauaagugugggugcaugugccgucccccauaaaagggguaauaaauguuuuuuauuccguguauuguaauuauuaauucuguuuugaggguaaaguuguacacuaccacaccacaccccauccugaaauuuuuuuaaagaaguggagaauuaguguagugcaugaugggaaacaauucaccaucgacagcaucucaaguggaaaauuugggaaccucaccaggauagucaugaccuuuauugcaucaucuaauuuucauucguugauaaugaguagagagcugaauuauaagucuggaugacucagggucuuaaugaccuuccuaagaaugacacccucagaaguuaguugccuguguauuaucuuuuaccuuucuuguguucucagaaugaaugugcuguaccuggcauguuuauuaacucuuugggcauaaugaaaaggagcuuucucaaaauuuuaagauuuuuaaggaagacaacuuaaaaaguuuagaugaguuggaaaauauccaaagauauucuuagcacucuagaugcagagcaggagaggcaagcauuuaaggcuagccuaggcuacauagcaagucuugggcuagccucagcuacaugacaagcaggaauagcaaccaaaugaucuuguggguucauuucagaaagcacuguaugcuucuagaacaacugcuuagagaaaguauguucuccuccagcugccuggcugauagacuguucuucacaugggauuucugauccaaccugaagagcagugggcauucagucaggggucaggcugagucaucuccuguggguuccucagcaggaccugcccucuagguggccagggugaugagcagcaccucugcacuuaccuugcucauauucuccaugccuccagcuaccacaaugguggagucgcccauggcuauggacugggcugcaagacacacggcuuuuaggcccgagccacagaucaucuggcagcuccaugcuggaaccgaauaggggaucccugcacccacacuggcuugucgaguaggauucugcccacaaccuggaacacaaggaacacagaagccuccaagucugugguucucaagcugugggucgagaccucuuugggggcugcaucucagauauuuacauuacaauucauaacaguagggacauucagguaugaagcagcaaggcccuacuuuuuuuuaaaauuuauuuauuuauuauauguaaguacacuauaguuguccucagacacuccaguuagaucucguuacagaugguugugagccaccaugugguugcugggauuugaacuccugacauucagaagagcagucgggugcucuuacccacugagccaucucaccagcccaaggcccuacuuuuauggcuguggugaucgccucacgaggaacuguaagaaagguuugccgccucagaaagguugagaacugcugccugugaaggagaaagguuuuuaagacagcagguucaagugcgggcucagugccaggagauagccugccgcuuuggcaugccuucgggccagcuaaguucccacagcagcagagaagccuguccuccucucugccugucacucuaguccugggacagaugcuaccuugugcaauuguuagguguuucagagagaagccuccuccuccaguguuccugauaccauaacacagaaccguaagagcuucaccucuagagagaacuugacuuuucuuccuauuaggcaagaaacuuaacuaagagcaaagguaacagccagcuaguuacagccaucuaacacaggcagaauucaggcaugcaguacacugugcucugauguucaggguguaagauaacuaggaaggaaagaggguuacuuuaggaggaaaucugugcacaaaagcuaugcacuaugcuggugcgguagcucacacuguaaucccagcauuuuguaaacugaaguagaaggaucucauuaaguuugagguuaguuugggcuacauauuaaguuugagaaaagcaugagccaaauggccaguucaagggcauucugaauuacauuaugagugaauuuccagccagccugcacuguauaguaaggccuuuucucagaaaguaaaaaaugaaguuaaauauacuuaagaaaauuagagccaacaauucaccuaagauuuccuucagaugccaacacaaacaaacaaacaaacaaacaaaaauuccacuucuuaaaaguagcagaaaaauaauugagucaaaaauucugaaaugcuauuaaucacacuguaauaaugacaaagaguggcuuucuccuuugcaaguuccagguacacacacaucuacauauccuucccuuaguaugccuguuagagaaguaccaaugggacaccgucagaacuuagcaacuauauuaauagugccauuaaucugaaguugguuuagaagugaaaagcacauaaaaugauucaucuccucaaugcuucgcccuaacgaggaagcaguaggaggaucugaguuaagacaggccagggcaucaaacaacguucugucugagaguaguggcuccugacuguaacccagcgauucaggaguuaaagguaacggguuugcuucaaggaucgcauauguugaaagguagccucucaugucucagaaauuaaaaaguaaaaaaacucaaaacuuuaaaauuaaacuaagaagauacuauucauuagagauauugcuaugcagggcguguuggcgcacgccuuuaaucccagcacucaggaggcagaggcagguggauuuccgaguccgaggccagccuggucuacagaguggugagguuacauuuauagaucagcaagcgaggcaauguacaacuugugaacgcugagacgcuacgacaugaccaccacuguccagcagugggcuacaaacgaugaucaggauuuaauuucuacucagaauugggcuccagccaggacauaaacauccuuacagggaugaagaugaagaucauauauauauuuuuucuuuuccucccaagacaggguucucacgcagcucuggccguccaggaaacuugcucgguagaccaggcuggccuugaauucacugagauccaccugccucugucuccugggugcugggaauaaagguguguacuaccacagucuggugauauuauauauauauuuacuuguaugaauguuuuucgugaaugaauguauguauguauguauguuugagggugccugguacuuauggaggcuagaagagggugcuagauucuggauuccuggaagagugaagaaggcuguaagaauccaagagggugccaggaaacaaauuugggcccuuuauaagaacaguaagugcuccuuagagcugagcaaucucuuuacucucuaaaagaugaugauacuucuuagagacacuuggcuucuuugcucuuucagacgacugaaacaaugaacuccucaaagacuggaaucacaugcugggagaaggaacaaguugaagccugguacaaggcaaaggagaucuuuccuuccagggaaaaagauuccacacacucugaggacuugccagaccacccugcuauagagacccagacaaugggucaaugcaggggguggggccauaacaugaccugacuguuuagaagugcgaaucuccagcugucuauuuaaaguuuaaucucacuucuggaguaugaagauggaccugaggaggauacuuggaucuccucccaauuuaaccaaauuaaauaaagcucccuuuucuacuauccauuuugcuguuccaccuagaauaugaaggacaacuagcugaacgugguuucuugagauaaagauugugacaccaaguucucuaacaaugauccuuuauauauauauauauauauauauauacagauguugcauaaucuaggagguggggaucugaugucaaaacaauucuagccccaaauguuucaaaaaacaauauucaacuggcacacauacaaauggucucagacagaguaagagcagaacuugguauugaauauuaacaauuuucucuacaguugauucaaaugugugcugagggagcacagggcagggcaggagugggaacucaugaccacaugcaugcuaaccacacacuucaccacugagcuauacacccaggccccaaaccaaucaucaacaucaguagucacugaucuccaagcccagcaggaaucagagcuaugaugaagcauucuuagacucuccugccuuccuccggacaguccccuggagugagggacagcugaucuccugacaaaguggaccaggguagagcugcucugcugcagccccacucgcagcuguggcacagugccaggcccacacacuuuuauugacugugugacauguuagggguauguggaggacugugaauacuuugcugugcuucuaacaaugcaaaggcgauacagucccguggucuaagaucacucaccgaaaaggcuuguaaaggagcugugacuucagccagaggaaggaggagggacagaaagaauccuagcagagagaacuccaagcaaagcaauguaugguggugguggugugugugcgcgcacacacacacauauaaauaaaugcuguuucuagugaaccagaucuguccugggcuacugaggaguuaccugccgucaagacauguccaaauaugaccucggacaccucuucuggagccaccuuggcccucugcaggacuucuuugaugacaguuguccccauuucguggacaggcacgguggacagggcaccauugaaggagccuacaauggaauggggaagagggaaggaaucugaaccaagagcacacugaggaccaccgagggggagaaggggucacaugcauuccaaauaaaaacggcuggagccgaggcgggcaaaggcgauggugacuuccagaacaaugccaaagccaaggccugccuggaggagcagcucagaccaccaucucucgggcccccgacaccacagcgugaucaauggugcaccgccgaacagaccaaucagcgaucaggagagagagcgcgucccaacguuaucuaauaggugagccuggcagagcgguggcucuacugcgaggagccaaucgcagcacgaggggcggguccgcgggcaaggcgcggggcaccgcgagcuguggagucuguggccggccgcccccuccccgucacgagagcccgagucuccgcgaucaugucgggaaggagggucacaggcugaagugaccucgcgggacacucaccuauagcggugcgcgccgcugagacgaugaccacggggucugagcccgcauucaucuugucgcucuggucucugcuagcucucagccuuguccugucugcgacugagguaaaacuuccuccagccugacaggcugugcug

SEQ ID NO: 8386 - RNA, 1050 nt, Mus musculus
uguggccggccgcccccuccccgucacgagagcccgagucuccgcgaucaugucgggaaggagggucacaggcugaagugaccucgcgggacacucaccuauagcggugcgcgccgcugagacgaugaccacggggucugagcccgcauucaucuugucgcucuggucucugcuagcucucagccuuguccugucugcgacugagguaaaacuuccuccagccugacaggcugugcuggggggggcggagcuauggccuccacgccacgccuccucacgccugcgcaggaagcugguagggcuaagucccagaauuguguaagauggagacucuuugguuugguaugggguagauggugucuacccaaccuaggugugucggguuagggugggguguggaggauccagggauguuggguuggagguagacagccuaggggugucgaagagcgaugcggugugcagacggucuaggggucauagguggagucggguccaaggguaaggcuuuccuccaggugacacuggaaccuagccuaaccuuuccuacauaggcaucucccguuucuucugaagguucuucucagcgcugacagcuucugaguggguagccuccuugcuaacagagauccuuagggcaguggaucucuacuguccaauccucucggacuuauuauucagccaaagacagaaucugccagacucuacuuaccucucugccuugugucauucucaugccuuuugcaggcucccucuggccaccccccagucccagcccuagcacuaucacaggucaccugcaguguccccaguguuuugaaaggagagucauccugguuugcuucugcagcuugcuggucuacagagaaugccaucuguuuaggaaagcagaauccugugguggaaggaaaggcuuucuaggcaagucuugcccucaguggggacaguggacagugaaguaagagaacugcgccacagauuguaggaaaggaaaacaaaccuaacaacaacaacccgguaagcugggauauccuccugaaauguaaagca

SEQ ID NO: 8387 - RNA, 1050 nt, Mus musculus
ugcuuuacauuucaggaggauaucccagcuuaccggguuguuguuguuagguuuguuuuccuuuccuacaaucuguggcgcaguucucuuacuucacuguccacuguccccacugagggcaagacuugccuagaaagccuuuccuuccaccacaggauucugcuuuccuaaacagauggcauucucuguagaccagcaagcugcagaagcaaaccaggaugacucuccuuucaaaacacuggggacacugcaggugaccugugauagugcuagggcugggacugggggguggccagagggagccugcaaaaggcaugagaaugacacaaggcagagagguaaguagagucuggcagauucugucuuuggcugaauaauaaguccgagaggauuggacaguagagauccacugcccuaaggaucucuguuagcaaggaggcuacccacucagaagcugucagcgcugagaagaaccuucagaagaaacgggagaugccuauguaggaaagguuaggcuagguuccagugucaccuggaggaaagccuuacccuuggacccgacuccaccuaugaccccuagaccgucugcacaccgcaucgcucuucgacaccccuaggcugucuaccuccaacccaacaucccuggauccuccacaccccacccuaacccgacacaccuagguuggguagacaccaucuaccccauaccaaaccaaagagucuccaucuuacacaauucugggacuuagcccuaccagcuuccugcgcaggcgugaggaggcguggcguggaggccauagcuccgccccccccagcacagccugucaggcuggaggaaguuuuaccucagucgcagacaggacaaggcugagagcuagcagagaccagagcgacaagaugaaugcgggcucagaccccguggucaucgucucagcggcgcgcaccgcuauaggugagugucccgcgaggucacuucagccugugacccuccuucccgacaugaucgcggagacucgggcucucgugacggggagggggcggccggccaca

SEQ ID NO: 8388 - RNA, 29835 nt, Mus musculus
ugcucucucuccuucaccugcuugcauugugggacugaacaacugcuagauccuuggacuuccauucacagcugcugcugaccauuguugggaguuggacuacagacuguaagucaucaacaaauucccuuacuauauagagacuacccauaaguucugugacucuagagaacccugacuaguacaauguguucaaauauaugugucuguaccacaauaugccuaccaagaccagaaauggucaucaggucuucuggaacuagaguuacaauugugagccaugaugugggugcuggaaauugaauccagguccucugaaagagcaacaaguacucuuaaucacugagccaucucuccagccccaaguuaaucuuuaaauuuaaaauagugucucugaacuucuuugguauuugaauuuguaucucauuaucuuuuacacuagaaaucuuugaagaaaguaacauuaaaauguuuguacuacaauauauguaacuucaaaaccauagcaacaauguuauaacuacaaaucacuuagugaaacugagugauucuuagguaucuaggacagagcccucuguaggcacagagccagagcaugaaauucaaacacugcagcuauauucuuucuuuuguguaucuuucaguuccgcuaucaauuuuaauuugaauugauuccuuucaauuuguuuuggacucuggagggauuuucuuguuuuaccuauucguuucauaaguuuugaaaacucacaagucuugcuguuucuaccuuuaucuccuacagccauuacccucuuuugaguaacuauuaaguuucugcaauauucuuccauuuucucgauaugugccuacauauauguguauauguauuucuacaccuugcuuuauucacucaagccaggacucauuccaaaguaacacauaacuauuaaugucugcauccucaccaggaaacaggauuucaauguauauuuccauuauaaacaaaguugauccuccuucuauggaauauuuuaaggaucugugaaccaucuguucacguccuucuccauuuucuuuaguuuuccaaggacccugcgauguaaacuaccuagugguggcaucuggucucuacuguaacuguauccuuauaaaugaucucaggcagggcaccuacgcuggggauuaaccgggcucauaaaaccgacuaagccuaaauaugacugucccaucugggaagugcugaagagacugccgagcaccgcuguucuugcuagaguacuccagaacccucacccggcugccuucccggggcuuccagucugcccacacgcgcagccuccuggcuccucgacucaaacccaaagacgccccggggcaaagccggcggccccaagaacggcgacggcuucuaagucccccucccccgcccccaacuuaaaacgaggggcgcuuaagcaugaagccgcugucuccccguuccggcacgaugcgcggaagcauccugagcugugagacugccuggaagagccaaucacgcgcuugucggcucggauuccuccgcccaggccgcgcagcagccgcagguggccccgccgagcuuguccggcagcggccgucgucccgagaugccucgcgggugaccuccgaccucgcgggcccgcccuucucuccggccgcuucccuucccagccccgcugagcuugcagagccccgacggggccggugcgggcuuccgcggacugucuccgugcggcggcggcguagugccgcugccucuccgcgccccgaggucccgagcggggccgagccggccgccccucgccccuucucuccagaggcgcccggcgcggugaccgaggaggcgcccgagaggcgcgucucgggugagugggccacgggcggggucuccgcggcgcgcucggggcggggcgcaguccgggcggggcggggccggcggcagggccggcuuuccucccucagcgccauuuuguggcugcgagacccgcaaauaaagguucucgccagcgcugcggcgggaggagcgcgggggggccggcggcggcgcggccucggccugugugacuggcggcgcccgcgcagccucgggcugggaagguaggugcagcccgcagcgggaauggccacgagggccuguggggccggggagcgaggcgcggccgcccuagacccggggaaaugcacuccgggccggaagggcgaccgggccugcggccgugcagguuucccguuaggcagagcgguuugcugcccguggggauccuugcaccgcuucgcggccauucuacuuccgucccugacggcaggggacagggcgggcguucccgcggccggggaggcggggaggccggaggccgcccucucggggcugacuggccaugccgguccuuuccccgccucugucgcccccucccaccuuccaggguucgucaccggggacccagagguacccacaguucuguauggcacaagugaagcauucuguuuuguuuuuuggguuuuuuuuuuguuaaaaacaauuccguaccacguaguagcuugucuuugcaaccacguucaccuguggacuuccauuuuuacauaagugcaugcauugugagaguaguucuuuuuuuuuuuuuuuuuugacagcuuaguggaauuuuucgugaacuucuagucuaguuuuggauuucuguauggcugauuugaccguauuuaaaauuguuuugcauaagacagcgggugcacgguagaacaagaccuaaguuuuccucucuguguacauguuuuaugggcguggggggcggcuaggccuugugcaugcacgcuaggccagccuucugccguucagcaauuccccgagcccacaguucuugguuugagaaugaggaagucaguuaauuugaccccaaaggacuaagaauacacuguaagcugguuguaaagaucggugagccuguuaaagcuucaaggagcauguuauaauccucuacguuuuauuuacgccuuuuucaucguuuucacgcucuacccuagccuuuucauuuaguuaauuuuauuguuuggaaagauagguggaagucacagaucaguuacuacaaauucuaccuuucuuucccuuuagcuuauguuugagcuuugggacuggagaguuggcucagcaguuucucuuccagcaccggaaugauggcucuugaccauccuuaacucuuguucuggaauuuugacuucccacuucugaccucaguggguggcaucaggcgugcacgugaugcacauauauacgugcaaaacauucauaaaacauuuuuaaaugcggucuggagagagaugguucagcgguuaagagaacugacugcucuuccaaaggccugaguucaaaucccagcaaccacaugguagcucacaaccacccauaaagagaucugaagcccucuucugguguaucugaagacagcuacaguguacuuaccauauaauaaauuuaaaaauuuuuuaaaugccuuuuuuuuaaacgcuuuuuuuucuuuuaaaccaagcaucauguuuucuuauagguaaacauguagacgauuugaaacuauugaaaacagacauuuuugagguggcuagguuucacucauucauucacuacugcuggggcaaguuaggggagguugcagucuacaggauggcuucugauaugauugaaacugaauuuuaaggauuugggcagauggguuucuaagagugcuuuaguucuucacucuuaaacagaugaguguguuuguacacuauguuaugacuuguauuuuuuguuuuuguuuugguuuuuuucuaguucauuuuuuuccuuuuuuuaaauuucauuuacauuuccaaugcuaucccaaaagucccucacacgcucccccacccacccacucccacuucuuggcccuggcguuccccuguacugaggcauauaaaguuugcacgacuaaugggccucucuuuccacugauggccgacuaggccauuuucugauucauaugcagcuagagacaggagcuccagggggguacugguuaguucauauuguuguuccaccuauagguuugcagaucccuuuagcuccuuggguacuuucucuagcuccuccauuggggcacugugauccauccaauagcugacugugagcauccacuucuguguuugcuaggccccgguuuuguuuuucuuuuucuuuuuuuuuuaauuaaagauuuauuuauuuauuuauuuauuauauaugaguacacuguagcuaucuucagacacacuagaagagggcgucagaucccauuguagaugguugugagccaccaugugguugcugggauuugaacucaggaccucuggaagagcagucagugcucuuaaccacugagccaccucaccagccccgguuuuguuuuucgagacaggguuucucuguauaguccuggcuguccuggagcucacuuuguagaccaggcuggccucaaacucagaaauccgccugccucugccuccggagugcugggauuaaaggcgugugccaccacgccccggcaacuuguaauuuucaagccuccucuugucauauguaucuaauguaggcuccucuuguaaauguuagccaucuagauuauugguguauaauagaguuguauuucuuguaucguggucuuuagaagcuuuacuuuaucagcuuuagcaaaucaagauauaagauagcauucuuaucuuuaucuccacuuuccugccucuaaauacuuuauauuucuugucacuaacuaagcuuggggaaauuuuucaguauucccauaauugaauaagcuauugauacaggguguuaggcauuuguucuuugccugaaagaugauguugguagaguuuauuuucucuguugauuguguucaaacaaucuuuguuuauauaguguuuuuaugguaccaauaacagaucugcagcacuuuguacaccaagcaacacuggcauuuucuuugacugauauggaaacugaagcccaaaguauuaagugacuugaucaaauaaagcugugagacugaaauagcauucugauuucuaacgaguucucuuacuccugcagugcugauacuucagcacugccagacgaugccauuucuuacaucgugauuuauuuuagcaaggcauauacauaccuucuuucauaaacuuacuuuggccugugauugccuuucuccagagaguacuaaguugccuaacuuaggaucauaguguuaugaucuggaaugcuaggcacuuaguaauuccauaacccaagcuaggcuuuaagaguagauggcauccucuauauucuuuauacugucuacacaaauaacuuaaguuuaaaaauauauuuauucgguuuuauguuauggguguuuugucuguacgucugucucuguaccacaucuaugcugugcccuuggagguucagaagaggauaucagaucccuagaacuggaguaacaguuguuaugagcuacaauguaagugggaauugaauccugaaagagcagucaguauucuuaaauucugagccaucucucuagcugcuucccaccuuguguaauuuuaaaaucagucauuggacgcuugccaaauuauucguguuuuaauuuuucuguuuugcuuuuguuuuuuguuuuuuuguuuuguuuugauuuuuuugguuuuuccagacaggguuuucucuguguagcccugguuguccuggaauucacuuuguaggccaggcugaccucgaacucagaaauccaccugccucugucucccgagugcugggauuaaaggcgugcgccaccacgcccggccuugccuuuguuuuuuaaagaauuacuuauuuagguguaugaguacacuguagcuguccugagacgcaccagaagagggcaucagaucccuuuacagaugguugugagccaccaugugguugcugggaauugauugaacucagaaccucuggaagagcagucaguguucuuaaucacugagccaucuccccagguguaugucuguagcccuggcuggccugcaacauccuugcuguguagaacuugaaacucuccagccucugccuccugcgugcuacugaacgauguaugcugugcuuuucugggguuuguuugcuuguuuuguuuuguugagacaggguuucucuguguagcccuggcuguccuggaacucacuuuguagaccaggcuggccuggaagucagagaucugccugccucagccucucaagugcugggauuaaaggggugcaccaccaccacccggcacagugagauuuuuaauagagaagauuuaauuuaugauaugcucauuuagaguguuuuccuaaaauacugguuucuucuguacaacagaccugauugagagccaaggggucagugguggugugacuagacuauuucaugcauaugggaguauauguaaauugauaauggaaaaaucuuuauuaugacaagucaaauauucauuaagaaauuaaauaguuuuuaaaaacaguauaacaaaauguucagucaaaaucuuuuuuuguuuauuuguuuuguuuuguuuuuuugagacaggguuucucuguauagcccuggcuauccuggaacucacuuuguagcccaggcuggccucgaacucagaaaucccccugccucugccucccgagugcugggauuaaaggcaugcgccaccaugcccggcuucagucaauaucuuaaucauuuagaauuuugagacagucucuauguagcuuuggcugucuggaacucucaaugcaggguggcuucaaaauacagggguccaccugucuauccuuucagagugcucaaauuugaagcauauauuaccacacccagcuuauaguuuagaauuuuugauagguauaguuaaguaaaauaaagugggaaaaauauaagguaacuuugggaacuaggaucuaguaauaacugacuccuuguuaaguuugaauguuagaaaauaucagguguguuauuacaggaacuuuuuaagauuuagucauugcauauacaguauucugcaugcaugcacacuugcaugcuggaagaauggcugugagccaccuugugguugugggaauugaacucaggaccucuggaaaagcagccaguuguccuaaccgcugagccaucucucuaggcccuaaagauuuauuuuuaauucugugugugugcuagugugcauaugcuugucuguggaggccagagguguugguucucccuggaacuggaguugugagccacuuuauaugaauucugggaacugaacuuagaucuuugagagcaauuaacugcugggccaucccuucaacccaagaauucaugguuuuuguuguuguuguuguuguuuguuuuuugguuuuuggauuuuuucaagccaggguuucucugcccuggcaguccuggaacucacucuguauaccaggcuggccucgaacucagaaaucagccugccucugccucccgagugcuggaauuaaaggcgugcgccaccacacccagcagaauucauguuuuaauuguguauaaauuauuacuucaaaacaauuuagauuuaaaaaaaauacugucccucaaacugagucaaguaauguuuagugcucaaaaucuucaaguggagguuuuguauuuguuagguuagcugucccuauucugucuauuuauuucccaacuuguguagugcauuguuuaagguccauuuguuacaugguucugucuuuaagguauauauacuuuauauuuaacaucguuagaguguagugaaucacaugauggcuucugcuuuacugucacagcaaugcuguacaagucaaggccagcaaacugguggccggugcugcccuucuaggccuuuagcaacaggccucgguggccuucugaggccugacuuacacuuuuuuaaaaauaauauaaccacgaugaugaaagauguuagcaaagaggaaauuuggugaaaguuacggggguacuuaugucuuuugugcccuuuuuuuggugguuguuaauugaagcuauccugggcuaacuaaccuaaauugugaagaguccuagguugaaucccuuucacuaaaaugaaugaagggaccaaagugcugugaaauacaagauuguuuaauaacuauuucacaaaacaguuuuguuuugaggagaaaaaacuuuaauugaaagaaaaucaacugaaaaucuuucccccacccccaccccuuauuuuucagggugcaagaugaccaacgaagaaccucuuccuaaaaagguaugucagcagcuucaaacccuccuuucuuagaguuuaaggggcuauucuauguccuuauuuuccacuuccuuuaccuuguacuuugcaucaagggacuacagcuuuaagaugucucuguaugugcucaguuucacagcuuuuagaaggcauuacaguauuccugugaucuucacuucuuagccuguauuacauuaccauauacacacgugaacaauuucugaauauuuuacagauuuuacacacaucuauacacacacauguauguauauguuccuauuuuugcuccuauuuuguuaaacccccaggguuguaacuuaaaucuauccaccugaguauuuuucaaggcuacaccuaauuaguucuuguuuuuuuccuuuauuuucuaacuuuggauguucuggcucuauaguccuuuacugaguuuagcuaucauuacuuauagguaauaacacuacauguauccugaaguucuguuaaacagugugcuauaggcuauggaaggauuuguaauucaguuuggaaaagcguaauguuauauaaaauucugccuaaaguuuuggagucaacauuauucaggagugaguaaugaacugugguuugcuuucucagguucaguguuuuuuccuguuuuguauugugacacuaguguuacugguuaauacuuagaaacucuuuaaaguguucucugugcuucuaggaaucaaagucugcuucuugcaugcugugcaggcaguucuccuuuugucuaggcucccucuuccaagaauuuuuuuguuuguuuuuucguugguuugguuugguuugguuugguuuuugguuuuucaagacaggguuucucuguauagcccuggcuguccuggaacucacucuguagaccaggcuggccucgaacucagaaauccaccugccucugccucccgagugcugggauaacaggcacacgccaccacugccuggccaagaauuuuuuuuuaauaagagaaauuaauagagccauagaaaaagcauuucuaggggcuggagaaugguucagugguuaagaacaccgacuacucuuccagagguccugaucaauuggaagcaaccacaugauggcucacaaccaucuguaaugggaucugaugccccucuccaggugagucugaagauagcuacagugcacucacauacauuaaauaaauacuuuugaaaaguagaaccuaaguugaaauuguuucaaacauuuagaaaugcaugcaugcaugcaugcuugcuuucuccuuucuuucuuucuuucuuucuuucuuucuuucuuucaagauuuauuuguuauuagguguaaguacacuguauccgucuucagacacaccagaagagggcaucagauuccauuacagaugguugugagccaccaugugcuugcugggaauugaacucuggaccucuggagaagucagucaguacucuuaacuguugagccaccucuccagcccucaaacuauugaaaguuguagauugauaagauguuuaguaacauucuaugagcuucuuucaaaaucagcaucuggauuaauaguuuaaaacuagggaacugguacacucacaaguuuuucaaauuucuucauuuuuuucaaacguucucuauacaacugcaguuguaucucaagauaagcaucugaauccucaccacagggcacuuugaugcccucccucccuccuuccccaggcuuguagugauaauccauuuuccaguuucuuuaacuuccugagugccucaggaaggaaaucaggcauguauguccuccuaagauuaucuuuucacuuuguauugcauaucaguaaucuuauuucuacuugcugcugaagaauauugaauauauggcuggaucaguuuuucuguuuuauuuuuuuucugguuuuucauaacgauuucucuguguagccuuugcuguccuggaauuugaucuguagaauaggcugaucuuggaacguacagagauccaccugccccuguauuauaauuauaguuuuacaagcauuuaccuguuaaaggacacuuggacggcucaaggaugcaaauacugguugauguggugugugaaaguuuaaucugacugaugugaguuuuuuauuucacuuguuuguuugguuuuaauuuuuaauuuuuuguguaucuguauuuugggaaugcucugaaguggagaaaugguguccuuuggagcuggaguuccagacaggugugcacucugacugauuagguauugcgaacuaaacugguucucugaagaguuccaagcacuguuaaccgauaagcuuucuccaaccuucacauuuaguuuaaagcuauuuucagaguuguuccuguggaaaacacuuugcgcucugaaagaauacucagucuguuuuaaauuuucuuucuagguccgacugagugaaacagacuucaaaguuauggcacgggaugaguuaauucuaagguaaaauguucuuucaucaaaaauacauauacaucauacuaugacuaccuacuuaccauuaugccaucccuaguuuggguuugcuuguucugugggguuuucuuguuacugauuguuugagacagugucuuccuauggaaauuaagauccucuugccuuagcccaccaagggauaggaauacuggcauguuuccacuacaguagcugacaugguuguuuguaguguuuguuuggggguuggcuuaauuuggguuuuuuauuuguuugguuuugggggguggggguugggguauguauguggggaguuuuuguuuuaaaacaugguuccuuuguguagcuuuggcugucuuggaaccucuaacccagaguuccaccugucuuuaaaucccacugcuggaauuaaagacgugugcuauuauuaucugauucagugugacuuuuuuuuaauguuaauauagccucaagucacuugaaauauuuuuuuggauauguuuccuaugauucuucaguauguaagcaagaagaacuauaauauuaguuuaggugauucauagauugauagcaaccaaauuuucuuuuagagcuaaaauacucaagauuaguuacacagaaagcauuuauauuucauauauaccuugcuagagaauguguuuaguuuaauaaaucagcaagcucagggagggcacaaugguucaguggguaaaggcccuuucuguguagaccuagcuguagcccaagcuuaaucccugaaaaacaaaacaaaacaaacaagucuacaagacgguuccuuagucucuuccacauguguaccauggcaaaugugagcccauauacaauaauaaguuuuuacuaaaaacuauaggaaugggggcuggugagauggcucaguggguaagagcacccgacugcucuuccgaaggucgaguucaaaucccagcaaccacaugguggcucacaaccauccauaaugagaucugacucccucuucuggagugucugaagacagcugcaguguauuuacauauauuaauaaauaaaucuuuaaaaaaaaaacuauaggaguggguguuuuucugaaacaggguauauucaaguuggccucaaauuagagaucucccuuagucuucugaauauuagaaauacaaggguauauauacuaaaauagucugacagguagucuuauuucaauacaauuucaaaggaugaucccuacccccaccuccagccccaccccuaccuccaccccuagguuuuucacgaugggguuucuauauguaguccuggcuguccuagaacucuauaaaucaaccaggugggccucugccucccaaugcugagauuaacauuaccacuaccugggucuuuuuguuuuagucuugcuaaggugccaagcuggccuugagccuuuguagguaaccuaugcccaaccuauguguauguucuuuugccuuaccugucuucuguaaauugugaagaagcaguaaagcuaaugaaugcauuugcucauuaaacuauguuuguaauuaugucaaaguuaaguauaauccagcacaguuuuuacucuaugauaaugggugugcuuuccuaguguauuuaauauaaagguaauuucaauguaaccacuaauaugaauuuccuuuuuacuuagauggaaacaauaugaagcauauguucaagcuuuggagggaaaguacacagaucuuaauuguaaguuugauccuuccuagauagagauaguauaguugucuuuuuuuuuuuuuuuuuuuuuugugguuuuuugagacaggguuucucaguguagccuuggcuguccuggaacucacucuguagaccaggcuggccuugaacucagaaauccgccugccucugccucccgagugcuggcuucuauuuauuuauuuauuuauuuuuccuuugucgauuuccgagacaggguuguugcaggaguauucuugguuuuguuuggguuuuuugguuuuuugagacagguuuucucuauguagccuuagcuggccuguuacucuguagaccaggcuagucuugaacugaucuaccugccucuaccuccagagagcuaggauuaaagguguguuccaccauaacccugcuugagacagggucucauacuauguagcagaagcuauccuggaauuaugaucuccugccacaggcuccugagugcugugauauagccagguuucugcucugccaggccaguuaaugucauuguucuauugaguggguuagaauguauuauugugaguuuuauauauuaaauauacuauaaaugaguguaggcguguggucuccuguguucaggugugacugguggaguacagaagcagcucagugugacucccuggggagcucuuccgagcaggaacaaauaacuuguguccaaaacugaaaacuuaaaggcguuaaaggcggugaauuuuuugauuaaucuugacaagagaauuuucuuuugguuagugaaauuuguaauuuugauuucuuuuacucagcaaacgaugugacugguuuaagggaaucugaagaaaaacuaaagcagcaacagcaggagucugcacgcagggagaacauucuugucaugcggcuagcaaccaaagagcaggagaugcaagagugcaccgugagugucuuuaaauagugauaauagcaaauauaaguguacuguuuuuaaaggguacaauggagagugguugggaauggagguucuuuuugguguguuuguuuguuuuuguggguuuuuuuguuuuuuuuuuuuuuuguuuuuuguuuuuuguuuuguuuuuuuuuuuuguuuuguuuuuuuuuuuuuugagacaggguuucucuguguagcccuggcuguccuggaacucacucuguagcccaggcuggccucgaacucagaaauccgccugccucugccucccgagugcugggauuaaaggcgugcgccaccacgcccggcugggaauggagguucuuauguuugcuuccaucucaauuccuaauuucuauggagucuguguaccuuuugcuaucauuaggcaauuugugcugcuugcaauugaauaugcaacuguugugcauacaguggcacuuugagucaccagggcuuugaggacgauggugcucccaucaccuuuugagauggguuuuagguuuuuguuuuguuuuguguugcguugggauuuuuuaucuaucuaucuaucuaucuauuuugccuuaagcuuuucuugucguauuuuuaauauuuauuucauguuuaugagcauuuggccugcauuuaugacuccgcacuacauguuugccuggugccuguggaugccagaaguaggcauugaauccucuguaaaaggaguuacugaugguuauaagccacuauguaagugcccgagcaagagcagccagugcuguaagcacucaacacauuguuuaugcccuucccuauguaauacagccauuauucuucuaucuacaauucaaaggugaggcuuugcaggcagcacuggggacaaaauagggaaaggauacauaaaguuggaguuacggguauggcugaaacuugguuaaggguuuagggacuuguuuuacccuagguauaaguaauagcuggaguuuuuugguugguugguugguuuuguuuuuuuaaaguuuuguuuugugugacaauaugucacuacauagcucuggcuagccugaaggacuccuuauguagaccagacggggcuugaauuuacagagauggaccugccucugccuuccuggugcuguauuaaaggugugcaccacucuguacagcuacugguggaaaauuuuucagcaaaagacucaugagguugguuaagucacugguaccugggaagggugucuuaaauagucuucuaggcacagucaguaggaccugaucaauuagaucuuguggggcaagcuauuuaauaagucauagguaggucucauguuuauacugugugacugugaaagagauggaauuuagaaagagaagagcauaaugcuagggaaacaggaacugcaaaucaccucuucuguccacccaccaccagcucaccaguuaagaaccacugauaguuagauguaggcuagagaguugguucagcuguuaagaguacuuguucuugaagaggacccagguucaauugccagcaaccaaaugguggcuuacagacuaacucuagucccaagggacccaaacccuuuuucugacuucuccuggcaccaggaauacaaaugaugcauguacacauguguaggcaaaacacaacauguaagaaaauguaaaucuuuuuuguuuugcuuuguuuuuugagauagguucucuauauguaguccuggcaguucugaaacuuacugugacacacugguuucagacucagaucugccucugccacuugagugccaggauuaaagaugugcacaccacaccuaaaaaagaagugucgaggcaaaaguuaguuuuaguaaaaauaggaauugaaaacuuuuauguuuagcagucagaaagauaguaggcuacuuuuuaguaggaccuauugcuuugggggcuaaggauaaaaguaagaauggaguaauuaaagcaggugauaauuucagauaguuaaacagaacuaagagaaugucuguaggguucagagccugaguucagaacugcaguaccagguaaagagcugcacauggagagcccugaggagccaguggagcgaggcagaccucuggggcuuccuggcugcagucaacaagcaacaggccagugagauacuuugucuccaaaaacaaaguggauguugucuagggagggaaaauacuagagguguauagccaggcuaacacucaagaugguucucuggccuauacagaaacacagguuuacaucuuuaguaaaauuguauuuaaugugaaagucagaggacagcuugcagcaauucauucucacccuacagaucuuggggauugaacucaggccaacagacuuagcaacaagugcuuucccccauuagaaaucuugcuagcccuuaagauuuuuuuauuacuauauuucauuuauuuauuuauggauauuuuaugaccugcguauuuaaguuagaggacaacuugugggaguugguucucuuuccaucauguggauccugggaauuaaauucauauuaucaggacugacagcaggcaccuuuagcugcuuagucaucuugccagcccuaaaacuuuccuccuguuuucuucccuggcaaaggggaguuuguucugguuacauucgucuccuuuucuauucgccuccuuuucaugaccaaaagugcuaacuguugggauuuaguuugagucaguguugugagauuguuguaaccaaugaggagagcacaugagacacacugacgugauguuauuuaacucuccucuuaaaauacuuuaguagcgcugggcagugguggcacacgccuuuaaacccagcacucaggaggcagaggcaggcggauuucugaguuugaggccagucuggucuacagaguuccaggacagccagggcuacacacagaaacccugucuugaaaaacuaaaaaaaagggggagggaaaggaagaaaaaaacaaaacaaaaaaaaaaccuuuaguagcuagcaguacuuugaauuaauggguaaacuuucuguuuaaaauuaauuucuuuuacauuuuuccaaaggagcugggcaagaugaucuaaugguuaaagugcuugcuuacugcuugugcagaggacuggaguucccuuuccaguacacucaguucccuauauaaaugcagccccagggaucugauggucucuggggguacccucaggcacaugcucauacugacauacagauacaaaaauuaaguaaauacuguuagagcaagcuugggcucauggugcuauccugcuguguacaguauggaucucugaauuccaggcuggccaggucuacauaauuagacuuugucucaaaagaaaaacauaguaucuccauaaauauucuuuucuauuuguguacagugaacucauaaauaaauguagucucaagucagucaguauacuugugucuucuacuaaauuuaugguaaggaauuuaaacuucauuuuauuaaaacauaggguaggguagaauugacuauaugacucaguagucaaagaugcuugcuacugugcuauauagccugaguucaacccccaugacccacaugguuagaggaagaggacugcacuuaccccauaagcacaaaauaauaaaugucccagcacuugggaggcagaggcaggcggauuucugaguucaaggccagccuggucuacagaguaaguuccgggacagccagggcuacaaugagaaacccugucuggaaaacaaaacaaaacaaaacaaaaaaaagaugcuacaaaauuucacuaauauaaagauauaaugucacuacuguuuuaaauuuagaaguggaaauugugugaaauuuaaccuuucugugggaguuuuauguaguuuaagcaaaaaguaagcaaugagaaacccugucuggaaaacaaaacaaaacaaaacaaaaaaaagaugcuacaaaauuucacuaauauaaagauauaaugucacuacuguuuuaaauuuagaaguggaaauugugugaaauuuaaccuuucugugggaguuuuauguaguuuaagcaaaaaguaagcuaagaccuuaccaguucuucuauaauaaaauuuuaaacuuugcuucuuucuagcaauugucaguccuuaaaauaaaaacauguugcuuguuuuuugguuuuguuuugaaacuagaucucacuguauaacccuggcugccuuagaacucacugcauagaucagacugccucccauguuccaccauggucaaguuugguuuggguuuugguuuaaguucuuuuuacuaauguuugugucuguggguuucugcugaaggaugccacagguguuggauccacccacccacagccccacccccaacccugguggaguccuaagcaguuuugggcuguccauugugggugcugagagcuagaauucuucauccucugccucuguaagagcaauucaugcucuuauuuauguauuuauuuauuuacuuauuuccauuuuaugugcauugguauuuucccucaugcauacuuguguaugugugauggugucagaucuuggaguuauggacaguugugagcugggauuugaaucccaguccucugaaagaaaagucagugcccucauccacugagcuaucucuccagaccccaguucauccuucuaacugcugagugugauggcaacccugauuuggcuugguuugguuugguuugguagaguuugguuuucagacaggguuucucuguaguccuggcuagccuugaacucagaggcuugccucugccuccuaaguauuggaacuaaaggcaugugccaccauuccccagcuuaugauauggccucuguuuuguuuuguuuuaaugcuguuuugguuguacagugaaaguaaccucaugaauugccuuaaacaaagacguguguuuucuuuuguccccguuuuuccuuugugguuguagagacuaaaacguagggccuuuuucauauaaugccagugaucugcuacuaggcuacauccccagccuuugguagccuucuuuaauuaagacacagucuuuuuuuuuaacucuuaggaagcuuaaaauccucccucuacuuccuaagggcuggaauuauaggcauaugccauuguucucaguuuugguacuuuuucuaggguuuguguuguuguuugaaauugugugagauuugacucaagggucuuguucuguguguaugcucucuguuaaagagcuacacccuuaacuuuagggagacuuaauaucaaagggguacagaccuaacauaggcugacugaguguuuaauaagaguguuucuccucuuagggguucuuugguuugguaguaauuguacccuuugcuuugcacagacucaaauccaguaccucaagcaaguucagcagccgaguguggcccaacugagaucaacaaugguagacccagcaaucaacuuguuuuuccuaaaaaugaaaggugaacuggaacagacuaaagacaaacuggaacaagcccaaaaugaacugagugccuggaaguuuacgccugauagguaaacaaaucauacuccccagucaagacuucccugacagucccaccucgagaaagcuguggugggacagccaaguacucguuuccacaccaagacucagacuuuuugagccaaaaaagccacauucuuauacuguccagcuuguaaugguuaauguaaaacuuagcagaugaaccuuguguuucagcuuuucucuuccccucccccuugcuucagaggccugaugccgucggacuauuccgaagaagaggccaacuccgaaaaauuccccuucuaggacauguagacacuuugaaaaguguuucuguuugaagaaaauagagggaaaaacagaagucuuaagucuguggcacacugugucuucagacaguuucgaggauugaaauccuagagguuuuaaaucaugaauugaacauguaaaauuccaguaaaauguaaaaauggaauaugcaucgcucuuagccaugagcauagugacuuagagacacuguacaucaguuaugccaauaagacuguggacuucaugauuguugaacuacugggucaaaacucaaaugaggugaauuugccuuuaaaggacuuacuuaugcuaagaaccaacuaauagccgugagacaaucacgucauagcuaccaguacaaguagagcaaauauuuauccauuuagcucugagcucuauauuauauaauggagccuuaaaucuaugugguuuuuaucaaugguuugucuuuugaaugguuguggaaacuguagauaaccuuaaccaaggacuguacaaacgugaagguguggucucacacuucagguuuaaaguguuugaagcauuauaagcauucauuucacaacuagauuguauaugguauuuggcugugaugagacucccauuauucaguaaacccucaucucauucagcaggcacauguuaaacagcauugucguuggugugaaaugggggaauguguuccuucauuguauugggccuuuuguaucuaucgaauuccugauauuaaauuaaaugugccuugaaauaguuggguuuuuuuuaauucaaggaauacucugauaauuuuguuguauucaauauuuuacuuuggggggcuauggagagcagaucaacacuuuggaaaauuuauucugugcucuucaaagugaagggaaaggcugucucgcuuaaaagacuauuccagaugguauaaaagacaaggagacuuggcauuuggccccaggauauuacaguagaacauauugugggacagucucacaaggugccugccagaagauuggggaaauaauguguuggaucucugggcuggcccaagugagaugguuugugaauugaaaaagguauagugaucauuucuagcaaacucauuugcucauuuagauaaaugaggcauuauauucuucaugcuuccauccaauccuggaggugaauuuuuuucgucuauaagucaccaguuugaauuuucccuuggugauaauggagucugagaugaguagaagauaaauguuccagcaugccccaacguuuaagugcaguuuuaacaagggugacuuaaguucucucuuaaucguuccaaucaauuguaaguaugcuuauguuugugcuuuaguggacugacugugggcagggugggcuggaggaaugauguguauaauuuuucaggaacaagucugcuucuaaaauugucacuggggguuuggaggguaaguaaaccagucuguuuaaaaguaguuuauugugacaaaauuggaucuuuuguauuuauuucaugcauuuucagguucaugguugaaaugauucugaauauaguuuuaguggguugaauaguaauugguaaaauguauugcuaguauguacucagauuuagccagucuuucucugcugcuugaauacagugacuuugaggccugugggccugcuuucuuguuauuguuaaucuucucucuuaauaagacaauacauguucauguauacaaaugaaauacuagagaaagaugggagauggaaagugucacucauggaccugaugucaaacuaccccauucugcucuacaggaccaguaccacuguuaaauaucuugggugucaucgagauaauuuguggauacacaaugauuucauguauauugguuuuaaagaaauguaaucauaugguacauacacaugcuucaaagcuuuauuauuucccuucauuuuuaucuucuagguauuuuuuuagcauaucuagauuacuaccuuuuuaauggucucuuaguauuuuuuaaucuuauuuuaacaacccaucaaugagguuucauuauauaaaacuaaaccaugugauauaaugaaucaaguacuaaaacuacauuauuaauuugaaaauaaguaguacuuaauuaguaauguggaaugauuccaaugauuggguuguaagguuuccuauauguauaugguauuccugcccuuugcugcaggucuaauuuugagggauaaagaucuuuuuagcuggaugugguggcuuaugccuuuaaucccagcagugaugaggcugauacagaaggagaggggacuuaggaguacguucauagauuuguaucucaaagaauaaacaaaagaacuacuaagaaauggauugugauuccuuccauaauauugucagcucuacacuuucauuugacaacacaaucauuguaagaguguuuaggaauauacuggucauuuucaacuuagucauuuaggcaguuguauguacaacucuacaaaguaaccuggcuuccuucccuugauuauuaagguaauauacugaugccccuuguguuuuaaguauuuccuguuacugggauuauuugguuuuaggagucaccucagcacuuaggaggcagaggcaggcagaucaggaaguugaguguagccaggacaucacauugagaaacaaaaggaacuagaggguuuggcccagugguuaacaacuggcugcucuuccagaggacccagauucaauuuccagcaccuacauggcaacuuacagcuuucuaaaacuccaguccaggagaacuaauaugcuucccucuagcacccggcgugcauguguugcauagacuuacaugcaaacaaaauacccacacucaugaaaagagaacagaaauauuuuuaaaauacaaaggcauuuuauuuuuuaaagacuuauuuguauguauaugugagugauuugucuacaugucuuucucuccaccaugugcauauggaggccagaagaggaugucagguccuuuagaauuggaguuauagaagguugggagccagcaugugugugauggggaucaaaccuggguccuguaaaguagccaguguucuuaacuauugaccucacuuuccagcaccaauuuuuaaauuuuuuuuuuaaugaaagcaauaaccucuacuauccauuuuaaaauaguuguaguuaaguucucucucuuucuacuuauuuuguguugcugaggauuggaucuagggcuuugacauggcuagaugagcacuuuacaauagagcuauauccuuagccuuuucuuuggugaagaguacuaaggauugaacccaugaccucacuugcuaaauaaacucagaguacacucccaggucccucacuguuuuauguguggaguguguuuaugugugcuguuauaaccacaaguacagauuuuauacaacauaguugcuaacauaaaaauuaaagcaguuuugagguauuuuagagguacuccuugagacagggucucucugugugucuagugcuggccuauaaaacuaacuucaguuuaugcuaggacaauaucagccugcuaagcauuaagcuauguuacacauuuuuaaauaaaauacuuuaacauuuuugauauuuuuguauggggcuaaggcaagugaccaauuaauguauuuuauacuuuuuuuuaaagucuuuauuuucuggcuagaaaaucuguuguauaugauuccaagaaacagguagccauaacuuuaauccaauacuuacaaaguaauacaaacuguaagaacagucaguuccagggcagccagggguaguaagaaucuuucucuccccucacccccuuuuuuguuuuguuucauuuuguuuuuuuuuuuugagacaggauuucuuuguguaguccuggcuguccuagaacucgcucuguauaucagguuggccucaaacucagaaaucuugccugcugggauuaaaggcaaacacguguugggccagacccugucucaaaagaaaaaaagaaacgaaguuauuggaauauggguagccaacuagaaggaagaaggagcucuggugucuuuggcagugguguccacaucuuguuuccuuguuagauucuccgugcuuguuuaguggaggcugaacucugaggaggucgauaggaaauguggguagggauguagagcuacaauaacugaaggcaaugguuaaacaaagaaaacuuaauacaugcacucagggcuucuacugugacuccuuugaacauuaguaaccuggguuuuauuguuccaaaaacaucuguaaggaaauuuuaauugcacuuuauuguuguuauugaacuguauuauauaacaugagcuguaaguuaaggaacccuacaacauuaccuguaaaagaguugucuacaaaguacuacuauuuuuagguguuccuaggaucagaugaaaaucuguguaucuggaaagugcaagucccgcuauauaugggaaaaaaaacacucuaguaccaaaguguuccuaacacaauuugaagaauguuaaacuguuccuaugcaagucucaaaguuaguaccacaguuacauauuaaaguuauuucugcuguuauugcuaaggcugaaagcagugagauuuuuauugguuuguuacuugaaauuuugauuacccuuuucaguuguuguaggaguugaauaguuaggacacuauuauugaaaacuaaacuguucuguggcacucauaaucuggcagauaauucaagguuuggaaaauagcccaaaccuuugugacuugguauuauacagucuaaaucacaucccaguauuauauguucaucaggaauaauggcccacaccuguauuccugguguuuaagaaguaggaggauugcaauuuuaacaucauccucuacuacacagcaaaaagaaaggaaauuaugucucaguuaaguuaaauaaggaauuaauggauuucuauuugggaagucuuuuaaaagauacauucuuguauagaaguuauaugugccagagaacugccuaguuaaaggaauccauuauguguguuuccuaguaagaauauauucuuauucuuuuauagguauuuuauagaugauaaaggggcaugcguuuguaauugauacuacacguauuuucuuaaagaaccuuucuguuugaugaauuaguaccuugguguuacauuaacaguuaaauccaacauacacguuaaauggccuauuucuucuugaaaugauaauuuaggaugagaaccuugauacaguaggaacaaaaaguggcuauuuggcacuuuuuguuuaagguuuauuuuugcuguucuugguaaaaauacugaagugcagaagauggacauguuccagaaaagaagaugguaauuacaggguggcaucucuguaacauaguuauguucuguacguguugaugcuccaguuauuaaauugugagcaaaggcuagagagagcuuugucuucaucuugugaugauaggcucuuuccuuugcagccaaacaggcaaaaagcuaauggcgaagugucgaaugcuuauccaggagaaccaagagcuuggaaggcagcugucccagggccguauugcacagcuugaagcagaauuggcuuuacagaagaaauauagugaggagcuuaaaagcagucaggaugguaaggagguuuuuauuuuaacuuugcacuggcuuuauagcuaccagccuugugguggaugagauucugugcauguucuuagaugauggcuaccuaaaauugugcauguaccaccuaccauugacuuaugaaacaaaaccauugaauguuaaaagagugcuccccaagguacuaauagcaugcagggacauuuuucuaaguuugugugugugauguuuuguuuaagguguaagaauugauaacucagugcaugagcaucacuaacagugucuucuaaauauaaaucuuggaaacuuggucauuauacuuccuuaagguacucuucguuuaaaagaggauuuaguauugaaauuugcugagacaaacuaaauguguuuguuacuauaguccuuuuuugucuaaguguagcugcauuuuuuguuuguuuugugaaguggauuaagaguuaaaaauggauccacacuguaaacugagaaccaguguaguuaguugguucuugguugcaaagaaagccaauagacaauguuguugucauuauuaguuuuuacugaguaaacauggaaguggggagaguuuauguaguuuguuguucuuaaagccuuaaagacaaaacaacaaaaaaaaccccaaaaaccuuaaaauugacuuguauacuuuggcaagccccaguuauuuuuuaugauuguguucuuguauguggagcagacuuugguucguacacauacaucuuugugagguuagaguaaaaaaacuaacacugucuugagggcuagagaugcuguagauuuaauuuaaggcccuggcuaagggugaagaaaagggacacagauaagauuuuacaaguuaucaucaauuguaugaggcaggaugguugcaaucaaauuuuagcuugauuucuuuaauauaguauuuaaaacaucaggccacccuccaaauguuuccuucuuggugauuaaaauuccaaguaaauucuuuaaagaaucuauuuuggggucuugguggucaacuagccuagccagaaggguagguuccagguucaaugagaaguaaaaagcuguagaaaagagacaucugguguugacuucuggccucucaaugcacacacauacacaggugaguggguguguguacauacagcagagaaauguuuuaaaauguuaagauauuagccgggugguggugguggcgguggcggugcacgccuuuaaucccagcacuugggaggcaaaggcaaguggauuucugaguucgaggacagccugucuacagagugaguuccaggacagccagggcuauacagaaaacaaacaaacaaaaaauuaagauacuaaaguuuggcucuccuuugcacagaacugaaugacuucaucauucaacuugaugaagaaguagaggguaugcagagcaccauucuaguucuucagcaacaauugaaggagacacgacagcaguuggcacaguaccagcagcagcagucucaagcuucagcuccaaguaccagcaggacuacaucuucugaaccuguagaucaggcagaggucacaagcaaagacugcagucgucuggcaaauggaccaaguaauggcagcuccucccgccagaggacgucugggucuggauuucacagggaggggagcacaccugaggaugacuuuccuucuucuucagggaaugguaauaaggccuccaacagcucagaggagagaacuggcagaggagguaguaguuacauaaacccacucagugcgggguaugaaaguguagacucucccacgggcagugaaaacucucucacacaucacucaaaugacacagacuccagucaugacccucaagaggagaaagcagugagugggaaagguaaucgaacuguggguucccgccauguucagaauggcuuggacucaaauguaaauguacagggugcaguuuuguaauauuuuuccagaaaauuuuuauacagugucauuuaauuggggaaaggauacugucaaaaaauuaaugcauacuuuugucacaauuuaccuuuuuguggguguguuuuuguuuuguuugguuccuuuuuuuuuuuuuuuuuuuuuuuuuuuuuuuuuuuuuuaauugcuucaauaccucugccacuuugaaaauuguaacaguuaauuacuuugaacauugcuaaaaggacauuuuguguagggucaaguuauuuuuauaugaguuaaugugaaguuguaaaugggaaucuauagcaaugaugucuguauaaaucugucuuaucuagaacuugugcugucagggcacucuuccucacgcuguuguuacucaugcaccauucagacuuguuagaguagauguggguuuaggacugccagguuugcccaguauaguaguuuuuaucacuaaaaaguuggacuuggaguccuauaguaguuucagcguuagauaaaguuuuuccaccauacaucuuuaggugcauucaucuuuaggugacugaauguuaagaaaucugugugcauaguuacuaaguuuuuaugaacuguuguguccuguuaaugcauauugcccugugacuccaguauaucucaccuguacugaccaaaccuaaauaaacauuuuuauuacgacucuuguuuguuuuuuccuuuugucuuggguguguuuagcaauuguccuuucuuuucacugaauggcugaauugcuacuuacucuguaguauauacaaagaucacauuaaaacagucuaugcauuaagucugacuauccaccuaauuuuaauuugcacuuuucuuugcagaaugaagugggaguuugacuacagcucaaggacuuugguuuugguuuuuuucccucuugacguaaagaucucauuuuuuaaaaaaacuaaccaaauuuuagguuuuuguugaagagcaguuuguucuucagaucugauuucagggaauagguacaaagauguuugcuuuaaagcauuggccaaauaaugcuuuuuccagaaacagcauccuugcauguauuguaaggaggucuaugggucuggacaugugaaacaaguacccuuaacagcugugccaucucuuugucaccacucccuuuuugcccaccuucucucuuccucuucuccccacccaugcaucugccggauuuauuaucauccuuaguuugccauuguucucaaaauguggcaaugauaccugggcuaacacuuagaggacuaucauuuaagcucccuugacaacauccacucuuacguuagcaggucacccaaccaugauucugagcuuaguccuuaauguuuuccugccucccuucgugcuucugaauaaaaggaagaaaagaaacaaaccugagcaggguuugagguugcugugccaaauacuuaagagauuggagcgagaaaugaacgugacggcugugcaguaaaaaugcaaauuaagggcuggagaggcugcucagcaguuaagagcacugacugcucuuccagagguccucaguucaauucccagcaaccacauaguagcucacaaccaucuguaaugggauccgaugcacucuuggugugucuuaagacagcuagaauguacucuaaaaugcaaguuauaaaagcuuuuaaguauauaguuaaugauggcaggcuaaggcaacaagcuugauuaaauagucuuuggaagcaauuugaggauggcacggcucugcuuagcauagucacagcccaggccauccaaaaaaaagagaaagcaagcaaaacaaaaaacaguuuaugaacaaaagaaauugaaagcagcauuaagucuagcauugaaaggugggcuaguugucauauacucaguucagugagugaacaguugguugugaugguagcuguuuuauguugucuaaucaaaacacugagagggugaaacaggauugagaaaucaaggccaaccugaagcuacuaucucagagugaaugcuacuauugagaagacgagugugagcauguguaaaaaaugcuuccuauuaaaaauauacuucaacagaugagcuuguccuuucaacuguguuuaauauggccuuuuguaaaaguaaaauucaugaacaaacagcauuuuucugacaguuggacuccuguaacuagucaugaaacaaccccagaaugacugcaagaccccuuaaggacaaauaguuuguagcaccacuaaauuauuuuuuuccauuuuuccccucagucuaacagauauaggaguuauuuaagaaacuauuguaggggcuggagagaugguucagcagugagaaagcacguuacugcuuuugcagagaacucugguuccauucuuggcauccaauaaucuauaacuuugaauuuuaggagacccaaagcccucucuggccuccacaggccccugcacaugugugcugcacacauacacaagaaauaaacugggcauagggggcuggagagaugguucagugguuaagagcaccgacugcucuucggaagguccgaaguucaaaucccagcaaccacaugguggcucacaaccauccguaaugagaucugaugcccucuucuggugcaucugaagacagcuacaguguacuuagauauaauaauaaauaaaucuuuaaaaaaaacugggcauagugagacacaccuuuaaucucaacacucaggaagcagaggcagggaaucuauaauuuggaagucaguuucgucuacauaguuccagaccagccagaacuaacuacauaauuccugucucagaaaccaagcagccaggcaaugguggcgcacaccuuuaaucccagcgcuugggaggcugagaccaguggauuucugaguuuaagccagccuggucuacagagcaaauucuaggacugccaaggcuacacaaagaaacuaucuagaaaaagcaaaacagggcugguuagauggcucagugaguaagagcacccaacugcacuucugaagguccagaguucaaaucccagcaaccacaugguggcucacaaccaucuguaacaagaucugacgcccucuucuggagugucugaagacaacuacagugugcuuacauauaauaaauaaaucuuuaaaaaaaaaaaaaaaaa

SEQ ID NO: 8389 - RNA, 33220 nt, Mus musculus
auuacacuucauaaaauccauguuuauucaaaaaaucucaugggaaaguuuggaaagcauaauaaauaucuguacaguggccgccgucucaacacacagccagaaagugugaacauggagugagcuguaaacggaacugcugaucauguaaacgcagcgcaggcugggagugggguggugccuuucaccugcacagacgagccaugcuggcuuccccuuccaccugucccugccacagagggaccccagagaccuuucccacuccaggugucucacagucuugcggguggugaagggcagcaaaaugugccagagagaaugaagagucacgguguaucuccuccuaugcuugagagaagcgguacaaugcaggggaaaucccaacgggcaucuuaaggaagaacaccauuuaaucaggaauacugcugacauuagauaccaucaggacgauccucacuuaaaaagccaaacaauauccaaagaccagugcacacagguaguucaaaaucacacacguuccaaccauaggacaggggacguucacggcuugccugccauugacucugggguacagaaucugacaagcaccccauccccaccuccuucaguggagcgcucaucauguucucagcccaaacagggcaggagcugcagugggauagcccaaaaguagcucuggggauggguaaaggaguuccaggauguaggcugggcuuucccaugacaaauucuguagcuacacaaguagucauuuguguagagaauacagagccuuuccucguguuggguaaagggucacaggccagguaaacaccggggacacgggguuacaugccacagcagacugcuguggcacugaagacuuuaaagaacagggauuaaaacgauccugucacgugcuccucugacugacuccacaagagauuucaaguaucaaguacugggugaggugggaaugugggguacuccacucucugcagggcaaggcugagcauccuuccagacacauccagaggaugcguuugguuugacugauggucuccuccaucccuuuggcgagaguaggcugaguguaaagcagguaaccucacauuacugaaagaggugaugcggccacaugaccaugaaggggacagguuaugcucgccuccucagccaugccuucuguguucuguuguucuuucuuuucauuagaacauguacacuugaagcugcaagcaaacccagccugagccgugagcagcuggagcaagggugcaugccagagaggcccucggagggugccagagcuccuguucauuucccagaggacagaaucugucacuaagacuacccacuauacuuucccucuggauuucuaucaagaaucggaaggauucaggcccagaacauuaacugggagaugaucucagccuugggcagagcauucacugagaaagcaggagaccauccccagggacacuggaaauggcacacagucuauccccacucuguauuuuauaauucucaaacagaacagaguccaguggaguaauuaaagcuucagaaauacguuuacguuuugaggucugaaauaauuagacugagcaaaggaauuauguucugaacauuccacuggggcaggcauugcagaagcagccgugguccaccuguggucuuccuaguguaagccugcuguggccaacaggcgccuccuacaggugccucuacugggcagaggggcugcuucucagacuggcagguucugagccacaguggagugucuucugaccugaguccacuauccucagcagccuccagagagacuucaggacacacaagucccuccucuccgaccaggaggaguggagcacgccacgggggaagggucucacucgguuacucugcaugaagaguaugccacagauagccugguccguguaacuacugcucccugcgcagacuacagccugaaaacagguuagacaacagaaacacaagaugcaacauaggaccacagcuucuaagaagagcaucacucccacugacaacuuguccaggcaccuucugccugucuaaggcaaggggcucaggugucucuccuguccucagucaagaagggauagagggguagaggagaagacauucucuguggcccaggaaagcagagagagagugaauaugcuauaccacagcaggcaaauaugagcagagaugccaacacacccagcaauggcagagccccacucucuccagugucccuggggccacaggguuaagggggcagcaguguaguggguacuggcucugcccggcaauuuccuggggcuccugucucaaccaacagaaaucacgcucucaaauagacucuacccaucuagacucuuggguugguugcuuucauccugccaagucagugacagagucagggagaagcuacccagcaucuugcuugagagcaggaggguggugagaggcacucuuugggugauuguggacagagucaggcaucuaagcuggaugcuuucacagggccacuggcauugccagaacauccagaaacauccagcucuucgaaaguggcucugcugucuccaggcagggacugugcacuaacacucucagagagacagugggacacguaggugacaucaggaugguaaaagagcucugcuuugggcauaagccaugacauggagacacugagagcccugagugagcccagggaggccccagcagggugcuaugaggugacagauucauuugguuucacucaggaggagagagagagcgggcggagaggucggcgcagcaaggcucagacauccugggcaggacccuuucuagggcugcaaaggaaacagagagauagccaaggccagauccaucuuugugcuggacucaugggcacucaagugcccaugaacaggaccugugucuggcgucugugaggcugagaggacguugggcagggcgacugaggcuggagacuuggcuggccacuacaaccugguagacgugagucucuucaugccucugcguugggccaagcuagaugagagcacaggcucuagccucggugccugugggguccuguucagagcaaaguagguggccgccauggcgcccuguaggaggaaaggcgggcaggugagcauggugcccaacuacucuugaauaggaagcuggaaacacgggaccuugagagccucagucuacccccauguaaagcagggaaggcccuccuccaagauuccugguacacuaggacaccaguuaugcugcaaugccuaccacguggucagcccacacaugaccguuacuaccucagcaucccaggcuggggauuuaagacuggaguggagcuccugggaagauuuugggauaaucuuccugauggcaggaaggcagauguguuuugggaccagcuggguccccaggaauucacugucaaugauucuuaggcucugcuagucugaagcaguguaaacuaaccugggcggcuaggcucaucuugguguagacacaaccaggaucugccuucuaacaggacugggcuuggacuaaauguacuuacuagaaggguggucuagccuggaccuugggucugcccagcagguggaagcugcuuaaacaggacuugugagcacaaagggaacuuuuacagacuucugguccagacugagggcuccggggcuuagggcugcacagccacgguaccagacaccaccccuacaccaaagcugucacuuagacacaauuugugcacaggugauaaagugacacuuacgugccuauaccuggugaccuuacacacuacaguuuuugggugugggcauuuucuuggggcuuuaguguaugugcuuguguguguauauguguguuuagacaggguuuagcauuuacuaugcagaucaaccugacuaugaauucauaaagagccuccugccucugccuccuaagugcuggaauuaaaggcgugugccaccgggcuuuauuuaaaaaacuaaaaugcuuauaaagaauuuaagggagccucaagcaugaugcugggguauagcuuggugguagaaauauauguuaagcugggcggugguggcacaggccuuuaacccagcacuuggaagguagaggcagguggauuucugaguucgaggccagccugucuacagagugaguuccaggacagccagggauauacagagaaaccuugucucaggaaaaaaacaaacaaacaaaaaaaaaaaaaaaacaaagagagagagaaagaaagaaggaaauacauguuuagcaugcaugaagccuuggguuccaucugcagcacccaggacaaauaggggaaacauauucuuuguguguguagaggauguagguaucuguucagguggauuugugaauguguauauguggcugcacauacauguguguguguguguguguguguguguguguguauguggaggguagaaguucauaucagauguuuuccuugauugcucuccacguuauuuuuugagaugguuuaucucccuguacucagagcuccuugacucagcuagauuggcaggucaaugggcaucacuacaucuagcuucuagaagaaucuggauccagccccuucugcauaugugccagacacuuuaucaacuacauuaucuuugagcucucuaaaucuauucuuaaaugugguuguauuucaaaagaaaagaggaaagaguggaaaauuccauuacgcaucagcccucaccuugcugggggcugcuggaagagacugguccugcaugcugggucuagauuugguaaguccgaagcagagcuguugguggcccagcagggcgaugaagucagcucaugucagcaguaaugacagucacagauccugggagggacugaagauuccucccuaaccacuggccaaggccaauguggcuuccuggcuaucaccuuggacagcuuccagaaucacgacuuccaaaggcuuuuuccuaggguccggguugcaaagaugagccucuggaaaaacguccaacucaugaccugugucccacauaaccucuguccugcauccagaagccucguugaaauuccacucaccuccaaagagcuuugacugggaccaaagacuucugugguauuggagguugggucugcaagccuuuuucucccuuucucuccacagcuuagaaagagcagagugaacacaggccucauuccccagaagaaaacaaaagcaggagaagcaugauuaguaggaccccaguaagcaugauuaguaggaccucaguaagcaugauuaguaggaccucaguaagcaugauuaguaggaccucaguaagcaugauuaguaggaccucaguaagcaugauuaguaggaccucaguaagcaugauuaguaggaccucaguaagcaugauuaguaggacccgugucacucucaaugucaaugagccaagacaacaacuccagcagagauuuucuuagucagaccgccaacuauuuacauuuuucuuaucuuuuucugccagagagcugagaucuguguuucucuguacauccuccuagauggcuccccgacuucugcagacccagaaccucagagaacccugcagaggcuucaggagccaauguuuaggaugggguagucacucucuaagcuauaagcuccagguccucuguaagguaguaaggccugcuuuggcucauuccaaccuuugguucugcccagccagguuccuaacaguccuugccaaacuguugaggguuagcaagaggccagauguucugccuagcuuugaggaggggaggcagggcagcgagggggagccagcauguucagcuacuuugcaggcuaagcuugggucacauauuacccuuggggcaugaggccuguccugcugccagcccugaguucccagacuugauucuccugauguucuccaccauuccauuccccaccacuggucuugugcagacauguucuucccuccauucucaccagucuuucauggagguagcaucucuccucugagggaaaugaaaccccagggccuugacagacucagacacacucucaugcaaucacaagguauacugguugucuuucaagaauggcuugggaccacuuugccaagaacagacaugcagagagagccagucagucuacucugugaccuuuuuaacaucauaagcucaaaaucuuccauccaggauguggagaucacacuuggggcagggcaacagggccugugaagaggccugaugccaucccauguccuuuuucucugaauggguggggguccuccaggguaguccucaucccucaaauuucaagucucuauaagacuucguacuuccuuucccacugaggccugagaaggcagccuagcuagaagaacauacccugcauacaggcaacagcuuuuagaauagccccuaucacuaucacucaggaaccacaugaagaccaagcuacacaucugcuauauaugugcagggaggccuagggccagccuguguauguuuuuugguuugugguucagacccugagagccccaaggguccagguuaguugaugcugguggucuuccuguggaguucugauccccuuaggggcugcaauccuuccuccuauucuucuguaagaguccccaagcuccauccacuguuugguuguggauguuugcaucugucugauccacagcuguuggagccucucagaggacaugauagacuccugucugcaagcauaacagagacaacuuacagcaaguccuuguuuggcauugagaggacccuaguauuuggaaaagucaguccaaaaagcaggaacucggguucagggugacugacugacaagaccgaagcccugccgagcauguggcuuuggggugugucuaccuaagcuaccucccuuccuccuggguaccaugcagggugccaugucuagucucugcugucauggacacccugugauccuguguucucuacagaccgggagcaaaugaucucucuuuccucccucuuuuccagacugauggaagggcugagacacagaaagugcuucucagaaggcagcucaauauggcggcugguguugcuccuacaaaugcaccuccuuguauccugaagccuuggaggccauugucacaguucaggacagugacccaucccuucccaaaucagccaaaauuaaauggccugaaaucuucgaggccccaggaacauacacuucuagaucagcacuuacuucucuucuuuuaacacagcuucucaugucuuugaccacacaggccaucccugucagggguagauccugagcucagggauugagcucugggaagcacuggccucucugucauaauugcuccuccucucugggaacacagacccaugcaucaacccccacuuugcagcagcaggcuugaguccuauaauuauaagcaugaugaagucugucucagcuggagccagaugggaacuaugcuaugaaagcuccuaauuacacaucucugcaaggagaaccaggugggugcggauuguaacgaugccuauugaggaaugacaacccugauaugccuauugaggagcgacaacccugauacacaacauggcaacauacggcucugaugcugggaaguucucgggaggugcuucccugcauuggcuucagggaacccacagagcuggguccccagcguaaagaggaaacacaacaguagccugaaagcuaagucucuucuauugagaaagacauggguguuaugcauucgagucauuccuaaagggaaaaaaaucagguuaaugggcucugggaccaaguuuucuccgugacagugaacugauacaaauguaugcacacauucaacccaaacacacacaccucauugcucacucacuguaaaacagucacuuacauaugcgaguguuacccuguugucacuugcagccacauaccuacauguacuuaagaaccuuaaggagcgucuaugucugguccaagucacaugacuggugaagaguagaggcaaagcuucaaauaacacugcaagcagugugaccaccauacuacacaguccccaagaaucauucgugucuggcuccauaaaaauuguucagguuucacagugagacagagagaagccugacacucugauauggucauucuuccggccucuauauaacaggcaugaaauaaccuacgcagagugugaugguuuguauauguuuggcccagggaguggcacuauuauaguguggcccuguuggaggagguaugucacuguggguaugggcuuuaacacccucauccuagcugccuggaagucaguauucugcuagcagccuucagaugaagauguagaacucucagcuccuccugcaccauuccugccuggaugcugccauguucucaccuugaugauaauggacugaaccucugaaccucuaagccagauccaauuaaauguuguccuuauaagaguugccuuauaaggucauggugucuguucacagcaguaaaacccuaauugagacacaguaaaucaagcaccgcauaugguuaccaucacaggacccaacacuggggcacaaguccaguuccccagaaucagagucccaaaguacccacuuguccucggaggcagcacacaaacaugaagaauguuuugaugaacuggaaauugccaaaauggggcguuuauaugccagcacuuuuggaggcaggaucauggcagccagaggggccaucauaugucccaagagaugugugggugacugagcagaugcaguggcauuuacccgugguuccugcuagugagguuaaggugggagaauuaucugagccuggggguugaauccuaggaaacguaaugaaauccuguucuaacccacaaaaugaagcccagggugagcaagguuggaaacacaacaagaaaaugccaccaaggugcuugugagaugcuguccagagccugggccaucauggcucaucagggaggcugauguaguauggccuuauuagggggugggcuuugagacucuccuccuagcuaccuggaagacauacugcucuugacugccuuuggaucaagauguagaacucuuagcucuccuggaacaugccugcucagauacugucaugcuuccugccaugaugauaaauggguugaaccuuagaaucuguaagguagcccuaauucaauguuguccuuguaagaguugccuuggucauagugucucuucacacuuaguuaggaaacccuaagacucgugugugugugugugugugugcaggugcaucugagccauagcgugcaugugcaaguggaaaucaggugacaacucuugagagagucuccgggcaccuuguaugaucugggauuaaacucuggucaccuagagacauguaggggaccuguuccagcuccugcauguucccugguugguagcguagcuucucugagccccauggucccagguuaguugacucuguggugcccuugaccccucugaguugcucaguucuauccccacucuuccacaagacuguccagauucaguaggaaagaaugugccuggacccuccuaggaccagaugccccaggguggcaugguacuuaagguaggcccccuucucugaggaauaggggugggggcaaugugggaagggugggacugggaagagaggagggacaggugcugugacugggauguaaaaugaauaaaaauguuaaauaaaaagaaaauaaguuaauaacaacaauauaaacaaaaaaaccucuggucaucaagccucugcuagcugggcuaugucaucccaggacccgcuuucuugaggccccgucuuagacagaguuacuacugcuaugaugaacaccacaaccaaacaaagacagggaggaaaggguuaacuuaacuuacacuuucacaucauaguccaccaguaaaagaagucagacaggaacuagaggcaggagcugauccaggggccuggaggcugcucuuacugccucgcuccccuugccuuguucagccugcuuucuuacagaagccaggaccaccagcccagggauagcaccacccacaaggggcaggguccuccccuuaaugaucacuaauuaagaaaaugcucuucgggcuugccugccgauggauucucuagagacauugacucaacugaaauuuccuccuuuagaaagacuauagcuuguguaaagcugacauaaaaacuaaauaucacaggccaggaugauggaggcaguucagagagaguagccaacacuggcuucccccaucagacaauuucacagguaucagagagacccugcauuugaccuaauuccugcucccuccgacuuuaaacccuacgauuuaauccugacuuguguccugagacugaggcaagcuggacggacgguaggugcugagcggcagaagaggcucaagcuaugcguauauucucaggggaggguggguggacuucuugggcccaugagcccaggucugaguacuccucugugggugcacaaugcgccugcuaaugaguuucuuuguucucucucuaaccuguccacuuugcagaucuuacaaaggacucuggaugaauaagcacgaaggaaaacacuaccuugccugcacagggauguucuagcuagggcuggaaaacaggagcuugugcccuagugaccagcuguccacugaaccaccucaggacagaugacagaggggagaggcaggagacauagguucucuuuuccuuucucugcuacccgccuccuacagccuccauaggcccugcuucauuagcacacugacugagguuucagggaaagcugacuccugcaagcaccuugaaaccacugggacaugggggcacuugacacuuuccccaguggcacugcuguagcugggcuguucucaucaagagaaggagaccaggacgagccucacagacugagccuuucgcaggcccucauggagacaagccuggggucacgcuaagcugaguuuauaaagguaaaaccagaaguuuggaaguuccuguugauguagucacaauggcuguuaccaagcaugacaagacaugacuguuuuaauaaggauagggcacaggaguuucacacgguguuugaucggggaauagaaagccuugugguuacaggagcagaaagaugcagguuaggaaaaguuucuguaagaacugcgugugccccaacaucaggcugagcucaguuuuagccugggauugggucaggauuuagcgaccucaguugacuuguagccuggggagaaagguccccauccucuucaucauuagccagaugugggaccuuggaagcuguaucgagccuuccugagcucuggcuucuuguucuaaagauggcaccagugccggcgcugccaccucagugcagaguugcagcaucugcaccaggcaugcaggcaacaagggcagaggacccucacuguaggccgcuuaucaaucuaccucuagcaggagcauucucuucacaccugcccugguuugaacugugaccugucccccacagguucccgugucagaacauuugaucccccuucugguggcacuguuucgaaagcuuaugaaaucuuugggaggcgaggcccggcuggaggaaguggguggaguuuuauagaccagcuuccuguuacucucugcuuccugacugaggaugagaccagcugucgacgcuaugcuucggucaucaugguggcugguagcagcagggaaaagucucuaagacagcuccuuagagaggagcgucuccagccagaugagaaggaaaagucacauccaugguaccaccugcggucacagcagaagcacuaagaccaaccagguccugguuccuacugccacaccauggaaacccccaagcuggagcccgugaguuuguucagggccuugggagaaccgaggggaagaugucgagcaucugggcugccggccauaccccaaagguugcagaagcaaggcacagggagugcucagugucugagauuccuguugggccgguugagcuugucaccugccaccuccuccucaccccagucucuccaaggaucaaggucaucccaagaaugagaaacuugacucagaaccccacuggguguucuggccugcggagaucagcucggccaugccuccaggaagucagcagucagggcacccggaagacaucuuccuggcaccggcuggaacuggauaggugauuuacugccauaucagcaccaauguggccaggugugccuugacagugaggccacaacuggcuuuguguucaacgcacacaaacuuucuacaagugguuuccuccuggccacgccucucucucccugucacagcucacacuggagcccaugggaugcccugcccucaaagcccaugacauacuguccuugggaaguuugccguucuaaucuuuauuuguuuagauguguccacacgaaaccauagcucucaucuuaacggaaauaagaguuuacucaggggucauuuugaguggcuaugggucccaggaacacagauugaagucaccccaaauuccaugucccagugaggaagcaguuucaaaguuuuacagaacgaagucauaaaucaaggcaaguuuaaaauggguuacuaguuauuucagaagcggguucagaaagaugugggcagacuuuauagauccgggauacuaccugagcgcuuaaguuaggggaagcuagggaucuguaaguuaauagauugauuuuuuuuuuccuuuaguugcaagauguuaguuccaacuuugagguggguaaggaauaguucugagggcuagaacuagcagcucuaaucagucccccaguguguguagacaccagggugaacccugcaaguaucuagccagggaagugaaucucgaagagacgagaacaaaauccuggugcagauugacuuugucaacguggaucagacuugggagucugaugucagguguuucacugucugcauauugaaaacauggugcagucagucugggaaaagguuucuaggcuacaaucauuccuguuccagaagcaagauaaagcuuaaggugugaccacauagugaguccuuuggaaaguacaugugaccgugacgguggagcuauagcuaaaaggucuagaauccaguguggucucuggucaagagacuauagaggucagcaagcuguagaauacgcgugacaucucuccuaaggaugggcucuguuaacugggagauaaaggugaggguagggaaggagagucugggauagagagaguuccagggaaugggugaggucugucucuauagcaaaagguggaugaggcauuuaugcaucuaaagagaguaaaaagucaucaggucauuaacaauauccacucccaacccuuugguuggaaaauagguauuuuaucuccuccuuugaggaggacccuuguauguuuaacauuccugguucccuagugcucucugagugcaaggaccuuuguguccccaguagacaaaagaagagguuuugugacauuuucauacauguuuugucaugagguggguguuuuccuaagaauacucagacauggguuuaagccaauagaaagucuauuauccagcuagugacuauacuugguguuugguaucccaguguagccccaggcuuuucucggggugagcuuuuaagcacagaaaaggcuauuccgaguuuacauauuucaguuaacaagaacaguuagccagaagcagaacuacagaagccaaaaggcaaggguaggacauucagacacuuccccacaacuacggcuuugaugaauaaggucuuuguuuuuauuuuggcagaugguguugucugcaugcugaguuucauagcccgaauggugcuuccaucguggagucaguucuauuaaagucugggaaauuguuacaguauguaauaaucuugcccugugcagcccucugucuguugcccuuccuguucuuccccaaugguugcacucauguuuucccauagcccuuaugugauagcuacucccugguuuugcuuaauaggaugaucuccaagugccauucauucuuugcugugguuuaaggaaacuccacuuguaauaggccacauuuucauuaucaacuguugcacuuccauaucuaggcugcuucuauaauuuggcuacaguguagccagugaacaguguagcaauagacccugugugcagguggcucuacaaaaagcagacuuugacuccugggguauagacccagaaaugcaauacaauagcucaggguuaguaguucagacauuggcaccugcucccacaguggcuccacuaauuuacccuuaugccagaguguuuauugucccuucccuacauccucacugaucuuucguuuucuugaugguagagucauuccaacugggaugauagccucucaauagauaacauuugauuucauuuucccaguuucuaaagauguuggaccccuuugugcauugauuacuucuucugaaaaguguuugcuuuguuuauuugaccauuugcugguggaaugguuuguccuuuugguaguuauuuaguuccuuauguagucuggacaucaggcacccuccgagugcacacacacaugaauucuucacgccaucuccuuacuccaguguuuugguuccugugcaguuccauagcugaugucgugauuucuguaucuguuuauauccuccucagaaagucauggcauaugccaaggucucuaccccuuuccucugccuuccugcaggguuugguuuaggucuuacaugaaguugcuugguccauuuugaguugaugcuguauaggaugaggacugagucuccaucugaauccagguuuuccucccugaacuugaagaagccauaucuacuccagcauccacuuuuugccaucuuugccaagaaucagacagcugccgcucuguagauuuauuucagggucuucuuuucuacuccauuggucuacacaucugucuuugugucaguaccaugcugguaguuuuacugugguucugucauauaauuuaaagucaggaauuaagugcugugcgcacaggauugcuuugugugugcacaggauugcuuugugugugcacaggauugcuuuaugugcaaaggauugcugugugugcacaggauugcuuuaugugcaaaggauugcugugugugcacaggauugcuuuguaugugcaaaggauuccuuugugugugcacaggauugcuuugugugugcacaggauugcuuugugugugcacaggauugcuuuguggacuauuuagcauuguuuguguuuucauaugaauuuuaaguuuggauuuuuguuguuguuuuguuuuucuaguucccugaagcaggucauuggaauucuggugaagacugcauugaaauuaaagaugacuuuuuuguagcggagccauuuucacgguuaauucugccaaccugugagcaugagaggucuuugcauauucuaguaucuucauuuucucuucuuaguguuuuccuuguagaggcuuucugguucuugggcaugcuugcuccuagguuuuauuuugauaauauuguuaaagggauuguuuuucugacguuucuagugauuuucuucuucuuguuguucuucuuguuuaguuguucaagacaugguuuuucucuguguauccuuggcugcccccccuguagaccaggcuggccucaaacucacagagauccaccugccucugccucugcuucugccuccugagugcugggauuaaaggcaugcaccccuccugccugguuucugauuuuuuaauuuguguauaaauagaugauuuuuuuuccaucuugcuacuuugcuggcaguguuuauuagaucucagagucucugacaaagucuccauguucuucaaagucuaagaucaguaaacagaugacgucuuaguuugggaucauuggugugaagggacaacaaaaccaagguccuucuuauaaagacaaauguuuaacuguuuaaauguucagcugcagagcagaaggacacugcugcacacuuuaucaugaggccuggugcuuacuaaagauuaagccaucugucacaaacugagucacuuguuaucauuuucugucuauaaauucuuaagugaacgaguaguuggaaaggauguacauguauauauaaauccuauuuguaacgaaauaagauaaaaauacaauauacauaaaagucuaugucuaaaaaaaauggaaauuaaaaucucuacagguuuaaaucaccccaguuaucuaacugauucuaucuauauuagcauauauaaaagcaugaaauguccuccuguuaaaauaaccaugugccugaacucagcuucugcuuccuaauauccuaaagaaaacccaaggagagaaaacauuaacuuaguuucauaaacuucauuguguauauaauacauaagcagaaaguuucuaaauuucaguaaggguaacaccccaugcaauuauauacauuaagguugauaagcugucaugcacccauguuuguacugauuuucucaugaaugcauaauaacuuuuuaaacuauggcaaguuaaucaaagaauucucuauaaucaaaauguucccaccuacaucuuuaccauucacuaaaaaugaaaucauagcacucaauuuauuucaauuuucaaaaaucuucaagcuaccuaucuaaauuuaacaguaucuucaaaacucuacccuauucaccauaguuaaucagcaaacauuuuuuuaaauauuugcuuaauuucuuuuuacugauaguaaguuuuucauguaauauucuagucacaguugcaaauuugagcaguuuuuucaguacucuuauacugucuuucacaacugacucaagacagguaugagugguugagaaacugggaaaagauagaaagagcaaacaaaaacaguaauuucugaguagccucuaggccauaaccauuacugcuuuccaguggggaauuuuauaaacaacagaaagccacagugcuuugcucaggugucaaggaagaauuuuccuugccauauuagcagcaauccucaacuacaguugguaccugguaccaccaagcccuuccuccugccuaucuucuuguuucacuguuuacaucaccaaaugaccagggcagacuggagugucacuugguaccaggcauggagaaaauaagaagguaagcugcauaaaucagcugagccauuuuaggaagaaggucucauuuguuccagaguuucuaacuaugauuauuuacaaaaauaauagagcaaagugagacaaaagcaaauaacucacuuuuaaaaugaauuuucuugacaugauucacaaaaucagaacuacuuugaacaggaucaucacuguccuguauucucagucagugucagggaaaugcugcacaagagcuacagguucaaccagacuucaacuagugaauccuaucacacaguuuuccaaucacacaguucuccaauccuaucacacaguuuuccaaucacacaguucuccgauccuaucacacaguucuccaaucacacaguucuccgauccuaucacacaguuuuccaaucacacaguucucagauccuaucacacaguucucagcuccuaucacacaguucuccgauccuaucacacaguucuccaaucacacaguucuccgauccuaucacacaguuuuccaaucacacaguucucagauccuaucacacaguucucagauccuaucacacaguucuccgauccuaucacacaguucuccgauccuaucacacaguuuuccaaucacacaguucuccgauccuaucacacaguuuuccaaucacacaguucuccgauccuaucacacaguucuccaaucacacaguucuccgauccuaucacacaguucuccgauccuaucacacaguuuuccaaucacacaguucuccgauccuaucacacaguucuccgauucuaucacacaguucuccaaucacacaguucuccgauccuaucacacaguucuccaaucacacaguucuccgauucuaucucacaguucuccaaucccccucugcccaaaaugaacucaccugaacuuggccgugcucccugacacccagcugccacagcacugagacagcaugacagugcagguaagugccuucugccuaaucccaacuaucccaaucucaucugaaaacacagcuuauaaacacaucccacacccuaccaccuacacaaaggcauuuuuuuaaguagccauacuaaaaucgagcuacauaagaaaaggaucaugugucaagugucagucucacuuguacaguagugaccugucuaccaugugugacuacuaaacaaguaaacaugaaaauagaaacuaagaaaggcaccuagaccuguccugcuaauacugcauuucuuagcaggcagguacacuucucacucucuccucugagaccacaugcuuucaucuguguaagccagccucuaacaaagccugacaaggaacagguucucaaucaguccuagucugaaugaacaaagacugccugcaccuaagacaacuccucacaauccaaagguaaccuuaaaugcucaaggguuuuuuguuuuguuuuguuuuuaaagcagggcugggccauuaaaaaacaaaucaaagaaaagggaacaaaugcuuccucgcuguaggaacucagccuauguucuaagcaccaacuacuucuaaacuuucuguugcuuacacacaucgcucaugauguaaaccaaugagcacuguaaaguacaaucugcaguacaucucuagaacugagcugguauuaacaaccaccuacauuaguaaucaaacacuaacaucaaagcuuaagacuccacugaacuaauaaaaugucgaagcaccgaaacuuguuccaaagcugcaaacuaagaagcagggcuuugugccacuucauuaaauuauaaauaauaaauacaaauuuaaaguaaaguaguacuuuacucaagaauacaaaggaccguagagucagaugcuauguuauauuuguguguguguguguguguguguguauacacacacacauauagguuugaauaugcuugacccagggagugacaccauuaggagauggcuuguuggauagguguggccuugccagaggaaauaugucacugugugggugggcuucgagacccuccucccagcugccuggaagccagucuucuccuagcagccuucagauguaagauagagaacacucagcuccuucuccagggacaugccugccuggaugcugccaugcuucccaccaugauaacggacugaaccucugaacccguaaaccagccccaauuaaauacuguccuuuauaaaguuguuguugaaggugucucuucagugauaaaacccuaagacaauacuaagaagguuauuuuaacacuuauuuagugagauuuguucucaugauaaaauuaaguaugcaaauacguuauucuuaaaauacuuaagagaaggccucuuuuuccuaaaaggaaagcaugagggcccugcgguuguguaauuacaauuucuaccacuucagugaccucuguagacugcaguucaaguaacugcagaaguaaguaguucugaggcuuuguuuuucgugugugugugugugugugugugugugugugugugugugugugcguaugauguuuaguauguguuaugguuuauuucugugugcacaugugugccgcaugccuguguauaggucagugggccaguguuuccucaaucccuacuuauuuugagacacagucuggcacugaaucugaagcucaccacuccagcugcacugaguggccaaugagcaucaggaucugccugucucuacccuuccaccuuagcauuagggucacaaauguacacaucagcuuuuacacggacguuagguauucaaacucacuucuuuuuuuuuuaaagauuuauuuuauuaauauauguaaguacacuguagcugucuucagacacuccagaagagggagucaaaucuuguuguggaugguugugagccaccaugugguuccugggauuugaacuuuggaccuucggaagagcaguggggugcucuuacccacugagccaucucaccagcccucaaacucacuucuuuaugcuuuugcagcagguacuuacuucaacaaacaagcuaacuccccuguccgaaucauaauuuuuaaauuguacauagcucugaguccugcucaggacaugaacucucuuugucuugaguuuccacaauguauaugguuuuugccugucauuuaguagcuaucucuauuaucaaauggacuguuaugguacuacaauguuuaaguaauacuaauuuuaguucauaauaaccacaaaauauagauuauuuuaaaauaauguacuacauaauuauuuuaguauugucgcuaauuucuguucccaaucuauaaauuaaacuuuaccauagagguguauguauaaaaaaauugugugugugugugcguaauuauauauauauaaauacgcacgcacacacacacacacacacacacacauguguuugguacuaucccuggcuuuaggcuuccauugaaugaaugaauccuuaaugaaucccgaccaaccagggaggccaacugguuuagcuccccacccagaagcuuucucaccaagcuuuccuaaccucacacaaaggaaaaacaaaagcucauccguggacggaagucucaucagcuuaccgcuaagccugcccuguauaugaaauucccuccucuuuuggaacagcucacauucaucugcauacaguaagaaucugcuaaucacaaucaaauacugccuaugaacuauuuuucuagaauucaagugcuaccuugagaaaacggauauagaauauuauauauacuauaguuucaugauaucaaauuagcugagcuuuagcagaaaggagaaucagggucucuaaaagucacagaaggaggguguuuuguuuucagugaagcaguaagagggagggaccagggacuccuccagcggaugucagaacacugucagacuccuugucucauauuuauuuucucuuucucccugucccaugagcacagggagguuucaguaaagcuacaaagugucguucacacauccagcacucaugcaauuuuggcuguuauguaggaaacaaaguaacuccauacucugccugagcuauugaaauguggcauguaucaucugagccaaagacagaacaaucgagcucaaacaaagacuguaacagagcuuuacaagucaagauaaaaaucaauauacuauagacugacugccaucagccagaugaccugaguucaauuccuggaauccacaugaucaaaggagaacugcuuccugcaaguuguccucuaacuccaacaugugccauggcacacacucccaugcaugugcaugcacacagugagaguaaacaaacaaacaaacaaaugaaaauuuagaaaucaauacucugccagguguggauuacaaacacaguaguuaauaggcaaaugucaucagacuaccugcccacaaaucucugcuacacaacugacuagcuguauucccucacacuagucaucuacucuuacucuacuuucuuguccauucacaacugcaaacagcaaaagaccuacccccuaggguugucgugaaaacugaaggagagaacauagagaaaguauucacauaaguaucagacuaacagugggccucaggaagaguggagcauucuuaccagaauaaccuggaucaguuuuaauaacuaaauucuuggcagagaugcaucuaagaaauaugauucauuacuggcuaaaauggaaaugauuaaccagauacaauauguacucuccuaccccuaaguaaaauaaaauccugcaagaaacucagaaaggcaguaugcauuucuucagacagcauaccacuggauacuuuguuaccuuugcuuuuauuaguauuuuccaaauaucuaaaacaugcauuuuacaauaaaacaacacucaccuuuaaaacugauaauuuacuacagcuaauccugucaggucuaacaguauucaagaauacuaacagucacucaaaacaaaacaaacaaaaucaacaacaauauuccucaaaacaacaauuuuguaaauguaauuuuuuaaauuuaaucuguaaaaaucagcaaauauggcauaaaaaucacguuaacugcaccaugaacucaccgaggucaucucugccaaacuugcaauaaaacaguuuuaaacacuggaaggccuaaacauuagacucaguaaaaucacuguccaugguacucauggcaggcggcgccucucagauaaacaggggcuucgcugaucuaaagagaucuuauuacaaauucacauacuuaggaauuauaauuccuugucugaauuguaauguccuuauaaauuaauguuuaauaguaagccuauuucacuaaaugguuaaaaauaguacaccaucaaaacaguucaguaaugcugucuacaacauuaaauauaacaaggacccaaugagccaaagaaacguauacacacucaggaauuaacaguaugcuguacuguuaugaaacaacuugccacuagauuaaaagcaagggaacccuaaaugcugccagucagaaauccaaguauuaaaauuccaaauggacacgauagguuugggcauauaaaagcugccugugcuuguaugacuaucuuuuuaucaaaaucuacucuaagaaaggaaaagaugacacgagugagcacugagauucucuguuuaaaauaauaaaaaggucuguuuuguccuauucauguguguguguguguuguuaacuguuuucuaaugggagggagaaagaaaagguguggauuuggguggguggggagguagggaggaucugagaggaguuggagaagggaaaacaugaucagaauauauuguauaaaaagaaguauuuucaauuaggggaaaaaaaaaaaagaggguccaggcuggagagaugacucaacgguuaaaagcacugacugcucuuccaaagguccugaguucaauucccagcaaacacagaguggcacacaaccaucuguaaugggauccaaugccuucuucugguguggcugaagacagcuacauugcacucauaugaauaaaauaaaucuuuuuuaaaaaaagaaaaagagcagggugugguggcacacgccuuuaaucccagcacucgggaggcagaggcaggcggauuucugaguucgaggccagccuggucuacaaagugaguuccaggacugccagggauacacaaugaaacccugucucaaaaagccaaaaaaaaaaaaaaaaaaaaaaacuugggacaaauuacaaaauacguuuaagaaaacaaucaauauuaaaaaaaaaaaaaaaauuccgggggcuggaaagauggcucagcgggcaagugcuuauugcucucacagaugauccaaguccccgcucaaggccaccuguaacuucuccagcucuaagggacccagacccaacaagcucuucugucuuccaugggcacaaugaacagaacauacacagacaugcauaauuaaaaagaaaacaaaccuuuaaaaaauacuccacuaacaaggauuugcaugcaugagaggcgcccacggccuuuuugguaauaaacaacaauuaaacaccaacaaacuauugacuauugagcaaccgauaaaacaucacauggacauuaaggaugacaggaagauggugagacgaaugugaaaaggcaaauucacuaaggaccccugugacagauaucuccacagugcacaggaacacagucagaagcacugugucaccuugucagggaaagggcagccuucuauugaauaacaauacaaaggcccucuugugacuguaaguucuugaaacuaaagaaaaaugaaaaaucugugucucuaaaaacuaauguucugaagacacccuacugaccucacucagaaacccauuugccgcuacugagaaaggugccaccacacccaggguccaguucuccagagauauacaauucauggggcugaauggcuucccagaaugcccuguggccuagugcccauggcugacaucaucggacaggcccuaccuacuuuguccaucuugaacacauucauacagcacacuguugguuuguaaagacaagauuagcuguuuuugcaugucugccuauagaaaacccagaggcaccauuaccuuccucucauaauaagcacuccucaagcaggagcaaagcuaugucuguugaccuuuuuucauuacugagguagagcccagggccuugcauaagacaggcaaggcucuaccacugaacuccauucacagccuugaguuacagaguuugagugaaaaaaaugguguacugugaaacugugaccauaaacaaagacuacuaggugauguccacuaaauagaggauuacuuacaaaaaauagcaauuuuuaauagaaaagagaacuauuugguucucuauuucacuauucaacaacucagggggcaggggggaacaacucaacuuuuuuucuaacugcaguagaacaggauuacagacucuccuacaggccccccaaaacagagaugggauauuucugauggucuuauaaugacagcuauagcauccaagcaauucaaggcucuaacgaaaauguucaaucaagagcaauucacacagaguaugcgcuguucucaaauaguugccuaagaauagauuuaauuaaaauaagaaauuaucauagaauuaucagguauguggaaagacaucaauaaagacuacagcaccccagucauagugcugcaaugcucuacacuacuauaaaccagcccggagccuggcacucaauguggccgugagugagguuucacuucuugcaagcuguguaucuuucaguaacauucucccaguugauuacauuccaaauagcuuucagauagucaggucugacguuuuuauacugaagguaguaagcgugcucccacacgucaauccccagcagcggaauaaggccuaucagaaagagggaaaaauuacuccuaaauacaacaucauucacuugcuucuuagauaacugaaaauuugcauaucccugcaaaaacauguaaaguuuuuauuuuggaagaaaauauaauaaauaaucugaaagagccccugaaaggucaaguuaaacuacagaagcuuaaucccugaugcuaaaauagcaauaguggcgccuagcgcugaagcccagccucccuccuagucucaggcaggcaccacaagcgaaagagacagcuaaggcccgagcuuccauuccagagggcuggagggcaggaggcuaagaaacugcuucuauucuccaaggguacuuucaguuuucuggaauaaacaucaaugagucacuaaaaagaauugauuaacaagaaguuaaacagaagcaaagaaaaugaacacuaccuucagaaauuaaaugguauaaaugaagaauuuaguuccauacguuaaaaaaaaaaaaaaaaguaaguccucaagucaguuaugguagcauaggucugugguaacagugcacggaggcucaggcagaagagcacggaauaggccagaccauccugagccucaaagcaagacucagucuuaaacacuucucaagccuuccuaugaaaacaucuccaccacuuuaucuagguaguugugaggaacagaagucauuacuaauaaaguagcaauauuuugugugacuuuucaucccagugugcuuucuguauguggaggagaagggcaguggaagccacaccucucaguggguacccgaggagcaggucugacugaggaacucacuguacacaagcucaccaugggcuuaacagacucgguggcaucucguguacaugaagaacgagugacacgguagaggugagaagaggggccggaacuaauguuugagaugucacagcagagacggaagccacagacaacugcuacacacgguggcucuccacuucccucagucuucagugacauauaggauaaccaguucaaucagacccagggaacaagaaagcauuugcuaagcugagagugucacacacugaagccaugcagggagcaggaccgaggcccugaguccuggucccaguuuuaagcacaacacucacgaggaaaggaccuguuccagucacccucagccuguauuccuuucuucucuuauugcuuaccuaauaaucucaaguuuuuauuguagugcauacagaaaucacccacgcuuauuuuacagacuaucagucaguuuuuacuauaaaaacuccggguagaauuuacuaacauuugcucaaauuaucacacauuccucacacacuuaacucugcuaauuuaccuuacuucuuagcuuaguccuuucuaggaagccauggcacugacaugggaagaguuuuaaagcucacucaccuguuguuccuugcaauggguccugauuagagcaggcagcaaucuguaagcgaccuugcuccuuauugaagccaagccagccccagccugaaccuuggacucccacagacacggcugucagcuucuccuuaaacuucucaaaagacccaaagucacgcuugauagccuccagcaacucuccugaggggaaaaaaacaaagccagaaaagacuucaaacacuacaauaaaauguuagguucaccacacuaaaauauucuugucaaaggaccaacuggaccacaccugagagaagaugccuacgucccaccgcaaggacacugggcugagguugacuagugagugcaaucagggucucucugcucccuguacuagugaagaaaacuaggaagggaagagccuucuccaugggccuccuuuccguuucucccauuucacaguuuuauccuauucuauaaccccauuuggaaacugaaaguuacugcugcuauucaacauccuccaauccuagaucuucccaucuuuaucaucuuguucuuuaaaugaaggcuucucuuguuacugagcuaaugguacacuuaagagggcuggaguggagcucaaugaacacaccuaauagucacgaagcccuggaguugaccacaacaaaguaaaggaaagagagagagagagggcagugagggaaaauacuaacaaacacgcacaccuggacucaaacuucugagucuccuaccucucccucccaaaugcugggauuacgggcauguaauaccccuccccuagaaucuuuuuacucuauagaaauauagaacuggagccgggcguggaggcgcacaccuuuaaucccagcacuugggaggcagaggcaggcggauuucggaguucgagaccagccuagucuacaaagugaguuccaggacagccagggcuauacagagaaacccugucucaaaaaaaacaaaaacaaaauaagaaagaaagaaauauagcacugauucuacaugaagcaaaucaacugaaucaaauggguccaacaucucacuucucucauucuauuggcuaaaacauaauuaucuuuuacaaacauggcuaaugcuucaggugggacaaacuguguaacagaaacaucaacaggagaaagaagagaaggagggagaggaggaggaggaggaggaagaagaagaggaggagaccucaacacaccuuauauccuggucauagccaaaaccugacaaguaucaagucauggucaaagugauuauuacuagugaguaagucaggcugccuuuuacaacaugguuuacauaaacagcacaagcaacauuaugcugggaauguagcucagcagagaagguuggccuagcaauggaagaccacguucaaucccagcaucaccaccacagagaaaaggacuggagaagaaccaacaaaaccagaaauuuaaggcacaugcaagagggagaaaaaaucaagggaggagaucuauacuauagcccucaccucccuaaauagaagauaacuaaagccacacaggaagucagaggaaccauggcggccauauaacuaucuaacgucuuacagaaaauauauuaguguacagaguggcuaaagaguagagaguuugguuuguugcuguuguuuucauuuugguguuuuguuuugcuuuuuaggauuuccuuuuauuuauuuuauauauaugacuacacugucacugucuucagacacaccagaagagggcaucagaucccauuacagaugguugugauccaccaugugguugcugggaauugaacucaggaccucuagaagaguagucaauguuuuuuguuuuuuuuuuuuuuugguuuuucaagacuggguuucucuguguagucaaugcucuuaacuacugaaccaucucuccaccccgaggauuuguuuuuguuuaaagacaaguaaacugucucuucauugcacaaaguuuuucuuuuuguuguuuuuguuuuuauuuucauaaaaaacuuguuuuacuggggcaagugaguucuucacauuagaaauaauaaucaaaagcacuacucuaagcacuuuacauauaacacugaaagcagccccauaauuacuccuguaucccauggauggcuacgugacuacgugucuucuuucccaggguccagagccagcaguggaaaggucauagucucuaaauacgagguuugcccagguuuuccuuaacacuuauccuagcagugggcagugcaugcagcauuuugugugugugugugugugugugugagagagagagagacaccucccugaacacacacacacacacagagagagagagagagagagagagagagaccucccugaacacauucucuauuccucccuuugaaacuuaagaacguguuacaaccugacuguaaaaaaaaaaaaaacaccaauaugagaacucagguaauaagaaaacgcaaaguccucuggaggcagucaauagguacauacuuuggcauagagaaaauacugaguucagucccuagaauaaaaagaagaaagucaccuccacacacagauauauauauauacacauaauaaaaauuauauaauaaacugccucaaaaaaauaaacaaauuuauaaagacugucuacauacugauuuccaagaacuacacaguaaaacucuuguaaaagaaaauuuuaaaaguuaagaaagagagggggaaaaaaccaacaaucggggcuagugagauggcucagcgguuaaaagcacugacugcucuuccaaaggucccgaguucaaaucccagcaaccacaugguggcucacaaccacccguaaugagaucugacgcccucuccuggugugucugaagacagcuacaguguaguugcauauaauaacguacauauaauaaauaaauaaaucuuaaaaaaagaaaaaacaucaaucauuccuacuguccaccaaauaugaagcuguagcagcuuauaccaaccuuuggguucuccaccacccuuagggcucagguuuguccagaaaauggugugauuaauaugucccccaccauugaacuucagugcaggcugaagagcgaccugaguuguaacaucuccugaaauauaaaauaagcaccuuuaaaaaaaccuguccucagccaggcaaaccaagccacaguuuucuuauucuugacaacauucacuaaacaaacaaagcucuggcuccacagaaggauuacaaucaagaugucuggacaacauuaagaagaaaguuuucuagaugccagaugucaccuuaaaggaaaugcuuucccaacugggcuauuccccugcuucacuauuaccacauccuccccagaucugcaauuuccaaaaaucccagucucuucccguauuuaagauuugugugauuugcuuauugcaaguaaaauuuccagaaugugguaauauuucccucucuuggauuggccacuuacacaauuauguugaaauacuauacuucuccacuagaugccccucgucagccagaugucacuaacauuuuacucaaccaauuucccagauaaaaguacauuuaagaaaaggugacucagcaguuaaaagcaaugacagcucuuccaaagguccagcaaccacaugguggcucacaaccauccuuaaugacaucugacgcccucuccuggugugucugaagacagcuacaguguacuuacauauaaaaauaaauaacaaauaaaucuaaaaaaaaagaaaaaagaauuuuacuaucugguuuuucaagcaauaugacuaacauagagacaugacuacaaauuaauucuccuuguaaaaaacaauagauuaaaaagacuauuuuguuaaauacuauuuuguuuagccauuaaaacaauauucccaggggcuggugagauggcucagugguuaagagaacugacugcucuucuggagguccugaguucaaaucccagcaaccacauggugguucacaacuaucuaucuguaaagagaucugauguccucuucugguguaucugaagacagcuacaguguacuuacgcccucugucugaagacaguuacaguauauguaauaauaauaaauaauaauaaaaauauaauaauaaauaaaucuuccaaaaaaauucccagaaauugugguugacucaacagguaaaacacaaaaaggcucuugccaggaaaaccugacacccugacuugaauugacaaucugagcuuaguuucuggauaccacaguggaaggagagaaccaaugcccuagguuauccucuaaccuccacuggcuccgugugucagcacgaauccauucacacacacacacacacacacacacacacacacacacacagagguuuuuuaauacuauagcauucccauauacaucaucuaggggugcaaacacagaacucugcacuauggauuuuguuggcugagcgcuuaaaaauauagguaaauaaauaagcuugccuacuguuccauucagugacagauacucaguuucucacaaaauagcuauuuuucuugugaacuuugaccccaaaaguaccaagucuagccuguucugcagcuaagugcucguuccugucuuuuccuccccccccccccaaggguaaagagugugaaacaggauguccagagauauccaaggggucagggagucccagcccuagacugaacuaauccuauuguuguccacaacggugacaauaaucacaacucggacugcagucuucugaugccacuucagacccucuccugcaccugcugccaggccaccaauaucgcuugcucucagcaaaaccccagccacuucuagccccaaccacccucucacccaagggcaccuggcugacccagcucgggcacucucaacccuccugcaaauggcugccaaggcuaccugaaaaauaagcaaaacaaacucuccugaagccacguuauauaacaaccgcauauuuuaaauauucauaugcaaaacaaaaacuaaauauucauuacgcaaaaaggagcagcguccgagagcugucuuuaaaggaccaccaccaaugcuagcuagcaacacgggugacaaaaaaggacacaacaguaagguccgucaaguacuuucgugagguccuguguuuuccgggauaggaaaggacguuuaugcgaaccaacggagguauuccccggcaucgaaacagaccuccguccggccaccgggauccucgugugcaggggccccgcaccuacccuuggccagagccucgugguacuucuccucgguggcguugagauuguucacguaggccgcguggugcuugcuguggugcagcugcaugaucugcgcguuaauguguggcuccagcgcgccauagucguaaggcaggucugggaggcugugcuugugccgggagcccgcggcaccggccacagggcccagccuccugcccgugcugagaggaacagagaggacggcgggucacgccacugacacggcgagccagccacgcccgccgccccgagacccacccguaggggacgccgaggccccggggcccugccgcucaccugcacgccgcccgacacaacauuauugagguuuacacgaccgcugcucuccucagaacacggccguucgcucgcaggcgcgcgucugcuaggcagcguccgcccggcguccgcaaggacacagcgaagcggugacccugcccgcagcgcccaucagcggaggggaggacggcgacacggacggcccggcgcauaacggagcggcauccugggaaggcaacgucuccccugugccaaauugguagaggccgcgugcuugcuacagccacgcccccaccaucggccuuggccccgccccgccucggggaaccccguccgccccgcgguguggcuccgccccuccucgggccgcccuguccagcucuggcugugagcugcaaagcuuccacucuauuucuacuccugcuucugggaaacccuggagacuuuccuccggaaagccaaggcucugcugcuggucagaauuauggaguaaucagggccccucugacccaguuaauuuaugcccggagugaccuucccuggggccuaaccugacauuaaaucacgucgcagguuugcguguguucaucuuuguugccccugagacugggguugcggacuccgggugcagcuugccaguuaacuaguaagaguccggauuagaaggcgagguucaucuuucuugauuaaacucugcaacauucagugacuucaaaaaccaacccacucgaccaaauguaaaaggacauuguuucccuuuguggacuuauuagucuaagaagcaguggcuaucaaauguuuccauaacaauuauacagcuuuccucuucuacuuaauggguuuaugucuucccugauuagaaaacacuaagaaagcagaaggcaguuggcugaguaguucccggugguuuuuucccacccccuuugcaggccuccuaaggaugacagggcuuaggguaaggggaauugcaagaggaugcuuuccgguagggagaaaccuguccacaggcgucagaccggagcuguauggaugaccugugucuuaguuaggguuuuacugcugugaacagacaccaugaccaaggcaagucuuauaaaaaacaacaguuacuuguggcuggcuuacagguucagagguucaguccauuaucauuaaggugggagcauggcaguauccaggcaggcauggcacaggcagagcugagaguucuauguccucauccaaaggcagcuaguggaagac

SEQ ID NO: 8390 - RNA, 146508 nt, Mus musculus
cuagugucucucucuccccguucuaacucagauucguuguuuuccccgagguggcaugcgcuccgcggagacacaaagggcgccgccgcucccuggccgggguugaggaaugcgggggauccaaaaggcacccugagccggaggagggcucggaaaacauuugcacugacgcucacacacaaccauaauaauuuaucuuuccuccggagaaaggucagcugggauuugaccccagcagccagcgcagcccaggcgucagggccgcggcgggauggccggccaguuccgccggccgcgcagcccacgcccaccuguccaucccgcucugcagcuccgggucgccccgcccgucagggcgccgccccucugcucgccagcucguccgccaccccugagccugcccagggcggaccgagcgcggccgcaggaccgagcggcuccggugaggacucacgccuccggcacagagcgagugcggcccgcugacacccgacgcgccccugcacgcacgcacgcgcgcgcgaccacgcggcagcaccuagcggcgcggcgcgcgcucgcggggacgcgcacggcgggcgggcgcgcacggcggcgggagggcggggggcggcgcucggcgcaccggccgcggcugaggcgggcugaagcggcgcgggccggacgcgggccgagcccggcggaggacgcgcggcggcggcggcggcggugaggcggccugcgguguuccggcccggcuggcccuggggaggagcggccgcgaucaugucggcgggcggccgcgacgaagagcggcggaagcuggccgacaucauucaccacuggaacgccaaccggcuggaccuguucgagaucagccagccgaccgaggugagcgccgccgccgccgccggggugcgaggggagggggcccgcgcgcgggccggcgacgcggaggccgcgggaggcagagcgcgguggggucccgcggccgccccucccccgcuggccugcccgcccgcccguccgcccgcggacccgcccucgcccgcggcccuguccccucggccuccgcccaccguacuggccagcggggucccuaggggcgcucguccuugucgccuccugcggugccccgccgcccgggcgggguccagggcggcuugguggccggcgcagagggcgggccggccaccugcgcgcggagacacaccuggacgugcacuuguguccccgggacuccgccuggccacccacguggguccucagaccccaccugugucacccgcauccuuuccaggcgcgcacuuguguccucaggccccgcuugcgcccacaggacugcaccuggccgcccaccugugcggcacgacccaccugugcccucccggcccuuaccugccagcgcaccgguccccgucgcggcccacgcaggccgcgggccuuccccugcgggaugcgcuccucgccgccgguuucuuugauggcgucuucgaaccgucgggacgcggaucucggccccuccgaggccacgugaccggccgaugcccgcggcggugugagccccgugcgccccacggcgcgcgugcguucuagcccggcgggguccgguggcgcgcagcgggcagacagauaaaccccugcuccagccccgugcgcuggcgguacgcagcggggcugcgggaagcguucuggacgaucuuggggguggggugagggccgguauccagccagccgguugguaccggggagacugucggaggaguuccguggccggcgggaagccucggggaagccuccguuagacagcgggccaaagggcguuugguuaaguuguggcugggcagaccuguuccacgcgaccccacacuauacccaggacuugugccggauuuggaaauagcucuggcuuugaaaccuaagaggugcuugcugaaacacagcagccagcgcuuagccgcgaacacagauuugguagaucugagcagucuucucagauugacuuaauuuugccgguggaggaaggcagguuuuccucuccuucccucucaccuucuugugagcacacuugaccuaguuagagcccuuucucucgaucccuauuugacaagcuaagguaaauuauuagguucagguggccaauuugaacaccgguggauguuaaguuacuccugauucauaauucaucuucuguaacgauuuuacgaguuguauuuuaguaagcaaauuuacuguguaguuaguguucguucauagccuuacaagcgacucuuuagaaaggagcccugaaucaauauaguuucaguauuauuuugucuuucagaauaauuagcuugauuuuuuuuuuuuuaaauggcaggauaaacuuugcaaguaaaauauugcuagucaagugaauucccuuguuccucccccucccccagaguucuuaucugauuaagaaaagauguguuuucuguugagaaguaacagcuuaguguuuuagucuuaaauugaggaguuagcuuuaaaacauuuuaaauuaaauauuuuagauuuaacuggauucuauucuauaagcauucacuugaaacuuuaucauuuuggagagaugaacaguaaaguugcauguuuuguggaauguuccccccccccccccccaguuuucugcagguaaagaguuguguagacaaugaaaaaaauuacaggacuuaaaugaaauuaucuuuuucauuacccucucuuacaucugaacauuucuauuuuuagaaacaacuuguaauugaaagccuuucauaaugaaauuaauuuguuuucaaaauguaauggcuagcucacauuuucuauuuuguuguuuuagagaaucuuugaguacuauuaaaauuauucuguucaauuugaagcuguuuuuuauuagcacacuauaucauauaaguaagcugaguucuaugaguaguguaagaccaguggcugcagccuguugugucugagcugcaucugcaaacaguuuuaccauccuguuugcuucuuauuccauuuggcuguuacaauuaagcagguuucuacaagaggauaggaaguacaccaaccccuguagauguucagugaccauugaaaagauucccugcagaaguugauuugugggaagguuuaagccuuguauuuguuuaauugggcagucuuuuaugcuuguuggugagagcaugaugaguguuuucuauuguuuguuuauuuugguacaguguugagugucaccugugacuugguugugucugguggugauagccacugauggaugagucuucgcuuucucuguggguuacauuuaccuuuaaagaaaaugcaucauccugauuaagcuugcacuucccuucacguuuacaguucuguguaaagggacccguucugggaaccagcaagguguugcugagcaguuuucagucaguccuuaacuugggacuuguguacuucuugaaaaaaagaguuaacagucuaaacucaacgugaacauuuuaugacugggagauugauguuaacucaauuaauaccauggccacuauagaaacugauaaacauuuucucaaagcauuacuggacucuuuccuuuuaaaauuagggcuuugaaauuagggauuucugaugauuuuaaugggagagugccccuuugaaucuuuguuauuuuccaguacuguuuaagaagucuucucuggucauccccaggucuuaccuagacuugucaucagaauugcuguuuuuuucucccucuucauuacacaaggcaagaaaugaaauauuuauccuugcagaacugcugucugucacaguugguacuuaguaagcauaaagaaagaaauauugaauauuccuggcaaaaaaaauuauaaaaauucauugaaaauuguucacauaguaaaaauuuguuuuguucugacuuuugcauaaagguuaugcugauaaacuuugcuaaguuacugacuuuagcuucaugagauacuuuuuagucauucacuauuuauuuaauucauuguugccuuuuugccucuggggagaaauaauccagaauuuguguacacccacauguguuuuauuauaggugaacaugauucauucuaauuccuugguuauucuugagaagucaugugaugauauuacacaugaugugugcaaaaaauaacauggagaauugccaggagagguggacuaggaaguguucaggagaagcggugguaacugcauagcuuauuauagcuacaucugucuuucagacuggcacuuagggguaaugaugcuuugucaugcaaccuaauuauauuugaaaacuuugaagguaacaguuguaguuuaaguauugguacugaugaaaaucuuuuuuuuucugugacuauaaaugaaacaggugguaguuguuggugagcuuuaguauucauagauccuuucuuccuuuucuuuuucuuuuuucuuuucugucaugucaggguuucucuguauaaccaccuuggcuguccuggaacucacuugguagaccacucuggucuuaaacuuugagaaaucugccugucucugccucccaagugcuucuguaccacugugcucagucauucuguuaguguuuacuuuuauuguuauuguuugagacagagucuuccugaguagcucagacacgccagcagcuagugauucucugucccagcauucucagugcuaagauuauagauguguauacuuggcuuuuuuuuuccuccuuagcuuauugaccuguaguuauuguuaugauuuucuaaagucuuuauguccuguaauaacugauguaaauuuuguguuucuauagcucuuauccaaauuuauguacauaaaacaauuucagaugauggcauuguccagaaguauuuuuuuuaaauuggauauuuuaguuguuuauauuucaaauguuauccccuuuuccuguuuccccucugcaaaccccuaucccauccccccuuuacccuccuucuaugagggugcuccuccacccaccugcucccuccucacugccuuagcauuccucuauacugggcaucaagccuucacaggaccaagggccucuccucccauugaugccagauaaagccccuuuagcuccuucaguccuuccccuaucuccuucauugggggauuccugugcucaguccaaugguuggcugagagcauaugcaucuguauuggucaggaucuggcaggaucucaggaggcagcuguaucaggcuccugccagcaagcacuucuuggcaucagcaauagugucuggguuuggugucugcaugugggauggauccccagguggggcagucucuauuccacucuuuuccccuguauuuccuuuagacgggagcgauguccagaaauauuuuaacagguuaauguguaauuguuagaugguugaacugcuaaaaccuguuuaccugaacaucuaacuuguaaauacuuuauaucuugcguuucuguuugaaguucacacauaaguggaaguagaacugccaaugccuauaacauuaauuucuucaaauccuauuuuaaugaugguucuuaaaugcuuuaaccucccauacagcccaccacccaccagagguaguagaaaagaaaggucaugggggaaguggaccuguuuagaaagguacuuuguagcaacucccaucuguguugucuggaaauuggcaguucaguucacagguuagcaggcagcugcagcuuggugcacacgcaaacacuucauggauacaccagcaguccaguucagaugaguuaggauaguuaacacgaaucagcagugguggcacuaucuaguagagacagcuaggccacagccuggcuccagucagcaggaaggaccagcaagaacacuaggaaaaguucucagcugugccucucagggaagugaggaucagcgaagacuugagaucugcaagcauuguacagcgaaguguuguaccagcaagugaagcucucugucacucugugggguccuauuuauacccuccaaacaucauguguccuucaagugucuugccucagcuccuauauucaaucagccugaguuugccgaaguggcaagaaacagcacuacaucaccagaaguuuuuuuggugcauuucucucuauggguccugacaaaugcagcucaacuaagcaauguaaggcagaccaguaccugcauguuguuagcaaagaauccuucaucacguguccuuucauguucuugcuuuaacagaacauccucucucgugucugcuucagcgaaaccuuccuucagacucugccuuggucuuucaccccuguguccauuuuaacgaaacgaaauguuccuucacuuguuugccccagcaaaacaccgacuuuccaaagaacccuuaaauuuccacuucaaaugcuugaucgauauaccccauuuuucacuaucagacauguacuuagguacuuuuugacucuagaguaaaaaucagaacuauaauaggaagaagagaaaaaaauaauuuugacaaggaaauauuuuuucaugguagccaguuuuuaaauucuauaaaccuacaacaugcuagcuggcuaauugguauaacugcuacacauuuggcacagauaacauucagguuguuauuuucaaauauaccaaccagguaggugucacuugccucuuacaaauauccccaauagcugcucucuggaaucacaagucugucuugaaguccugagaaauuuucuauaucagauacuggaagaggaguuugagaauuagaagcuggcagcuggcagugucuaauucgcagaggccauaguacuagcccuguaaugacaacauuucuugacuuaccauggagagugaacuguugugugagugguuucuguagcuccuuguuuccugagugcuuuguuguaacuuugcacacagucugcucuguagcagucuuggagacuugacuuagccuucuugagcuggggcuugaccgccuagauacaguacugguaguagugcuaacuacuuuauuuagacuggcuuuaauucauuaguuuguuuuccuguaccaaugaaaauaacuuuuugcaguuuguuggcccaguggaauauacauuuuguaaaucuagauuuuuauggaauuuugugauuaaaugacagcaguagaauaucuguagaaguaucuuucauagugaauaaaaagggaaccauauuagaauaugguaccagguugguggaaguuuaagaaacacauuuaucauuauguuauuaugggugaauugaguaguuguagucugcagagcauuacugcuaaacauugguuacuguucugguggcauugguuuaacuugcuuucaaacaauuuugcuagacuugaacucugggguaaugucagauacaacuauuucaauacaaacuuacuuuacuuuauuaugaauaaaauggcaauugcuaauaacuaccgugauuuaauauuuuaaaguugugucuauguuagauagauuauugguuauuguucagaaguuugggguuucuauuaguuuccuggcagagguuaugugcagauucagcucaucuaccuagauaaugccuggguauuauuguaucguuguaugcguaugugcuugacuugcauuuauacuugcaagauagguacuaaggaguguguucuauacaucccaaugauuccucaucaguuccugacugguuaaguguugucacugacaugccauggaggccuaagaagccccuggugucugcuugcugcugucucuaggccuucgaguugauugcagugugcguguuaucaaggaugggcuuucuguauucaggagcacaguuuucuuaucucuguucaacuugaaaucuaaaauccaaaaugcugcagaaucuaaaacagucugaguggaaaaaaaaaaucaauauaagaccucauauguagcaaaaauacaggcauaagaaaaauauuguuccaggugugguggcacacgccuuuaaucccagcacuugggaagcagaggcaggcggauuucugaguuccaggccagccuggucuacaaagugaguuccaggacagccagggcuacacagagaaacccugucucgaaaaaccaaaaaaaaaaaaaaaaaaaaagaaagaaagaaaaaagaaaaauauuguauagaauuacaaguagacuguguuuauaagguguaacauaaauugaacaaauaaauguaacguuuaaauucaugcccuauccucaagacaccuuauuuugugcaugcagauacuaugaaacccggaaaaaugugaguucugaaaauagcuuugaucccaagcauguaggaauucagaacuggguuaaaguagucacagauagcaagggcacuugacuguauuugcuggucucagguuaucuggcuuauauuucuuucccccuauuaguggcuuggaucuuguucuaguuacagugacaaaaaaaauucacuguuuugcauaugugaaugacccauaucacauaauguggagagugaauguacuuaauaaagugaaaagcauacaaacaaaaaguuuacaggucuauagaguaguuuccuaauguaagcugagccuaaaaguugagaaauaugagauuuugcaugacucaaguuuauaagucugugucaggaauaaaauuauuuagagacuuggaaauugauugauuacaccgauaaguuuuuacuuugaaaacaaacacacacucacauauauuuaaucuaucuaucugacaugcuuuccuuguaaauguaacuacauuguaguuagaacaaacauccugaacaccauggcuuagacuggcuguuaguacagcaggccagcaggcaugcacuggcauugcuucuguuagcucccagguagugucagaauggacuggguggaacugucuuucuuuauugcccuuuugaacuugcuggaguuugcuaacuaguuaggcagauccugaccuuuuacucacuguguaaaacagugaguaaaaguaaaaccagcuugcauauuaguaagagaaauaggcugagaaccugcuccagaggaguccagcugugugcugaggaaugugccauaaauuguuuccagguugggaagaccucuucuggagaaugcaacauaacaucucugguuuucaagauagaagagugcauugacaaauguugaccagagaaaagcaugcccauuugcuguuuggcuauuuuauugguuaggagcuccugguucucugcugcuugauuucaugcacucucuuagaggaaaucaagcaggggcuggagagacagacacuuagugguuaagaaccuugguuguagcugggcggugguggugcacgccuuuaaucccagcacuugggaggcaguggcaggcagauuucuaaguucgaggccagccuggucuacagagugaguuccaggacagccggagcuacacaaagaaacccugucuuaaaacaaaacaaaacaaaacaaaaaaagaaccuugguugcucuuucaaaggacauggguuugauugccagcaccuacguauguggcagcucucaacuugucuguaacuccaguucuaagugaucugaugcccucuucuggccccugcaugcacugcacacauguaguguagagaaauacaugcaagcauaagauauacaauaaaauauguacacauaaaauaaaguaaaaacaaaggaaagcagguaaaugcugcccuaugccuguuaacucuuagagagcuuguguccuucuugugucuacucagagugcugcuuuacaagaagacccgauguuuucuauuucuuguguuuuagugaacuuuauuaucaaaaaaucuuguaaguaaguacaaauaucacacacccaaauuaaccaaagccaaauucuguacaacuuacugaaguuaauauacaguuaaaauuggcaugugaaacaugcgaggcuucacauuaaauuuuacacucuaguauugaauauaauuuuauguacuuagccaccaccaaacacaaaaauccauaacagauuuagagcuagaaaagcaauuagcuucuaucuucuuuccuagcguguguugaccaccugcgguccugcacucagucccucagcuccacauucagccuuccuuguucucuucccuccaugcuguccuauccccacagauacaucugcuuacauagacauagauucuugucuauauucuauauuugagggagaacauuuguuuuauuucuuucugagaguauuugaccucauuucauauucuaauuccauucacuuuuuuuuuuuuuuacaaaauuuuaaacuuaauuuuucuccagaacggagaaauauccuguuuauauguaucccagguuuucauuauucacucacuugcugacaggacagcugugcuguuccauuuccucguacagugaauaaagcagcagaaagaaaacaggguacagauauuucugugguagggugugaaccucucuggguacaugcccaggaaugaaauaguugggccacauaguauucuauuuuuacuuuuuuugaguaauuuccaagcugauuuucucaauggcuuuauuaguguguaccccuaccaguagugaauaaggguucuuuucuccaccugcuuucuaacacauacugucagauuuauuaaugacgccauucugacugggggaaguaguaucuguuuuuacuuuauauuucuuuuuuccuuuuuuuuuuaaauuggauaucuucuuuuuuuacauuucaaguaucuucuccuuuucaggucuccccuuuggaagcccccuaucucccccccccccuuuaugagggugcucacccacccacccauuccugucuucccacacuagcauucccuacacuggggcauugaccacccucagggccaagggccucuccucccacugauguccaacaaggccauccucugccacauauguggccagcgccauggguacucugguuggugguccauucuccgggagcuccggggguugggugucugggcaguugacacuguugcucccuccauagggcugcaaaccaccucagcuccuucaguccuuucuccaacuuaucuaucaggaacuccguguucaguccaaugguuggcugcgagcauccucuguauuugucaugcucuggcagagccuucaggagacagccauauuaggcuuccaucagcaaacacuuccuggcauccacaauaacgcccagguuugguggcuuuaugugggauggauccccagguggggcagucucuggauggccuuuccuucagucucugcuccacacuuucucucuguauuuccuccugugagaguauuuuguucaccuuucuaagaagcccugaagcauccacauuuuggucuuccuucuugggcuucauguggccuguguauuuauugaaucuuggguauucugauuuuuuuuuuuuuuuguuuuuuuguuuuuuugguuuuucgagacaggguuucucuguguaguccuggcuguccuggaacucacucuguagaccaggcuggccucgaacucagaaaucugccugccucugccuucccagugcugggacuaaagguguucgccaccacgcccggcugaaucuuggcuauucugaacuuuugggcuaauacccacuuaucagucguguguucuuuugugacagaguugccucacucaggaugauauuuucaaauuccauccauuugcuugugaauuuugugaagucauuguuuuuaauagcugaguaguaguccauuguguaaauguacccacauuucuguauccauuccucuguugaggaacaucuggguuguuuccagcuccuggcuauuauaaauguggcugcuaugaacauugugaagcauguguucuuauuacauguuggagcaucuggguauaugcccaggagugguauaguuggguccucagguaguacuaugucuaauuuucugaggaacugccagacugauuuccagauugguuguaccauuuugcagucccaccauaaguggaggaguguucuuucuccacauccuugccagcaucugcuaucaccuguuuuugaucuuagccauucugacuggugagguggaaucucaggguuguuuugauuugcauuucccugaugauaaagaauguuaaacauuucuuuaggugcuucucagugauucgaguuuccucaguugagaacucuguuuagguuuguuucccauuuuuuaauaggguuauuugguucuuuggagucuaacuucuugaguuuuauuuauuuauuucuuucuuuauuuauguuugucgagacaggguuucucuguauagcccuggcuguccuggaacucacuuuguagaccaggcuggccucaaacucagaaaucugccugccucugccucccaagugcugggauuaaaggcgugugccaccacacccugcucuuuuucuuuuuuuaaaaaagauuuauuuuauucauaugagugcaauguagcugucuucagccacaccagaagaaggcauuggaucccauuacagaugguugugugccacccugugguugcugggaauugaacucaggaccuuuggaagagcagucagugcuuuuaaccguugagccaucucuccagccuggacccucuuuuuuuuuuuuccuccuaauugaaaauacuucuuuuuauacaauauauucugaucauguuuucccuucuccgacuccucucagauccucccuaccuccccacccacccaaauccacaacuuuucuuucucccucccauuagaaaauagguaacaacacacacacacacacacacacacaugaauaggacaaaacagaccuuuuuauuauuuuaaacagagaaucucagugcucacucgugucaucuuuuccuuucuuagaguaaauuuugauaaaaagauagucauacaagcacaggcagcuuuuauaugcccaaaccuaucguguccauuuggaauuuuaauacuuggauuucugacuggcagcuuuuaggauucccuugcuuuuaaucuaguggcaaguuguuucauaacaguacagcauacuguuaauuccugaguguguauacguuucuuuggcucauuggguccuuguuauauuuaauguuguagacagcauuacugaacuguuuugaugguguacuauuuuuaaccauuuagugaaauaggcuuacuauuaaacauuaauuuauaaggacauuacaauucagacaaggaauuauaauuccuaaguaugugaauuuguaauaagaucucuuuagaucagcgaagccccuguuuaucugagaggcgccgccugccaugaguaccauggacagugauuuuacugagucuaauguuuaggccuuccaguguuuaaaacuguuuuauugcaaguuuggcagagaugaccucggugaguucauggugcaguuaacgugauuuuuaugccauauuugcugauuuuuacagauuaaauuuaaaaaauuacauuuacaaaauuguuguuuugaggaauauuguuguugauuuuguuuguuuuguuuugagugacuguuaguauucuugaauacuguuagaccugacaggauuagcuguaguaaauuaucaguuuuaaaggugaguguuguuuuauuguaaaaugcauguuuuagauauuuggaaaauacuaauaaaagcaaagguaacaaaguauccagugguaugcugucugaagaaaugcauacugccuuucugaguuucuugcaggauuuuauuuuacuuaggggugggagaguacauauuguaucugguuaaucauuuccauuuuagccaguaaugaaucauauuucuuagaugcaucucugccaagaauuuaguuauuaaaacugacccagguuauucugguaagaaugcuccacucuuccugaggcccacuguuagucugauacuuaugugaauacuuucucuauguucucuccuucaguuuucacgacaacccugggagguaggucuuuugcuguuugcauuugugaauggacaagaaaguagaguaagaguagaugacuagugugagggaauacaguuagucaguuguguagcagagauuugugggcagguagucugaugacauuugccuauuaacuacuguguuuguaauccacaccuggcagaguauugauuucuaaauuuucauuuguuuguuuguuuguuuacucucacugugugcaugcacaugcaugggagugugugccauggcacauguuggaguuagaggacaacuugcaggaagcaguucuccuuugaucauguggauuccaggaauugaacucaggucaucuggcugauggcagucagucuauaguauauugauuuuuaucuugacuuguaaagcucuguuacagucuuuguuugagcucgauuguucugucuuuggcucagaugauacaugccacauuucaauagcucaggcagaguauggaguuacuuuguuuccuacauaacagccaaaauugcaugagugcuggaugugugaacgacacuuuguagcuuuacugaaaccucccugugcucaugggacagggagaaagagaaaauaaauaugagacaaggagucugacaguguucugacauccgcuggaggagucccuggucccucccucuuacugcuucacugaaaacaaaacacccuccuucugugacuuuuagagacccugauucuccuuucugcuaaagcucagcuaauuugauaucaugaaacuauaguauauauaauauucuauauccguuuucucaagguagcacuugaauucuagaaaaauaguucauaggcaguauuugauugugauuagcagauucuuacuguaugcagaugaaugugagcuguuccaaaagaggagggaauuucauauacagggcaggcuuagcgguaagcugaugagacuuccguccacggaugagcuuuuguuuuuccuuugugugagguuaggaaagcuuggugagaaagcuucuggguggggagcuaaaccaguuggccucccugguuggucgggauucauuaaggauucauucauucaauggaagccuaaagccagggauaguaccaaacacaugugugugugugugugugugugugugugugcguauuuauauauauauaauuacgcacacacacacacaauuuuuuuauacauacaccucuaugguaaaguuuaauuuauagauugggaacagaaauuagcgacaauacuaaaauaauuauguaguacauuauuuuaaaauaaucuauauuuugugguuauuaugaacuaaaauuaguauuacuuaaacauuguaguaccauaacaguccauuugauaauagagauagcuacuaaaugacaggcaaaaaccauauacauuguggaaauucaagacaaagagaguucauguccugagcaggacucagagccauguacaauuuaaaaauuaugauuuggacaggggaguuagcuuguuuguugaaguaaguaccugcugcaaaagcauaaagaagugaguuugaauaccuaacguccguguaaaagcugauguguacauuugugacccuaaugcuaagguggaaggguagagacaggcagauccugaugcucauuggccacucagugcagcuggaguggugagcuucagauucagugccagacugugucucaaaauaaguagggauugaggaaacacuggcccacugaccuauacacaggcaugcggcacacaugugcacacagaaauaaaccauaacacauacuaaacaucauacgcgcgcacacacacacacacacacacacacacacgaaaaacaaagccucagaacuacuuacuucugcaguuacuugaacugcagucuacagaggucacugaagugguagaaauuguaauuacacaaccgcagggcccucaugcuuuccuuuuaggaaaaagaggccuucucuuaaguauuuuaagaauaacguauuugcauacuuaauuuuaucaugagaacaaaucucacuaaauauguguuaaaauaaccuucuuaguauugucuuaggguuuuaucacugugaagagacaccuucaacaacaacuuuauaaaggacaguauuuaauuggggcugguuuacggguucagagguucagucuguuaucauggugggaaguauggcagcauccaggcaggcaugucccuggagaaggagcugaguguucucuaucuuacaucugaaggcugcuaggagaagacuggcuuccaggcagcugggaggagggucucgaagcccacccacacagugacauauuuccucuggcaaggccacaccuauccaacaagccaucuccuaauggugucacucccugggucaagcauauucaaaccuauauauguguguguguauacauacauacauacauacauacacacacauaaauauaacauagcaucuggcucuacaguccuuuguauucuugaguaaaguacuacuuuacuuuaaauuuguauuuauuauuuauaauuuaaugaaguggcacaaagcccugcuucuuaguuugcagcuuuggaauaaguuuaggugcuucgacauuuuauuaguucaguggagucuuaagcuuugauguuaguguuugauuacuaauguaggugguuguuaauaccagcucaguucuagagauguacugcagauuguacuuuacagugcucauugguuuacaucaugagcgauguguguaagcaacagaaaguuuagaaguaguuggugcuuagagcauaggcugaguuccuacagagaagaagcauuuguucccuuuucuuugguuuguuuuuuaauggcccagcccugcuuuaaaaacaaaacaaaacaaaacaaaacaaaacaaccuuugagcauuuaaagguuaccuuuggauugugaggaguugucuuaggugcaggcagucuuuguucauucagacuaggacugauugagaaccuguuccuugucaggcuuuguuagaggcuggcuuacacagaugaaagcauguggucucagaggagagagugagaaguguaccugccugcuaagaaaugcaguauuagcaggacaggucuaggugacuuucuuaguuucuauuuucauguuuacuuguuuaguagucacacaugguagauaggucacuacuguacaagugagacugacaacuugacacaugauccuuuucuuauguagcuugauuuuaguaugguuacuuaaaaaaaugccuuuguguaggugguagggugugggauguguuuauaagcuguguuuucagaugagauugggauaguugggauuaggcagaaggcacuuaccugcacugucaugcugucucagggcuguggcagcugggugucagggagcacggccaaguucaggcgaguucauuuugggcagaggggcauugaaaaaacugugugauaggauuggagaacugugugauuggagaacugugugauaggauuggagaacugugugauaggauuggagaacugugugauaggauuggagaacugugugauaggaucggggaacugugugauaggaucggagaacugugugauaggaucggagaacugugugauuggagaacugugugauaggauuggagaacugugugauaggauuggagaacugugugauaggauuggagaacugugugauaggauuggagaacugugugauaggaucggggaacugugugauuggagaacugugugauaggauuggagaacugugugauaggauuggagaacugugugauagguauucacaguuguugaguucauguaggucgugauuguucuuaagugauuugcuuuccucccugaaaaaggauuuuaaguguuuccuccuuuauuuagcuggggaaagagcagaaguguugagucucaugcagugcuucuaguccucugucuuccaagaauuaguauguuccagguagggcucauccucucagccuuggccucagcucccagagugagacacuauuuuaagaacgaaacacagcugguuggugguggcccaugcuuuuaacccagcacuuggcaggcaggaucucugaguucaaggccacucuggucuacagagugagauacaggacagccaaggcuacacggagaaacugucuggaaaacaaaaacaaacaaaaaagaaacagagcuaugagaggguccacugucuugggccauuuguuuucacaguuugaguuagagaugaaauauuauuuaucugaauguggcugugguuguacuagucuaguugggaggaggagacuggagcuagcuaagacacuggaguguaaaccaagcaccaucccacugaugagcuggcaggagcccuucaggguggaggcaggagaccugggccauguugcaccugucugagcgaggcaguggccuaagugaguuaagguaauacaguuaauguggaaggagaaaaggaagguuaugaagaaguagauuuagacucuacgagagauacgaacaugucugagagaaaggaguuuauggaaaucccagcuaugcaaugacacuguuaaccagaguagaaaguauacaugguacauagaauuggaguggggaacuuuuucaucguuuacuuaauuugaguacuugugauucuuagaaacuuuguacuuaauuaagaguaaugggagccagggauucagggugaccgugucagggagauagagccaagauaucgucgagagggaaaugguggcggagagacaggaaaccuaggacagcaagcucaggcacuugcagugagcugaaagggaggagcuguugaacaaucccuucaggcaagacaggcaugccuccuaaggucuccuacucccugcugcagaguuaaaucaaguuucuuuacuauuccugggagcccucgcuucugacaccccagugauacuguuuauuaucaucugucauacagcauuugucauguuucagugaagucuguugugguuagacuugguugucagcuugacuggauggggcauccuuaucagggcuuuucuugauaggcuauuugagguagaaaaucuacacuaaaugugacagcccaaauaagaggaggugagagaaagaaacuugcuuuugccugcuugccauuacuuuugcugguaaauguaucuacuguguugcugcugcugcuguugcugcuucugcauuccuuugcugauaaucauagcccaguuucuuuggauuuccaauguagacugaaaacuggcagcucuucaggaaugcacuaggccuuuagugccuucagcuugauacucuugagguaccaagccuggcagauugagcagcucugguguauuugagccauuguugggcuaucuggacuauacuguguaagucagucucauaaauucccuuuuaauaccuauuauuuuuauuggauuuguuccucuagagaauuguagcgaauacauuucuagcauucuuuuguugcauguagggaaaacucacauggucuguuuuauuccuucaagaacauuuucacuagugucuuagugacuuauagaauuacggucucacuuugaggcccagauuggccucaaacucacaauccuccugccucagccuccugaguacugggauuacaggugugugcaaccauggcaucaggcuggccuuucauuuuuaaaguguugugcuugugaaauuuuacugcuguucuugauuuuccccuccucgguuacuuucucuuccuucuucccuauuuccacuccccccccccccccaggguuucucuguguagccuuggcuguccuggaacucacuugguagaccaggcuggccuugaauuuaguaauccgccugccucugccuccugagugcugggauuaaaggcaugcaccaccaugccuggcuauuuccacucauucuuuguuguuguuguuguuguuguguuucuauucucuugagagccagucauuguaggcuuuuucuuucaggagcucuggguuugacuuucggugcugcccaccauucuagagguggaugcuugaggaucaugaccuuacguuaggccuuagucagcuagaagugcaucuggacuacuuuagagcuugacucaaaacaacaaauggaaaccuacaucagggguaaggucuuguucuuuuguuguuauuauuuuuaauaguuuuuuuuuuuuuuuuuugagauagguuuuauuacuuagucaaggcugaaacuccugauccuccugucucuucgucugaauuuguagcauuacaggcuuaccuugccuggcuggauuuuguuauuguuuuuuagcuaaaaagcuuuuguucuguucugucuuuguuuugcugaaucccaccacuacuacaauaucuauuucuacccugaccucugaagaaggucucccuuccuuugugcuuaugacucauuucacuuuugcuuucuugcuuucagcccaccucacuguugccuuuccuuuuucuuuugguuuuucaaggcaggguuucuuuguguagcugaggcugucuuggaacuagcucuguagaccaggaacucacagagucugucugccucagucucugccucccaauugcagggauuaaaggcaugcaccaaagucaggcuaauguugccuuucuugagacccuccaguuucuaauugccuaaaccaguugucauuguggugcacacaaaagacuuuaauuauugccuuuaaguacuucuuuaauugcucuuccuccccuucauccuuuccccuccuucuccccucuuccuuccuuacccucccuuccucaccccuccucccccucuucuuuuccccccuucucuccccuucuuccuuaccccuucuguucugucucuuccuccuccccuucuccuccccaaagauguggcaguauugcuuccuaagguacaaaguauaagauagccauuuauucucaagauugaagaaugaaacauuaguguccaaacaugucacacauccaugagauugggguaacacugaagacagguuucugcacuguaccuuucugagacuugagagcaaggguguuuguuaugcacacuaugacaguuuucugucaucuuaaugcaugcuggggggucuacauuagagccagaaguguaugaaaagcauggagcuuguguagacauuauugacuuguuagcaugucaugaaaaauacagauuugcucuggggauacucucccgcuuuacaugaucuguuaagauuuuacucucugaccaacuugagaaaaaucuugcaauaguggcuacugaaggauaauguaggccuuuuuccaggaaauaguaaacauaagucuuauaacacgugauaugaaaaacuuguauuuaaugaguuuuguagaauaaaauuaguucauuauuuuuaaaucagauccuuagaguacaauuagacaucuccuuuucucagcuguccugaaguugccaggcagaauggguauuguuuucagaguuuuagugucuugcucaucuuuucaugaguugcucuugccaccuacauugccuucuagguaaaaugcuuguuucugucaggauauuuauuauaauuguuaaacauuuuuuuagaaaaacauugagcugucuguuucuuucuguuuccucucccugucucugucucugucugaggcagugucucacuguuuagcucuggcugucuuagaagucuguguagaccaggcuggccucaaacucaccagagaucugccugccucugucuccugagugcugggagugcacuacauuuggcucaaagacauugacuucuuacccuguguuuacaaaugcuuuuuccuucuuaguaauuuaguaauuuugguguuugccacucagugaaauguucccuuauauuuaggguacuugaaaugguucuggaaggauuaagguaacacuuaaugcuccacauaucaguaucuuagcuggagcuauaauugauaguuugcaucuuuaaaaaauucuaacagaugccauauuuaucagagcuugggcuuggguaggcuuaaccccacccuuucucucucucuuucauuaauugcauucucauuaauugcaauuucauuaauugcaaauguugugugugugugugugugugugugugugugugugugcgugugugugcgcuggacuaaggggaaacuuagacacguuguuucuuucuuacuauaugggucccaaugaucaaaaugauguggucaggcuuggcagcaccuuuaccuguugagccauuucgccaguccuccuccuaagccaggcucucaccucgucaccuguaugugccagaugcuacugugucagcuugacacaaacaugagccauuugugaggagggcagcuccagugaacaaaugcccauaacagauggucugugggcaaacuugugaggcauuuucuugauguucuaagcagggcagguggcccuggguacucuaagaaugcaggccgaguacaccgggaagaguaugccaguaagcagcacccaccaugacuugagugcccccacuuccuuugguaauguacuguguuguggaacugaaagcugaaauaaacccuuugcuuacgagguugauuuugaucauuauggguuuuuuuuuuuuuuguuuuuuuguuuucuugugacaggguuucucuguguagcuuggcugaggguuucucuguguagccuggcugucuuguaacucauucuguagaccaggcuggccucaaacucagaaauccgccucccucugccucccaagugcugggauuaaagguaugcgccaccacugcccagcuuggucauuauguuuuaucacagcaauagaaacccuaacuaagauacuguaccacuguguuguuaauauuagaagaacauugguuugagauccuuaaauguugacugauuuugaugccuuugauuuuaaguuccuguuuucuauguaacuauaauaaaaaaaucaaacuuauuuauacuuuaaugauuuguuccuuuauguacuguagauuuaaaaaguaaacuauuguauauauguacacacacaccuuuuauaccuguguguguauguguaauaaaugaacuuaaaauuuuccucaaaaugaaagcauacacuuguaaagguuuaaaaauaagcagugauuguuauagaaguuagcuaguucaucaauuagugauuagaaaucacuuacugguaacuaaauauugucacaugccacguaauguguggguuuuaagaaguuuguuuuuauaauuugucuuauaaacauuguauacaucauacuacuacugaccuagguggcauagccuaccacacuauaugucgaguguauguuauauguuauauauguauaugcuuaucugauuucuuaaaacuguuaauuaguuuuuuauuuguuuuggcauauauagguauaucuaaugguaaaguagcuuuuauuuuuucaguuuauuuccacaaaaaugguaaaguguugguccuugugagucaggaaaaaaggucuguucaacaugacucaguaaccaguguuggcuaaaaaaaaaaaaagucugacacuggccaauuuauuuuaggugcauuuagguacaguaaaauuugggaaaaguuuccugguguaacacaguccugagugcacaguuaaagcuuaaggcauaauuacuuugaaacuuaucaaaguacauguuguugccucuucccgggaagauggguucuauagauagacuacaugugucaucuugagagccucagggaggaucugguguggucucugucauacagauagaaaagucacuaggcuauuaaauaccuuagguccuguuaguaagagucuggaggagccugagggaggcagguguggccaaggcccugcaggcagugcagaggucacuuaggcucuuagccaccuccaagucuucugggcagaaaacagguuaagcaucucuuccuuugaagagacugcccuguguguuuaacauuccuagcuucccuagagcuuaucugugagcacaaggaccucugugcucccaccaguaaaaaaaaauuaaauuaauagguugauaaaaauacuucacacuaaaaaaacaugaaugcacuguguuugcuaguguaauuucaaaauccucuaugggaauggggaaguggcaacauacuugucuaguaagagccauuuucagaggaguuaugcauuauaaaauucuuaaagcucaagaucuuauuaagccggcauugauuaauauauucuggcaaacaguugcauuuugugaagauggucagugauuauauucuauuaucgucuccugugaauguguuauauauaaaagauggugaaaugugccuguacucugcucuccucuuaaacugguucauuuucaggauagaugauauauuucugaacauuucccugcuaccagccaucauucuugucuuguucuguuuguuauuuuagucccaaguacuuggucuaucaucuguggcacuuucuucucuugacaccuguacuguaguuuugcgugucaacuagacacaagcuagaaucaucagagaagaaggagccucaguugaggaaaugcuuccaugagauccaucuguaaggcauuuucucacuuagugaucaauggugggaggguccagcccacuguggauggugucaucccugggaagaggugguccugaguucucuaagaaaucaggcugagcaagccaugaaaaggaggccaguaagcagcacccuuccaugguuucugcaucagccccugccucuagguuuuugcccuguucgaguugcugucccaccuuccuuugaugauaaacagugaugaggaagugaucaacccuuuccuccccaauuugccuuuuggucaugguguuucagagaaacaauagaaacucuuaagauagcacccgugacuaguuucuuguuuugggcaaauagggaaaaauaccuuggauuuagucuguuucuucacauuugcucuguugggaaaucuuucauccucauggcuuuggagcuaguauguucugaauuuauauuucugagcuugagcuucuuccccuuaauuauugcucccuggacaucucuaggugcaauccaggacuuguagaucagucuaacugacccauccaugcuguuugcucccccugcaggugccugacauuuaccuaacacuuuucuuccccuuucaccucaugccuaacuugucaguauggucagcaccacugccuuuuaaaacugcuucuuaccacuuggcagguggauuguucaagucuuauuuuguaugguaugguguuaaauuguaucuuauauuucagcugcguuaguuuuuuaauuuuuuuuuaaaucaagauacauaccccagaccuuaaaucauguacuuuuccugcucaacucuuacuguuuuuauauuccucauagagugccucacuuguaaagcuucuaacuaugucucucagggggucauucuguugucuguacaguuguccuugaugccucucccacaugccagcggguuuugccuggcuugggugccuggcucuggugcuggcuuggaugcuguuucccuguagugaggcuucagcucccuaaugugacagcgaagcuuuccuccuacucccuuggacuucaguccaucccuacugguccuuaugugugcuuccugcuagauucuuaagcuacacaagagcaggaauuauuuugugugcccagugcccagagguaagggaaacguguguuaauggugcuuuaacauugaauaaaaguauuuugucuucaggcuuaaugucucuuuugaguacucuuuaguuacuaacuuacaguguucuuuaagaauuauagcauguggaacugccugcuuuuugcuucuuucuccccuuugccuuucucucucuucuuucuuuuuucucacucucccuucuucccuuccuuucuuuuucucccucccucccucuuuccagaugguuuuucuguguagcccuggcuguccuggaacuugcuuuauagaccaggcuggccuugaauucagaaaucuaccugccuucucuauggcuuaggaaauauuuuuuuaaaaaagagagagaauauucccucuuuuugcagucuuucauguaagagccagaggacaggagaagugcuuagagauacugucuucuggacaugacauggucauuguauuuauuacuucacugcagcuauaguuaccugcauacaaucaagccauuaucuguugucacuauuccaacaggcagcauucauuggacucagugggcuaccauugugugaggaguggaaaggggaguugggauggaucaaugucuauauacauguaugauauugucaaagaauaaaugaaagaaauuuauuacagauuggcacuccuguauuacagccagacuuuuggugacuuuaugagcuccuuuuucuaucacccuguuccaccauuauaccuuccaacccccaauacuacgcaggagcagaaagcugguuagaggggaaagggacugucacucucauugguuaggggcuuugaguuccuuggagcaaguuugaucuucccaaacagcagcaaucaggaagagcagcagcugccgcgccccucucagggcucuagcauuuuuaauacccucucaaaugauuaucgugauggcuguuuaacuccccauguuccagaaaccacccacuaucaggcuuugugaaugaaauaucagugaagcgaacacacagcaacagucuggcguuguguccccagaauuccaaagucauacuugcagaaacucucugcagcuggcaaaaucauaucccugccagggcaugaugcaaaucauagucugcugcuguggacucucugaaucugccccauaucucacaccuaggauuuaaacaaaaauauauuccaauaauauuucuguguuuaaagaaaccacaagucucacuacacuguauuacuugauauuugagauguuugaagugacuuuaaagagucacuauggagugagcuuuacucccagcuucuagaagaauucuguuguucugccucacagguaguguccagcucuuuacugucuauucuuugguaauaaguacugggaauauuuaaagagcuuuaguccuaaauaucuuucaguucucuugguagacucacggcucuacuucaagaguuccagaauagucagucuuuucaaagauuuuaguuuugaaacguuugaaaucaguuaugguuuaaauguauauacccugguaucacuggaguuucagcuuuccugugucuguagucauucuuuuuucuuugaauuaccuauauuguauccuuaauuucccuuugagguguuugucuucuaaaauuugauuuagaauugauuuguaggaguuccucauauaggugugucuuagucaggguuccuauuccugcacaaacaucaugaccaagaagcaguuggggaggaaaggguuuauucaacuuacaauuccauacugcuguucaucaccaaaggaagucaggacuggaacucaagcaggucagaaagcaggagcugaugcagaggccauggagggauguuccuuacuggcuggcuuccccuggcuugcucagucugcucucuuauagaacccaagacuaccagcccagagauggcaccacccacaaggggccuuuucccccuugaucacuaauugagaaaaugccuuacaguuggaucucauggaggcauuuccucaacugaagcuccuuucucugugauaacucuagcugugucaaguugacacaaaacuagccaguacaauugaccccuugucaacuugacacacaaacacaucacuaguaagccucaacccuuacauucuuauucauccccaagaucuaaauaacuuuaaaagccccacagucuuuacauauucuuaaaauuucaaucucuuuaaaauauccaucgcuuuuaaaacccaaagucuuuuuacaauuaaaagccucuuaacugugggcuccauuaaaauaguuucuuccuucaagagggaaaauaucagggcacagucacaaucaaaagcaaaaaucaaucuccaacuguccaaugucugggauccaacucacgaucuucugggcuccuccaagggcuuaggucacuucuccagccaggcccuuuguagcacacgagucauccucuaggcuccagaugccuguacuccacugcugcugcugcucuugguggucaucucaugguacuggcaucuccaaaacacugcaugaccccuucaguccugggcugucaauugcaaccgaggcugcaccuucaccaauggccuuccauggccucucacagugccgagccucaacugcucugcgugaccccuucaugccuucaaaacccguaccaccugggugacccuuacacauuaccaagucccgcugcagcaggaguacaaccuuggcuaucucugguacacagccucuuugugcucucagaaaacacuucccagaagaugucaccucaacgaugauggucucuucuuuuuuuuuuaauuaauuaauuuauuuauuauauguaaguacacuguagcugucuucagacacuccagaagagagcaucagauuucauuauggaugguugugagccaccaugucguugcugggauuugaacucaggacccuuggaagagcagucagcucucuuaacuacugagccaucucaccagcccgcuggucucuucuuaaucaccgcuaauuucuagcuccagcuaaucagcaucaauagucccaguaaugcaaagguuuugcuuuaguaguucugguaucuuguuaaucacagcuguuucuucagcuccagcuaaccagaaccacagaauaaucaaacuccaaaauagcaauggcccugaaaagagucuuuaauuuucccucugaaauuucacaagucaggccuccaucuucugcacuguucucaacauuaucuuccaagcuccuacacaacaucucacagagcucuuaacacugaauggaucuucugucucaauguuccaaaguccuuccucaguccucccuaaaacauggucagguugucacaggaauaccucacuucugauaccaauuugucuuagucaggguuccuauuccugcacaaacaucaugaccaagaagcaguugaggaggaaaggguuuuuucagcuuacacuuccauacugcuguucaucaccaaaggaagucaggacuggaacucaagcaggucagaaagcaggagcugaugcagaggccauggagggauguuccuuacuggcuggcuuccccuggcuugcucagucugcucucuuauagaacccaagacuaccagcccagagauggcaccacccacaaggggccuuuucccccuugaucacuaauugagaaaaugccuuacaguuggaucucauggaggcauuuccucaacugaagcuccuuucucugugauaacucuagcugugucaaguugacacaaaacuagccaguacaaggugaauacuaaucuuuuguacauaacauauucugcagauauguuauuccuauucuucuuuacauccaaaacuuuuaauguagcuuuaaaaauuuuuagacuugagccagcuguaguggugcacaccagcauucaggaggcacaggcaggaaggcguaucucuguggguugaggccagccuggucugcagggcaagucccaggacagucaagacuacacucagaaacccugucucaaaaucaaacaaaacaaaacaaacaaaaggcccaaaacaaacucagaaaaccaaauagauuuguuagucuuugauguuuauaugcuuuuuuguuugaggguauuuauuccuaauuucauucuaaaacuuuuaaaguuuaauuuuucacacuuagauagcuaguugaucugaacucuuuaagauauauaaggggaacucuucuccaguuguguuucuugcccuaugccaguuauugaaaaaaaucacacacacaauuuuaaaucccagaugugagauauggggcagcuucagaguauccacagcagcagacuauaauuugcagcaugccauggcauucuuauuuucacaaacucagauacguauugauugcaugcuuauucugucuguuagcugauguguaacagagugcuuccugaauguuuagucuuauugcagaacuguguauguuuaugucuuaguuaggguuuuacugaugugaacagacaccaugaccaaggcaacucuuaugaggacaacacuuaguuguaucuggcuuauagguucagagguucagucuauuaucaucaaggugggaacauggcagcauccaggcaugcauaguccaggaggagcacagaguucuacaucuucaucugaaggcugcuagcagaauacuaacuuccaggcagcuagggugaggcucuuauaacccacacccacagcgacacgacaacuccaacagagccacaccuucuaauagugccacuuccugggccaaucauauacaaaccagcacaguuuacaaccuuauuuuuguacagcaugauaagaggcauugaguguaacagggugauugugaaguauggguuuuugauucaaaauuacucaagugaauucugguucaagcuauguggccauggucaaguuacuguaucuuuguaagccuaguuuguuuguuuuguuuucuccaugagacauuguaauauaacuuguauuaguaaauugucagguguuuuuguuuguugaaugcugacucuacaagagaugggucccuugcuucagauuccugaaugguuauaugauguggucucugaagacccuuuucugaggcaggcugccuccugccucuguaacaggagaaaagcaaacagauaaagaacaucacacccugauaccagcuagaaguuaaacccuuuccaaccuuguaucucauaauauaaaaacgaagcagguucugcucugcacgggacucuuaggaagaccagcuggcugcuucacaggggcuccuccagucaguuacugcuggauagugcaucugaucagaagaugguauauuugcuugcucucucaggcuguuaauaguugucucugcuggguuucauaagcaccugacuugaggauguuuucaucuuuccucuggcucuaucugucgggugcuguugucccuuuacuuuugcuugcuacauacuucuuuuuuuaauuaauuaauuaauuaauuaauuuuuuauuagauauuuucuuuauauacauuucaagugcugucccgaaaguucccuauacccuuccccugcccugcuccccuacacacccacuucugcuucuuggcccuggcauuccccuguacuggggaauaaaguuugcaauaccaaggggccucucuucccagugauggccgacuaggccaucuucugcuacauaugcagcuagagacaugagcucuggggguacugguuaguucauauuguuguuccaccuauagggugcuuucagcuccuugggugcuuucucuagcuuuuccauugagagcccuguguuccauccaauagaugacugugagcauccacuucuguauuugacaggcacuggcauagccucauauaaguauaacagggucccuucagcaaaaucuuucuggcauaugcaauagugucuggguuugguggcugauaaugggauggauucccaggugagguagucucuggauaguccauccuuucgucuuagcuccaaacuuugucucuguaacuccuuucauggguauuuuguucccuauucuaaggaggaaugaaguauccacccauuggucuucccucuucuugauuuucuuguauuuugcaaauuguaucuuggguguuauguuucugggcuaauaaccacuuaucagugagugcauaucuaaugacuucuuuugugauugggauaccucacuaaggaugauauccuccagauaccuccauuuguccaagaauuucauaaauccauuuuuuuaauagcugaguaguauuccauuguguaaauguaccacauuugcuguauccauucuucuguugagggacaucuggguucuuugcagcuucuggcuauuauaaauaaggcugcuaugaacauaguggagaauguguuuuuauuaccaguuggaauucuucuggguauaugcccaggagagguauugcuggaucuuccgguaguauuauguccaauuuucugaggaaccuccagacugacuucuagagugguuguacaagcuugcaaucccaccaucaauggaggagugcuccucuuucuccacauccuugccagcaucuguugucaccugaauuuuugaucuuagccauucugacugguaugagguggaaucucaagguuguuuugauuugcauuucccugaugauuaaggauguugaacauuuuuucaggugcuucucagccauucuguauuccucaguugagaauuauuuguuuagcucuguaccccauuuuuaaaugggguuauuugaauuucuggaguucagcuucuugagcucuuuguauauauuggauauuaguccccuuucagauuuaggauugguaaaaauucuuucccaaucugcucguggccuuuuugucuuauuggcagugucuuuugccuuacagaagcuuugcaauuuuaugaggucccauuugucaauucuugaucuuacagcacaagccauugcuguucucuuuaggaauuuuuucccugugcccagcuuuucccuacuuucuccucuauuaauuucagugucucuggucuuaugcuacauacuacuuaguaaacucaugccaucauuaacucacucacuugaaaccugaaguacaguuaguauagguaaaucucucucugaaaaaggcagcaguagggauaguuuccaccugguaagguuuuaaaaauugaaguagauacauaaaacccuuuacuauauuauuuggcauaagguagacaccuagugguccaugaucuccauuaguauauaguauuauuguuuuccuuucucuuguccucuuuguuugcuuuuuuguagcaaaacgucuugcucaggauggaaauugagcacuauguguuuaacuguagcccaugucauguguuggggaaauugagcacuauguguuuaacuguagcccaugucauguguuggggaaauugagcacuauguguuuaacuguagcccaugccauguguuggggaaauugagcacuauguguuuaacuguagcccaugccauguguuggggagggcagcuucggaaggauacuuagguugggggguaugguuuagguugacucugcauuccaugauuuaaagagaagaaaacuguucauuuauauuguguguaguuacaucuagaaauuguauuaucuuuucugaaaguaaccuuaaagggcugacauaagcaugaguugggaaaaggugcuugcugcaugccugacaacuugagugcaguccuaaaaucacauggaaggagagaacugaauucugcaaguuguccucuggucuccguaugggcacuggcauacacacuuccugcguacacacacauaugcuugagggugcacgugugugcacacacauacuugaaaaugugauaguuuuaaagauguauccuuaaauuagcuauuaagauuaguauagcuuuauguaugcagaaucacugauugugguauuuuugcauaaugacaacacuugcuguaugucucuaucccugucuucagugcaucccagugauacaugccacugcuaaagacuauguuccaaaaccuacuuuuccuuuucuugguuugugcaagugugcacuagguuggugugucaguuuaacuguggaagucugguugaaccuguagcucuugugcagcauuucccugacacugacugagaauccaguucaguguugauucugucccaaguaguucugauuuugugaaucaugucaagaaaauuaauuuuaaaagugaguuauuuguuuuugucucacuuugcucuauuauuuuuguaaauaaucauaguuauaaagucuggaacaaaugagaccuucuuccuaaaauggcucagcugauuuaugcagcuuaccuucuuguuuucuccaugccuggaaccaagugacacuccagucugcccuggucauuuggugauguaaacagugaaacaagaagauaggcaggaggaagggcuuggugguaccagguaccaacuguaguugaggauugcugcuaauauggcaaggaaaauucuuccuugacacuugagcaaagcacuguggcuuucuguuguuuauaaaauuccccacuggaaagcaguaaugguuauggccuagaggcuacucaaaaauuacuguuuuuuguuugcucuuucuaccuuuucccaguuucucaaccacucauaccugucuugagucaguuguaaaagacaguauaagaguacugaaaaaacugcucaaauuuacaacugugacuagaauauuacaugaaaaacuuacuaucaguaaaaagaaauuaagcaaauauuuaaaaaaauguuugcugauuaacuauggugaauaggguagaguuuugaagauacuguuaaauuuagauagguagcuugaagauuuuugaaaauugaaauaaauugagugcuaugauuucauuuuuagugaaugguaaagauguaggugggaacauuuugauuauagagaauucuuugauuaacuugccauaguuuaaaaaguuauuaugcauucaugagaaaaucaguacaaacaugggugcaugacagcuuaucaaccuuaauguauauaauugcaugggguguuacccuuacugaaauuuagaaacuuucugcuuauguauuauauacacaaugaaguuuaugaaacuaaguuaauguuuucucuccuuggguuuucuuuaggauauuaggaagcagaagcugaguucaggcacaugguuauuuuaacaggaggacauuucaugcuuuuauauaugcuaauauauauagaaucaguuauauaacuggggugauuugaaccuguagagauuuuaauuuccauuuuuuuuagacauagacuuuaaauguauauuguaucucgaaaaaucaaaaaaccaaaaaaauauauauuguauuuuuaucuuauuucguuauaaauaggauuuauauauacauguacauccuuuccaacuacucguucacuuaagaauuuauaggcagaaaaugauaacaagugacucaguuugugacagauggcuuaaucuuuaguaaguaccaggccucaugauagagugugcagcaguuuccuucugcucugcagcugaaggacacagaguacuugcacugucauagcucugguugucccugaacuccggauauuccagucugucaccuaagugcaggugacuuucauauaacaccguaucuggcuaaauuaacuuuuaauuaucauucauccauuuauauguguuuguggggauacauguacuauagcauguauguaacucuaccucaugggagucaauucuucuauuguguggaggagcccugggaucaaacucagguagucaggccuucaccuacuuagccacuccucaacccaacuaguuucuucuuccugacucucacauucucucacauucuuucucucacauucuuugucccucccuccuuccccucccuccuucccuucccuucuuccccuuucccuuucccuuucccuuccccuuuccucccucucucucucuuucuuuuuucuuuuuucuuuuucuuuucuuuuuuguggagacagggucucucuacacucucuacauaguccuggauguucuggaacucacuguguagaccaggcugauggaugaccuuaaacucaaagaaauccaccugccucugccucucugccuccucucugccuccuuuccgccuccucuuugccucugcgccccugcgccccugccugaguacugggauuaaaagcaugcaccaccacucgaaauaacuauuuuacuuuuuaaauguuaaaauuuucaggcaggucaaauucaucucccagguuagaauuauagacuuuugagagcacauggagaguuuuccuauagacugucucacuccuggauuuccuuugcuauuuugcagagugaaggugauuuuguuguugucuccagcuuuaaaggcucuguggauucagacuuagccauguggcacguuucuuaagcagagcugagcauuucacaucuauaucacauuaggucacuuugugucaaguucuuuacuagccuucaucuaaugguguuaucuauaggcucuuuguccacaucacuuugggcucacaaaaucaugcuuuucugauacuaccauuuuucauuucuugguuggaauucuuugcaaauagacauggauuucccuaucauccaagccacaacugcuuaguuuuuccauuugcgacuccuuuuugccuaagggaaaaucuuuuuuuaaaugugcacacauguauccuugugugcauuugagggagcuggagggagagagcgcgaugcucauaaguguguaucccagagcauccugugggucagaacacacauuagcuucucaggaacuagaguuacggugguuagucugccuuggguacuuguguuuuguguucagaaccaaaguuguggugaagucccaaaaagcaagaugcacuggcagaaagaccucagauuuauagagcuaugacacauuugauucugggcuaaucuuuaguuguugcucauucagaaaccuuauucuaucuccugaacuugguaacccaugucuguaauugaacaguucuggaaguaguggcaggaggaucacucaguacaaagcugcuagccugcucuauauggcaaguuccagacuagccagggcuauauaucgagucuuuguccaaacaaaacagaauagcuguggucaaguuuuccuucugugucccccauauucauucagagcccacaugaggccacacccacagucugacaagcuguggucugaacuguaggaaaggaagauacauuguuuuacuuuauuaccuuaugugcuuucauuaccaaucuugaguuugccuuuucuguuugucuuuaguguuaccaugaacuuguggguuugcauguauuccaugauucaguagguugcagucuuugugucuucaaaguuuguguucugcugugucuuuugguggcagagucuucugaaagccaucuuggagaguuuccugcuuuccuaacauaacacuguugcuuaaacucauuuuucugaucuagauuuugacaguaucuuuuuuacagcuuuggucccuacacaugagaaagguauguaagguguaggguugggguagcuugucaaguuaccucuaaauguugacuaaaaacaaacaaaacaaaacaaaacguccccauccacucauuuagucagaaacuauuuauucaagaaauacauugcauaccagagacacaugaacauagugaaaagaaacaaaauauuuuuauaccaacauuuuuauuauacuccuauuucugugacuccauuuagaaaacaggaaccacuuuuucauuaagcugugguuccuuuuuuguuuuuguuuuuguuuuuguuuuuuguuuuuuuagagacaggguuucuccguauagcuuuggcuguccuggaacucacuuuguagaccaggcuagccuugaacucagagauccgccugccucugccucccgagugcugggauuaaaggcgugcgccaccaggcccagugcugugauuccuuuuaauuuaacauuaguuuaaggaaggcuugguuuuuagaaucaugaaauuagcuuuucaucucuacauuacaauuuaauuauucauaaaccucgaaacuacagacacaguacauaacuuugaaaaugucuauaucagugguucucaacuuuauaaugcuuuaauacaguucuucauguugugguaauccuccacccuaaaauuauuucacuguuacuucauaacuaauuuuguuacucuaaugaauaguaauguaaauaucuguguuucccagugguuuuaggcgaccccugaggugguuugaauaggaauggcccucauagacucauguguuugaaugcuuggccaauagggauuggcacuauuaggaggugugaccuuguuggagaaaguaugucauuguggagguggauggagguggacuuugagcuuuuuaagcucaaacuaggccuagugugacacacagucuucugcuaccuguagaugaagauguagaacucuuagauccuucugcauccccaugucugccugugugcugccaugcuucuugucaugauaauggauuaaaccucuggaacuguaagccagcccgauugaauguuuuccuuuauaagaguugucuuggucauuguaucucuuucauagcaauaaagcaggcacuaagacaaccccuaaagggguuugacucacagguuaagaaccauugaucuauaauugugaaguuaaaaacaaauuuauguaccauaaaugucucuuucuauucucauuuucuguuuuuggguauaccuuagaaaguaaaaauuaaauacaaauguugucaacucauuucaaaugucaagauaauugguuaucaccuaguguucaaugacuaauauuaugcucagaauuguuacccauguauuuuaaaacuguacuuucaaaaugcauuuuuuggaguuaucaccauaaaggaugggaagaauauauaauauuggaaaauauaaaaauaaacaugacugggcucccaauggaggagcuagagaaaguacccaaggagcuaaagggaucugcaacccuauagguggaacaacauuaugaacuaaccaguacccaggagcucuuggcucuagcugcauauguaucaaaagauggccuagucggccaucacuggaaagagaggcccauuggacacacaaacuuuauaugccccaguacaggggaacgccagggccaaaaaaaugggaauggguggguagggaaguggggggaggguaugggggacuuuugggauagcauuggaaauguaauugaggaaaauacauaauaaaaaaaaauaaacaugacuacauaaauaaaagaauaaucuuacuuaucugacuuugaaugcagauugguguuauguaaauuuggcuagacaucuauuucaaaacagaaggguugucuuuuuuuuuaaagaaaauguauguaugaauauaugaauguauguauguauguauguauguauguaugugugugcucuauuugcauauaugccugcaugacagaagaggacgucagauuccauuccauuguagaugguugugagcuacuguguaguuguugggaacugaacccaggaccccuggaagagcauccagugcucuuaaccgcugagcucucucuccaacccuaggcugccuucugagacaaggguucccuagagaccaggcuagcuuggaauuuauuauccuuuucaaccaggaguguaaagauaagcuuuguuuucuaagaucacuuggagaugauuuucuuucuguuaaugugaucuguuuauuauauagauucauuucagguugaaucuuugaaaugauugcauuuuauuaaaauuuaauuuuuuucccuuuuaaaaauaauuuuacaguucucaaaaugaggccuuguaaugagguauaauuagaaaacaaauuuccugcuuuucuguaauagauuuuuugugguugcucuucuugugugguuucuguuguggugggaaaacacugaugaaaagcuaccuucauuuuuagguuacaguccaucucugaaggaaucagagaacugcugcuaauguuccccugccuggcuccugcucagcgacucuuaugaaggaaaccauuuaacuggggcuggcuuacagguucugagguuuagucuguuacugucauggaggggaagcaugguggcauguagcagacuuggugcuggagaaggagcugaguaguucugcaucugcaucccuaggcagcaggaagagagaguaacacugggccaggcuugagcuugugaaaccgcaaagcccacccccacuuccuccagcaaggccauaccuccaaaaaugcaauuccuuaugagucugugggggccauuuccauuuaaaccagcacauaugcauguacuggaaucuguucuuucgguucucaggcagguaacauuuuuugcauuguauccucuccuugguaguaggucuacaaaaguaggauugcugugucacugaaugugaauuuuuuggaaaacacugcccgucugcuccuugucugagcucucuuugucagccccacuaauagaguauguuguuagaacuuuuggauguuuaccagcuaagguuguugaggaaagaccuuuuacuguucauucuauuaucuugaggugguuuugccaugaguaggagagugguucauucuuuugucuauuuaagagcuuaucuaccauuuugacauuuuuaguuuuuuguuuuauuuuaaauuggguuuuuggucuuuuuuuugaaucauaaauauuugauucaaugaugcaaguuggaaauauuuuguuauuucuguuacaauaugagagguauguguucagggcagggaccuacucaguaguucugguuugaacuuagugugucccaguccuuagccccagucuucugugagcugggguuugagccagcuaccacaccugguccguaggagucuuacguggauuucuuaucacuccuuuagauuuuugauuccugaccuuugucccuucucuuagguuguacuaugauuucuugugcacuuuuucucucuuguuucuugcaccucaguuaacaaaaugaugggaaccucaaaagguaugcgcagaggcugccugcuaggugauucuagcucuccccaagcugccaguugagauuaaucaucacaggcagaguauuuguugaagugagccaaaguugucaccuuucagaaguaauaaauaauggauacuggaaaauaguuucuuaauauaaaaaaaugauagaaggccagaaguuagcaacuuacaacuaacuauagccuaacuggguagagagcuguguagguaaugacccuugaccucugucuguccucccacagacaugcaaugcaugcacacauaugcacuuccccucccaaguuuauugaguagugguggcuguuuuuuguagaguccugcuauuuaguccaggcuggcuuggaacuuacuacauguccugcucaacucaaacagcaauccuucccugcgucacccuuugaauguggagauuacagaggugcacuaauaugccuggccgguuuucagaggauugggaucaaaggaggguuuuguacacacuaggauuuuuuauuuuuuuauguguauugguauuugccugcauguauguuuguaugaggguguggagucauuggaguuacagacagaugugaacugccaugugggugcugggaauugaaccagguccucugaaagaauagccaaugcccuuaacugcugagcgcucuccccagcaccaggguuacuuguuuuguuuuuuaaaacuaaauaaggaaacuggaguguauugcuucugggcuucaggugucuuuuucaucauucauuuguuucuuuugagacuuuucuuauuucuaauguaaggccaaagaaaaauaauuccuauuguaauucuauuuagauggcauagcacuuuuggaagcaggggcagaagcugaguuucugugguuagugcauuuaaccacucuguuuucccccacuuaaugcugcugcugauagaacucaacucugagauugguaauaacguguaaaauucuuuuuuauuuauuuuuuauuuuuuuauuuuguuuuuuuucgagacaggguuucucuguauagcccugucugucugacuguccuggaacucacuuugaagaccaggcuggccucgaacucagaaauccaccugccucugccucccaagugcugggauuaaaggugugcaccaccacgcccggcuaaaauucuuaauacucaacauuuaguaagcccuuuuuguguguuaauuauaauaaucauuacaguuuguuacuauaaauuuaauuuuuaggcucaagaauugauuuuuaucacuuuuaggucugauaaaauuugguagacuuggcagcagcuagauuuaggauuggcugaaucagugaacagaauguuaaucuuaaauauuaagggacuguucugguuauaaguauaucugguuauucuuguggaacaugaaacuaauacuuauguaguauuaauugaagucauguccacgguuuuuauaggcuauuuuauuucagcuugacaagaccuugagaauuguuuuauuacaaacaucagugggaguacaggaguguggcuuuggggugaggacacuaguguccccucacucccuugggguguggguguggcucuggguuaggacaccaguguccccucacucuccuagguuugcuucuuucccuuuugacuguggcuuuuggaaggucagugagauuuacucuuaaguuuccuuugugaaggguggugccauacauuacagugcacugugaggacagucuuauaaauuuggggugaaaauaugacucccauuuagaaaccucacuuuauguaguuuuauuauuauuauuauuauuauuauuauuauuauuauuauuauuauugcguauauguguguguguguugucucagaaaucuguaggaagggaccagaaucugaaguggaagauacuuagauuuugaguccaguagguagggggggagggaaauuuuuuuuuuuuuuuuugaguccagugggcuagugggugaggggggucuguaguagggaaaagagcugagagaguaccauuuaggaguauuuaguacaaagguugguauauauuauaacuuaauguuagaaaugcucuuuuuuagguucugguucagagaauuauuccacacguucugacagacauccaggauaauauacuaacacagcaauauuuaaaagucauguuagcuauguucuguuaauuguuccaagccaaagaggcaguugcuauaauuucuggaagacccagaccauaauucuagcuaacaugacuccacuuccaagcgcuaacuccuuacacuuuaucagcucucauaccauaccuucuuucccucaggguuagugucucccacugacacacuaggaagguaacuugauagccuaagccugaacaagcccaggaaaacacuaggcuaguaauacacuugacuguuucacuuuuuggcuuuaauuccuaugacuauacacuuguuaacuccaguugcuuaacuccauucagagacuccuuuuuuuguucauuaaaugaguacuuaaaaaaaaacuuuaauaaauacagaaaaggucauggguuguggagaacuggagaggcuuauuagucauugaaugagaauuugacuucugagaggaggagaaauccccacagcucaugcagguuggcauguaaggaaaggguauuuggauugagccugacaacguagcuccauaccugcagcaugcaugguaggagagagcacaguagaaguuguccucugauuucaacuggggcacugugauguguguguguguguguguguguguguguguguguguguguguguguguguauacaccacucccuucaacaaauaacacagaugaaaaagacuuugguuuaacccuaguuggucuuuucuuuaauaauuaaauacaaagggugagcagaagaagagagcauaaugcugauaguacagcuaagacuuuuucccugccagaacaugugugcaacccacacuuagaaauauugcucagaauuuuguuggaaauuauuggauguauuaagaaauugaaggaagaucauaguugcaugagcuuuauucugccuuagaguuaggaggaacaugugaaaggaacaccuugggcuggaauuccaccgugggcuuucuccauaagauuuuaauuauaucuaaaauauauucauuuauuuagugugauauuccauauagaaaauuaauuuagaaugucauugauuuuaauuuguggcaggauugggaguuucuaagauguugauaguaaacauuugaagaaagcugauagacuuuucauuuuuacuaaaagaugaacauuucagaauaacuucuaauaacaucauuuuguuuucuucuaggauuuggaguuucauggagucaugagauuuuauuuucaagauaaagcugcuggaaacuuugcaacaaaauguauucgagucucuagcacagccaccacucaagaugugauugaaacacuggcagagaaguuccgcccugacaugcgcaugcucuccucucccaaguacucccucuaugaagugcaugucaguggaggucagugaagacuguguccugaccuggggucagccgcuugcuacugcucaucuccuuuucuuucuuuccuccacccaacagugauugacaggauggcaaacucuucuaagacuugacguguccaaguucuugcacauaacauuuauuagaaguuaggaugaaugcauuuuauauauaauuauuucuucaaaauaaguaucauuaacuuauuauuuauuaaaauaagucacccaacagaucugagugucuuguauaucagugguauuguaugcuucuugcuuuuggaagaaaucuuggauguagguaacacugucaugacugcucauaauucagaucuguacagaucagggucagggaucuuaccaucauauuucugcauucuguucacagcgcauauauacauacauacauauauguauauguauguauguauguaugaauauauguauauguguguauauauauauguauauguguuccuugggaacaacaggacaccucgaggaaaaucuuaaagauuuuauaauuucugcuuguuuuuuuuuuaauuagguauuuauuucauuuacauuuucaaugcuaucccaaaagucuccuacacggucccucacccacucccccacccacucacucccacuucuuggcccugguguuccccuguacugaggcauauaaaguuugcacgaccaaugggccucucuuuccacugauggcugauaaggccaucuucugauacauaugcagcuagagacacgagcucugggggguacugguuaguucauauuguuguuccaccuauaggauugcagaucccuuuagcuccuugguuacuuucucuagcuccuccuaacauuagcaauugugagauuuuuacugagagacaugaagaaauuuuuauucacucuagauagaaaaucaauaacagaccaaaguacagacacuaucaaaguccaauuuugaaccaaugaauuuuauuggggucauuuagagggagaugagugagggguuacaggcacagaaaugacucaaagucagcugcaucacaaaaagccuauuccagcaugggugacggcucuugaaagcuggccugcagcaggacacauaucugagcagauuggagguuguccuuucuagucagcauggccggucucuucuucaagguagcucagcugcucagagccuuagcucaguuugucugagaguguuuagcauagcaguccuuacugcuuacacauacuugggcagguauggagaccagagauucugaucagcuuuagggacuuccugaaacuguugacuuguuugcuuccugagcuuaaggggauucccuguaggauggaauauuugacaucccuuuagcagauucugugucuugaagugcuuuccucuaagauggagauuuucugucaggaaauugcugucuaacagcaguuaaugacuaaaauacuaaaaguugagcugacuagaaaugcagaaacauaaauauuuuauagguacauuugaaaauguguaguaacauauuaaaaagugugaaguacaacaaacgcugcuaaaaggauuaugacuuaaccccaguaccucuuaaaugccagcugugaaguuuuuaaaacaguagauuuuucuuuauuuuuauguacacagcuuucuuugcacauuugaaauaauacugaaauguuuuugauguagaggauuuucaaguguuguaaucaccuuucuuuggaacguauaaaaugauccauauuuauuacuuuaugguugugagcauauucccugcuaaaauaauacccagacuaaaguuaguuguagagaguauucccaguuugggaugauuuucuuggagaugaauucuuuuuucccaugcaaaucucuguuacuagguuucaaagaaaaggaagcugcuguuuguguccuuugguuauuugaauaccaccaauaagggauuuggaauaauaugaaagauggguugcaugauuuugaaaauuaaaugguuuugauuuuuccagaaaucucuccgcacccuucauguacucuuuuugucuuucuccuuguucuccuuguaucacacuguggcuggaagccagggucucuugcauacuaggcaagcugccuacuacccagcuauaucuccagccagauuacccagugaucuguuaaugguguauguaucauuaggccaaagaaaugcauagacuuucauuuauuauauagauucagauauugguaaguauuuaacaaaggcuugaucaguuuuugaaaaauaguacaguuaaaugaaaagaaaacuacuccuuucauucuugaucacaaguacuacugaugagcauuguaccucuugaauguagugaacuucucugacacagacucucucucucauccacaugauucuaacagguuugcaucagacugcuauagaccaggagcccacuuggagccagggguucuuuagugucuggucuggcauuaaagauaauccugcuccaguuggacauaacagagcucaucuguagccaauuguugcuggaugucucucaugucuucuuuguucucaugagaauuccagguccaacccuugcuccagucaucagggaaacuuuuacuugauugucugucugucucauauuauuggggguagggaacacaugccauggugugugugugugaggacaauuucacugaaaggaaggcucaguuauuugagacagguugcccuuucaagauaaggaaaaucugauucaucaauggauuguauauacuauuaacaugaucucauuuucuaauuguaugagagauagauugauauauagaaaccuacaucucucuuguuuucuuagaucugaauaaaggaaguguuguuuccugaucagugucuggcacugggucuauggugacaaucacacccacuagcaauaaaauguccaucucaccuggucagugaaucaaccugguaggacaguagcaacaaaguucugaacuaaccaaaacugauugaaagugguaacaauacauugcagucucucagcagguguuugaggcacuaaaguauuuuauuuguauagaguuaaauguaugucauauggccaguauugugcucaugucaggaaaugaccacgguuuguucuucuuuccauuucauguuuugaagaagaaagaagauuggacauugaugagaaaccucuaguuguacaguugaauuggaacaaagaugaucgagagggucgauucguccuuaagaacgagaaugacgccauuccugccaaggugggagcaguccccaugucugugccaacugcagcucagggcuuggucaguggagugggcaagacuuagccucugccauaggagccgcuugucuucuccucuucugcagucccucgccuccuaccuagcaugaccgugaaaagcagucuauuggaccugguuccucccuuaucucaccuggccacccagucacccuuccucacuuuucuaaagaagaguuguagaugcuguugagacagagcugaugaugagcuuguuguuuucaucuuucuuccaaauuauaaagucacaaugguuccuauaggaaauacaagggacaaaggaaguguuggggaccuaguuucaggugcaacuuccuaaggcacauuuaaagcauuuucauauuacauguucaagauuaggaaucagaaaacuuccuuggacucuuuccuuucuuagugcugugguaagaugucugacaaaagcaacuugaggagacuuugcuuugucucacacuuggauggggaagucccugaggcaggagacagcugaucugucuuuuuacauugaugugacuugaaaauauguaguccugugcuaaacugagugaugucauaugcaauauuuugauauuaacaaauggcagcaaauacagagguugaaaauaucuucuaaauuuuacccuugugaaaugcugcugcuguauagcaguaaggaguuuccuguugucuuguguccauguggugugcuacccuguauagcuacacagcuguguucuuguccuuucuuguuccuggauucugguggccagcugcacuguggcaacuguauauaaaguagaaaggggccauugcuuuccuauccauguuuauucuugguuucagcugggguugcucccuuguguucacuuauaacaaaggaagguuucccccuccucuauaccauaacuauuauuuuucuucuuuuuaagcuacuuaaaaacaauguagcuuuauguauuaauaggccaacuuuguagguagauugaaauucaaaguaaaauaagcaacuaauaaaaaagaucuggaaaauaaagcagacauuuuaacaaaaauaaauacaacaucgauucaugaauugcaguuuuagaaaaacaccuauuuauucagcagacuccuugccucuauaucuucauuggauucccuucucuuaguuacuugaugcuaacucuuuuugacuuucacugagugaaauucagauuuucucauuuguacucuuuuuuuuuucuuuuuuaaaaguuguacccuauuuucuaugcugaauuuggguuuuuguuuuuuguuuuaaauugaggugaaauuuacaugugagaaacauucauguuguaugggaguuacaaugugacuaucaccuuagucaaggugugaagucguugccgccuugagccccuccccaucccucacuguuugagguugcuuauuuguuuguccaugguuugugaggugagguggcagcaaagccuaaggaaccuggugugaugccuggcuguggucagugugcugauaauauugcuuuuaccagaaggcucagaguaauggaccugaaaagcaggagaaagaagguguuauucagaacuucaaaagaacucucucaaagaaagaaaagaaggaaaaaaagaagaaagagaaggaggcauugagacaagccucugauaaggaagaaaggccuucucaaggggaugacagguaggucuuucuggaaguauuucugucacucugagcuacaaacaagccaggugucuaauacagcaaacuuaccucaguuauugguaacugguggcacagugacugagacugucauguuaggcuugcuguggaaccuugacgggacauuggagggccuuguuuaaacauggcaccgugcucuuuuauauuagcaggugccuaaucuagcagggaagacccugcucccucuaggcaaacacuaguuaacauuguuuccugagcagaccacacuuagaugucugucucucuucagcuaguccuuugaacuuacuucugugguuuugcucccagaggcaauugugguugcauauucaguacauauaaacuggucagaauuggcaggacuagggagcaaagcagauuuuccuuuucaaauuagaugcgcguuggacauucacacucuuuugcagcagccucguuguggaucacccugcuaggaggugaugccuaugaugcuugcgaauagcaguaagugggcuuauuucauguaauuaucuaagagacagaacacaccuuagaaaaggacacauuucagcucacacuguguggcuugguuuauauuauuuguuauagaaaaugagcuacuuaagaugaauuauaucauuuuaccugauagcuuaaaguguaacuucuuauuaaauaaauuauuuuaugauuacauguugauaccauuaaaauuuauuuaaguauuuagcuuuuuucaucauaccuuauauucaguuuucugcccaugacuuuuguauuguugauuccuuugcagaaacuguuggagucguaucccuaugaaaguuuaacuucaggaaaguaaauguugauagaucucuuagguguuaaaagcaaucaugcuauuuaauuuacauuuuuaaggauuuacuauaauuuuaaguaagggucuucaguauggcuucuuguauuuggaugcugugcuguaauauuguuuguuguguuguagcacagcacuucuagagacugaacugcacaauccagcuagaaacugaaaugcauggcccauauguuuuguuuucuuugcuuuguucaugagcgcaagacaguugagauguguaauccuaaaaguuuagauacagauuucuuagucugugcauuuauauuugagagaaacuguauuuuuaaucucaugguaauuugcacaugguaacuaguauacaauagaccuauuaggggacagguguagacagaugacauuugcaguugugauauuuguauuucuaauaggaaaaaaguuuaaaauauuguugguggucuuuuuccuugcagugagaacucacgacuggcugcugaaguuuacaaagacaugccugagaccagcuuuacuaggaccauuucuaacccugaaguugucaugaaacggcggcggcagcaaaaacuggagaagagaaugcaagaguuucggagcucagaugggcggccugacucagguagagagcuguuuuucugaauauucacuguaaaauguauuucacuauacucuuuuauauauguauuucuuaaacugagaaggugggugaaguagccuuuuaauagcaaauauauccauguaugccuuacauagaaucuuuucacuuagaguucacauuagucaaauagacucaccaaugaggcucuucucucccacggucuugaacccagaaaaugcuaaauauauacaaaagacaagagaaagauaacuaccacaauuuugaaaauuauuagcucauauucuucucuuuuucacuaugcauugcccucucagucccaaacuacuaauauuuugaagcauugcaaauuuacuaguucaucuguaagcauuuuagugcauuuucaugaagggcaaagauucauaguaaaacaaacuccaggaucaucaucacauauaaaacaccugacagcugcucuuuuagccaugcacuuacucauuguuuaaacuuugauugcuuuugauauucuuuucuucacacacacacggucaagauugagucauagauuuaagucucauucuagaguucccuuuaguuucuuucuuucuuucuuucuuucuuucuuucuuucuuucuuucuuucuuucuuucuuucuuucuuuuuuuuuuuuuuuuuuuuguugguuugcccuuuaaaacuuagguguguugguuggcuuuuguuaacuugacacaaaccuggaguuaucugggaagaggaaaucuuaauagagaauugacucuguaagauuggccuguugguuagucuguuggguauugucuuguuuaaugauugaugugggagggcccagccugcuguggguggugucacuccugggugguaguccuggguuguauagaaaguaggcugagcaaaaccauaagaaguaagcccauaagcaguguuccuccauagucucugguuugcuuccagguucccgcucugacuucccuucaauaguugauugaccacuguucagcugacauuggucuucauugcaacaauagagacccuaagacauuagguuauuugucuucuagaaucuggugacuuccuuugggguucauuacuuuuuucccgucuauuuucuguuuccuugauuaggguguagaugcaggugcacaugaagcuauugauguggcagggauauuuacuuuaguguccucuaaaguugaccagugauuauuaaaacuuucucaaacucguggguuuaagacuugccagcacuuuucagcccauuggagcuguuuccuuucugguuuugguagucacaacuggagccagguggugccccuguggucucagcuggcuuuguuucauggggaaacagguaucuacuccuuugccuaggagauacuucucaaguaguacugcuuucuuuaaaccaguaugacuuuagagagccugaauguccucugcaauuacauuuuuacuuucuaaugaucuuaauaaauaauaauagugucaaaauaaaaauaaagauuuguguucaaguguggugacgccuuccuuugaucccagcagaggcacguggaucucugugaggucaagaccaguugggucugcaggacaaguucaaggccagucagagcuauguaguaagacccccucuccccuuuuguuuuuuauuauuagcaauaugauucuuaaaaauuuuuaagaguuuuaugaaauuguguguguauguauauguuuacuuucaauacauaagucacaauuguuguuuuaccacauauuuaauuccuauuuauggcaacauucuauguugauuuauauuuaaguuuuauauucuuuagaguuugccacuuuacagaugaaguacauuuaaaggaguuuggcuucuguugcuguacaaggcaauucagacugcacagagcacagggcuuuccggcucuguuuccuccauaguaccugacaguuguuuugugucuguaagaaguagguaugauaaagagagcugaaauaguuauuagcaauccuguuugaacuauauauugguucugcguauuauuuguuaacuguuugauaaaacucugacuuauaacuaacuggaaauuguguucagcagagaaaauacauguuauaaagcaggaauuuaucaugagguaguuucacuucuuaaaaaguuauaggguaaccauuuugaguuucagaaagaaauaauuguauuaaagcuauauuguuacucucaccuuacccccaaaaguuuagucuaauguccuaaugucaucaccucuauuucucuuacaacaucacuuucagaugcuugguacuugggaaccacagugcucucuuuggaauucuaggagacuagcuuacuugauaaugaaaagauucugauguuaggauguacagaauuucuuuauggacuuuuuaaaaaaacacaaaacaaaaagcaaaagcuuauguugagaaaacucacuuuauuauagaccuuuucucucaaauccaagucugagugaaaggauuauacuacuuauccagguuauuguuaaaguagucaucuaauguguucuguguucuguuuugucaucagucuuguuuaaggaguaggcuccauggacuguccuacauugcagggucaccugcuucugccccaugacuauauaguauacuugauugcaaaguuucacuagcuguuggugggaaguaggccucuuauugccucagcacuguauacuugauccagccuucaaugcugugcugguuugaagaggugugggucucauagguucauguguuagaauggauggccauagggaguggcacuguuaggaguugugucauucuggaggugggcuuugagagcucagauauaugcucaagcuccucccagugugguauauaguucccuucugccugugauucaagauguagacuagaacucucagcuccuucuccagccccaugcuaucuguaugcugccaugcuucccaccaugaugguaauggacuuaaacaucugaacuauaagccagccucaguuaaauguuuuccuuuguaagaggaaaggaaaacuucuugaucauaguaucuauucacagcaguaauaacugagucucaauuguauacuuuauaggaauguaguauugaugauuguaaaagaaaaugaaaaaccaaaaacuacaagccagguaugggaguguguaccuauaagccuaguacuaucacauuuacucccacauugcugugauaaaauaccuugauagaagcaacuuaaggaaaaaugaauuuauuuuaaccuacaguuccaaagguauacagucuaucauggugaggaacauguggcaguagucaagauagugugaacagaggccugacugguccuguugcaucugcacagggaagcaaagaaugaacagaaaggggcgggggggggggaaauaugcguguauguguggcucuaaagccucaaugcucuauccagugagcaguuuccuccggugagagucuacuucccucaagauucagcaauauugcauaacaacacuauuagccaucuggugaccaaaguguccaccaaacaccugagacauuucacacucaaaccacaacagagguugaggcaguuuucguucuuaaggacuacauacuaagaucugcucagaaacacacuaacacacagaauugagaauaacgagggcuucuugguuuuauaacuauucuggcaaaggauuuuaaggauucugaauacugucucauucugucacguaccuaaguuuauguauagaaaaagaaaaaagaggugccugccuuuaaucccagcacuuggggggcagagacaggcagaucucugaauuugaggcauccuggucuauagagaaacccugucuugaaaaaacacuuaaaaaaaaaaaaaagauuuagaaggcuagagaaaaauaaagaagaauacagguaacaaaaggaacacucagaaauacuuaugucugcuaacuacaucccacaugugaagagucuucugcacuauaggaaggcccuaacauuguuacuuagugagcuuuggaaaaugaaaccaugguucuaccugaggaauagucauucaggagugugggagucaugaaggagacaguggcucagaguaucgacuuuuaacuugguugauaaaacauuccuagagacgaaguauuuuuuaaugugggcuugaaugcaacauugagauauaucuucaagaaaauaguaagcuuguugaaugucagauggucuguucccccaguauuuauuuuucaaagucauuggcaguacuugauggaaauuuucuuuauauuuuguaauaagcugccaaagagcuuuaagguugggacauagugaccuuucuauuuagccucagccucagauuuggagagguugccauaaaaguagaguguaggaugcuuaugagggaacugugcuaaaaacuaacauagccauggaaguacuacaucacccucacaaagcaugaccucugaccuccugcuccacacugaaaagccauagagagaaagcugaagaguacugagagauagcgugagaucuggaucaguaauagacuggcuuuuauugaacuuggauagacagugauuggcucuagagugagcagcaaugucagauguaaauggguggcagagaggugaccugugcgguaggcagauaucaucaccaugugugggaagucauuucacuaagagaagucagucaggcaucguggugugcuuauacucucagacucaggagacugaggcaggaagauuguuaguuugaggacagccuagcuacauaauuagacuggaucucaaaaaucaaacaaaaccugauauuugccauggacaguuacuuuuuuuuuuuuuugguuuuucaagacaggguuucucuguauagcccuggcuguccuggaacucacuuuguagaccaggcuggccucgaacucagaaauccgccugccucugccucuggagugcugggauuaaaggugugcgaccacauccggcugacuuuuuuuuuuuuuuaagaaguugcaaauuguaaagaaaauauaaagauucaaauacuugaacuaagcucacauaguguugagcacaugccucccccccaaaaaaaaaauugguucaagaaguuuugccagcacaguggcacaugccuauaauuccagcaccuggaagccugaggcaggaggauugccacaagucugagcccagccuggguuguggugugguguuaguucuaagcuggucugagcugcaaacuauaaccacaucucaaagcaaaacaaacaaaaggagaauaagcaaagaaaaaaguaaccaguauaaggaggagaaauauuagaaaaccaaagcagaacuugcuuauuaaagaaauaguugaagucaaaccauuuuuauauauuuauaauguccaagaaauucuaguaaacuaaauaauaucaggaaaguagcaguuugcuaaggaaguccacaguucauuuauuaguuucaauauuuuuugucaguuuuuuuuuuuaaaaaaagcuauguagucguguaugugugcaugcaagcaugugugugcagcugccuggaggccagaagagggagcuggggccucuuagagccacaagcagaccugugugaagcugggaaaugaacuuggguguucugaaacagcuacaagagcucuuaaccacugaagcaucucuccagccacauuuuugucuguuuuaauaaacccccugagaaaaguguauccugauagcuagccugcuauggccgugugcuagugcgguugguugauuccuugaacgagacugggggcagagcaugacuguggaggcuguaauuuccuaggacaugaugccauugucauacauauccuuugcuguguuuuggaagcugauuaggcaucacagcucacacaggcuuugcucuuggacuuguaaugcauuuaaaaacaacaacaacacucagauauauucacucuaugaugucuucaaaggguagcugauccaaaaaguguugcuauauuucaguuaguugauuuguaaaauuuccguuuccuugcagaauuucucuuguuuugcuaacucuuaaguuacuuuuaaguuuuacuuacuugauuuugugagugcacaugugagugcaggugcacgcauggcugagaaugugugaagguaagaagucaaggacuaggucauuagguuugcuugcaagugucccuacuacugagucauuucaccaguccacggcacuguuuuaugucgucgucgucgucuucuuccacagcuugaauuaauuuccuuccuuuguuugcuugcuugcuuguuuccucucguaaucauuuuuacaaauagaccuuuuaugucaaguauuuuggucauuuuauugucuucagauuuaguaguugagcaguuaagucuucuguaggcaucacauugccugcuuuuccacacugucaauguuucuguucugcaguuugcgcaugcuucuucuaggguucuuucuccuuuuccuuuuccuccuccuccucuuccucuucuuccuccucuuccuuuuccucuuccuucuuucucucucuucuucuuucuuuucuuuaauuuucuuuucuuuucucucuuucucucuuucucuuucucucucucuuucucucccuucccuucccuccccuuccucccucuuucuuuuuuucuuucuuucuuucuuucuuucuuucuuucuuucuuucuuucuuucuuucuuuucucucucucucucccucccucccucccucccucccucccuucccucccuuccuucguucccuuccuucguucccucccucccucccucccucccucccucccucccucccuuccuuccuuccuuccuuccuuccuuccuuccuucccuuugacaggguuucacuauguaguccuggcuauccuggaacucacuauguagcuuugaacucccagagauccaccugccucugcuggagucugggauugagccaugauuccugcuuuguuucagggcuucuuaaccaugacuuauaauagaaaauagauuaagagagucaaguugacauaauguggcauauguauauuucuacuaagaaggggacaucagaacaucugaggaaaucuaaauuguccuuccuaccuccaggccccucagaugacuguacaccuacauauaaaauuaguuuauagugccuaggauugaaauagccccaccaugguggcaaaugccucaugaagucuuuggauuaaguacuugaggucuucuguuuucuaguucacuuuuaaaauacugguuuguugagugaaauugauccuugguguauuugggcucuguuugcuucagaugaaagcuucaaaaguagaacuggaggaagcaggucuuguaguuacaggguugaggaaguuggaaacgggaagagaaguacaccacagaagagugucguagaagccagccccagguccacacuggauguaucugcaccacuguggcuggugcuuuccuagugacagucagugucagcagccucugucagugaccuaagaugaagaugcacucaaagauguaaaauucuuucuucagguggaacacugaggauauaugcagauaguuuaaaaccaaauauuccauacaagacaauccugcugucuacuaccgauaccgcagacuuugcuguagccgaaucuuuggagaaguauggucuggaaaaagagaaucccaaggacuacuguauugcccggguacguaacuacaaaucgacuucuccccaggauuguucauaauaagacuuggcuuuuaaaggaaagauuguuuuuuaaaauuuugguguguguucacucauauuuauggccccuauccccuuacauacacagaggaauaguaaacaaauguaauaaaaacaaauuuauauucuuaaaauaaaagauaaauuuaauaaaauguagcccaaaguuguuuuaccaaaguuaaccucauuauuaaaguuuugauaggcauucuuccaauuuuuauuuugugcauauauuauaugagucaagaggaguauaaccaauuuuauguauguauaauuacauaauauauaaauaaaauagucucagcagugcugcacauuggagacugagagaaccugguggcuguuaagucuaagauguaaggaucgcauagauagaggguccaguugugcaguccuggugugaaguugaaggucugacaacuaccuggaaagucacuguugugauccucuguugaaagacuugaagaaacuugggugugaaguccaggcagugguuucagcgauggaaguauagggcuugcacaccuugcugccuuccugugcuuccucccuuuuguguuauuugagcccucagcccguuggugcugcauccggggcugaucuuccccacaucaguuauuagggcagccaacauugaaaacacacuuagagccgggcgugguggcacaugccuuuaaucccagcacuugggaggcagagacaggcagauuucugaguucgaggccagccuguucuacaaagugaguuccaggacagccagggcuauacagagaaacccugucuugaaaaacaaaaaaaaacaaaaaaaacaaaaaagaaaagaaaacacacuuacagacacacucaguucaguguaggugucauucaggaucaccaucauagauaacauaauuguauuuauauucgaaucugcuuucauaaucaccugcagcuucucggaggcacuguaccuguggcauuagguauauauauugggguauagugauuguuuguauccugagauugauuuguaguaguaaguaaaacagcagauuuucuauuuagccauaaaccaauuaagagcucuuagucucugcaucaguuauaguuguauacuuguuuacuuuagcguuuguccaguuauaacaaacagugguuuguuuuuugcuuuggaaggaagguuuguuuuggcucagugguuugaggguuugguucauugugguaggaauccacagcagcuggacggugaggcagcuggucacauuuuauccauggucaggaagcagagagaaaugaaucaauagauuuaaaaacaaagauagcugguauuuuauuacagcaagugauuugaaaagaaaaauauuucaugugggugugggugacguggugccuuugucuauugcucuccacucuuaauuuuuugagcgggcucucucuugccugaaccuggagcucgcuguccuggguggccucuggacuucaggauacuguuuccucuccccagcacugagguuauagacaugugcuguuaugccucuugguuuagguuuuuguuguugauaauauuuucauucuuugaauauuucauacguguauacaacguacuuugaucauauucaccucccuguaccuacucuucuaaccuccuccagcuuuuccccaucuccucucaacuuuaugccucccaaccccugguauuuuuuguuuuuuaaaauaacccacugaguucaguucaguucagcuucaaauauauuuauucauggguguggcgccaucaacuaagcaugaucagucuacuaaggaccauucucccuccugcagaagucacuaguuguguguagcuccuuagcuacaggcaggggcuugggagccauucucugcucuaugaugggauguugacuggccugaucuuaugcuggucucaugcaggcaacaacaucuccugcugaguuugugaaugcuauggcccugugcaguucagaagacucucuuucaacucucucuuagcacuuuaaucugcugagccaucuuacuggcccauucuuuuuaauuauuauuuuaccuucucuauaaaucaguauguucauuuuacauuaauguuguuaucuuuuccauauugagauacccaguugacccagcauguuuugaaaggcuuuguuuucucuucccucugaaugcuuuguucagucaccuucauuugugugagucaguuuguguacucugcuuuuuguugaucucuguaucucucuugccuacccuucaaaugugcauuuuucuugaaauguggcuucgcuaaauuguauggcaaggggagguuuuuauauaaaucggauauuaauguuccauggaauuacaugguuuggucuaugauaaugaauuuuguaacaucuucaucuuuuuaaacuaagugauuuguuuuuacuauuaaaauuagaaaguaaaguaaccauuccucagggaccuaaaguuacagaagcagaccaugaacuuuauugacgguccauuuugagcuuguuugauuccucuggaggaacgcugguacuuuggucuuuugcucagucugaacagcuuucuugagcaagcuuaggcagccuaguuaaugauuuuaccugauugcauuauauucccagcuugccauaguaaacuauugcuguuucauagucuacuuucauuuuauuuauucacauaauuauuuguugaguauuuaaaauuuucuguuagcucuuuugcuagaauacaaaguuaagagaugucccccaaagagcuuauaauaaaaagaacaaaaggccaaguagaaaggagauagugucuucagacugagagagugcucugugauguccuaaaugaaucacuuggacugugggcucuuaauacacccaugugccaguggccuaaaaaugaguggcacaaagagaggcugaggauauaagugaaggucaggucuggaaggcguaggauauagaauuuaauaaaaagugcuaaugaaaaccgguaaguuuagccuggggauguugucauucguuuuccuuuagggcuaaucugaagccuuguacagaaggauaauagguuucuacagaaugguuucaucuguuuuguguguaagcaugaugaaggguuaccugguaacgucuguugcagucagaccuuuuaauuaagaaguugaaacuguggcucggcuucucauguuucuuugcacugaaucagagaauauaaacugcgagugucuguagaggcaucaaccacauuccucucccuuuggagucuugagugaaugagaauuuggccucaguagacaugcauaagaaacagaaacagcauuuguuaagaguacagugagcacaagauuauccaacauuugccugaaaacaguugaauggcuauguaauguaccuagacaguauacuuaaaaugacaccauacaguuaucuacaauaaaaacuguuuugaguuguaguuuaagauuuccgauuauaugaauuuacuucauaaauauuugcuugaaugugaaagaugaaguagugacugcagaggauuguaguagaggaguuaucuuuaagaaauuauuugaaggcuaacugugugguuuucuauguggaaauuuguaauaaaugcaaauauuuagcacaauuuuucuuaagagccaggugaauaauugccaaauuagcuauccaacuaagcuuuuguuugaaacaaugucuuuacuuaguuaaucuuuuuuuuucucaaugaccagugaagauuguucauaguguuuguuggguucuguugauugauugauugauugauugauugauugacugcucauucagaacaguacuuuaaaggucgguagauacaggaguacaccaguauucaggaggccagccugggugagcgagaccaaaggcugcaagccuucucuugagcagcugcugaucugcuuuugugguauuuacuguaauuauguuuuccuuagguuaugcuuccuccuggagcccagcauucugaugagagaggugcuaaggaaauaauucuugacgaugaugaauguccuuuacaaaucuucagggaauggccaagugacaaagguagagacuacucuuuguuagucuaccagucagauucugcaaccucuucuucauccagugauuuggaaaauaugugugugugugugugugugugugugugugugugugugugugugugagagagagagagagagggagggaggggggagagaauguguguuugugauggguuuuggcacauuauuuuuaauguguugaugugcaaccugucaugagguuugguuuuggacaaugcagcacuuuagauucagggguuggacuuagggaugcucaacuguaaugguguccauuuaucacugugcagacauuuuccucuacucuguuaggauugguauaguugacuuucuagaugagugccuuuacauuaaugaagacauaauccuuccuuaucauaucaauauugcauauagauggauacuuuaaaauacaaccaccccccaaaaauaaaaaaaaaaaacaagaauaagugcauuucuagcuucauacauaauuugcaauauucuagacaguuaauacagcuuaauuuugaaaauuguuuugaauuuugaguuaauucauuugaauuaaauaaaaaucaggucagcugacauauuuguauaugugugugugaauguuugcugauaaggcuauccacagugcaaguucauuuauuuuuaaacuaaugugccauuuacuaguuaguauaugcuguucuugcuagcuaucuugcuuuguuuggaguuuuucagagcacacagacuagacuaguuuauccuucacugaguaagauaucaguugugugagcuuuuccuugcuacuccuuggcagauguuacuaaaauaugucuucuugguuuuguuugggcccaugguugucauuuagugaucaugccccugguuugcuuggcugauaauugccaucgucacuguuccagggauuuuagucuuucaguugaagaggagaccaccggacuacaucccaaagaaaaugaagaaacauguugaagggaagucguugaaggggaaagacagagcugacgggucuggcuacggcuccgcucuuccucccgagaagcugcccuacuuaguagagcuaagcccaggugagaacgcuggguagaguaggaauguguuuuuaaccauaaauguuucuacuuucuaauguauuaaguggccauucauugaagaaauaaaacauucauuaaauggcaauuauuuuucaaaaagcuaaaaaaacccuuaaggccauagaauucauuaauucaugaacaaaaauuaaguucacaugaacaaaaauaaauauaacacaaguuuuaaaguaacaaguaguauuuaaacauuuuaaauaaucaguuccuuuuaagaaaacuuuuccaaaguaacuuuaguuaauguacuagaaacaaauugaaauuaacucuuccuggagucaaccucuguauguaugugagagagaaagggagagguuacccuaacuguuuaugacauauguacaguauuuauuagauuuaacuauaacuuugaaaccuauuauaguaacuaguaggcuauuuuaaaauaacacauuuauuuucauauuacucuucuaauuauaucauagaauucuugcaagcugaagcuguugucauaaguuagucacuagguagacaaauacacugauuccauaauuacaaauacaaauuccauaaguauguuacagauacauacauucucauguaguauguauuagcauguaugugcucuauguaacauguuuaucagucagccaaaaucacauuauugucaauuuaguuuaaaugguauuauguggccuguauuauuaaauauugugaagauauuuuaucuacuuucuucugguaaggaacuaaaauaaaagucaguaauuacagaaaaauagcauuaaaaaggauauauuacauuaauaauaugugguuccuugggcagguuuuuccaacucucuccuucagguuucaguguucauuuuuauuucuaaggcugcuucgguuuuucccagcuggcuauuauaauuaacuagagauuagauauguucuuugugguucaacagucuuaggagauagcugagauacaccgaugcugaauagaauaguaaagugugaaagccacucuaauuuauggccaaggccgugugguucuuaggguaguaguuucauauuuauuauguuugaggaccuguauucauugcuaggcaguuugugaagaauuauuggugcuacuuuguccucaauucucugacuaggaguucacuguuagucagagauguucugugauguaaggacauggugccuguuuaccugaaggaaggaagagaaauggugaaaaugccauuggguuuuaacugaaaacuuugagggucuuuuucaaggaugggucuguccaucaaaauguugcauugguuggagaacuuaugugugguaguuugagagucuuaguuguuagcaguugacaguaaucuuuaaauguauaguagaaaauagacuuugguagacagcagagaggcuacaucagacaccauucugggcuucagacauagagugguaacagcauagauuggcccaacccucguaucuaaugacugcuuccaugguuugcuuaauuuuuacuugucugucagauaaccgcaugcauuuaauguuuuguguuucaaagauggcagacccuggauaaaggucaguucuguccuacuuuucaucaaaugcuagcaacaacacaguugcauauucaccaguaccuuucuuagcacuugguuaccuucaggcaacauuuaucgagcuccuauguaagcagaucaauggauaugaagauagcuaagaaagacugucucugauagcagguaaugaacucaguuuaauuucagugccucuccagauccacacucccuucuaagucucugggcugcuugugagagcuaccuucauauccaaaaugaggaaacauuguuuuuguccuaagggugguagguuugcugguagggccugagugcuagaauaaggucuuuguugccucagagcugugucacuuugcauuaugagaaauauucaugcauauugauauguuauggguggauaaggacuauauuugcauuaggcacauugucaguuaagugugugcccucaauguggaagacugggagguauuggcaggaauuuucagaggugcagguguguuuacaggauuacagaagaauggaagccaggguacugauucucuuguguguuggauuugaaugugcccuuuaaacggagggagccagccaaguggggugguaaccuauaagguuaacucacuguuaacacaagcuguccugcugcuuggugacucaccuguuaccccgcuguuuuccuuaacagucugcacugguuucuaaaacacugacugggucuacuguagucuuuuccccacagcucugaaugcugguggguaaaaugugccaguucuuccuuugaagcaucuuacugaagcucacccuuugcaucucuucuccuccuucccucuuccaccuguucugcauggucucuguccugcugaugcugccuucaccuggguccuggcaugucucuuaaucccagggagaaggaaucacuuugccuacuacagcuaucacacuuacgaagguaaugcucugcuuauacuacuuuuguaauuggggcacuaacaggaccuccuaggugaacaauguugacugagcagacacuguauguguaagaaguguaacaugcuggcuuucuauucauaucuauuuaguguucuguguccagaacccagauuauuuauuggaagcccccaccuccccuuuuaaaugcuuauuuucccaaguucccucugggaagugaaugcagacacaggauugagugcagacuuguagcaugcaagcaaagggccauuaaaugcucuugagcuguguuauggccugugucccuuucaucuuaaagaacaucucaucccaaaauuugaaaugcuuuaagugcugacgugaaaccagaagcucauguagugagugaccucauguaauggauguaguuaucacccaggcacccgaaauauguuugaugcaguuuccuguaaggcuguguauuuagcuguauauuagauggucauagaauuuauauuuaaacauaaguuccaacaccacaauuuguaguauauuaaauauuugucaguaugucacaaucugagggaaaauugcauuaugaaacuuggcuaggguuuugguagccuauuguaucugcccugagucggauuauggcuggccuauagcacuucagauauccuaauuuuccacuggagaggcacucaggugcuauggacuauguagagugcucccuggagguggaagacaguuggaauggagguugaaggaacauccauaauacuccugcuugugaccaucagcuuccagucuagagauggagguggguugccauggggagagaggucagaggcaccaaacuuccagccauucucauuugccagccucccucugcuuggacuagauguucuguuacccacugguccuauagucauuagcuucucuguacucuauauaagguugucucuggcuucugcuguagugaaguguaggaagaaaggagagacugggaacgcagcccugucuguuggugucauaaaguauagugucccucuguaaguugcagaagaauaguaauguaaauacugcucuaauagacaugucuuucauguucuugugguuuuaacucacaugguuacuuauuuugacccuuuguaauuuauuuguguaguugugugacuguauugcauuaugcuuucacuuuuaauauaacuguuugcucuagaacauuaacuauuaaaagggccaguguggccuagcuaccaaggagccugcaacuuauggggaccuauucaagugagaaucuuuguaguacaagguuccugugcucugaauguaggaaaggcacaguuugugaucugccugugacaguugagaauauauuacaguaaacaucuugggaggguaggaguucaggaaaaggccacaagaguugguuuuguuuuugaggcagggucagccuccagagugcugaaauucaucauguaccacaguauuuagcuucugugauuuugauguuucauugaaauccagaguuuaugagaacaguuagagaugagaauauucuaaccuuaugagaaacaacacagacaauccauuuugggagguccauauaaggcauuaugucucugacauacccuggucuccucuuaccuucacccaguuguuaaagauuuugauaauucagaaauagaaaaugcugucaguagaaugauauuucguguacucuaaacuaaagcuagaucuagauaacuagauauucauggugucuuuuguuuuuaagaauucagacuacauugccgcugagagacuuuuaacagucuuuguguauacaccaaaccuucuaaacuucugaaccucucauagccaacauuugauuccaaugacugaagauuugaauaagugacugaauguuacuugggcaaucuugaaacagacuggggagacuuuuuaaaggaaaucuuugcaacucaauguugggcugugguggaagccugguguauacuaacugcuguguucugugagguacauguguucugugagguuauauauuaacucugaaaacaggggucuucugccuccuuuccuccagcuccuuccccaucauagagagucagguuuacagcaaugucaauacacauauucuuuaaaggacacaagauuggauggauacaaaagcaagguagaucuggaggaguugggguaugguguucacaucaucaaaacauguaugaaauucuaaaagaaccaauuaaaaaaaaaagcaaaaucucuuuucugucuucgacuccguucuucucaaggggguuaaacauuucaucagcauuuauuaucagugguagacauuggaaucacaugagacuuacuccuaggucugugguucaggagaucuggguugcacaguuaaaagccuuguuaugccccaccagcuauauugugcugugcacuguaagggugcgugguacuucuguccaacaaaggcacagcauugaaguaauuaauggcuuauguggccuuacucuguguucucagugcaguuccauccucagagucaguaaggggacguuaggagagcauguaggaaaacuuguaauuagaacguguugguagcugggcguggugguacacgccuuuaaucccagcagaggcagguggauuucugaguucaaggccagccuggucuacaaagugaguuccaggacagccagggccacacagagaaacccugucucaaaaaaccaaacaacaaaaaaagaaaguauuggaaucagugacacuguacauucuauuccagcaggagcugcuuggcuucuguaucugguuaaguuucacugcaacaucaacucuggaaagaaauccugagaaguuaaaccgugcuagccuuaguaagagaaacuuguuuguuucaagcauaagaacaucagacuugacaaacggagcucugugucuucucuucccucucacagauggcucugacuccagagacaagccaaaguuauaccgccuucaauuaagugugacugaaguugggacagagaaauuugaugacaauucuauccagguacuugaucaugccugcugucuaagcguuuuaagguuguuccuccuaucaguaauuaguaagcacucaucaaggaaccagcugcaagggaauggaugaaggugacaggcagccuuuguauuugaauaugccgcucauccucucugacucacuucucugauuuaguuuggagagaacgugacuugucuguauccagaagggauacacggaaacaugacugguugugacauucuucucugaguuuuuacuucugacuagaaagugaaggugcugauagcaacuuauaggucuguuucaggauaguggagauacaguggaaauguugcuaccucucccccuccccccuuucccccucccccuccccccucuuccucucccccucccccucccucucccccucuuccucuccuccuccccccuccccucucccccucuuccccuucucccccucucccucucccuuuuuucccccucucccucccccucccccuuccccucacccucccucuguguguguguguguguguguguguguguguguguguguguguguguguguauucuaggguuggaacucaggaccucauacaaaucguuaaggaucauaacuauugaacuacuuccccaggccaucauaugauuaguaaaacagaguuacaauguuccugccuuacaacagguuuuuagauguuaacaguguucagcuguccugacaugguuuuacacuauuagagagaaauccacuuaagaaaccagagaaccgagggcuucuuagacugcauucgucauaacagaacucuacacauugagugcuucaugauggaacucuuuuccuucucuucuuagcuguuuggccccggaauucagccccaucacugugaucucaccaacauggauggaguggucacugugacacccagaaguauggaugcagagaccuacguggauggucagcgcaucucagagaccacaaugcugcagaguggcaugagacugcaguuuggcaccucgcauguguuuaaguuuguggaccccauccaggaccacguucuuuccaagagaucuguggauggaggccugauggucaagggcccaagacauaaaccugggugaaugugauagaucagcuuaaggauuuuagaguguuuggcuguaaaguaauuucaauuagauggaaauaucuuuacuuagaguuuauuacauuaguuuaaauuuucuguaugugugucugcgucuguuccuuuuggaguugagaggauaccucacaggaguagguucuccuacuuguggguccuguggaucaaacucaggcugucagccugccauuuuccccauccuuaaauuuucaguuuuaaaagaucaaggugaagaagggucuggagauaaggcuuagugcuuaaaaacaguugcugaucuuacagaugaucccaguuugguucccagcaccuaaaucaggcagcucauaacugucuguagugccagcccuagggguccugaugugggcauuauacacacacauguugcacauauauacaugcaggcuaaucacucaccuauuuaaaauaauuuuuuuugaagaucagugcauuuuaugaaaugggaguuuauaucacaaauuuggauugguuuuggagcaaacacguagauucugauuuuaucuugaaauugguuuuuaaguugaucucuuuuugugugaaccaucacccuauguaacuaauaguauuucaaaaucuuuccuugauguauuuuccuccuucauauucuucucccugagaaccaugguaaugcaagggggaaucuguuuaggaauucagagcauuuuagcuccaccuaguguuuuccugaggucuugcaguguggucuacuaaugagcauucuucuggagaagagugacuuuuccuuuagugauaauuuugaaaacauacacuguuuagcuauuuugcuaucuauuuuauauguuaauaaaguaucuuuuggaaaaauaggugccauggcucuucaugguauuuaaaacaaacuucugaguccacagaagugaaacuuucugccaaagaguauacaaauagaccaaccuauauaccuguauugguagucucugcauggcccuggccugaaacucaaccauguaguccaggcuggccucagauucacagagguccaucuacuacagagaccacuggccaccuucacagauaggacacuuuggaauagcuucucaccucaaguuguuuguuuguuuguuuguuuauuauuacuuuuuuuguaauguauguacuuggguguguguaccacauguaggcaggaaucuagcccaaguccagagugacuuuauacugacuuagaugccaucauguuaugaccuuuggcuauacaaaucacaccuuucuuaggauucagaacacaauaauaacacauaggugcucgauggauaaugacuagauagguaaauaauucaugaaucaguguauuaucacacagcccucaaaaccccaaacugaugucuuacagacaguuacaugcagaaagugaaugauuagccuuuaguaaaagcauuugaacuucuuaguaagaagcuauuauucagagcaugguaacuguuuuacaucacaacagauuuuauuuucuuagacgauuguagaggaauuucuaauaaaaauggcuugaauuucuacauuauuuccuuguuucagucucuagaugaaguuuugaaauuaaaccauguaguucuuagauguuagaacaauccagaaauagccauaucuuugcuuuugauggcuuauaggcaccuuaggcuccuucuccccuuagguugggaccaggguguuguauuuacuguguuuguuccaaagaauaucguuuugcuuaucucaccuuuguccauguugaaaaugugauuuuuuuauuauuauuauuuuauuauuauuuugaguaaguguuuugccugcgcucauguauagcaugugugugcuugaugcccacagaagucagaagacuguauuagauccccugaagcuggagauauagaugguugugaucuaccacguggguucugggacccaaacucagcagaugcucuuaaccuuagagccagcucuuuagucucaauauuuuguuuuuguuguuaacaucugguuuuaaaaauaggaccaugagaguuuuuuugauaugcuuccuaauuaagaaaaguucacauauuuauugucacuuuuuaaagucugugugccaaaguaaaugaauuuauuaaugauauuugaauauugaaauacucaucuguucuugcuguauuaagaguacuaccuugucaguugaaguuuaauuuuuauguuuauuuuucaucuccauagagcuguucaggagacaaccuuugaauugggaggagauguccacagugggacagcauugccggcaagcaggguagguauuuacagacucaugaccugaccaucccuuggauucgauguucuaggacacccaagaacagacacuccuuuguaaagacaacuucacaguggccucucucugcugcaacccacucuuuucuaucuguucacacagugaugcuuaaaugaaagguagcuagcuguuccuuuuguccugaggucagaaucuaguacuuucucuuucauuuggaguaugugcuuugccugugcucuguguguaacuaaccgcuguggccaucaugcugaggauaauggacuuuugcuacuuuauucacuggguacaaguccuagaucucagcuggguacucaccuccgacagucauucuuugcucuuguauagacaagucauuucucucuucauuuuggugaucuauuccuggauuacacucacugcaaaacuuguugagcuuaaacagcaaucccuucauuuacugacaaguuggcuugaguuuccuagggcaguugguuuacuagucauguuccugguuccucuugugagugcagugagcuagcaggugaaucagaggucacacugugggacuacccacccugccucucuguaggaccuugaauucacagcuguuuucauggguuaggcucagggcugguguagcgcuguuuucucugccuuuuauugaaagcaaaucagagccagauuuagagggaagaggucuccuugaacuguguucuuguuuuguugauuuuuuuuuuuugauaccauaaugcaacugagucuggaauauuggucucaccagugucaaaaagacacaggaucuccugauucagcuuauuguauucuuccaguugcugaccccauuaugcuacuccaauucucagcauaauuucuugaagacauggccugagguggcuguucauuuguucuaggcuggucuccuuuguuuucuguguucuuguuauaaaaguacaaaaauaaccacuauuugagauauaccuuucuauuuccaggguaaauucugucuuuuaucuucgagucguggcuucuuggcucuuucuagaugaauuuuugcuacuucauucucagauauacuuaauuucugaaaauuggagagcuaagcugucagcucuagggcucugucuucuguauuuaugcauggucccugggagaccuugccauguugacuaagacuauaccauuuauuguugucuaugaucccuaauguaugccuuugacccuggucucuccaaacauccucagaggcuugacuaacuugcugugucauuuuuaugauagacugucugaugggaacuucaaauuuaacauagcaaaugaagcuuggcuuuuguuuuuguucuuaaacuuaauuuuuucucauugucuuuacuuuaguaaauuauaucaccaaccauggcuuugcuccacugaagcugacuuagauuuauuaucuuugcacaacucuugcaugaggauugucauguccuauuucuuugacuguaaagcgucuguaugucucugccuugcucauuagcaguuuugugagcaacaguuccucuugggugcuccuggucaguccauguugguugccauugcucuugaauuguagagacaugcuuuugguucuguuggcgcucugcugucauagcugcuuguaucuucccagcucacagacagcucuugggauguggccuccaucccuccaggaguguuguaauuaguaucugcccuccuccucuauacucuuccugagugucccacuugucucucugaagcucuuuuuaccuuguacuugaucucauucuuuguuuucauaugauuggccccuucuugucuuagcccauccuccugacagggggcaggggguuguucuuugagcaucaucuggucauaauacuccauguaagacuucuauauaacuauuaauuaaaacugcugcuaucuuugcuugcuacuugaugauguaguuugugagcucuggacaugggaacccugcuucuuuaauuacucucaucccucucuugcuuugaguagugccacgcugcaacagaaucuuggcacauacaaaugaguguaugacuugagaggucaagcagagcuuuucucaucacaauguauacucaacacagaagacuugguaaauagagggagaaugaaaaucuguuauccguaguauauagauuagccuuuucaacacuauuggacccuuuccagagugcuugugucauagggaggugugcgucugugccuuugugugcagucacauguuucaacgcuacuaggcuuuuguuugucuauguacauuauacuguuguguuaugaguaguuuuuuuuuuuuuucuuaagucacuuaagaacaauucuucaguggauaagcacauaaacaugcccuaauuuacauaaacauguuauaauuuaauuuuccauugccauugcucaccauuuauaagcuuauuuuuaaaaaguuuuaaaaccuaaaaauugugcaauccauugcuuaguuuuauuaugugacuauaacuuuggaaguaaaaugacuagucuuucaaaaucauuuugucuuuauauuuuguugauaaaguuuauuccuugcccuuugaaaaucaacaguuuguuuuucaugcuguuguguucagugcugugagcuucugggcagaaccuugggcagcuuguccugaguguuucugaauuacucuccggucuguguccuuaccguaccugaguagcaacugcacaucagauugcugccugcagugcuaaguggaaagccgauggcugggcugugagguguucuaacacacucuggcuucccuugucacagagcacuacuagacuggacagugacaggguguccucugccucuagcacagcugagcgagggauggugaagccgaugauccgacuggaccaggagcaggaauaucgacgacgagaaaacagguaacucacguugacuaacagagagaagagagccguccucgaggaggcuuucuguaacaauuguugaguugacagauuuagcugccaccucuccugggguuuaaugacgauuuuuguguugcugaugacuggugaggaaugacuguuggguaggugcauuccuuacuugccccugccuaggcgugcugacacacgggcauguugggucacacuugcucuuuuauguuggcugcuuuacacacagagagaaaggaugucuuuauaacauguuaguauccaucauuuuuauagauuauauucauuuguagagacauaaagacacaaaugauuuuggagagacauauucccuauguagacuccaugguaugccucccuguugaggcaaguagagggugaacuaguuuccuuauaguguuguuucauuuuuuguaacacagagcuucucugcuuucuguauucuuuuaugcuuucuaguauguuaccuuaauaaaucagaauuccauaucucugaaauuguuuuaagugcuauagcaggucgugucccaccugcucacuguuagugacaccguaguagucauaugcugagugaauguguuauuggugggagcuaaagacacugaccuuuuuuaguguuuugaaggaggcaucuuuguguucuugucagagauccagaacagaugguuggcauacgcaggggagacauaccuaggguuacaguugacugucagcccaagacaucguuuauuauuuuaccaucauccagcagagggcacuguguacaagauuaugaauaacuucaguccagaaaugaaauauguaguuaucagcaaauaucaguauacuuuuauucuguguuuuugacuguccauguaagauuuuuuggcuuugugauuauuaggugucauacauguaguucucuuuccauguuugcacuuguauugggugguguagaguaaauauguugucugucaugcguaguggugaguugcuuuguuuuuuuuuuuuuuuuugagaugggcuucaguauaaaacccuggcuguccuuggaccucaguaugucagccaagcuggaauuggauucaaagagguccuccugccuccgcaucccaagugcuggggguuaaaggcguguuuccauacccaauaugaguugguguuauagugagcacagcugugcaucuauaugguaauggggaaaugugacuaggaaucuaaguggagaggcagaacauggaagcaaguaaauaugcucuugcuauagcaaaggagccauggcuaauuaaaaguuacucccuauaagacgcguuuugacaacguuuugcaagguaagccuggucugcuuugcaaguaguaagaguuucauuuacacuaaguauguuguuuguugauauuaagacaagauggaacauaaaccuuucuucuaauuccuacuacaguuuccacacugacaaugcugaaaguagcaaagguuaauuuaaauggugugccaugaaauaugaaucauuuuaauaaauaggguuaaaauuaaaaguuuaggcgaguauaagcacccuuuagagugauaggaaugauuuuucuuuuaaucaucaacagguuuuuuuccuuuuuccaguuuauauacacucuuuacuaaauuuguuaaaagaaugaaaugaguagcuuacacagcuuauccaaacuaauucauuuaugcauuggaagcugcucacuaagcaugauugugcacacacccuuaauccuggagccaggcacauaucugugagguuaugcguuugaggccagccugcucuacagugucacuuccagucagccaaaguuuuauggugagacccugucucaaaaaaaguauacuuaguauaagauccauauugaaauaauugugaauuaaaaucauguuguuuucuuaaauuauuaaguuaaacuuaaguuguuaaauuauagacuggauugaacuuugacuaauauaauuuaauggaaauaauuuuguuuuuaaaaugauaauaguguguguuaacauuuuuuucuuuagauuuauuuauuuguguaugcuguguuugaugcacgugugugcgugcgugcacguauguguguuuguguguuucuguguguguguguuucugugugugugugugugugugugugugguuacaccacagucuuucuugacuguuagguacuucuccagucccuuguauuguuuucuuuuuauucaccuucccaugcuuggcagaggugauacugaggagaagggagcuaugugcuauugggaaagaauuauuucaguuagcugguuuguaaauuauuagaaaucuauaccaaauuauccacuuguacuuucaaacaaaauuauuuggcuauuuguguuaacuuauugugagugggccagugaucucguguacuuggaucugccagugugucaccauccaucuuuccugugcuuaguggaacgagauagugcuagagauaggguuccucacuuuaaagccauuagcaaguaguucugcuucaggaaucuuggccuugaugauauuccaucuccauuuaggucugucuuuaacuuaauguuucuaaucuacuaugucauuauaauucacagugaauuuugcagaaaaggggaauacauguuccuagccuuaugccgggugugugugggucaguuuucuaauuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggaucuuccgguaguacuauguccaguuuucugaggaaccgccagacugauuuccagagugguuguacaagccugcacucccaccaacaaugaaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuuuagaagaguuuuugcuauccucgguuuuuuguuauuccagaugaauuugcaaauugcuccuucuaauucguugaagaauugaguuggaauuuuaauggggauugcauugagucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuauagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggccggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggcucuuuuugcauuuuccauuuucuuugauuguugugccgauguucucuauggaaucuucugaaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuacccucuaucagcagaccugggagacagauucucuccucugaauuucagugcucagagcacugucugcuggcaagcucucuuacagggaaggugcgcagauaucuuguauuuggaccuccuccuggccgaagaagaaggccuaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggccgccucccaagccgggcgggcaccuguccuccgguccggacgguggcuggcuguccccggcccacacagggugcugccucagcgccucugugcuucugccuguuccagaggcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcuguggcuuaggccgccuccccagcugggugggcaccuguccuccgguccggaagguggccggcuguccccggcccacacagggugcugccucagcgccucugugcuucugccuguuccagaagcugucagauucucuggcgcacccucucaccuguucagacuaauuuccuaaguucggcgggucucggaccaagauggcgaccgcugcugcuguggcuuaggccgccuccccagccgggcgggcaccuguccuccgguccggacgguggcuggcuguccccggcccacaaagggugcugccucagcgccucugugcuucugccuguuccagaagcugucagguucucuggcgcacccucucaccuguucagacuaauuuccuaaguucggcgggucccggaccaagaucagaucacccaguuuucuaauuuuaauaauuauuccuaauuaucucuguaaaguuggacaaaagugaaaaagauguugaaauauuaacgaagguuacuugucuuuuuauuuaguagcaaacuaccuuagaauaacuauggucguaauuacaucucaaaaggaaaggguauuugaggggaauguuagccauuaagguaaggagagcuacaguggaguuauacuuauguaguuuacuauuucugcaagaccucagugguaacuuucaaauguuuucuggccauagucauagcaugagguauauggagccuguuggauguacucaggcauguguacagguuuacagcugaggaggaguuaggcagaacaguguucaggcaucuuuccucagcacuggggcucugagccaucuucugaagacaucuaucgcagaacuagacuuagccuucuaauucauuuguuccugaguaccuagagacguauaaacaguagcacaguaaguacuuagcuaguucuuagaaauguuuccaguuauuuaaauuuuugauaauuccuuauagguaaagugauagcaucugauauuuaugugaccuugaggaagaugagcagauagaaugaccauuuuuuguuguuguuguuguuguugucuuuguuuuuuaaagcaugcuuuauugugagcuuugauaaaggaaauacuguguuauuuaaaaacaaaacccgaggggcuggagacaugcuugucgguuaagaacaccugucuugcuugcagaggacccaguucaguuccuaguaguguuuaaucuugucuguggggauggauugcugccugccucuuaggacaugccuucuuccauuuggaagugcucaguuucuagcgcaggguggugucucccagcagugucuuuucacuguuaccugagcugggugguuuagauccuugucuuuaacauggcacucucauuaauaauccagacuuguguuauagcugcaugauagcuacuugaaggagucagccuucugucuguucugaauguuugacucgguaacugaugaggcugagaggcuguacugcuaugucacacugcaaaacuccauguggauacaaacuagcuuagaggugcacgcagcagugaggagaggugggaucagcuccuaaggcagguucaaugaugucagguuuuuuuuuuucaggacucaggaugcuacugggccugaacugauacugccugccagcauugaauucagggaaagcuguaagugauuuuagauucuauuauuaguggaugaguucuugcuccauuuucuccaggugacuugcauacuuuauguucauuuuuuuuucuuguuuuacagcugaagacucuuuuuuaucugccauuauaaacuauaccaauaguucuacaguucauuuuaaguugucaccuacauauguguuauacauggcaugccgguauguauuguccagccagcacaggcccgacaucaguccuacagagcguacacauaaggccauugcuguugucaacaagauggugagcaugauggaaggggucauccaggugaguggcagcccagcaagugcugggaggauggcagccaucuuguuaguuucugugacacuucugaucuggugacaaguuuugccuguacagccugggggggucuuuuuuuuuuuuuuuuaaaugcauagauuuuaaaguugaaagaaaauaacaccuuguucuaaaaaauuucuucucuguaaauuguagagaaaaugaagauaaacuguaacccaacacuugugaaaaauacccugaaauuauaguacaugugagagagugcuuagaggguggucagguuauuuucugaauuuucuuuaaauuauugaaaugaaauucacacaguauacugucaucugcauucuggugugugcagcucuacccuaagaguguuucuccaguguagcaaggauagucauucucucuuuccacaggcccugggguccacuuucuuaguuuuuuagugugaggcacuugcuuuuuuguaaugagccugugguguugggugcauuugcacauauguauucuugacagugugucuguagaguuagugggcuggaggguaaacuucucauuaagguggaauucucucacccugguaagaauucuuggguggugguuuggcucccuuaacuaacuccucagucuacaguuuauaaacuuggugcagcuguuuuccauauuugcagguaauuugaggauuuaauuguaaagguuauaaagacuuuaaaaaguuuccuuaacucagcuaagaaacuaaaagugcaauguuacuuuaguuaaaugguuuggugacuuaaaaaaauuuuuuuggcaguauaauuugaggguaacugagauggucucuuaauacuuucugaguuauuuuuaaaagccaaaaguuuuccacaaauuuuucuuucacauuugagugacuagcacaguaggauucugauggucuuauuuaagcuaaagaauagauaaaaagaaagaccauuuuaucuggauacuuuguuauuucugguaucaucauuuuauauauaaauaaauguaaguguccuucuuaguugucauccaaaguuauugucugucucuugccaugugugaacuugaagccugugucauucagacugugauaauuuuaucaccaaacuaccuuugagaauuuauccucagugucugcuagugggaacuuugacuacuagcuggaaaaggcuuuuaaacuuaagaguagauucaguguaucauuggaucacucauuggugaugggaaaaaaauuaccauaguagauaauuuagagucuacugcccaaaccagcauucccuuuaguacagguauagaugaauucuuuaugcacuuuagaaauugccagcuuuuauuuggacuguuuuucucaguguuuccauuuucaucuucauaguuaauucaugggaauggacccuuucaccuucauguaguaagcucacagaaucauuuuaaaguguuugcagguccuuccuucgcguucucucuuagagagaggagcauggucauguguguuuuauuaugacauugucuuuauaaacaguaaagagguugugcugauguuaagaccacgaaccuagcccucugugucagaugcuuugggaauaacuaagugucgugcucaugucguaccuucauguuaguguuuugauuuuuuuuaaauuaucaugauuguuuacaaguuucuuucucucguucugcuugauuuccccucgucuguuuuucuccaggaaguagaccagguugaucagguaggacauacugcugggaacugauccuagcuguguuggcuuagcugaguuucucaugcugcuuccauuacaaauaugagccuacaaaaacuggacugagcaguucauaacccucauucagcaacugaaacaugcaacacuaaaauccuuuuugacugcgcaacuuauaucagcauuucauaauuucugcuuaaugcacuucaguguggauaugaaaugacaaaaguucuguuucuucucuauuuuuauccuugguuccuauucuuuggaucucaucuaaggcugccuggccugcaaauguggucgggagaggaugugauagaucaguacuugauacugaguugcaugguguccaagccagugacuacaaguaucaggguggcuguggguaaccauggauaccugugugugugcuacgcagauuaccagauaaugcauaaucuacaauuugguuuuguaauacacaguauauccguucuuuacugacucugcaaauuccauuuaauuagaccaguaugacuguguauaugaauccucagacgcugcauugguuauuugcuucccauugcucggcauguaucuaaauuucuuugcaaguaucugguaucugugguaacuaccugguggagaugggaagguacuggucuaucuucagcuucucaggaacauuccuguuuauuuguaauuuuucugaugccuugcuuuguuuaugggaauguuuucuguccacagaaacagaagaacauugcaggagcacuugcuuuuuggauggcaaaugcaucugagcuucucaacuucaucaagcaggaccgagaccuuagucggaucacgcuggaugcccaggauguccuagcacacuugguucagauggcauuuaaguaagaagcacauucuggaaagaauaauaaguuuucaugcuuacaagcuucauguuguguuuucaaagccaguguuaaagauuuuacuuacccuaagugaagaugcuugauugccacaaaacacaggagauuguguuaacuuaagagcagugugcucuggaacaacugcaguguugugaguguuccagaguacaauuuuuguuauuuuuaaugaaaaauauucuuaaagaauacagauugucucaaaugguaaaaaucuaacacugccucugugcaaccugcucaggugauuaaaauuguuuguguauuuucagguacuugguucauugccuucagucagaacuuaauaacuacaugccagccuuucuggaugauccugaggagaacagucugcaaagaccaaaaauagguaagagucuuaugugccuccccuaacauugaacuuggguuuauuuuuaagucuuuuuuuuuuuaauauauuaaauguuuguauguucugacugcauuuaugucuguauaccauaucugagccacagaggccagaagaaggugucagauugccuagaacuagaauuaaauuaaagacuguugugaaccacuaugugggugcugggaguugaacuugggcccucugaaagaccagccaguguuuuuaaucacugagcucucucucuaguuccuaguuuuacuagucuucuggugcuacuggccucugucuggguuauaggccuagcaagcuucugcugcgccacucuccuaagggccuguuuuuuuuuuuuuuuuuuuuuuuuuuuuuuuaauguauaugagcuuugacuacuuguacgugugugucuaguauccaacagaggcaaggaaagguuguggcauuuccuggaacuagaauuauacauagauggcccuuaugccaugucaggugcuaggaacugaaccuggaccugcaagugcagcagcuuccaagccaccucuccagcccuaaguuuaucuuuguaugcaguauauuguaaggaaggucuuucuucuuuuaagauuuacuuuuauuuguguuacguguuugugugaaaauaugcuguggguacccaaaaaggucagaagagggcaucagaguccauagauuuggaguuuaagcagcugggaaacaaacuuuggucuuguggaagaacagugcugcugcacugcaacaagugcucuuagcugugaaacuguccuuccagccccaggcuuguuucuuaaaugacugccuuauuguagcuuugagaugacuuccgaagaacuggcugucagacuuaggagucauuuucacuuuugcuuugcuucuuuaaaaaacuuuuagguaaauuuauuugaauagugguuagaaacuauguguuuaagaccacaccccugcuuucuguuugaauuugguauuuguaacugguuugacacauuuguuaauuguuauaacuaccuuugucugaaguugguaugacucagagguucugcugugacccuguggccccugacgauuugucccauauccugaacagaugaugugcugcacacacucacaggagccauguccuugcugcggcgcugcagagucaaugcugccuugaccauccagcucuucucucagcuuuuccacuucaucaauauguggcuguucaacagacuggugacugacccagauucaggccugugcucccacuacuggggugccauuauccgccagcagcuggggcauauugaagcgugggcagagaagcaggggcuagagcuggcagcugacugucacuugagcagaauuguacagguguggacaguggcuguacuccauucuccuugcuucucccucuucccugccaguacaugaacuuuagauugacaugaugagugacaacuuggggugauagagccucaguguuuuucccauaugcauucagucaagcagcuacugugguuguagccucugggcugcuguaacaagccagcuaaaacuaaaugucucagccgagguuuauugucucucucuccuggaaaccagagguugaaaucaaggugcuggccucugagggacuugaauauaaguugguucuuccagcccuugguaguuuauacccaacuuaggcauucuuuggccagucuuugccacagacuucaugugguauucuuggguacaugucuguccaagucccugguuuguacaggggcaucaguaaaacuggccuccuuuuaaccaauuguaugcacaaggcccuuccucaauaguacuccagccuccagcaucagaaccuuaaggacaugguuccuucuguaacaagguguguaaacaguaggacagagauaucacugacauggucuuuuuuaugagaccagcaaaauagguuuuacugaaggauaaaugaugauuuuaaaauggggcagcaguuaacucuuuagauguuaaucauaaccuacuauuuuaacagcucucagauaccaaagucuaggaacugguguuuauaaugaaggacaugaguuauaugcagccucaaaacuuaaaacauuuacuuaaauguauuuauuaacuuuuguuuuuaugccuuucauuuccucuaaagauauuuaguaacccaagaagcugaugaguucucagcuuuuaucaagauucauauuugcaaaacuaucagauuccuauuaacuaaucauccggcuugcuauguaaauguucaaacuuuaaaggagacugcuuaaaagacuuuauaaacauugauaguugaguaaaauuauauuaaaaacauaacaacuaaaguaaaacccaagaguguauacaaaaguaugcuuaucauuuacuauauguagcucaauguuaaugccucuuuaaaagcaucuugcauuucaaaaucaaauuaacaagauacugccuuuacggugguuauaaauggauauuuuuguuguguggugcuggagauuugaaccuccagcuucacacaugauacugagugugaggucuuuuauaagcuuuacacucucggcuuuacaaagaaugucuuucaaagaaaaaauacuuuaucuuacugcaugauauuuguucucuuaaauaggcuacaacauugcuuacgauggauaaguauguaccugaugacauuccaaauauaaacagcacaugcuuuaaguuaaauucucugcagcuucaagccuuguuacaaaauuaccacugugcacccgaugagccuuuuauuccuacgguacgugaguauuuacugucccacagagugugggcgugucugcacaggagacuggggaugggggggagaggaaagcaugcucacuggugugucagcauuggcucaccugaaacugucucuugaggucagugcaaagacuagagacuauagacacauuuuaaguaagaaaugauuugauucagggcauuguuucuuggcaaguccuuggaagaacuagaguaauggguuuugaguugaaguucauaccaccaugccugaguaccagagagccagagcugcugcaggagguacaaggauacuuuuuauaugucgcuuacacuccugccaucaggaacagcaugcauaagucuucacuagauagcagcuuucuugauuuaaaucagugucugauugguaacaaccaaaaucucauccagaagaaagucuggaauugugggaauucugaucuccuucuauaaggagacuucaaggugagaaacccauuugugugugugcgcguguaugugugugcaugugugugcauguauacacacagagagacagagagagagagcuguguuacagaugcuaccaucuuaagucaauaccugagagacaguuugaaagaggaaagauuuggacucaggguuucugaguuucagcccaugaucaacugguuucaugauuguggguuguaauaaggcagagaacuccauugcaaagaagaugcuauggaggagaacuguuuccuuccugcagccagggaacagaaauugcagcaguuauccucuuugcucaugacguguguugcuaucuuaaaauuagagcaacugacaacucauacuaaaauuucaggacacagguugagcucacuaccauucugucgugggauagggggaggacucaaaggacuucuuuucaugaauaauguauaauuagauagcauggggguugggaagcucuccuuugcugggacagcugccuguaaguugcccauguuccucuaaucccucuuaauuguuuaucaugccagacuuggcugggaucauuucuuuuaccuguucuuaccucucuauacagagguaguauauauggacuacucaggggaaaaauuauucaaagacaggaaggggccauggcaaaauaaaaaucuuuaaagauagauucccccugugaccuguuucuaauuagauccaauuuucccuaguucugcuacuucacaauaaccuauucaaguaugaauuccccaacuguuuauccauugaugaagacaaguacccuuuagaucuaaucauugccucaaagccucuaagcauaggacaccuuuaggaggaugggacaguuccacgcaguaacugugagaccccgacuuaaagcguuucccccaagcuuguuuucccugaucucuaaaaauacagccagaaagaaguucuuuguucucuauagccagcaaaaagccuuuuuguuucugugccuuacagccagagaugcgaugauuguggggagaccuagccaggagcuugcuuggcuuccugugccaaggacacggagauagauuccacagagaagagcuacagcucacucgccacuccucaugccuuguaauuuuaccaaggacacccaccagaggagagcuguagccaaacuccucucaacuucccucggcuccucccaacuccucccaauuccucagcuagcuguuaaaagcacccuagugauaccgcucugugcuggcugugaaaggaguuuuuccucagcuagcugacaauaaagucucuugcaguuugcaucaggugugguuuucucuugaguuauuggggugucggccagcucaucccgggacuugagcugaggucuccccaguuucaggggucuuacauaacaucuaacacccgagccagcuguauggagaagauuaugcuaguugguggacaaaugaagcucauacugaguuucaauaaaaggcagguacagaauagccaaacacuggauaucacccccgcagcaguauacugcaccagaaagucauguuacagugauggcaaggaaucaugguugccgugauaccgugagugaggguuaugaugcacuugcugcagaagaaaccauaugcaaaguauugacagucgcuucuagcguuuaauuuuaacaguagaugaaacucccuuugacauuauaaauaaaccuagacuuuugcuccuuuugugggaaaggaaaauggugguagagcccaggacugucuccaggggcagcucugcuccucauauagaaguuguggggaagugcgcugggaucuucauguuaaugagccucagaauggagagcuuucuuucucgccacucccugcacucccagauauguguuaguaauauaucuuguaauguaaaucauccacagacccccccccccgccugccccccacucagcaguucuucuacugauuggcuuccaagcuagauauuuuaccuguguuuuuauuugcuuuuguuauuuucucauucauuuucccuguguuauuuuauguacuauaaaaauaauuauucacaacuucauaacaauguguuaaagaguuauacaaaucaccugcuuuggagaaaagaacaucaggugcuaaaacaguguuuuaaagccuucuguucugucuuuaaguggugugugucugacaugcaggcacucugugaagccagcuccuauugcuccccugaggucacaucugugagguggugcuucccgucagugagcaucucuugaugaguccauguuuguccucugcaggaucucauagaaaauguuguggcuguugcugagaacacagcugaugagcucgcccgcagugauggcagagacgugcagcuggaggaagacccagaccuacagcugccuuuucuucugccagaagauggcuauuccugugauguugucagaaacauuccaaaugguuuacaagaauuuuuagacccucugugccagagagguaaauacuacuugucacacuucaguuggagcuccaacuggguucaagugggcuuuguacugacucucuggauaacaggccugcagaauugugccagcucuccugaggaagcugugcuccuaugacuccagaagaguuucacugagauuaaagaucuugcauguccagacaugaccccauguggguguguugucucccuugacuuugugccugcucucuucccacacggugcuguaacaaagcaucuguaaccacaccuuucuccuggcauggagagcaguagaggaucccuggguucugagggauccagcccacugccagccacuggacugucaugggcaggucaccccuuaccuuagcuccuuccuuauaaaucagugcaagagcucagagaauuggacagguugccuuuagggggaggguucuguguagauucucaggccaccacaucaugcagacuucuaucagucucuagcuuuuccccaugaccuuugauagacugauuugcuggugucuaucaauuuuuuaaaaacacuguuuuucuuuaaagcauggcuuugaaacaaaccaaauuuuaauuguacccugcuacuuuuuuuuuuuuuuuuaugauauggagaauaacauaugaguuggaagauagucccaaaguacaggagucugaauaacagauaguaaggccaguaaaggugcuguggcuguagacaaauacaguaagugugauugucuuaccugacuucacucacuacaauaaauauguuuuauaucuucaaaagugcagugaacaaaagaucacuccauugaaaggcugucucuugucaugaauuguguugccgauaaagcaguuugugcuuuagucuuccuagcagguuugcuguucucagagacaagaagcccgaggucagggaagcagaggugaggucacugaagaaaacugugaaguuugaaggagcagguuuagaccugaaagguccucauccaugguacagguaaaccuguggucacauggugaggcuauagccaggcuuaaauagucucaaaugcucuagcuaucccucucuaauggaagaacuccagcccauggaaggccccuggucacagcauggggaacacaguaaagcuauuugacugcuugcuguggaguuccuuaaaggugucuuuucaugugcauguucucaggagaucagguugaaaccaugggcuuuaagcuaggcacaaucccucuauuguauccuuacccuggugucccagugcugggcuacuuuagguuuggcugggcuuucucauuccugccuguacucauugaggcauguuugaugcugagugcucagaaaggcuuuaauuaauauccuauaaauaaguaagccaggcgacuauagucuguuacgacuuuggaaguggacauaauuuauagugugccaguuuugucaugugugcuauagguauuugccagcauggaaacaccgagugcuuaaccggaugaagaucuuucuucauacuuuccccuaggcucucuuggauaagcagucuuaggccaugugauaccugauucuggucuuggcaucuguacauuguuucguacauguuugauguuuauaguucaugcagccuagcacacagaugccuuuaaagguguaaaguaggcugaguguuaugacaucaguguuuguuaauucuucacacucuuuucuuuguaagcugauuaaaggacuacuguguacugucagucccccuucacccccaguacaaagcaguucugggaaagacuauaaaaccagcccagacuaaggccugaguuaugaugaguaccucaagcuaugacaaaucaguucccaucagcaguauagugcagagcuuguuauggaaaccuggcauuugaaaacauaaaacauugcuuacaauuguugaaauucagauuuuuaauagaauuauaauucuuuaaaacuugaagaaaagcaaaaucugaacacauuucaaugaaacuuagauugaaacaauuuuaaaagugaaauuacauguuuuuuuuuuugcuuuaacuaauguucuuuauuccucccccaaaaauacaugucugauaacagcaguccacauuauauuacaauggugaagugcuagaccagggcagccucccuagggcagcugcacucagacaucagccauguccacaggagugugauccugagccacacuggcuauucaggacaagaagacggcagcagcccuguagcauaaucaaguucuggaaaccuugugugauaugguuuugucaaaaaagaacccugaggaauauaaaauaaaccuugacuaagugauggugacauggcuuugaauaugagucuuaguucuuuaaguauguccuuaauaaggcgucauaaauauuuuggugggaguaucagggguccagcuaaggaccuugcacauucuagauaaaguauucuacacuuagcuauaacagaaaaguaaggcaggaggaucaugaguuuucagccagucuaggcuacaaauauguuuaaagccccugucucagaaaacaacaaagcagaacucuccuuuucuuuucuuuucuuuucuuuucuuuucuuuucuuuucuuuucuuuucuuuucuuuucuuucuuuucucucuuucucucuuucucucuuucuuucuuuuuuuuauugaauauuuucuuuauuuacauuuuaaauguuauccccuuucccaguuucuccucuggaaacccccauuccauuuccccuccccuuccuucuaugaggguucucccccacccacccacccacucccaccuccucacccuggcauucccuuacacggggccucuccucccauugauguuugacaaggccaucugcuacauaugcggauggagccacgggucccuccauguggacucuuugguugguggucuagucccugggagcucagggcgggggacaggggggaggucugguugguugauauaguuguucuuauaggguuacaaaccccuucaguccuccacuggggacccugugcucaguccaaugguuggcuucgagcaucugccucuauauuugucaggcucuggcagagccucucaggaggcagcuguaucaggcuccugucagcaagcucuucuugacauccacaauagugucugcauuuggugauuguauaugggauggauccccaggugggacagucucuggauggccucuccuucaguuucugcuccacagucucuguaacucuuuccguggguauuuuguuccucuucuaagaaggacugacguaugcacacuuugguuuuccuucuucuugagcuucauauggucuguggguuggagagauggcucagccauuaaaggcuaggcucacaaccaaaauauaagaaauucaaguuaaaaaacuugugaguugaaaagucucugauccauacuuugucuccauauuuccucccaugaguauucuguucccuguucuaagaaggacugaagcauccacacuuuggucuuccuucuuucuugaguuucauguggucugugaauuguaucuuggcuauuuggagcuuuugggcuaauauccacuucucagugaguacauaccauguguguucuuuugugacugggucaccucacucaggauauuuucuaguugcauccauuugccuaagaauuucaugaagucauuguuuuuaauagcugaguauuauuccauuguguaaauguaccacauuuucuguaucuauuccucuguugaagggcaucugaguucuuuguagcuccuggcuauuauaaauaaggcugcuaugaacauuuguuaguaauuuuaacacauaugaaguuagaagaaauuggacaaaaugcugugagaauggacccucccaacuccaggauguucauuuuaaauggccuauagugugagaauuaaauucagaaugguguaguaaaccaauagccuguaccugugccauucucugguucucugugcuugucuuuugcuaaacaaguguguuguuguugguuuuccuuuaggguggaauguauaguucugcaagaacguaguuuacagaguagcucacuaauuuucauaguaaaagagaaauaguucuuuggugugcacagaagaggaaacccagcaacuuuuuguuauuguugcuuaaauccugauggaucgaucaaucagguacauggcuuuaaacagguuucagagggaauaaagguauagacugugaaaaugaguguucacuaagguaguaagccuucagaaacaugugguguccuaucccuguaaaucccagcacgugagaagcugaggcagaagcaugguuccagacaauccucagauucauagugagaccuuaucacaaaauaaccacccuggugcuuaacauaaagcacugcucugucuuguuuuccuuguugaaaauuguaugugaucagguaugccuuacccauuuucuaauuacuauuuucuuuuuaggauuuuguagauugguuccucacacacguucaccagguaccuggacaauauauuuugaaggagcagauuaugaaagucaccuuaugcgugagaacgcagaacuggcaaguauugagguuuggauggauuagagcaucagauauguuucuaaugaguugaagaugugagauaucauuaauccucugcuuacacugaauguuacgauggaaauuuaaaaugauuuucuuauaccagauagauucaaacauuuuaaaaccuugcuuuguaaaaauacauaugcuugcuccaggucugcacaguuguguuauaauaaugguucuuuagaaguaaagaguauuuaugcucacaguuauggcacacacacgaaacauguaguguaguaacuuugaaagauauuauuagaaaacuauuuuucaguugcaaaaguaauuuuuuucuacucauuucugccuuaucuuaaauguauaucauaacucacuauuuugagauaguaaggaguuuccucuaucuuaagaaaaauuauacuuugcuucaaauacauaguuucaaaauggauacuuuuuuauauauuaaauucagaguaguaauuauggcuucuugcauacuuuaaauuugaacaugcaucagaacuguguccuaaaauugaguuaauagaugauguuauaccaaauguauggcucagaacuaacagugaccauuccuuuuucuugacuuccuauguuuauuuuuggucagauucgaaguaacaacaacagcagcugaugaccagaucuuaacaggaagauaagcacuucuuggacucaaugcuugcucauugagauagauuucaauuguugguuuauauaaaccaacugucuugcugucacaugacucuguuuucucccaguccuccgugggcuauaccuuagcuugccuuuguuuaaauaccaccuucuguaauauauaucuuaagaguuaaguuuucaucagcacguacucaguguucauuuugcuuuuuaacuguucacauuuugguuugaaguuuggggccugaguguaaugugacuuaaauaauguuuuccuuaaaaaaacaaacaaaaaaacaaaacaaaaagcaccaacaagcuuucuuuggcugugucuaagcuuuggcugcucuguggcuacacugcguucagucucuuuguacugagugcccagugcagggugcauuucuugguagaguacuaggaauacuugcaacgcauccuauaguuccuuuauggucaucauuuuaaauagaaugacucucaguuucucaagagacaaagauauuaguucaucucuguuacagccauuuucugcuagcuucccagacaauaugcaauaauucuaaacuuuuuucaguagagaacaaaacaaaagcuuagugguuauauuuaaaagaucauuaagauaaaaauuggauuuuauuuuuauguuuguuuucuaaccugauaguaagagagguuuaauuuuguuucauauauuaaauacuuaauauuuaaauggcauuuguaacuaagacucaccuucuagacuauaaucaaaugauucaguauuuuguuuaccaaaugaaaagaaccugugugacuagagaguuggcucagugguuaagagcacuggcugcucuuccagagguccugaguuuaguucccagcagccacaugguggcucacaagcaucuguaaugggaucugaugcccucuucuggugugucugaagacagcuacagaauacuuauaaauaaaauaaacaaaucuuuuuaaaaagaaaaguaccugagacaguggacccuuuaugcccuuucccauucucggugauaacaaauaacuuccuuuccaaccauguaaaagcaguucguguuagucauaaaguaagccucuucugucaucuuaggcccagccucugaggaaggagccugagauaaucacugugacucugaagaagcagaauggaaugggccucagcaucguugcagccaagguaggacugaaggagcacaggagcaucuuuccuaucugagaccauugaaggaugaucucugugugagagucuggauagaguaaauaguaccuugagaugggauagauagauagucucagaggaaguaguguaaaggcauggucaagacuugguagucacagugagaaaagcaaauaugggcacaagagaacaauugcaccugucacuuuauaauaucagauaacagcacuuuucaacuccguguuugacaucagggggaccuaauaacaccaccauuccaaucucaaggcauuuucuacuagaggauggauuggagcuuaaauucagcuguguauccauugaaggcauugucagcuuccucaccuuccuuguucucuuggcauauaagucccuucaccuauuaguuugcuaaagaaaaauuauuuuuuuccuggugcugguauuuuauuucuuuguguacguuaggucaugaauucguauggaaugggcuccaacagcucaggcucuuuuccguuaguccucacaaagugugcuucucuggguggcgcaggcuggcgcuucagcugcacccaggugcccucuccuuggcuuccuuuuucuucuggucguucuccuucaccgcuucaggaagcugucucugcucuucgagugcuugaugugcucaauccgcacauugauccucuuggccagaauuuugcccuuaaccugcuuguugacaaugaugcccacagcaugcugggugacauuguagacucuuccgguuuugccgugguagcacuuauggggcauuccuuuuugaacagugcccauucccuugaugucuacaauaucaccuuucuuguagauucgcauauacguggccaaaggaacaaugccauguuuccuaaaaggccuagagaacauguaccgggugccucuccucuuucccuuuguguucgucauuuuggcgaguuacuggaagauggcugcggcggccgaaaaagcaagauuuucuuucuuucagugaaaagaaauuaguaguaugaauagaagguuuuuuuuagcaaaagcuuccacaaucauagucauauacuuucaguagaacaaauguuuuugcauaugguuuucagcauuccccucuccauuacuguuuccucgugucuucuucacccuacucugacugguucucuuccuuaaauucucuccacuguacuuucauaucacauagguuauuaccuucucuuuucuaaauagguguuuuagcuaauauuuaauaagauacuuuguugagcuguaguaauauuuugccuaaaauaauacuuugucagcagaaguuguuaccuuugucuuauucccagagaguauuugagaagcuugcaaacaccauauggcauuaugaaaaaagaacaucccaaaugucaugauauaguacauucugagaaauauuuuaaauuggugcuugucauuucgguacaucagaauaguauuaugaugaauauuaauuggaaauugauauucgaagcuucaucuuguguauuuuuaaaggcugcauuaaguccccuacucuggcccacugauuugcauaugguacacauggccugagauguagggcuggauugugaggccagcauugcuccauucgggaggaugagcagcuuaccaaagucauggcucuuggcugggaguagauuguaagcacguguuuguuauuccuucuuuuuggaucuuuguccuucuugcuuauuuuaaaaaagagacauguugguccaugcuuguaaucccagcuuuuagcaggcaggaucaggaagauggagagucuagacuagccuagccugggauauauagcacaauccugucucaaaaaaaacaagacacagcaaaaaaacauaaaacacauaguugauauccugcaccuuccagcauuuuacuagcaacuuccuguccugagcuugucauugagccaagccagauccuugugugauuucuaguccuccccagcacuggaguuugaugguuaggaguuggcuugcauugucauugauaaacaaccaacauauuucucucuagugcuguuugcuaaguuagcugcuggaaugugauagacaaaauuacuuguuagcaaaaauaagaacuuuuuuuuuuaacuuuuaaaguaugcuugucuuaguuuucuuucugcugcugugauaaggacuaugagcaaugccagcuuguagaggcagucugucauuaagguaaggaaccuggacgcaggaacugagccagaaacuguggaggaauacugguuauugacuucuuuucagugcucacucauauuguuuucuuauaccacucagcaccaccagccugaggcaguaauacccacaaugggcuggguauuuccgcauuaaugaagagaauccuccacagacauaaccacaggccagacucagagagacaguucuuaaauugaaauucccucuuuuuaagugacuuuagauugugucaaguugauaaagacuacuaacacaaugagccacucauuuauuucauuaacuuagucagugugcuaaauugucaacuguauuacaauaguguuagaugaauuuacuguaaagaaacuuguuguucauaguguuaaacauaccacgauauauuguggauacugugaaacuguauuugaacuuuuuaaaaguuaagaaauaaauagauuaaugagcgugaaaguagucauccaaacauugugggauauuagcugauuuuuggaauuaagaaauuggaaagauggcccagcagagguauguuauagguagaagugaaaacauggcaggggagaaccaaccaguauuguguaccauauuugagcagucugcaucuccaaggagaccagagaaguuagggagagcugugcuaugcaggguuacaguuguggacucacagggggaggagucuuguugccuuguuggcagcacaacaaaaugacaggcuuggagaaggauagaaggugauguccgagacaugguggcaugcugagcagaaggcuagggucuuuagacaagucuguuuaggacuagacuggaugaaccugugguggggaauguugcuugucucucucaagcucaagucuguggaaucaccugugauagagcaaagaucuggagccucugauccuacuuuauaguucaaaaauuccugcucaccucaugugguccagaucacaaaauaaacuucuagacuguuaucauaugcuugacccaagcucagaacauuugaaaacaugaaaggaacaugucagccaugggacauuuuccuucuuaguuacagcugaauuacugcccauuuuuagggggaacuagaaguucaagggcggucugccacacuuagauaugcagagaagacucaacuccugaggugggguaccucaacucaguggugacauacccacucagcauuuggcaagcucugcgcugggucuuguauacuacaaaggaaaacaaaacagagaagccuuaaguucuauauuuccuguuguagacaugaucuuuucaccugauacugggcugcuagagaguggcuguuauucccaguugaaaaagccuuacagugcauuucuguagacucugucugacuuauguuugaucuccuggggugcugucuugaugcuaaggaccuugcguucugucauaugaugcucaaggucggucuugcauccuuguccacucuugguuccucugccagguaucauguggagaaguagggcaucaagccaagcucagagucguaguccagccuguguucccugaaaccugauuuacaagaacaggcguauuaguuccucucugagauucaaccuugugaaggugcaucuugucaaaacuguacguuuuaguguaagugagagagggcuuugacuaggguauaguaugauaacuguuauguugugugggguggggauuguaggcuuugaugauaagcuuuuguugucaccauggcuggauuuagaaucaccaggagacacccagaccccuuuguguugucugaggauguuuucagagauugaacugagaagggaagacccaugucuguggccaaauuguccuauugacuggguuccuagacuugaacaaggaaggaaagggauggagccagcugagcaccagcauuugucccccuuugcuucuuaacuguggauucagugugaccaggccccucuucuucucgcugccacagcuuuucaacagugaugauggacuuaaccgccucaaaccaugagacacgaacaaaaacuaucuuuuaaguugcuuuuaucauuuuuuguuuguuuuuauuguuguuguuuugaguuuuuggcuuuucuuuuuauagcaggagaaaaguagcuaauucacaggguuucugcacucauuuugcaaugaaagauccuaguagcagagguggcagagguaaucaguagcagaaauguaccagacccuugugagggaauguguuaucuccugccuugaugaguggcagguaguuccuuggucauggucaguggugguagauacuugcugcauggcagugcucagaugggaugaauugaggggagaaacagagaaucugguucugacuugagccgcuggguccugaaggcaaaacugucagaaaaagaacaggcagaaguugguggagguuaauuguaaguucaggauugaauaugucacacuugaaauuuugggauccugguaagauaaacuaauguguuuucuagcaggggauuggaaaauggagcucaaaaaguuagagccagagauaaaauuuaggaauugguaauugggcacucugaaugaaauaacuaaaaauacuuuguaaacuggacagugugccauuuuuaauauaugaauaauaguaucccuaacaucuguuuucuggacgacacagguaaauagcguuucacugugccuauuccacucuguaugugucauguuuauaguauaggaaggaaggcucagccaaagaaagcacaggucgccuuggguggacagcugcuggacagcacagcacaggugagaaguguuuaggucuauauagauaauagugaugaccucugguacauguugggauggucagcccugucuccugcuuagcuacuuguaggcugcccucggccugagggcucugcaggccuaugggcuugucugucucugugccuuuaagacuuagugaugauuguguucccucaugauugaguaagaagccaucaaaaacacuggcaguagcugcuuauuccauguagcucuuacuuccacccagcccacuguauuuuccugucaccccaaaccuuucuguuguuugcugcaaauuugagugucuaacucaggccucuucccuuuuuuaauugcugcaugucucuguugcuguaacccagaaccguguuuugauauuaaguucuucuccuugcccuccacauggugguuaaacauuaugaaauccagaugauuuggaagcgauguggguuugcaguuuacuuuuggagacauugcuuuuggagaguucagcaugcuacuucuuacucgucugugggauagcaccgugccgacgcuuccuguuuaauuuggauuuuuaaaauacaaacaauucccguucauuuuuauaacccuuuaaaguuuaguaaaggacgaagggaaugaaaaucugaguggcuggguugcauaagaaccugaguguugcguugguuccaguuccuguugauaaaugccauacagugucacagcacccagucggcauuguggccagccagucccgaaaagccagcugugcugcuugcugugggaacugagagaaguagacaacuagucuccagcucgaggcuguuguccuggagauaacaugugguucucuguugucggaagggcagaaucaguggugaguuucuucaggguguuguccugaauguucuugugcaaacugauccuuaaagaaugcuuccuccugcacucuggcuuguucaaaccuguuaauaauuaacuugcucaucuagagugaggcuuguaacguagcuuguaauuacauacccagauuguuguuguucucuguuuauguugcaaauauuuaagguucauaaaaaugugaaguucuuaugauauuuuuuuauucaggaaaaaaaaaacccauaagauuuagcccuacuaguuauaauaugguagaaauggcuuuaaaugguaacugccguuguauaauuugcaaaagcagacauagucaggugcucauaacuuucggcuacauuugauagcuucagaguagacuuucuccacagcuuuuugaugugcuguucuuuuuuaaaacaugaaaauaucaacuuauaguuuaaauauauuaaaauauuuacuacuguguuuauuuuuacuacuauauauuacagcauauuuuuacuauauauugcaauauuuuuuuaagaaacaauuggcuaauuacugcuuuuuacuacuauauauuacagcauauuuuuacuauauauugcaauauuuuuuuaagaaacaauuggcuaauuacugccuuaaugauguuacaguuaguucuuuuaaacuaaauacccgaguuuuaaguuuuuaaaucuuagauuaaaucauaagguuccuguacuggcugguucugugucaacuugacacagcuggaguuaucacagagaaaggagcuuuugaugcagguuagcuggagcuaagcaauuagcggugauuaagaagagaccagcaucguugaggugacaucuucugagaaguguuuucugaaagcacaaagaggcuguguuccaaagauagucaagguuguacuccugcugcagcgggacuuguuaauguguaagggucacccaggugguacugguuuuggagaugccaguaccaugagaugaccaccaagagcagcagcagcaguggaguacaggcaucuggagccuagaggacaacgcgugugcuacaaagggccuggcuggagaagugaccuaagcccuuggaggagcccagaagaucaugaguuggaucccagacauuggacgguuggagauugauuuuugcuuuugauugugacugugcccugauauuuucccucuugaaggaagaaauuauuuuagugaagcccacagauaagagauuuuuaauucuaaaaagacuuuggauuuuaaaagagauggguauuuuaaagagauugaaauuuuaagaauauguaaagacugugggacuuuuaaaguuauuuagaucuuggggaugaauaagaauguaaggguugaggcuuacuagugauguguuugugugucaaguugacaaggggucaauuguacuggcuaguuuugugucaacuugacacagcuggaguuaucacagagaaaggagcuucaguugaggaaauaccuccaugagauccagcuguaaggcauuuucucaauuagugaucaagagaggaaguccccuugugggugggaccaucucuggacugguagucuuggguucuauaagagagcaggcugagcaagccagaggaagcaagccaguaaggaacaucccuccauggccucugcaucagcuccugcuuccugaccugcuugaguuccaguccuaacuuccuuagugaugaacagcaguauggaaguguaagccuaauaaacccuuuccuccccaacuugcuucuuggucaugauguuugugcaggaauagaaacccugacuaaguuccuaugcuuuaaaaaagagacaacaaaguguuagugcugccuucgcuugaagagguuacaauuuaggccucugaugcauuugagaccuuccuguuggguucuuuaaugguccgauaacccuuccugguaagaaccugguuaaagaaguaaacucaggauuuugguucccuuuaaagccuagcuggagagcuggcucuagagugagagcacagaggauuuuccagaggacccaaguugcuccuauuacccaggucagacagcucauagcugcuucuguguccaagagacccacugccaucuucaggacucuggaagauggaugcacacauacagcaccuuacacacacacacacacacacacacacacaccuaccuacacaugaauacaaauaaaauaauguuuaaaaaauuauuuuuguuccaaaggaccuuauguggguggaaaaugucuucugcagaggugccaaaaguaucuuucucuuguuauaugaaauagcauagcgccuuuuguggcuaugguuuaugaguuuguaauauuauuauguauguuuuugcuaaaagggaaauagugaauuacaugaaaggguaauuuuucaggguuauuaccuuaauauuuauuucuggaauugauugaaauauugaauuccauuggaguacuaauuacacaaauuguuaguccucuuaagauuuuuuuguuuguuuguuuuuauuggauauuuucuuuauuuacauuucaaauauuauucccucuuccuggaaaccccuuaucccauccucccucccccugcuucuaugaauguguuccuccacccacccacuccuaccuccccgccuuagauucuccuacacugaggggggucaucuauugagccuucauuggaccaaggaccucuccucccauugaugccugacaaagacauccucugcuacauuugcagcuggagccauguguauuccuugguuguuggcuuacuccccaggagcucugggguguguacuccuauuuggggugugucuggccuauuuacaauguugcucccucaguggggcugcaaacccccucagcuccuucagucccuucuccaacucccccuucagggacccugcacucaguccaaugguuggcugcgagcuuccuccucuguauguguuaggcucuggucuccuuucaggagauggccauaucaggcuucuuauuagcaagcacuuccuggccucuacaauaacauccagguuugguggcuguauaugggauggauccccagguagggcagucucuggauggccuuuccgucagucucugcuccauacuuugucuccauauuuccuccugugaguauuuuauucacccuucuaaaaaucacugaagcauccacauuuugguauuccuucuucuuaggugucauauggucugugaauuaaaucuuggguauuccgaacuuuugggcuaauaccuacuuaucagugaguguauaccguauuuguuccuuuaugacugagucaccucacucaggaugauauucucaaguuccauccauuugccugugaauuucaugaaguuguuguuuuuaauaauugaguaguacuccauuguguaaauguaccacauuuucuguauccauuccucuguugagggacaucuggguugcuuccagcuucuggcuauuauaaauauggcugcugugaacauaguggagaauguguccuuauuacauguuggagcauuuucuggauauaugcccagaaguucuauagcugggucuucagguauaugcccaauuuucugaggaaccaccagacugauuuccaaagugguuguaccagcuugcaaucccaccagcaauggaggaguguuccucuuucuccacauucucaccagcaucuguugucaccugaauuuuucaucuugguuauuuugacugguaugagguggaaucucagggccguuuugacuugcauuucucugaucacuaaggauguugaacauuucuuuagguguuucugagcccuuugaguuuccucaguugggaauucuuuguuuagcucuguuccucauuuuuuaauaggguuauuuaguucucuggagucuaccuucuugaguucuuuacauauauuguauauuaguccucuguuggauguaggauugcuaaagaucuuuucccagucuguugguugccauuuuguccuauugacaguguccuuugccuuacagaagcuuugcaauuuuaugaggucccacuuguugauucuuggucuuagagccuggaccauugguguucuguucagaacuuuuccccacuuucucuucuauuagauucaguguaucugguuuuauaugaagguucuugauccacuuggacuugagcuuuguauagggagauaagaauguugaaccagcaccauuuguugaaaaugcuguuuuuuuuuuuuucccccaguggaugguuuuagcuucuuugucaaauaucaagugaccauagguguguggauucauuucugggucuucaauucuauucuauugauccaccugucugucgcucuaccaguaccaugcaguuuuuaucauaauugcucuguaguacagcuugagguccaggauggugauucccccagaaguucuuuuauuuuuuagaauauuuuuuguuauccuguuuuuuguuuguuuguuuuuguuauuccagaugaauuugagaauugcccuuucuaacucuaugaagaauugaguuggaguuuugaugaggauugcauugaaucuguagauugcuuuuggcaacauggccauuuuuacuauguuaauccugccaauuuacgagcaugggagaucuuucuaucuucugaggucuucuucaauuucuuucuucagagacuugaaguucuugucauacagaucuuucacuugcuugguuagagucauaccaaaauacuuuauauuguuugugacuauugugaagggugucguuucccuaauuucuuucucagccuguuuauccuuugaguagaggaagguuacugauuuguuugaguucauuuuauauccagccacauugcugaaguuguuuaucagcuguagugugggaagccacaugugucguuguaggguggcgcugguuacuaugggccaccacgcguacauaggcaguaaaguuuuguuuuuuuuuuccccacacuguaggaguucucugguggaguuuuuggggucauuuaauuauaugaucauaucaucugcaaauagugauauuuugacuucuuccuuuccaauuuguaucccuuugacguccuuuuguugucuuaaaugcucuagcuagaacuuccaguacuauauugaauagauagggagagaggggacagccuugucuagucccugauuuuaaugggauugcuuuaaguuucuccucauuuacuuugcuguuggcuacugauuugcuguauauugcuuuuacuauguuuagguaugggccuugaauuccugaucuuuccaagacuuuuaccaugaagggguguuggauguugucaaaugcuuuuuuagcaucuaaugagauuaucaugugcuuuuguuuuguuuuguuuuguuuuguuuuuuccuuugcguuuguuuaugaaguggauuacauugauggauuucuguaaauugaaccaucucugcaucccuggggugaaaccuacuugauacuugugaaugaucauuuugauguguucuugaauuugguuggcaagaauuuuauugaguauuuuugcaucgauauucauaaggggaauuggucugaaguucucuuuuuuuguugggucuuugugugguuuugcuaucagcauaauuguggcuucauagaaugaauuggguaguguuccuucuguuucuauauuguggaauaguuugaagaguauugguauuaggucuucuuagaaagucuaauagaauucugcacuaaacccaucugguccugggcuuuuuuuugguugggaaaauuuuaaagacugcuucuauuucuuuagggguuaugggacuguuuagaugguuuaucugacccugauuuaacuuugguauuugguauuugucuagaaaauugugcauuucauccagauuuuccaguuguguugaguauauaggcuuuuuguaguaggaucugaugauuuuuuugaauuuccucaguuucuguuguuauaucucccuuuucauuucugauuuuagaaccuuuuuuuuuuuuuccuguguagugacauagaaacagacaccgccuaccucacacuucacccucauuuaaggccuagggauccaggugugugcauacucuguagucauacauuauguggcuucugggaguucugcguaauuucuucuguugaauuaucuccuccuacauugcauacugacuugagagguuggugggccaaauguauucugugaaucucaguucagaaucuccuggcuguguugucuccuauauuucagagagacagaaaagauggauggugugguaaauauuuguuguguuggugguguuguuaaagguaaaggaaugcagcugaggguagaauucaguuacuuuaccaaccugucuguuggaauaacauuaauuugagaauugcuguaagugaaacuuauuugaauaaaccauuuuagaaccaauuuaaaaauuaagguagaaagauauuuaagaguuuuuuaagaaccacuugagcuuugauagcuuguugucuggaaagagcaacugaacugaaagguaugaggacagugccagugacagacuuaccuaaggcaugagaguuucaucugggcugcucucgcucuuaggucaugcagcccacaauuguuuggagcuccaucugaggaguccaggcugggccuccacccuagaacaauggccuaagcccaguggugcuuggcagacaccucuucuucccucccacccccacccccccuuggcuuguguuuaaugauguuuuuaugcuguuacugaggcauacucccacacacuccauuugcagccaagcugucuggagcacaggcuccuugugguagugacucucuguugaagaaccccuccagccucugagaacagaacagagaggcagccuucucucugggugucaauucuccagaggcugaggcagcuuagagguuuguaugauuguccuuucucuagacucgggggacacuagccuucuguuuucuuaucuuguuuauuuuuauuuuucuuuccuaccuuuuuauagguaacguucagauaguuaucuucuuuccucccuuguuaguccagcucccucaccccacuuuccucuuaaacagaagagaaguauccaccuguagggugcaguuugaagguuaggguguugagugguaugaguguaaggagggguccagaucucugccuucucugggcaucaccugcucacuugcuuccuaggcacucucuaagaaaggcacagagcagaccugaugugagcguugugcuguggauauggaucucaggugcuuccaggagggaaaaaaauggguuuuaugccuuuuauuuaaguuugcucaaauaaauuucagaacuaguucugcaugguguauuuggaaauguguaacuguuuucugaaagaucucuuuuaauucaagggauugacuuacgaaaugagaaaugagaaguucuuaguaguuauguuuaaucuuuuaauuucacaacuaaguugaacauuuuaggugccuuuagauaaaugcuuuuuuuaaaaaauacuuagacuguaaauauuuaucuagauauuauucucauuuuuggcaaucaggguauguaauauuaauauauguguuacaauaagaugcuauuuugacaguuuugugcauaauuaugaauuuauuguuaguaauguugaugacgaauaaacuacaauacaugccauaaaauucuucuuucuuaaagaggugcuauucaccaaaauacugugugucacauggguaacuuaaauauuuucaaaauguugccuuaauacauaauuagcauaaaagaguaaugagauguuuuccguucuuuuuucauacucugccuuugaagucaagagauuucuuugugaaugagccacauuuugaguacuguguaguuacauguggcccagugacugugguacuggacagcaggguugguuguaagugguccaguaccuuucaucuggugccucaaacuguuguucuaugcucuacugcuggcuuuuagagagugcuuaaagugaccgugguuagugguugaaaugccguacgcugacguacaguaucaauuaagagauaacuucuagacucuauuuuucuuuaacuaggaaaugaguagaacuauaauaaaauguuuuaguuauugucugugugcaggugcuuugucuacauguauguauguauguauguauguauguauguauguauaccacauguuugcuuggugcccaaggagguccucaggggugucacauccccugggacuugaguuaaagugagcuaccauguugaugcugggaaccauaccaggcuucucugcaagagcaauaaguguucuuaacugcuguacucucucucuaguuccuagaauuugauuguauguaguucuucuuuaaaucuuagacuaauuaacauguugcuaucauaaaggagagagagaguucugaaaagccuaaggaauuucuguggugcagcagauggcaguuuuucuaggaaaagguagggggcuccucauguacuguaauugaaaggccaucucacuuacacaaaagcuguaaggcaggguauuacuccuacuuucuucaggggagcaaugaaaaucccauaugaacauagaagauagcaccucuucugggagaacaggacagaagcuugguugguaagucuagagacugacuguuggaggccuauggcaaagaccacaguccaguugacaauggugugcugggaaguuauaccugaacaucgggaaggagaaagugugugcugugaagguagcaggcagguagugauauauggugugguauucacauaugcucuacaacaggauauuuaucuaguuaggagccauguagagaucuaagcagaugagacagccaccacugccucuuuuugccagaauguuucugaugcugaagauguauccguggcuacuuuaagauucauaacaacaccauuaaauacuuaacacauggucaguuuugcuugaauauuuaaguuuguauuuauuuaauuuuacauuguauaugcacaugugugguaaauuacccaacuugaaauacccaggauuugaaauuauuuaaauaacugcuuacaguuuauauuacaucuucagcaugagcuuauggaguaggugucucgaauguagaguagcuuugagugaaggacccuaacaguuguuugaggagagugagcacugaagacagugaagugguuaggacaguucugcaggaagcagccauaguggcagugagcucaagguggcaggcugugugcugcuagucuccugcaggcagcagcaguguguucaggagggccagguuggcugcuucuauuucaugucaguucacuucgugauuuuaaaaaguguucuuauuguagagugucaagugagagauagauuauuuugggguuuauuaauaauauucugaaacauaccagaaaugacacagaaucgauuuauuguucuaaaauuuauacuugguguugcucauagcagugcuccuaaaauauguuaguuauuauugcuaaauguuuuucuugcuagagaugacgguaguugguucuuauuaaaaggauagacuuuuauaacuuaaaugguaaggucaggggcugggacagggacucagcaguuaagaaguauguacugcuccuucagaggccccgaguucaguucccagcacccaaguggugagggcagcucaaaaccaccaguaacuuuagcuccaggggucucugugggugugcuguagaaauauacacaugcauguaauuagacauaaaacuuaaauuauaaggccuguguugcauuaccaaaagcugccauguggaaauguaacucuuguucauacuaugagcagugcugcucuggcauuuaguaacuauugcuuuucugacagucagcaggaaguggacagaauugaacuuggagaggaggaaugggggaugggaaugaauguuagugcagccugguaucccagccagaagggaaucagucaugcagcucuccuggagaaaagagaggacuuggcaccagagcucauauucaaagacauuaggacaucaugggugcaucauggaaguucacugaagaauugaaugauuuaaaagcugaguuguggaauuaaauagaucuauaaaaaauaaaucuaugcaaucaauaauauaaaguuaugaaauauauuccagccugauugaucagaauuauaaauuuccagucuagcacaugguuacugaggggaacugugauuucaaggucauuuccaaucgucuauaucaaguguuuugacucaaggaaacugguauugccauagaugaaaugagguaaaggcauauuuauuucucuuuugccaaguuacuugacaaaguucaaaaaguuagugagugugcuuuuuuuuuuuuuuguuccacucagguacuuuguauauuuuucuaacuuauuuaaauauuuauacauguauacaguaaaauauagucacauccucccuuacuucucuccuccaacuucuaauagauuccugucagaaugcccccucucuagcacuggucugacuugcuauguaaaucagauuagccuagaacucacagagguccacgugcaucuguuuccuaggugcuaggauaaaaagccugcaccaccauacaaccccauguauauguuuguguguguauaugugcaugugugugugugugugcauguguguguguguguguguguguguaucacauuaagcccuauuagugcuacucauauaugcauacagugugugcagccauucacuggagaaugggaaaccuaccauuggccauacccuuaaagaagaaugauuuucuauuagcugcuguuaacugcagcuccucauuaggggcaggggcuuauaagcuuuucucccauccaugcuggaauuguaucuggcuucaucuggcucagguaacugcagcugcucuguguggaugugauggccuuguaucauucagacaucaugggugcgauggucauguccaucuauacaucauggaugugaugguagugucacauccagacgccacagaugugguggccaugucaugcccagacuucacaaugugauggcugugucacaucuggagcagcauuucgcagcacuucuccccauccuccagcccuuucuacaagguuugagaaagauguaccauuugggacugagcaguccuccaucacuuacccucagcacuugaccaauugugaguguuuucaccgacugcugaccacugcaugaagaaacuucuuggaccaagaucgggauaacaagucucuggguauaauaagcacgugcuuggaagggaaacggaggucacagccaucuaguaaaauaacaggagguucucaaguaggaucucuaugaacucucagcaaugggcuucugacgagucacuaaauuuccuccuguggagcagauugcagauauagucagaaaguacuuaguuaccucagucacaggcaugucacuguugcugcauuuggcacaucuuuuuuggcaagucuguauucuagcaagccagaguccagcacuaaauaagaccauaggcgugguuucucccccagcaagcagccuguauuguacucucugacacuaugaacagggaagaaauuucuuccuuugguuugagauuaauuuuuauccuguaagcaaaguuugguaguuguagucguugcaucugacuuuugucguuauggugaugacuaagagcaaugccaauagccugugucauucuggagacuucuggacccuccugcuguggaaauuucucccaugccugcccugcacuuuuauuuacccauguugucuagggauggccuaaugcaucaugcagaaaaccucuguucaaaccccuuuauggucaucaucacuguuacauguagaaguuagcuuucuuaccuguggguuuccauaagaccuuucauaaucccgaguuuugauuaacacauaccuuucucucccccauuuccucacccugccccuguuuaacccuuuaacacauuucauaacacauguguucuucuacuaucuccuccaguuagauuuuuauauuggauugcaauuuaguaacuuuccaucuggcuugauuccccccaucucccuauugccuccagacuuccaguuuccuucuuuauuuaccuuucuuuuauuuccuuuggcacugccagcuauucaagaugugguuuuguggcuguuguuaaguguugacaguaccaaguggccuuacaguugagagcccagggcugguaagagacuugcaguaugguacacgggagggaguauagacagacacaggaggagacuggcaacauacuggacaaccuucauccuucaucuuaggguaaaagagcuuuacauggagaagcacucagucuuucuuaguuucuagcuguucagagucugcaugacaugcagacaaaugccacagccacaucugucacuacucaguuaacauauacuaauaaaauguuacgcuguuuucaaauuuuuauauauauuuguauauguaugauaacauauacuguuuuauaauuauaauauauauaguauaauuucuauuguuauaaauguauauacauacuacuuuauaagacacauaauuuuauauauauaaacauacacacaaaacacagguucuauuccugugaaacaguaacauacugcauaacugaugacugccuuccugucccuacucccuacuguagggagaaaaaagggagccagucucaccagugaaaacuguaaacuaaaaugcuagcuaauagaggaaauauggaugguuugcacaucuuccagauuauuacuuugaaaaacuuaucuuaauauacugaaauuucuuuuaauaauacauuauuauaugauauaauaucucaaaguuauuaagggaacuuaauuuuauuguugguacaaaaguauauauacucaguugugcuacuuccaguaauauccaaguaagguuucaugcacaugacuguauguguuuuguuguuauauuaugaucuccaaguagaguauugaugaucuugaaacuauguaugauaccuaagguuucucaaagauuucauuaguuuuccauagaaugcuaauguaauuguguaugaaucuuaaguuacagaguaucaauuacaauauaguauuuucuggguaauguuuucuuacaaaacccucuuaacuggcugcuacaagaaguuauuuucuuguuuugaaauguaaaccauauguuuaaagagugaggcuagagaaggcagauacuggauggauuauauaguaccacagcugauuuacuggccugcucggguuaagggccagucacuugaagaguuucucauucauuuggaauuguagcuguuuuagacuuuauaaauaaucauuuugaguauuccaagacuaugggcauauuuuugucaaauuauccaguuuuacaggaguauuuuucuuauaaguuuggaaccauaaaauagaaauauuccuaaccugucaaguuaccaauguguaugugggcaggauuuuguucauuuccugcuuugugauuucauuguguuguucuggccuuauuuuugcauagggugcuggccaggauaaacugggaaucuacguuaagucgguugucaaaggaggugcugcagauguggugaguauuugauuuuuuguuuguuuguuuuguuuuuguuuuuuuucgagacaggguuucucuauguagccuuggcuguccuggaacucacuuuguagaccagcuuggccucaaacucagagauccgccugccucugccucccaagugcuggaauuaaaggcgugcgccaccacgcccagcgacuauuuguuuuaaaggaaacugugaagggcauuaugcgcuccagcuuugugaaauacugugcagaugcuuauagcuguggaugcuguauggugaagaaugcugcuguucauugacuguggugggaagacugaugcgcgcugaccauguggugugaagaaugcuggugugcacuggcuguggugugaaaaacacugcuguguacugacuguggugugaaguacacagcugugcacugacuggugugaaaaaugcugcugugcacugauacuaccucuuuuucuuuucucucuacacuuucaucucucugguggcucaggauggacgauuagcugcuggugaccaacuccucaguguggauggacgaagucugguuggacuuucucaggaaagguaugacuaauugguuaguguuaaaguuagucuuaguguauugaagugauauuuuacauuuaauuuugaaauuuguauucaaaaaguagugcuauaaaguccuuuaugcucugugaguacaccuucaccuauaauccuaguucuuagagcacauaaaucucauuuucuguucacucauauguguuuuaguauagagcauuucuuuaaguaauucuauaaauaugugcacauauacuuaaaacuugugaaaucuuuaaauauaucuuaaugguauagcauagaacauauuuaaauguuuuuauaauuaacuuucaacugugaugugaacaggagauuaucuuucugaaagccaggcuaauuucuccaacagcagucaggcugaggaacaagaguucugaacacagacugucaucugacacugagcgcucaguuucuuuauacuuauauuuucuuccuagggcagcagaacucaugacaagaaccaguuccgugguuacacuggaaguugcaaagcaaggugccaucuaucacggccuggccacccuccuuaaccagccgucccccaugaugcaaagaaguaagaacuaggaacucaagccaggauagcuauccuaugcugauucuaugcuggaaugugacuucucuugaaaguuaucaaaagcuggggcuggaaagaugguucaguacuucacagcacuuauguuagcugacaacugucuguaauucccauuucaggggauucaaugcucucuucuaacuucuuugagcaccaguaaggcaugcacuuguacacauacuguaaaaacacucauacacacuaaauaaauuauuuuuaaaaagagagucaucaaaaucccauguagaaguugcuacuacagcuguuuuccagcucuaccagugaaaaguuaguugagaacgagugaagaaugcugagaaauacuacucgguuucuauucagaucgucccuaauggggcagcuugcuagauauauuaaaagucuguuagguguagucuucugagcccuccucgccccugagucagccuugaauccuguacacccuagcaccugaccuuuguaaccacagucccaacaacaacaacaaugucugacagccuagaaucccguuuacuaaagcauagaaacgccagagcauggugguaagaccauguguuagcaugguagaacaucauuuagaaaagagggaagugguuaaugaaugagucccaggugaacagaugaaaagacuaaacuauggacaugcaugguuaaucacaccaggugacagcagucugauggauauuaauauguguguuaucaagugagagaaguguaguaccuuugagggcuuauuaaaaauuacucuuuaaauaguuacuuuguuauuuacaaauuacaguucaauuguugagaaaauaaugucaauuucucccauagauacauaccaaguaaaugaaaaauuuucuagacccaauauauuuaaaagcuuuugaaaauguucauauaaagccauuugugguggcauguaccuuuaaugccagcacugaggaugcggaaggaugcagcuuucugugaauuugggguggccuggccuauguaguaaauuccagaccaaccacgaguaucuagugccuggauuuuguuuuguucuacuugcuugcuuguuuuugguuuuuaagcuagucaaagaauguauaugaaaaucacccuguuauacuaagaacaguuaugaaauguaagaauuuuagaugcauccuuugaagcucuucaacucuuagagccagugagggagaaagaaugaaucugcuuugguuucaguuucagaucgucguggcucagguaaacccagaccaaagagugaagguuuugagcucuauaauaauucagcucaaaauggcuccccagagaguccucagaugccuuggacagaguacagugagccaaagaaacugccuggggaugacaggcugaugaaaaacagagcggaccaccguuccagccccaauguggcaaguaagaagagucauucucuacguuaucuuuuuaccuccagaagccaauggggcaugcuguacuuugaucauuguuguuugugucucuuggcuagcuagaguuuucauagaggugucacaauacuccaaaauuuggguuuuauuugagaaaacccuugacucaguauacauuauagaucaaaaugcauuguuaaugucucuacaaaagugugucagggguugccaacuuagaaagaaacaggggcggggggagggagagagaggaagacagagaggaagagagaaggaaaggaaaaaaaaagaguugcuaacaaagaaaugaggaugguggguauugaauagagaccccagccuccaaaaagcuucaaguauuuacucucaggucucugccacagaugucagcuagguccugauccuggagauaguccuuuccugggcuauggugguaggagacuuguaggggcgcaggaagccagauucugguacauuuuugucucuggcucugugcuggacauccugucaauaguguaaugaugcacaugauacagugccugcauuuaaaggaauguuguuauguguauuuuacuuguuauuuaaugugaaacuuggggguucuuuugacuguuuccaacagaucagccuccuagcccuggagggaaggguccauauacaucuggaacagcagcuaagauaacaucugucuccacuggaaaccucugcacugaggucugagauaagcuggaacacuuuauuacuugugaaauaucugaguugucugauacaauucucaacaaaguacauuagcuaucauucuugacuuuuguucauuuaauuuuuuuaauuuucauuauacuagucaaauaauuuaauauuuaauaaaucuaggggaaaugagaauuaguuuaagugaguaacucuggaaaaauuaauguuccucauucaaagcauagggucaguuuuucaauuuuuagcauaacauuuaauguauaugcuuuuuaaaaaacacuuauuuauucccuuuauaaucaaauaucaucccauccucuccuccuagugcccccccauuuccccuucuugagacagggaagcuucccucaggguaucaaaccccuccccuccauagaugcuguauggccuaguuggccaucaguggaaagagaggcccauuggucgugcaaacuuuaucugccucaguacaggggaacgccagggccaagaagugggaguugggguggggguugggggggacuuuugggauagcauuagaaauguaaaugaaauaaauacccaauuaaaaaaaaaagauuguaaaacagauccccgaguauaaaguuagccuuuuaugaaauuuuaagcaucucuuuuucucuuugcuuacauuuuacaggagcaguccccuccacccagaccugaagccuauccuaucccuacucagacauacaccagagaguauuuuaccuuuccagcuucaaagucgcaggaucggauggcuccuccucagagccaguggccaaauuaugaggaaaaaccacaugugcacacagaaaguaaucauuccaguauugcaauccagguuaggaauaaggggcuuacaaaugguucucaucucucagaggaguaugauagaucagguuagcaggauuaagacugguggcuguuuuuuucuuuaaaaauauuuauuuguauuuauuuugugugugaguguaugggguacaugaacagagggcaguuuucaagaaucaguugucaccuucaaugauuuggguuccugggaucagacuagaucacagcauccacacucuuggcagcccaagagugugugaguuuuaagacacaauuguuaacuucagauugcuagguuguccucuuuuuuuguauguguguuuuuaagucugaggcaaaaagaaguaggcucaaaugcagaacauuguaaacaaguucuguguaauauuugguuaaugaaauaaugguaauguaagacauaguuacagcauugaaggcaaggcuuuuacagauucuaggagugaaagaugaaaucuagugacuggcauagcuugcacugagacugucucugcccguggaucuugaaguagggcauacagaaaacauacaaugcaauuagaguugcugaaaagguggguauuaccaggcguaucaacugggaaagaaucuauccucucuggauuccaucccuggugcuuguguagugucuuccucuggcuuuggcuuucuggcugaaagaaaagaucugaacaucagaaggcaaggcuggagccugaagguaagcaggcucauuagaagaguuauagguucuagcuaaaaagacuucuguccaaaucacuaaagauagagaugucaguauagggcuuuaaacuggaaagcacuaucagaugugacuuggagaagaaaccagcagugugcuuuaaagagaaaccuaggacacauaagacagauacauguccuggaaaguaaauguuguaugauccccaaaacagucauuccuccguagaguggucacagaagucaugggaauagaucacgauaguggucaccaaagacaugggaauugagcugagccuuacaggaugagaaaaauagacaggcagacagcagaaagggguguacucacaggagacugugcaccaagguaagaggaaacuuuguuuaggaaaaaaauaauccucugcugugugcccugccuuaucuacguucuccugaguggaccuuaugaccguuagcagcuggguuuucuaaguguuagaugucuuccuucucugcccauaccaugucuuuucuaguaacacuguccgguaacacacuagacagaagguucagaguugugauuuuagcagggccaggucucuguucccuucaugaugcucuaaugugauguguagauugugugagcaugugacuucaugaugcucuuacgugauguauagauuguaugagcaugugacuucaugaugcucuuaugugauguguggauugugugagcaugugacuucaugaugcucuuaugugauguguggauugugugagcaugugacuucaugaugcucuuaugugauguguggauugugugagcaugugacuucaugaugcucuuaugugauguguggauugugugagcaugugacuucaugaugcucuuaugugauguguggauugugugagcaugugacuucaugaugcucuuaugugguuuguugauaaggaaccuacucaaaguugagcuguaccuaaguauugggaauuauuguugaacuuccugcuauggcuauuguuuuuuuaaagugguaauucguguuuuuuuaaaugaaaaggaaauaguuauuuucagguuuccaucuucaacugauguucacuaucaaggugugcuaaggauaauugauucacauaucauagugaucaucuucaucaggauauacugcuuuuauaaaugccacuugucaggcuucauuguagccuucuagagaaaaagaauacuuguuugaaucuccuuccucacaaagggcuuuauuuccauuaaaguaugcuauugccuucuuucucugauaacaguggagcuaaacaucuuugaugaauggaacuuguccucauagccuugucuuauugagagaaaacaaagguaguccugaucuuuguaacucacucagaaucaagccauagaugcaugcaaugaguauuuuguaauaguuagacuaacuuaacagaagguuuuguugcucuucuuggauuacacuguucucacuuaccuaugggagucaggugugccuggagccugagcauguaccuucaccugcuaggcaggagugacagugccagaaauagcaugcaucaguauauagaaaaccuucuuuauucuuuuguggauagauuuacagcugacuacuuggccagugagcaguaaagcacuuucagcuucugguuauacacccauuccacagguuuuguugucuccucuuugaggaugaagcaugugugauauucugguaaugugucuggugagucucugaaguaugagaacuucuuuucuuuucucagcguguuacccguucccaggaagagcuucgggaagaaaagguuuaccaacuugagcggcaucgaguagaggcaggcauggaucgcaagugugacagugauauguggaucaaucagagcuccucaguggaauccagcacauccagccaggaacaccugaaccauucuuccaagucaguuaccccugcuuccacucugaccaagagugguccuggccguuggaaaacaccagcagcggugcugcccaccccuguggcugucucucagcccauucgaacagaccucccuccaccaccaccuccaccgccgguccacuacaccagugaguuugaugguauuccaauggauuugccccucccaccuccuccugccaaccaggcaggaccccagucugcucagguggcugcugcagaguggaaaaagagagaggagcaccagaggugguaugagaaagagaaggcccgccuggaggaagaacgagagagaaagcgcagggagcaggagcggaaguuggggcagaugcgcucucagacccugaacccugcuuccuucucaccuuuggccacacaggccaagccagaaaagccuuccacacugcagaggccccaagaaacagucauucgggagcuucagccccagcagcagccccgcacgaucgagcgcaaggaucugcaguauauaaccaucaguaaagaggagcuguccucuggugauagucugucuccagaccccuggaaacgagaugccagggagaagcuggagaagcaacagcaaaugcacauuguggacaugcuaagcaaggagauccacgagcugcaaaacaagguggaccguacugcggaggagagugaccgccugcggaagcuuaugcuggaguggcaguuccagaagagacuacaggaguccaaacagaaggaugaggaugaugacgaagaggaagaugaugauguggacaccaugcugaucaugcagcgucuggaggccgagcggagagccaggguaaaggggaaaggccucgguugugcguaucuguguucccuaugcuaucuucuggguguuucugugcagacagcuauauucacaaucacaaagaggaguuuaaagaccccugguuucuuuugcucacucuuggcugacaacuugaagggaugagucaggcccuuugggcuucaguguuuuaauuagcagucguauaguuauccuugcuacacuuaaguugcaaaaacagguacuuaguaaugaccacuaacagucggcacagggccagaugguaaaucccugagacuuggugggcuaugucaaguguaauggucacauggcucugcugugagcagaacagucagaguuguuuacaaacccuggauaacucaccaaggacaucacacagaaagagucggguccugauucucaugaugagcagaggacuuuaggacaucaauuuuaaagugcagggucauuaccaguaguaggacuuguguagcuauuuuacuguuauuacuucaaauauuuauuaguuauuaauuguaguuguaacauaaagauacuaacaaauuuugauagaauuuaaucucuauauuaaaaaaaaaaccuuuuauuaucuuuguuucaaauaaaaauuuaaauuagccuaauguaaauaaguuuuaaaaauaccaaauuugggguuuaaacuagauucuugcuacuuaucaagcauaauuguucagaggcauuuauuguuacuaacaugggcacuugauauuagcuugccgaagagugcuguugucuaucauguuagugaguuuuaaugaugcuuuuuaucaauauaauuuuuuucugauuucuucuuuuuucuuuuuucuguuuuaugcugugcauaaaagggguuguugaaagaguagcuguuucagacaucuuacuucaagggcaugaugcagguuaaccuugguugauauuguaacaguccaguacugugauuagucucuuuucagugagguuuuccugaagacuguugagaaacucaaaggggaguucacuggcuucuucauauugacauuccucagcauauacagugcucuaauucaccuaagauuuauuuuacauacuggcuuucuugcgugaaaccagaauguaaauuuuaacuauuacaucauuuuacuaguauuuuucuaguaccuuuaguaaacauccuuaagaauaacuguauccaccacuucaacuauuauaucucaaagaauaagcgaugaaugagacuuguacaauaagggugcguugaauaguuuccacugugcucaugcucaggacucucagacacacugucuagcucuugucuggacuggccagcgcugguaugucccucggcccugacuggcuagggacagauacggugauuuguggcuuuguauugcccucaccccaaguuccaugaagaggaagauuuccccuccccuguacuacaguaaauaacuccgaauguccagcugguauugaucacauagcauuagcauugcuuccuuugauagcagaucacugcagagauaaaaaguuagcuacuacgauagaacaucucaauuuucugugaggaugaaauguuuauugaagauuugucauagauuuacaaaauugcuacuacuuugaauauuuuaaagccuuuuaguauggauuaugaugccuaguaaaauuuugauauuaauuuuuaaaaaguaauuucauuuuaauaauuauauauuuagcuuauuaucuuaaucuccaaauaaacacuaaagaaagcuuugguuuuuuaauaugucuuugaaugauaaaucugaaaauauuaaugccacauggacauuuuucuauuucugaaugcuagaaguuagucugugguucuauaguuuucaucaaguugucuaaaaccagaugacgcuugacagcaacaaagaugccggugguggaacacaggucuaaaccuaacuuuuuuguugacgcuucaucuuucuuuuuuuccccuucucuauuaccugcagcagacugcuaugccagcaaucucuguucuagauuugguauguucuuguuucuuucccuuugguacuuuuuuuuugucuugauuuucuuuccuccuuuggugauggcuguucuguguucucaguagucaguucucccuagcaccuccugggucaggaggugagcuccgugguuagaagcaugccucugaauguuacuagacuaguuacucuacuuccuuguuaaccuuaagugucacuguuuguuuauggguuugacuuuccuacaguguuagucauaaucugauucuaucucauaguuagucucaaguaggugaacaaaugaaauagguuuugcauuggguaauuauuucuuguuguauuagaaauagauuuucacuauuucuaauaaguauguucacugugaacucaguugaaagggcauugccacuacucccagacuuaaaauguaaugaagaugucacugugaaugguaaaguaagagguuuccugugaaccaaaauccuauuuuucuuaauaccacauggauuaucaaaauauuugauugaucauuuauacacacacacacacacacacacacuuauccgagguuaaugucuagaugauaaaaaaaaaaaaaagccaguucuuuaaaguuaaacucuagcagccaucucaucaaaugcuaguccccucuuuucuguucuguagcuugaggacaggucacgcacagagaaaccuguuuauaaacagcuccucuucuuggugaacagaggacuaauuuccgacuuccaugucuucauucuuuauaagaaacaaggauaauaaacaugcuccuccacagaaaauaagagaugaaguuguacauuagguucaugaaaauuuuuuguugcuguuauuuuguuuguuuugaaaaaagaugucacugcauaagccaggauugccccaaacucagaucguacaggguuaacagguguguaccacaguagcccacuuaagaguuauucaucauuuagcaaguauuuaucaguauccuuuauagagcaagcacugaccagaggcacugccacagacacuagccaacucuugguucaagaauagcuuucuccugugaaguuguuugugauaaauaauguuugcacuaaauuuuuauuucuaaucaauauuucucaguuuuucuuauuuuaaagagauaaauacuuugauuaucaauuaacaauuaauaaaauguuaauaauuuauuuaccacugucuauauacacuucuuauccaaguuuccuaguaucaaauauuaauaugaaauaauaguaucauuaaauauuaguaugauuaguauuaacuauuaguauuauuaacaauaaugcauuauucuuagagcccuuaacaugucagaaucgguagauuaucuugggaaacucuuccuaaguaagaauuaguggauaguggcaagcaugugucuugggcuagcaguuugcccuguaaucuuaagacauguucuugauaucauaaaauaagauuuggggugacucgugggacaaaugagacagguuuuaucuuguuaggagcagcagaguuucaugagguugggggacugccuacauugauuuccagucuuuccuuagggcuccccguggcuggaugccaccauugauccaaggcuugccuccugcugccuucuucugcuuguucucaauccauaacuuuaagacaguaaugaugccagugacauuucauucauggcucuagucuugcccucuugcacaauaagauugcuuaccaacaugcuuguauuccaucucccccagauggcaagaugcagcuuuccgaauucagccugugccccuugcacugcagcucaaucugcccuccacccccaauccauaggcccuauuuuccaagauacacuuguauucauuugagcuuuauggccuuauaugauccacuucacacugcagaggguacugcccuaccgacauucuugcccuggcugcuucgcugcccuuuacugcuggguuuaccagucaagguguaaaagcagguccuuguacaccuaguguuuaggccucaugauuauauuacauuucuucauaacaaaucuucuauuaccaaggaaaacucuagacccaaaguguaagccuuaacccucugucacauagagccaacaugaguuugcuuucuagacaguauuuccuguuacauuaucuguaauucugcuucaucaaaggcacuuccuuuguaauaaugacauucugggccaucagguagauaaucucuuggccuguuugucccacaaaagcuugucugagcuguguccucucaccacauaugaauaggucacauuguucccugggcaacauacauuuucacaggaauaagcaucuccauggggugauacacauggaaagauguuuccagagacuccgguggcucuuguacaucaucagaacacuguuagguguucuuuuuuuuaaauaugucuuuugccacuguuagagggaucauuguuuucuaauggacucugaugcuacacauagagcuuuuuccuuagacaggaauagcugguccuuugcagaucuaggcucuaaacccaggucuuagaguacuagaagacugacugcaaacaguucaaaacaccuuucguaauaaucuaaugcuuucaaggcuuuuauaccuuugucuuaaaauugggauugaauuguggaaagaaauaccuauauuggaaaacuauuuugaaaaauccugcagacucuagcagacuucagaugucaaaaaguaaaggcugucgugacuuuguuuugcauggcugauaauuuaauaacaauagcauccuuaguauguuuuuguaaagcuauauacacacaaaucucaaccugcaguacuuguuugaccugaaagcaccuuuuagaaauacagacugguacagagucugccaggcuuuucugcuggccuugauuagaugagagaugucagauacucaguuucacugcacugggcagcuugucacugggcuacagaacagugagacugaugucaagguugacaaccacuucaccagcuaggagaaugaagaaccaugucuuuuagagaaaaugucucuugccaaauuugagagccugcacuuagaauuugagcucugugauugaacuuguuagcuaaaccauugugcagugcuucuccugccggguaacaggaggagcugaguuuuggagaagggcaaguguagcuuugguuuugcccuuaaguugccuucucugagcauuugauugucccugugcuguuugcuuuuguugcucuugugggguucugcuucucccagguuuuccuaaccaccaugcucuuuuguuuugacauuggcucugcuggagugugcacaguuagcugcagcccccucauugaaguucucagggaagacuuuugcuucccugucucuuugugccuugguucuucauuaacagugucuaugccugcuauaaaauccacccugaaucucaacuucuguuuggacuugcacuaccuuauguuuuuuuuuuuuuuuaagucaacuucauuugucuuuuugagaagacaauuuuuuuucagggauguuuuauuacuugcugacaucaauaaccccaacagcacaggcuaauuuauucuuuuccacuggauauaguagaguuucuaauuuuuuauuguauaugcuugaauauuuugccugcauagaugucugugccugguacccucagaggcuggaagagggcaucagauccccugagaauggaguuacacaugauuucgaguuuuguaggaaucaaucuuggacccuuuauaagagcagccagggcucuuaacugcugaaagucacuccagcccuagggcuaguguuuuauuccauugaaaauaaggaauaaaauuuuuagaguuguuuuuuauauuuuuaaaaaauaugcacauacaaucuaaguucagaauuuuaaauaguuuuucuauaaacacuguguaggugauuuuauggaacuugaacuggaucucacaggaauaucuuuauuauaaagaguuucugcaauagcuagacgucagcaguacaguuuuaggauucaaauuauggagaguuuuagucaguccucacggugacauaucacagugcugggguauuucugcccagaacagcucuagugcagcauuucagugucaccacagucugugacaaaaccaaagacauagcugcaggucagcauggauaaaggggagacuuuauccuacccuagaacucaugaugcugaggaauauggucagaagguucaaggagucacaacaaacaaggagaugcacgucacuggcaguugaagguggcugguaguguugggcacuggaaacggaagguguuggaucuuuuguuguuucagaaagguagaacuuaaugaucagaaauagacaagcaucagcugauggauuugggaccuacauauaaacuuuugaaccaacugucacauacagcaguguguccuguguaggggaguuagcagugguccccaugugugauaaucagaaaugggccauaaugagucccaacacuaaacugcaagucugaggucaugucagcuagaaagagacugccugaguccauugacauauggagggaacaaaauugcuaaaagaggaggagccucagaguuuuaaaccacucccaaguaaaaguaggcgguuccuaacagcucucaacugagacuggauuggggauaggcagccuuguacuuaugugcaagugccacccacaucccaggagaaagaggagucuuuuaacauugguggugguuaucauauuauguaguugugaaaguggaauguauugguaauuuguaggcgguagcuaacauuuacuuuagugcaugaauguauggaacaacuuguuucuuugagucuucuaugauuaauagaagaauaacacugggccuuggagacaaagcuuuuaggcaacuuacauugaaauugguaagagcuaguuuaauacaugagcuuuaccacccuacaacagugauuuagccugguguuuucuacuucacuuucugugucugucugucugucugugucugcuugucucaggaugugcuuauuugugucuuugcuggugggguugauugggugaaaauuaaauucuguuuauuguuagaugcaggaugaggagcgcaggcgccagcaacaguuggaagagaugcggaaacgagaagcagaagaucgaguaagacaagaggaagauggacgccaucaggaggaggagcgaguaaagagagaugcugaagaaaagguuaugguccucuaaaggcagcuaguuauuaccaaguuauccugaacacaaaugauuggcuugggcaaaggggcuagaaauuauguguaucuaguaugcauaagacagaacagggcugcaucuuccaacuuuugcuauuggaccaaaaacucuagcccuaucuggccugccuaccucucuuccggacuaucuucaggcuuccuugccuucugaucuagucucccucaaauucuugagcaccauguccccgaggaagggguaugggguauaauacugcucugguuuucccaggcagaguucagguggcuuuuaugaagguuuuacaguuauuguaagaauugcguaugaguucugugggaggcaacaguaacauggaaggcaaucaguucucauuagcuauuucaaauagcuuauccauuaaaaucacuuaauucugaugguaaagaguguagauggcuuguaaaaaacacaaaauuaauaaugcagcccaacaaacauucugguuauuuauguggacucuaacucugauacuuuuccauaguugaauuuuaaaaugauagcugauuuuugacauucugcaaagcaagaacuuaugguguaguuguaggaucucucugcauccuugucagaggccgagguucugcugggugaggaggcugcuacccugaguccaggucugcucuacccuaccccagggacuguauguugcuguuugguuugagagaagcuauuuuucucaguuacuucccuuccaugaagguagaagcucugagugugacuacuggucgggaagaacuuaguuuuuauucauaguuaucuccuugauaguccccaugaacuauguaaauagaaccuucucccccuuauccaagaaacgaaagguuuuuuaaaaaaauuucgaggaaguucuuuuuaaugaaagcaaugauuugaucacaagacaaucuaagaguaugauugauagacaugauguggcucauuuaaauggacgguguaaggccacacacuugcaucugaaacaacgucucuguuacagcagaguaguuucggagacuuugaguuuuaagaucaguuuacccacaagucuuuagcauguguaauguuaguggaaacugaugucugcaggaagucaggaaguacccaauacaggagccaugcagguuuuaaauuaugguggucuugcuuugcuguuuauucugagaguccucaggcugcagagcgagaugcuuucccagguuagggcuggccagguacugggaugaagcacccuggucauugcaucagaguuguaugcccagagagaagcaggcugugauuccuguguugagaaacucuccguuauuuaaucuuuccaguauguguuuucauaagucauaauuaugucaaauacccuuguguuuuaguaacugucucuauaauuuaguagucaauguaaaaaagaaacugaaauacuauuuuuacuauagaauguccacaauuaaugacuuugaucuguuauggaauaugugcauucauuuucuggauaaagucaccauggucauuucauuguaucugcucuugguguaacugaacaagguugguuuggucuuucccuacaggguuauucaagcaucuguucuucguguaauuuuaacauucuugguagugccacuaaaaagccacugaagucaucauaguuuaauuacccaaccuaagauaauacugauauuguauagucaagaacauaaaaauucuuuccuuuaggauuuuacaacauaaaagaagaaguaaagcggaaguuggggccaggguaaugagcagggcagccuuuagucuuccccuuucucucacagaauaugaagcagggagcacuguguguucacugugugugcuugugcuauagggacacagggaaaauguggcauaguagaggccaacaaacaugaugucagcauggucccuggugucaguucucuaugguugguugaauucaauccuggcugcccuugaacguuugcuuaagucaaggcagauugucauguuuucucuuucgucccuuuucauauuuaccuccuucuuguggucuaaaucucuugucaauccuuaacaaaacuguguuguugccuuuuuuuaaauguaaaaagaauuucaauacugucaacuguaguuugccugaaugaaaauguacagugugugucagaauauaucugcuaacacuauuaaugcuuggcucccauuuucuguuccucagagaguuuauuaagauuugaaacauauauuaacucuggaagcauacguguuagauuguggcuuugggaaaaugagugauauuucuuauuguuuaugguuuccucuugaaacacagcagaaaaagguaaguuaauauccuguucaaacagaagaggagagaaaaauguucuaggaaaagaggaggacuaaagaaugcagaugauccuaaaucuaacugugcaaaugaaaaguccuaagauuugacucaucccaugcuucugagcaguucuugucaaugugggggcagugugguguucucgaaagucuugagacaagaggcucgcaggacuggccugccccuucuguugcagucauuguagcacugaaacaugucuuguggauauguuccuuuggugauggauagugaugaucaggguaccugucauccccugaaggcacuaaggauccaccgcuuccccugaccuuuugcacucucgucuauuccugccugcagaggcgacaggaggaaggguauuacagccgccuagaagcugagaggcgccgacagcacgaagaggcagcacgcaggcugcuggagccugaagagcccgggcugagccgaccuccacuuccacgggacuaugagcccccguccuuguccucagcacccugugccccuccucccccaccucagcgaaacgcauccuaccucaaaacacagguccucuccccagacucgcuguucacugccaaguuuguugcguaugaugaggaggaggaggacuacggcccagcaggucaggauaaguaccccagcacacggaagucucaugggcaccuuccucuugccacccuuaagccgcagcagccccccugccagccacgcccagccucggauggcaucucccucugcaacucauuccagccacccuuggccaaagccaacaguacagcuuacaaagcaggccagcccccgccccugccaggcaaaccaagccuguaccguccuggccacuggaaaggucgagguaaaagagggaauggugaaucagaccuuucuguccuugaugauugagccuggaaucucuguaccccugccauuuggcaagguacauggagaccaugccugcuuuggcacuggguuuuaucugaucacucucagcaugugaucuaccucugccucugaugugguguuugcuaauccucuuaacuuagccuuucuucucaaauuuuuauuauacuuaaagguauuccaucuuguuaaucuacugacaacagucaguccuccacuaucagcaaauuauuugaaguacuguuggucuuggcuuuuuuucuguaccugcaaaaguaauucuucccuuugggcaaaaaaacugccuucucaaacaugaucuauaaaggcagagugccaggucccagcugcauuuuaaauuuacaucauuuaaugugaguagaacaugugguucuguuccugaggccuaugcaguaacucaaaccccuuguagaaguuuggugggauauuggggcaugcagugauguagcuaacaguaaagcuucacugacuaacacaggcaagcccucaucacagauucucaucuugaaauccuuccucugucacucucacuuguuccauucuguuucauuauccuucucucuugcaccucauauacuaguauauagacuuuuguuggcuugcaguuucugacugacuccagagugcagugguuccccuguuuaugacagagcaaaagaguugcccacaaaagauccaguaaggagaagauguagcucauuuagauucauauugacaauuuuaacugucuuggccauaaaugaaauaaaauccugucaucgaauaucuaguaguguaauuuuagugaguaaacuucugugagauuuuuauaugaaugugaacuuggcagaucugaaagaggcugacucagcaaggcuuguuuccuacauacaacagagcaguucugcuagaauaaugacauuuucccacaccuguaucagacucuuuuaaucucuuuuggagaauugguaugcaauauucuucaaucauucugaaagcccaaaaccagucuuucuuacaaaauuucuguuauaaauguugagaccuuggugcucuuucaaggcauuucuggaauaauacauuuugaagcaaagugcuguugaucguauaucagauuuuauaguugaauuauagauaguuuaugaauggcaggacaaacuggauagucuaauuauuguuaggaucuacaccuguggauuucagcccccaaucaauccagcgacccuuacuuuaugucauaccuaaagcaccacuguggauccaccugcacacaugcaacagcauugugccuugucuauguccuuugugugcuguauccggccuuucucugaugaagcaugcuucugcaggugggacuugaccucuuccaaggguucacaugagucagugcuuaugcaguuggaauaaugaagaauacauuuuaaugauuggauaucuuuaaaugauggcuuuuuugcuauaaauuuugggaaauuaguuauaaguggauauauauauauauaagguauauauauauacacacacacaucauauauauagucagcuccaaguuuuaauguuacagcaaauucaaaauacacugaaagauuugcccauggaagaagucauugucacucucagcaaagcacaaaaguacaaagcauuuaauuucagacaaaaugaauauacgguugggaauugagaccaacuaugcaaauaccauguuauaucccacuguagguugcuaggagauagaaggcagucuuugcuggagcugacagccucugagaugacuugggaagccuaaauuucuggugcuugaacuugcaguuugaaggccacuagacucuguccaaauccauccaacaaacccuaaccaccagcucuuucuaugcaggaaaacuugcucuccuuccucuugucuaacaaggaggggaacuuuauaaucugaaaacagagugauaauguuguggccuauuuaauccaaucuuauccuuguuugccagauauucugagucucuuguauucuauacauuauuaucugguuauucagauaugaauaugcuuuuaugaguuuuuugucggcauguaugucugaguaaccaggaacuugagauaguuguaagcugggaaccuagcccugggcuucuacaguugccacaaggacucuuaacugcugagcccccuuacuacauuuugugauguuacaguagauacagcaauggcacugagguauucuauauuagagcaugacuguagacuuggauacaugguaaaucuuuauuugcaucaucucuuacugccgccugaagucuuggcaacuguuggccagcuggugggcaucgaguucagcugcgcuuucuugguuaagacagaugugcuugcccagggccaacuuaacucauuuuucucugggaauuuuuuuaucagcagcacuaauguggaguguuaggaauuuuaucugaguuucauuuugguaacccauuuguuucaaaggauuuauuuuacuuuuaauaacuacaucuaucuugaaaaagaaaucuaguaguuacccucuacaaagggacuuuaauuauagauguagguuugucacuuaaacuuugggguuacauuugcucucaaugauuguauacaaaaacuccuacagugugucaggaguaugucuaaacauuuuuccuuacucuuaagagcuuuaagucuuccguggguuuguuuucugcauuugugguuauugugccuuguuuuugaguucagggguuuuauuauuuuuauuuugauuugauuaauuuuuaaaggaugcacuguagcuuuuccauucuaaguucuugaacauagugauuggauuaccuaggccacuaagaguagugaauuuuauauuaaugaaucuuugagcauauaaagagccuuugauuucuuaguuuguuuuucuuuuuuaauuacacuucaauaauuaagggaauccuguuuucagcagacacucuaauaugaguaaaguuuaagaaauaauuaaauacuuuaacuuggacuuuuuuucucccucuggaaaaggaccaaacucuuacucgggaucugcaggcacagcugugggagccuaugaugccccucgggaagcgagagagaaacugacuaggagguacuagggcuggguggggccaggcugggcggggcuucaucuaaccugugcuggcuuauucucauuuucaugugauugcucaauugugucagacuuuaucaggauucggguauuuguuauuauacaaaaccaugugagaauguagacuguccugcccccucccccccccacacccucucuccauuccccccaaccuuuauaagucuagaacuuauuguguagccaggcuggccucaaacuguugguaggccccauuuuucggugucccuaguacuuugaugucgggugugagucacacuuguacauguaggcuuuuuuaaagugguguugcuaucgugggucuuuuggaggugguacuagaccugcuauaagaccuaaaguacaggagacaugaaggccaggccugccagagcaggcuucuuguuaguacaggcugggccccucugagguuuaacuagacauuuaguucaucuuaaauguccucugcucuuguaacauugaauuggauuaaucagugcuggucugacucucaguauuagacuggggaagguuuguggaaauggucuacuuuuaaaccacccccacaauuaaacuugcuuagcuggcaagaguugccugcuuacugaaacugaacucacuggcuuugcuauuuucuuucuccauuuuuaguguggggauguggcaucagacauacaaacacaucauguauguucgugcguguggaggccuuagauugauagaaauuauccucaaauuacucuaccaacucauugaaagaggaucucucuauggcuaugcaggcugccaugucuuuccaguauuuaugugaucucugguucaccacugagcaaucucuaguucccuuauucauuuucaaaagucaccgucaagagaauauuuugccccuuucuacauggaauuauuuguugguuuauuacucucuugauuuuuuuuauuucuuuacguuuuaaucaugaauguuuggcccaggugguuaugggccuaaggcgcuguccucucccuuuucuuugaacuugcauuuaguuguaugaguacugacuggcuuuuaaaguucuguucagaccauaguguagguauaguuuuucucagccacaauacauaaaaugacuucaauaaugugcaacaaugaguaagucucacugagacgguacaguuuuucugaaaguuuacuuaguuacuuguauuuugaugcacuaucuuuguguuuccucuugccagccaagacgcagacuuaccuggcaguucuggagccccugaaaaucugacauuuaaagagcgucagcgccuuuuuucacaagggcaggaugugucugacaaagugaaagcuucucguaaauuaacagagcucgagaaugaacugaacacaaagugagaagagagaggucugcccuuggcgggagcuuugugggggcgagccugaagaggaaggaacagugcuacuucuaagugauguuuauuuucuguaccugaaaugguugcaauuuagagauguuccaauuccaagaaacuucguuuuacuuuaccaagaaaaauccugucuaguucuuugugaucugacucacaugaaguuaccuguuucuguuagcuuuuggggagacucuuggacucauagggcagaaugaagggcuguaaagaugaggggguauuucuucuacccuaucuucuuucauugucauuccaagggcaguaggccaagaaauuaucuuucugguuuuuuuccucuaaacuccauuugguuagcagacagugacagcugagcaggucugagcacuacugugucauaguggacccugacugcaggagucaggccucucagcccagggcagaugcugccuuuaucuucuaucauuuguaugacguggcuggauggaguuucuuuuguaaggugcacaacacauucuugacaaaugugagucuccugaucaauuuaaauguuugagauugaauaucuaauuaauaauucaauuuugaaaauucucaaaaaaauuugaggauuuaagccuagggauuuuauuuuuauaaauaccaaaucaucauuagacuaaucacugguggaaauuaaauauggcaguuauguuagguuuccuaauauuucaaagguuccaaaggaucuagagcucucuaguuacauagcauucauauaggaaugagcagagacaucugagaagagugggagcucaugggugacaguaaaacuuaggugucucagaacuuaacauuuaguaaagugauguagauccaaugucaggaaaggaaggacuguguuacugugccuccucugacucaugugcuuuucagcauaauagacuuauuuaauauuaauuccuaaacuuugcacugucaauccucugcugaguugugggaggcagaccucaguuugcuuguuuuuugugaaagcuaacuuuaugauuucaagcacacuuucuacaugagaaaccccuaauguguguccauaugaucuuucuguacauucuauucucuuacaaaucugugcaucaggaaaauaugcauacuuucaaauagaacagagguauuugcaaccugaaaaaccacuuuuaauaagagcuguaugauaaauuguugaaaugcaaguguaaauauuuuuuauguuaauccaguuuccuauuagaaagugugucuuugcuauuuccucuguaagagaauagaauggccuugagaguuuaugaaggauuugcacacucgucuugccuaggaagugcaaucuccuugugacuggagcacacuggcagccuucaggugucauaaucauacaucccagagaagagcagucaccugcugucacuagugcaugggaagacagaugcacagaagagccagguagcaccugaaaacgcugcacguguguuugugaaaccuguagugaaguagacuuggccgucccuggacagugaggucagaugugaauacauauuguaagagcacguugaauagugugcauuacuguggggaaacaccgaaacugcuguuguuuuucauuucuacuguauuuuaguugcagccuauuuuuaauaaacuuuguaucuauuuaaguguauuugcuauuguuuucaaagugcugacaaaguuuauauuuguaaugccagcauuccucuuccccauuuccagcugucacuccuucauuaaacugcugagucauuccuuccuuugucccuugguuguuuuucugucugugggaaaguguucuuuaaugacacaaccagcugaagacuaggguggcauuuucacaagagucccuugugagagcucggucaccucuaucuacaugucuaccccuuaugccuucagcaucccaaaggagcacugggaccaugucuccuuucacuaccccaucuggucccuggacucccugaacacacucacggauaagcucauugccuaaacagucuccuggucauacacagucaagauugcuggaaugaagguauguuuuauugucauggcacaagguacccugaccagcuggaacuggucagugggcuggugugccucccccucaugccuacugugcuuuagcaaggaggcaaagcaacguccaaaucucagggcuugggugaaauggaaugaggaguuggggagucgcuagucaaaguguauaaaaguuccaaugaacagggaauaacuuugaguacuguuacuugguaaaguaugacacucagcagcguccugcaaacaugccaaggaacuuuaagggugggaaggcauguuugaaggucaaaggaacaugugagaaacuuuuuuggauaaguaaaauuuauauacu

SEQ ID NO: 8391 - RNA, 28814 nt, Mus musculus
ucauuuacagaaaccuuuuuauaauuuauuugcuguugauaaucuuugguauaaaaaugaagcucuagcuaaaugagggguuuuaguggugaaauuuaacccaaugaacaaauaaauaaauauuuacaaucuuuggcaaaaaaaaaaaaacaauguuucauuaacguauaugagaagcuucuguuuuuaaaaaaaacuacauaaauaauuuacaaaaauaauaugguacauugaauguauucacaucgcucccaccaccuuguaccauugaaccaaaugcccaagugagagccuaaauguucuucacacccucauggccagaagucuccugaccugugcuggccuugggaauacaguuccacaaaaaucuaaaaagugcaggauaacaagaaacaaggaaacucacccucagagauuucaacacaaauaacuccaucuagacaaauuguggaaacucagaucaaaaucguggauucuuucugucuaacuuagaaaugcaguugccauuacuagaaaggggacugugaacuaccccaccagagggacaaaauauucuuccacugagcucgugugaagugagagaggcaguacuuccugcugggagaucaugcagcuuaaagcaaaacaaaaacaaaauaaaauaaaucaagcauaugucuguaaugaugugacugauuaaugggugugucuggaaaaaacaaaugauguuuccuuaagcauuaaaauaaaaagaaccuauauacaacaaagagauaauaguaaaaagaacugaauuaaaauuauugguaaggaugcauauuaagguuccauucuaucaugacauaaauccuuguauuucaaacagcagauauuuguaagugugucuuuauaucauuauauccuugucauaugcuuauuucuagaaauuauauacuacauacuuguuacuuuguauguuuaaaauaaauuauugaugagugaagcuauauuccaaaucauuuaauaaauauuaacaaaagagccguaccuggaaccuuaaggaaaugcauuaccaaauuuggcaaaagcagcuuuugcaucauucuaaagccuagaguaggaacaggguaccaaagugcaucugccaacuuauuugccagucuguuuccuagcagcagggacaggaaaggaugcccagacaaagauccuagcagucaguaugcagaguaugcagagccugaugacguccagccagguaugcuuuccacacugcccaacccaggcaggcagcugaaauggacauugccucugcugagguuuucuucugaaagcucugagaagccuacagcuggaacccugaaauauuccccuuucaaaggaugcagcuucuuugucucugucgagucagcuuuaacuguggccaaguaagaacugcguuucuucuaacuuuucgaucacuuccuauguucuaauuaguuaauguuucaaaucacuggacaaggggccacagucucacaugacugucuucuggccucuuccuuacugcagccgaguucaccugaucuuucuuccuguucagccucacaggauuugugugucauuauagaacagcacgaauccaaaaacagugacaacauuaagcacugaggguaagugagccauauuuuucaugcuuaauuuaugagaaugacuuaaacacaauacucccuucgacuccauauacacauaaauacugcaaguaauuacauuuacauguaaacgucauucuuuuuaaacaaacaagaaaaggcaacacagcggaaugcucggucuucgcuccacggugagccucauaucucauccaaauguuuuccagcagcaggcuggaagcucuuggagugcaauugauguuucuccuuugaagacacuuggacuuggugcugaugaaggagguguagauccacucaguuaaggucaagaaacaggaaaugccaaaugacagaaaagccacaagugccaagauggacugaugugucuaagaagggguguuugcagcacauugcuggagcuggagcccugcucucuaggcaucuagaagagaaggaacaacaggauuaggaagaaacaacuaggggguguuuuacuguuuccuuguuuuucuaucuuacaguuguagcccagaauucacuauguagcucagacuggccucagggcuccccagggcuaauauuacauacauggccucagauaccauuauuuuaacuuuaggauugcguacaugagauagauaaguagaacagauugauaaaugacagagagguguguggacaaacaaguagaugagugaauagauagaaagacagaagggugaauggacagauggauaaguaggcauuuggauggauagauggauaaauagcuguuuggaaagaugcauguguagauugauguauuaauggguggauaaguuaagaaaaaauaaaucucuucaguggaauagugacauguguaaagaucuucaguggaagaaggggagaaaacaauguccuuggcuuuacuucuccuugauguguguaucauuuucaaugcauaaguacugagaaacauuuuugagcuuuacugaucucuguaaaaggcaugucauuagacuugacuggucaaguuugcuuucagguuuauauuuugguucagauaaauuaacuucuagugguauaacuaagaaggggccgccuuuccucccucacuccaucuucuuuccuuccuccuuucuacccuuucccuuccuuuccuuuccuauuucaauuuuuaguagagauaguaaucuaaaaugacccuagaaauucaggaaguauggaaacaaaaagcucuaggacucaguacagugccagauaacagccuguggaggucagaaaguauuuguacuaccaaagacauucagauucaauuuaaaacaaaagaacuaucaaggaagaaagugaagaagaaaggaggaggagaaggaagaagaauaaaggaagaaggaaggaaagaaauaaaagagaaaggaaagaagaaaggaaggaaggaaggaagggagggaggaaggaaggaaggaaggaaggaaggaaggaaggaaggaaggaaggaaggaaggaaggaacuauaucccuaaaccacaucuuugcugggaagggcagaagccccagcucauagcaacaguucauuucccuggaaugaagccucuguaggcagaaaaauggaugccagucccuccugcuccugugggaccacuucccugaugggaacacauacucaccucugcacucauacuugagguccgagaaauagaccaucucuugggagaagacaaacaggcccagccguccaccagcguagguuuggucauaaauugguccugagucagccaugacuugcuuuccuucaugcacuaagacucuaaaacaggcaaggaaguaaaagacaaaagagaacuugaacucagaagcacauucaccagcggucugucguugguuuuaaaugccagcuguuggcuaagaggaaucuagucucccuguuuagugcuaaggaugaaagcauggccuuguauaugcuauucaagugcucucugaucuaccauagagugacauccagacaacccaaaagggaucuauagccccacucucugcucagggucugaacaagacuugcuuucccuuuaggaacaacaacuccugucaugcagcagagacuucagagcccauuccuucucacaggcaaagcugcugcacccuugguguauauggcugcaauaagccagugacuacaaagugcagugcugccuuuaacagccaaggcaguguaaagaguaaaggauguuucuugaauguuuguguguguguguguccuuagagccagguacucccugaguguggcucccaaagcuuucauuuucccugaagaucccgagucucaucucccuggcucagaauggguagugaucccucagaauuuccugauggaacccaugacagaugggaccucuuugcagggacauuacacccccccacacacacacccagacccucagggaucugcagacacuggauagccaucaggaguaagacuaaguggaagaguauuugcuuauuaucuacaaaaaaagguggauuccauccagaugagugugggguaguuugcauaucagccaauaaguauuuaagacauggcuuauuuuucagguuuuuaaaaguaaguaauguauagaaaggaugcaaaauagacaagaaaggacauuuaaaacuaaggaauccagagaagaauauaaaagugcucauuacagcauaguuacuuauugauauucuccaauaggaagguagacagagaaagcacauuguccauccaauggaaaaguuaucuaugcaauggguaacaggcuauccauccauuugaugaaaaaaaaucuaucuggccauccaauggaaaggcagacugguuguuuaauggaaaagauuagccgacccacugggaugaagccuaccacugacaaugugcaacugcccuuaccucauguagccugucuuaggccugugaaucaggugccaccuguaggcaguguagucuuuccagccaauguuuuuggggucaugccauagaguccggaccuguggaauaggagcauuguugaaaggugagcuaugugccucccuuccauucuucucgcccuggacugugcaaaguaauacuccacuugcuguacuaccucccuaguacauacauuuuauuuuguauguucuacuuucaaaugcuguaucaucuacccuacuauccacucuacuaugggagacuacagugugcaccuaaguccaguguuggguguguuaacacuaagagcaugaacacuugacccagauagucauggaucugaauucauaccuucugcuucuuggguguggagcuaugaacaaaacugacacuguaaguccugucucugcaaaagacuggacauguguucagucuuuccaaccagaagcacugggcauuucgugcucaauaaaguagguauuccacaccaacuauuaaaaugauugcuauuugauuaaaauuaagggcagaaggguaucucuuuggaacagguuaggagugcagggucugucuggaaauggccaucaacugccccgucccucaccuggccuucuguguuucccgugugccacagggcauuccucaggugcucgccaguaccagucguggaguuuaccacuuugagugacacaccagaguagccguaagcccgacugggcuugucuucccaguaggucugggucaccugcuuccacaucaccacauagaagcggcugcuugacugauagccaaagacaaagccagcguagucaucaucccggucaguguugacauagaaagugccacugaaguccacagacccaaacucgucgaaaccugagugcagagaaaacauggauggucugguggcccagagaaaagcacauugggaacuucagaaguccaucucacagaaacguggaucugaagagcuuagauuagcuuagauaaccucugcucuucgcugagagagcagcaaaaggacuugugacccagcugacaguuuugugacagaagcuccagugucucauguauuguuucagagaguccauaacaugagcuggcuuacugaacaccaaauuccauaggucagagaguugcaaaccugugcuuucccagagcccuuaaccagauuaugaagggagacuauuccacauaccaaggaaggguaaggcuaccagaaaaauuauccuaaauccugaccacauggucucucugaacuacccacaggaucucaggcucaccuacagcgaugccagggucugaguuugcugucugcaccagcucuuugccuuggugacgaauuacccaguugggaucaauuugugugguccccuugggauccagagggaccaucuggaaguuucugaagucugucucagugauggcauuguucucagggcacacaucaucaauaucugggacauuaucauugucaaagucaucuuuacaaaugucaccucggccgucaccuauggauaaggaagaaaugaacccaagggggacaaguuaggugguuugcauuucccuucauguguauaaacagagaccucugagucuguaagauuugaggcuaugcaccuuguaauuaauugugguuugagggucaacugcuuccaaaacacugagcuuguaaagcuauaaggcaucccagggaugcuuuuaaaaaacauccucacugcaaacacuacagccaaggauagugcgauaagcccaagcucuguucccuacauucaaaguugaaaacagagaguuggcugcugcuaaugucucucuaagcucacuucucacugucauucucaguaacuggagccauuuuaauuuauuuggcacuuaaaguagaaccuuuccagcacacaugacuuccccuagggagaucagacccaaugagguuggucugcaaagggggcuaggucaugccuuaucuuacagcugaccuguccucggccacagugagaugccccaaggcagaggcgauggaguuaaccaggcacucugcuaugaccucuuauuucaaaaggaagaaaagaaaccauauuugguaucuagauugauaucuugauuuccccauucuucaaaccaauuuucaguucugguauucaauacuguagccuccccacugugggaaacauaauuagauguacaggcauuuucuuuuauugagacaggaccucagcacaggcucaucucaaacuggcaauauggagccaaggaugauuuuuuaaugguccucuugcuucucccucccgaguauaggcacgcaucgcuaugccuugucuauguagugcugaguuuucacacuaggcaagugcuuuaccaauuaaucuauuccccagccucagcaacagcaucuuaaaaguaauaaaaauaccccucgccucuucuucccaguccccuuccuaggugagccaaaggccaccucccacugucugcaccagugucugcaucaagcugggggcucucugcugaaagcauucuuuccugugcugggagaaugcugcagcugcccuuggucccuggccagucuuuucacgugcuucugagucacauuggcucaacaccccaggacuccuggccuccauuuguucaggauaaguguguuccaaagggagcuuggaucauccugcccauugggagggaguuagagaccagccuaucagcaagcgcagcugugcacuuuguuauucaggacugcggucuuccuggagugugacauccuccagccccugcacagcuacagaccacugaugugcaagaccuuccaugucgcaccuucccuauuuaugaauccucuccccaucaugucacuggcugcauucagugaaccuuaucucuuucaaaguguuugccaaagguuuucaaaaguacccagaagcugaaagguuuccucuuccuggcacucacaaacaaaccucaccucucucauugguagaauauuaaacacacaugaagaagcugaagcuuccagcaggcuagacagacaaccagccaacccugugcccaacacccuuagauagccauccugcuuauuuuugaacuuccaaaccggaguucugccucugugggacugcucgugcgguuugcaaggcacaugugaacugaagaaggcacccaccguccgagucuuccuggucuggguugaacacaagccgacaguugucccugucaucuggaacaccaucauugucaucaucagagucgcaggcaucgcccuugccgucguugucauggucagccugguuggaguuggagauguaugggcaguugucuugguuguucugguggccgucaucaucuauguccucauuguugucacacuggucuccaacgagaucauuguccugaucgaucugggggacagagcagcaagugagcaccaugaauacucccugaggaagcacaggaagacucggggacuagacuagagacacacccgcucuugguacaggccagcacugggggauaagguacaaaaaugggguaugauggcucacuugcuguccucacagaagagagcuuggauuggaggcuucugggugcaggcuuucccagccagugccccaucucauaggggacuucuuauugcuaacuaccacucagguaucauaggaaccacuuucucuaccauuacuguauacucugcagaccauaguccuagucacacucuucaggucccuuucaaaggcaagccuggaaauguagcuaguucuggguuugccucuggauaaccauggagacuaauuuucccccagacagugugggaaagucacuuccucccuuggccuggggccaccuagauauaaagugcuuagauuuggucucuguaagauguuucaacugagcuuauagcaagcuauguugucaugcuuggcagggcagaagagaaccacaccggagcaccuuuaucaagcuguuuaaggaugaggaacacccugcucuggauaugggucacccucaaggcucaucuccaggcaacagcuggggaucacagagcccuguuuggacacaucucaucaccugaucuggguugugcaucagaggacaauugucacaguggucacccacgccaucaccauccguaucucucuggucaguguuguagacauauggacaauugucucgcucauugaaaacaucuguuggugaaagaaacaaaguaggcacaggcugaguuuagagaaguugcaucauuuucccagcauacuggauaacauacaggccuucacuagaaaaauggcaaaaauuuaaagauuauuagauucauugaagagaauaugaaauauuuuccauuaaacaucaaauucccagugagacccugccucaaaaaaaaaaaauccaauucccuuaaccuaaaauauaaugaguguuugggauucucugggcaaugcugcccagucagaagagggugagugugguguguccucugcgcuugcuguuuuggcuguucccacugagaucucagaaagugaguuaagucuguaggcacacaagagccucugggugaugauuccucauuguucacagacagugggagagaagugauggugcagauggaucggcaagggucuuagaaaucugaaaauagggaacgagguccaacaguacggaaggaauaauaauaauaauaauaauaauaauaauaauaauaauaauaauaggauaaaguggcaaacugaaggaagauaaagccaaaggaagaagagaccauuuuggggaacagaaaggacccuuaaaaugacaggguauaagaagcugacaccccagcuggcagaacagaggcaccagcccacuuuaggacagacaugaggugccugcuaacugcaucaaccuucaagaaggcagagugaucgaggcuguccugaggcuaagguuggaugcagaagcugacuggaaaguucuacaagagcauauacuuugagaugggucuaaauagcaggguagagucagaggggaugaaggaacuccaggcugugcaucguugaggagggggugaggcucaugggguacacagaggagucaagcagagcagugaucugagugucuccuagucuacagugacacucugagagagcggagccugaguuccaaguggucagucucugggcucuugcauagaagacgccaggucucaggguaaaaugucagccugcaguaauaugucagagcucacggggcacaccugugucgcucuaccugucuugguucccaggucccgugguuaggccuuaucaauaaacaauaagaaaccugaguagaaguaagacaaacaaccuccucauacccuucucggagcaguuggaugcagcucugggaugauuuagagaguauucacugcagaagaugcagugaaagagucagaugaagcagcugugggucugacagcaaggaaagaaagugcagaaagcugugauuuucuaagauggaccucaggcuugugggaaaaggcaaguuauuuagggaaucauuuucguaagcauauagauaaauugagcucuucuaagauguuugaaauugcaguugcuccaggcacacauggagggcugcuacuaggacccacaaagauaccaaaauccagauguccaaauucauuacacaaaauaaagugauguuuacaaaccaucuaguuagaauccccuacauacuuaaaagccaucucuauacuguaauuucguuguuuagaugaacagcaugguaaaggucuggggguuacaauguaagacagcucuguggcuaaaagugcuugcagcacaagccugauaacccaaguuagauccucagaacccacauuaagacaaaacaaauaaaagccagaugcagcagugagcaucugugguuggcagcaccucuauggagagauguauggaagacacagaagagucaccuacgugcucucagaacagcucgucuagaguacacagugcaacagaaaccagagagauccugccucaagaagguggagagaaccaacuccugaccuccacacacacagggcagcacccucugccuuucacacacacacacacaaauaaaugaaaauuuacaaaucugugcauguucuguacauccucuuucuguaugguuaguugauuuguggcugugaaccuuaguacacaaagugcuggcucacuuacaaccauuaacccugaucugcgucacuaaagugagcagagccacugaccgucuccgucaauguccacagagcaggcaucccccucgccauuguugucugugucgaucugugcuggguugugcacauaggggcaguugucacagcggucuccaaccucauccuugucauagucuaauugacggggauugaagagaagcuggcaauuguccuaaaaaucaccagaaaaagacaucaggaagaacacagaccaggcaaucaggcugccauaagacaacucaauacucaggaguagaccaccaauaaggaagcagagaaaaugagcgaguuagcccugcacaggcaacggcucagcauccuguguuuucgcaguuccauacacagcuguccugucucccugaguguugagauuuccuauugcaaaguggcagucuccucuccuucacaggaaagucacagaugagacaguaggugaguguguggauggaugugugcaaggaagggaaagcauggacucucaccauagagaagccauccucggggagcuauaugagcccauguuaaaccuucugauugcaucugccacuugcaucaagcaccagaagaaaaggaagcgaauaaggucuuuugaggcaauuaaggaaagggaaguuaugagcacuuucugcguuguaccccagggagcccugugcacccacuaaucaguauuuucagggacuacuuucucuaugggugaucuuugggagcuguucacaaauaugucagaagagcagccucggaauccccaucucuuccaacuucucggugcuugagaacagcgcucauccuaccuucucaucgcucacaccgucauugucaucguccucgucacaagcaucuccgauuccauccuuaucaaaauccuccugcccggaauuuggcaguuuggggcaguuguccugugauuugggaaagaaauaacaaccaugaaagcauuccaaaguguccuucucuccaaaucggggaaaauaaaacaagaauuaugaagccaaggauauaaauaucugauacaaguccucagauagaagcggagcgagcaucggagccagcuguccuggacgugugcuguucugaguccuacccugagaauuaugucacugcugcacgugaggagagacaaaaggagcccuguucugaacccagaccccaggaagggaucagacaccugagagaacagagggaggugagggcgccugucccaggagaggugcagagccagaugcuuagcauccuguucuuucccccagcucaucaaaugaacuaagagcuccagcaugcgugcaagcucaguccucaccggccagcaggucucaaaggaggaagaccucucacagcuguacauugucuaagcuuugcaauucugcacugaaggaagcuuagaaggagggagaagaacaccacuccagcucuucacauuugauagacaugcaacagcauaaaagccucucuacucugucuacugugcugugacccaaaugagcugcagggacccaacugagggacugaagaugggcagggcagggcagggcaggguagggcagggcagggcagggcagggcagggcagggcagggcagggcagggcagggcaaggcagcuuugguuucaaccacauugaugccuuuucucgacucucuguguguguguguguguguguguguguguguguguguguacaggcaagugugcauauuuucacauacauaguuuguguacauauguauauguacauacugugugugcauguaugcauggguauauacaugcauagugugugugcuugugugccuauacauuguguauguguguguaugcuaugcacauguguguauacauauauagugugccuguauacauacagcauugugugugcauguauguuuauacauacauaguguguaugcacauauauguguauaccuucauuguguauguuuucauaugcauguguguacauauguacuuuucauaacaugugcugcuuuuccuaacgaugccuggaaugggaagaaaaggaagcccaguugcauucagugcuucagguagacuccuggguagacgccugugcccagugcacaucagacccacgcucucuucaucccuucagcugugagaagauguguugcuccuacaugguccagucucagaguaggaaguucauguggaguguaggaaggaacaagauaauuuggagugucucccuguuuagaucauugcuuccaauuggcccaaucucuccuggcagugaaucacugaagagacacuggguagggguggggcagccccuugcacugacugaagaggacugaggggcagacuccucacugaugaagcuagauggaguggcagaauccuacacuuaagaaaggggcugaggcacagcuccuuauacugacugaagagggauuaagacacagaccccugacaauggcucaagaagggacugaagcacagagaccuagcucuuagccugaggugacugugacucucaccuugaugcagugguagguggcauuaguagcacacaccagguuguuguugggccagccauccaggucugaguccuccccgcagaugagcccaucaccugcguagccaaucuggcacucacacuuguacauggggucacuaaaguggcccagguagaugcacucugcauucuuguggcagcugugagucuuguccuuacauggauucucuggcucacacaccuagaauaucaagagaaauaugaaauacagacaggacuuacuagggaagaaguuggccacggguaccccugagaauccgaagagacuagcucauugugagaggacacagagauuuugacauuucucaggaagucgacaaguauuuuuuaaugguuaucugagccauauaaacaucauuuuugaacuuguuguguaacacugcuugccauggcuuuguugugacccccagggcauggauuagaauccauauccaagugugguagcuucaaagccucauuggaaguguauagucaucagggacccuccaacuucagcucaucagugcucaagcucacucucucugucucucuuucugucucuuucccucccuccccucaucccucuggcuucugacaugcaaugacaacucagaaacaugaacuagguaccugguccuuggucuuguguuuccagacucuaaaauugugagaaaugaaucuuuguccuguaucccuacccagccuuggucuucugcuauaguauccaaaacugaccaaggugucauugcuacccugaaggucaugggcccucugcaugaaaacaucuggauucuucuguguugguagaagaggcagcagaugaacagagccugggaggcuuucauaagaaaggcuccucucugcauuccucccccaacaaggcugcccuuucccuuccuuuccauuucuucuccacuugccuagacuuggcagacucuuucaagccuuuagauacacaggcaaggucagaaccacuuacuuguuuuucuguccuagcauccuccaggccaacaccgaaggguugguuccccuuguagcgugguggacaaggcaggcaguggaagcccggguugguguugacacagcggggagcuuuguuaguugagaagcaaauaucugugaccacagcacacugugaggacaaacagaagugagccucucuccagaucuucauaagacacccagcuacccaaggcagagguaccaaccucauccagguccucacaguggguaccauugcccagaaagcccacugggcaggagccacaggaccaggacccaucagggaagcuguugcacuuggcuccaggaaaacacggguuggauaagcacccaucugcauggaggaugggagacagggcuaagacaagaugccacacacacacacacacacacacacacacacaaacacacacacacacacacacacacacacacacacacacacacacacacauauauauauauacacacauggguacacauacauacauacauucaaguaugcaugcccugucacccauggaacagcuccuuucacacacacacacacacacacacacacacacacacacacacacacucacucaccaauagggcagcuucucuuguugcacauuugguguucugucacauccccgacacaguccuucccuccauacuggggcucagggcuguugcaaacacgugagcgcucacggaucccuccagcacagguaacugugcaggcugaccaaggggaccaggggcuccagcggccaucaacuauagagagaagcagggaaggugacugagaggaggauggaggauucagauaugacuggcacuagcaagaucagaaggaagaugaggcugauauccuggcuauuccaguguaguugaagacacugggguagaagggaaaauggaggacuggucuacugugauuuacacagcugugauucagggagucaauauuauuacagaguuucugauagauuuucuugccucuaaaauaaaauucuuacaaucuuuuacagccagaagccugaguuuccuuaccaagccaggcaugaaggauagaccagccuccaaaucuagaagacuuugugggacugauucuuauugcacugggcaggaggcagugaagaucuggguggauuaccuguuaugaaggcaaucccccugccuccaguguacugugagaacucagccuaccuggagauauccugguauacuaagcugugagucccccaagcuguaccuuggugugacuaagacacguaaagcccuguccugagcuucagguucaaguucacauucuggcuuauuuuuuuguccacuugccugaucugugcaagguacagagaccuucaggcuaauucaggaaaucaggguguagaaccagagguggucaccgacgucagagcaacagagcggccacauccccacugccaaagcugcacuggcuuuugauuuaguaaccagauuaggauggaacaggccuuagugaccagcagcugucagcucuacgacauugccagcagcaccuacucacuugggcacggaucacgcugacaggguuugguuucccggccgcugcccuugcaguucuugccacccaucuggggcacuggugaguugcagagacguaugcgggugacauugccaacuccacaagucacggagcaugaagaccagggugaccagugacuccagccuccauucugacggacuggcacaggaaacacaaagaggucagcaucccaugcugugacccugcacugggcaaaccccaagaucugucuuuccagcuaauccccguuuccacuagagagggcuguagagagagcacggccucacccaggagaaagcuucucaccaggaaaaaccuuccccuggggccauagccuccagacaccaucaaauagcugcuguuggcauacccacaugaggaaccacccacccuacccgggacacucacuucucguaucacauuugcccaggcugcauguccuugucugaauggaggggcccaggcagguguugcuggugacaucacaagaccggccucucugcugggucccagagccacaggugacagaacacucgguccacucugcccacggagaccagcccucaucacugucugcagcuagccaagaagguagacaaacacaagagguugagugcucccucuccacaagcccuagggagaucaggcacuacagccauauggggccugcuuuggggacuucggaauagggaagagcuuggcagcaagaaggguguaugggaagagcccaccaccugggcaagcuuaagugucuucaaaaggaagagaaugcugaguaaugaggaacaaguaaucuagaucuguuuagaaaagcuggcuccaaaaaaggaaaaagaaugcugagucuuauuuacaggagauguuuucaaggucaccaagaggccauuucuacauagcuucuauugaccuguaugagauaacaacaugccaaccacugguugaaauuagaagcugcauaguuuacuucuaaacacuuuaacgaaaauucaauacaagggcaacucucuggaauaaaauuuuuauagacacauaggguaugguuuaccugugcuggggccugggcuaaagguaaaguacauacauaguaggucuuuuaguagaugucccuuaguaggggccucucaguagggucccuuuggauaauggaagaaggaaaggagagcagccgcacagacaacacaaggacagacaaccuagcugucaguccauuguacccuugcccuugccaauauagggcaagcagacucgggcacccagcacugugguaguagcauugcuguauggagcagguagcugggauucuagaaacacaccaaaaggaaagaccaggauaaagacaggccagaggcaucccgaacacucagagacggugacugggugggaagggcuucccacucaugcuggggagccaccguugagcaccacuggaggccagauccaaagcacugacacagggauccacaggugaauggggguucugaguggagcagcuugggcacuucuagagagcaucugagccuccaggcuccugauguccggcccgcucugucuccacaguguuggaccucacagaacuggcuccgccaugguccaagucugggucacuuggaccaugucucuguuacuugaaucccucauugaguaagagucucugaauuuuguguuuauuuacuauaucacggguuuggaugcaacuguucacucagcguaggucuagcugcagcuccugacucagcggcuacugacaugagggccgccuucuuggccugggaguuggaacuuuggucccugcaggaucguuggggcccuccuugucugggaugagccagaacaggacagcugcagacacuuaacuucuagaacucucaauggcuuccuggccacuggcuaguggcugaagcggagccuagccacccucugcuccccuccacugccuaucucuaggaaucugggccucacccuccucuauucaagccacaaaacaaauuaucagauacuaagacucacaacaugcucaccacaggggacuuacagugugaacaggauggacagcacucgccuuccacaaaagauggguuggcacaaguugcaggugagcaggugaucugauggcagacuguuuuaaauuucugaaaguauagagaaauauauggaaaacaguccuuuaccauaaugggcauugucccaggagcuggauggggaaggucaguaggauggcuagauauuuuucugacuccaaauccuacuucaaauauaggguuugaccaggcccaaggggacucucugagcacccacacucuguccucccacugugagcagagagaugacagcaccagcuuuugaauccucugaguggggaagaaaaaggaugacagagucgucucagaucgccggauaacugaggucaacacaaggacaggggacaaucaggagaaacuaaaccgucugcauuuucucgucaucucugcugagcacugaggcccugucagagaugagugggaucaaaugcaaaccagaggaacacugagacagcucaguucccacugacucucuccacaggaaaaugcugagcaagccauuucacccucuggguugugaugucuuuugugcacagcacaaagagguccaaguuacauuuguguggacuuccauguuuaaggcucucuuacugagccuccuauguauuugagcaucauuuauacugaugugcugagcaggccauugccagccauuaagaucuguguaugucaauuugaacaugccuacccugugcagggcauaucugccuccaggaggacucaucucuggaacucaccuugcaggugcaugugguacaacuauccacaacccagguuucauuuucugcaaagauucggcccuccugcacacaggcugacauguuucuugucuucagagggcccccaaugagcuccaaaaggaacugguuaucacuagacuggaaacagaggugagagaugggagaagaaucaaaggccuuccuucaccaaggaggagcuuaggucuagcagugcaaacaucggguguaggugugacacuacugcacgcagacacuggggccugguuaagacagauaauacugcaaacccacauaaacuuugcaacaaagacuguacugcggagcucagcuacacacacggucuccaucgcuagcuccccuaccucuccucuguucacagaucauaucaaacgcauagucauccauuaaugaugucuccucaaccccugggcugaccaugccucauagaugcaagaaagacugccauugugcacagugggcagauaucaggggagaggggaggagcccauacaugauuggcacagaagaacacagccacaguuccagccaucuagacauuaugccagggaaaggaggcaaaacuuacaaaucagauaaacacgaauugaaaugcuacucaacauguacguauuugccuuggccaucucagcacucuauagguuucucccaaguuucccccaagaugaacuggaauacuaggccuuagggaucacaugaguguugcaaaccuacuacuacaaacacacacagaaacacacuacccuguggcuuugugcaaguucagggggucacacauuuccuugaccuuguguuaagggacccagacuggaauacuuggcagcuguagagaagcugccaggcccugugcucagcuccugccucuccugaccucuguuuugaggucaucuggcaagacacaugugagccucaguauuuucugguguaguaaggaauuaagugacaccacugguggaccaguccuaagaggcaaacugcaguagaagaggacucuucccacauaaagacagccucacagaacacccugcacagaccuugggggcggggcuuucucucccuggcaguguuugagaggagaucucccugucccuguacgauaucucacaaugucaggggcauuacagggaaggacaguuggaagacaauaugacucucccucuucaaagcuacagaacccucauucuggagcauuugacuguccccugcuuccacacacuucaggacacacaaucaugucugucagucuuacaaaacuguauggcacagacacuuguaaagccuguggcugcuccuuucaacacucagcugcucacaugagauggaugucuuuuacucucugggagaugcguuccucaucauuagagagcacauguguccccugacuguuuuuauuugcaacacuuuuaacaucucuccaucuucccucucacuaacuugugguaggccaggauuccugaagggccugaucugggugucccccugauguggcuuucuaaucagaguuucuccaaagcaaugaaguauugguccccagaggccugacuggcugucuggugaggcugccagagggcuggcuccugaggcuucccugacagacugcugucuguccccacuacccucauuuuccaccucuacccuccaccagguacccaccacucucuccagguucuugcucagcugguucaccaugacgugcaguccagagagcucauucaucauguugcucaacuccucgcaggagugcguacacaccuccugugccuucuccacacccuggaccacgagaucuguggugaugugagggcucagauggagagucucuguauguucacugaugguguugacuucagcuaaaggaaagagagaauuauagcggagcacagucucuggggagucaggcuugcaacuguaagcuggcacccauugacauggucaccagagcacaucccuagggugucaccucugcagcuauaaaccaauacccauaaauaucucugcuuucuuggaguggccacaugcucaauuguauccaucaacacaagaacauuugacggccacugcuuccaguuaagacccaugcuuagcaagaggaaccuguccuacuuccuaugauuuccugguagggcagagguccagacuaggaacagagaaaggcagagcagaacaaugggagacaagucucuuguaaugcagggccauacaucacauaccucaaucaaacugagcugagacacugccuuuuccucauccucgacccuaagucuauuccuccaacacauagcccaugaacucaccccuccccacccccaaccuuccuaugcaccaguucaacccgagugcccuuucaugggcuuccuuucagaauaaaagccuacuuagguaucugcaugucagagacacacccccaaggcacacguucuucucuccacacacuaugcucugcugccgcucauaugcagaugucacaguccuggcacaaucgcagggagucucccugggccaugcaugcacaugcuccuugacucccaaguagcucugagauaaguccagaaacagaguuauucccagucaagcuagagugaagaacuccagggaaggacaggcuccagggaaggacagacagacagaaugacaggaauucacuccacaacugagaguucauuacuuggguucaaaaucuuguugcgaucuacauggcuucugggagccgcuaauuuccagugugcuacuaaccguaaaaagccaugcuaguauaacuauuuuuaauaacuaaguagagggacacuguuaaauaguggauuuacgggagggcuauucaucauuuaucuucguuuauguuuuuaaaccuucaacuuaucuaaaauacuucuuuuucauaucuuagaguuaagcaaaauaaaccaaugugugccuuuguucacacuugccauggacaggcuuagacugaugauagaaaaauguuugagccagugugcaccucccgacacauaacagguucuacagcugugaaauuugagugguuuagccuugaaacagagaaauucccauuuuaacaaacauccaaaaagccaugcucugagaccaggcucacgaguucacucucugaaugaauagaauauucaaggcuggugugaccagcagaagaaagcagaagucucugucagggccaagacuuuaguaaagaacucgcagugggcccugaccuccaggugaacgcacauaaauccagcuauuccagucuuucucuucaucuuaagagaacagauuuagacuccuguguaaguguguuuuauuaagaaggguucagugccuccagauauguuuaaguguuugcuuguaauaguccuuuguguggcugacuuguaacucugagccaaaauauccgcugaagaaaguuauguguuagaauauguucagaagccccgaaagauauggucuugaucgcaggcuggaauaccuccucagaauggcuccugggagccgcuaauuuggaauuguuauucuuaaaauugggauuguuauucuuaaaaucuauucagaacugauccuugacaauuuaucauuuuucaggacuggagaucuaaacugagcagugaacucacccacagaggauaaaaacacuugaugcaaaucuccaccagggcacaaacacacauggcccagcagcaacccagcagaacaguacagaaacucuuagaacagagcuuacccaccucccuggcuguguugacagccuuucuugcuuaagauaucuuccacagaaucugcaaacacgagauggacauucugcagcaagcccuagagggagagaggaacagggcugcaggugaacccuaagcuugauggaaggugaugguacacugcaaaugcaaaauacaagacuccaauagcacugcucuauccaacaggucugaagguaucagucacccuauuccuauuauuuuuaaaaugcugcuauaacacacacacacauacacgcacgcaggguuagcauaaaaacuuucuaacuaggagaacaauaacuuuggagaagaauuagggaggcuuagggauaggcaacuucuguccucuguauauucucagguagacaugaugggcuauuuccucaaguagaacugaaauguguuauuguuguuugugauucaagucuucagaaacaucuagguucacgcaggagaagaaccaggagaaggaagcuaaugcugaaauaugacugggccagucagacagucacaguagccccugacaaaauauucuuaccuagaccuguuacugaaauaacuaaucucugacauacauuuauuuccaagaauaaaugcgugccugccagagggcaauggucagauauccaucccuucaucugcagugagaguggaaugaauacacucacucauuggaaguuaaaacaccacgggcagaaaguccauuuacuacacuugaacuugaagacacaccuuugguuguucucugagguuauagacugacuaggagucauagcuugccucugcccagcauugagaggaaggaccagagugcaauauuggugggccauaaaaagucaaaauacagagccucaguaugacuucaccaccagugaauggucuucaugccagagaaagaaugaauaaaccccaagaaagccauuagaauuggggguuaucuguguggacccgccauugcagguucuaaauucccaguuuuagaaggauccaaacuucuuaagccucaaugaagguuuggggauggggagauccacuuacaaagcagcagugguuuuuuguuuguuuguuuguuuuuguuuguuuguuuguuuguuuguuuuaaggaacucagucccucucuagugccucaauaacuucauucccagagcaaaggcuaggaugggguuucaggccuacuaaaguaacuugggguuuccuggaaaaugcggauucuuucccucaacaccugacucaggcuuccaagagcaacacaucugugacacaauucugcuucacauagcuuaagaauguguauucuauguauacugaguugauggcuuugaauaugugcacugaaguguggugcacaugugucugcaugaccucguacgugucccuuguguaugugcaauuguauaugucaguguuauacuuauaaguguggauguuuguuguguguacacauguauaaauguguguauuugugaggguauguggacacaauaugcaagcuucugcaugcuugugcacugaguguauuguauaagcuuacacauauaagcaagugcacucauuauacaagugugcacuugugguagauauauagguguguguacgugugugugugugugugugugugugugugugugaugugcaugcacaugugugauauguucauacacuugagugugcacaugugugugcuuaucauguaaguauagguuguugaacaagugagcauguguaauauauauaugaauguauaugcagucuauacaggugugcaaagugugcacacaugugccacaguguaugcuacaugcuucuccaagggaggaucacauccuuuccaacacaaaagcuacacugacuugccccaugcuguaagcucccuacaaggcucuaucccaugacugccacgcuauguacgcacccugaagugacucucucgagaugcaccuuuggccacguacauccugcuccugucuacuucuagcugcucauagaaugguucuuccagggugacacugucgauaagaucgcagcccacauacaggcuauaggugucacuggccaccugcacagucacauucuuccacugggagucagccaggcccacauccuccaggaaguugguaugcugauugccuucuacccaguaguugagguccaaaguguccccugggccauuggacacaaucucaaacugccucugggaggugccggggccuuccaacaccaggagcguuccccgagacuugcgguccugcuucaguugggcugugaggaagaagcccuccuuucuccuugcaagcuugacaauccuguugagaucaucuguguucacuggggggauguagucaaaccguacaaaacgguaggcgggcaccccggggucaggcccucggaacugcuuggcaccgauggucuuccgguuaauguugcugaugcugaaaaggucaaaugaaguguccuugacguggucaccagcugccaaagggaaccacagggucacaguuaucacaggcugaugcugaggcuuuccugaaugcagacuggagagccauaagccauaagcucacaagggcuucccccgcgacaaggcucagagacuuucugugcgucuuucucucccacccuagcugagccugagccggcuacccacuaucauggaggcuggcuuucuccaggacuacagugcagcagguguucugggccuucccagaacccagaacauggcuucauccauaaacaacaucucacuggaggcccugaauuccagccccugagcccugcuguucuuugucccagauuugggcaaagcacagccuccccuccaucuugggacuggggaagagggaggcuggaagggggaccuuugacuuuaucgccauccacuaaguccuauguugcauucugaggaugauauucuuucucaaacaucuucucauuucuauagaaagacugccaauaaauaguaaauacugugcacuaugaaccaguauuugagacaacaauggaccucacccuaucaguaacucuuugaagucaccauucagcugccaaugagaaaaucaucagaucucaucaaaacuaaacaacaauucaaaauaagacuagaaugauaaaacacagcacagcuucucaucaugcacugacaaccgaaaacacagaauaaacugcuguguauagaggcauaaauguugucguuuuuauaaagguauugacagugacacaauuaaaauaauuagacucugugacuauuguuacuaaauauggagguccaaguuuuaugaauuauuuuauaaauuauacuaauauaccaaggacaagcugugugaaguaaguaucucacuacuagaugcagugcauuggucucaauuccuaguuuccaaaagacaaucucucugugcuauacagacucagaaaucuuugauuuuuuuuuuauuuauuuacaagcauguuuaaaaagcuucauaugcaaaauacgacuacaaccacuugcuggucucucgucugcagcuaauucaccauugcacacagaaacaagaagauauauccauacucaccagaagcucuuggcccuaugcccagagccagcagggccagugcccagagcaucuugucuccaccugugacacuuaggagaaaaccaaccucgugguugaagagugcacagcuacagccugagugucaccaggaaguuucuucacgugaccuuugaaaaacagauuucacacaaaaucaaaagcaaauauaacugugggaagcaaaacucuagauaauauacuuucuuuccaaccagauucuuccaacugcuacuagcauuuaucccaccacuucucccuggcauggaggugaggggguccugaggccucuugcuguacuaacaccauaacaacccgggguuccugugagugugagugugccugcucuuuggaggagccaguggaagauaugccagagcauuguuucccuggggacucugcuauagcucaguugcaagacuuaaguccaggagaccugaacccaggcaaauauccuggcugauaagacucuggaaaggcuucuuuguaaauguccaggaaaaccaguuaugcauagcuucauuacaggcaaucaauacuaacuacauuucgaaguuuggaauaaacucggugcauuuuucucaggacaagcagaaacuuucccucagcgagggcuuuagccuacuuuucuguucuccugcaggccuguguuuccauuugcagggauucuaaguuggcucagcagacccuggaucagaagucggaggccuggccugaagccugguuccucugcuccucuguuaacuccuuaagggcuugcuuccccaugcucagcucucagcucccccuccaacaggccagguucuguuccaugucauucccugcuccguggaaacugauccgugcacuguagucccucaucucuguaaagauggcuacaaugggauaacuucucauugagaaggacaucucagcaguuccccucuccagaauauuuuugcuaagcuggaaacaaugcccuccaccaagggacaguuuucuccccagagggagacaauggggcaagaacuuggucuugccccaugagcagugcuuauggacugagcgcuagguacauuucaggaggcagccaaauacaccaugucaccugagugcuaacaccagcuuuucuaaccagguggaaagagggcaaucuuuucacccucccacuaaguugcuuuguccauggcuugaaaaaccugacucuuaaaguaucaacuucucuagaugcuagagaaagacccuaugcaaauaaauaucuccagagcucuuugaggcacagcaaacacucaggauguggaacuguggcugggaggacucccaaugucaguucuugaggugacauuuuucugaggauucaaguauaaaguagaccuugucagguacuuuagagaaucuucagaguccacaucugaagacuccagcuugcccuaucccugagucccuagugcagguguuugccacagggcagcugccccugaacuccauccccaacuuucuccuuauucuauggacaaaugcugucucugcaaagacaaguuccaucuuaaaaugacauuuuacagcucaggcauacaaacacaaacagaguccauuaaacuguguuucgguaaaaccaagcucaaucaagagugucacaaguaaucaacggucauuaacagcaucccaucuaaucuugcugccuuccccacauggaaaagggaccaagaagugaauaguauuugguccuggaucaagccuccuggggccaaugcaauugcauccaagcuccaugggucacacacacacacacacacacacacacacacacacacacagacucuuccccauccacaaguccucacugcagguuaugaguagacuuucaaagguuuucugcaacaggcuauuaucacuuuuauaggucuuacacaaguucaccccacaggaacaaucgaagugaaaguguguuugcugggugucucuaaacaucuucaacuccuacuguuuugccccccuccccgcccuccuccuucagcaccagaucacuuucuuuugacugccccaggcuaccagcucuuuuguaugcaaauuagccaagcugcaacccaaacacaguccccucaggguucuccccgcccuguacauuauaauuauaaugacagcaacacuuguucagcucuuacuaauguuuagaaucagaucccuauaaucccguugguuauuuuuuacauuuucaagagaucucuugacauuccuuucucugcuuucucuuccauagcaaacuuugguagagaaacuuucuuauuuuuaaguagaaaaugucaguucccccucccugaaccccagcauccuuggaaugaagccaacaagccccuuguugcuucacaggguuccugcuaugagagaccacgaaagacacuccccacauccccaaccccugccaccccggggacaaagacagcagugaauguucuuggcaggucaauaaguuugcagagcaaggacggugaggacgccacugggcuaagugucagaggacacagcuggacuuccccuuuagaccccuggaaaccguagccuuuucugaaagaucacagccagugaaaugucuuagaaauaaaaagguaccugguguguuugcaagugaauggugaccgacgccaguacucugucuguccugagggggacuagcugcggcaggagaggagaggccuggccagggaggcugcagacaucggacuggcucucucugccucccggcagugaccggcuccuuuauacgcccuuuccccaggaggccugucaaucagacacaugcggaggcacguuuaauucauucuuucgaaggagugucauaauucguccucuggucucgccauuugcucagaguaccugguuacccaguccaaauccagccccucagagcuaacgccccuccuacagguccacccaggcuuuccagaca

SEQ ID NO: 8392 - RNA, 28814 nt, Mus musculus
ugucuggaaagccuggguggaccuguaggaggggcguuagcucugaggggcuggauuuggacuggguaaccagguacucugagcaaauggcgagaccagaggacgaauuaugacacuccuucgaaagaaugaauuaaacgugccuccgcaugugucugauugacaggccuccuggggaaagggcguauaaaggagccggucacugccgggaggcagagagagccaguccgaugucugcagccucccuggccaggccucuccucuccugccgcagcuagucccccucaggacagacagaguacuggcgucggucaccauucacuugcaaacacaccagguaccuuuuuauuucuaagacauuucacuggcugugaucuuucagaaaaggcuacgguuuccaggggucuaaaggggaaguccagcuguguccucugacacuuagcccaguggcguccucaccguccuugcucugcaaacuuauugaccugccaagaacauucacugcugucuuuguccccgggguggcagggguuggggauguggggagugucuuucguggucucucauagcaggaacccugugaagcaacaaggggcuuguuggcuucauuccaaggaugcugggguucagggagggggaacugacauuuucuacuuaaaaauaagaaaguuucucuaccaaaguuugcuauggaagagaaagcagagaaaggaaugucaagagaucucuugaaaauguaaaaaauaaccaacgggauuauagggaucugauucuaaacauuaguaagagcugaacaaguguugcugucauuauaauuauaauguacagggcggggagaacccugaggggacuguguuuggguugcagcuuggcuaauuugcauacaaaagagcugguagccuggggcagucaaaagaaagugaucuggugcugaaggaggagggcggggaggggggcaaaacaguaggaguugaagauguuuagagacacccagcaaacacacuuucacuucgauuguuccuguggggugaacuuguguaagaccuauaaaagugauaauagccuguugcagaaaaccuuugaaagucuacucauaaccugcagugaggacuuguggauggggaagagucugugugugugugugugugugugugugugugugugugugugacccauggagcuuggaugcaauugcauuggccccaggaggcuugauccaggaccaaauacuauucacuucuuggucccuuuuccauguggggaaggcagcaagauuagaugggaugcuguuaaugaccguugauuacuugugacacucuugauugagcuugguuuuaccgaaacacaguuuaauggacucuguuuguguuuguaugccugagcuguaaaaugucauuuuaagauggaacuugucuuugcagagacagcauuuguccauagaauaaggagaaaguuggggauggaguucaggggcagcugcccuguggcaaacaccugcacuagggacucagggauagggcaagcuggagucuucagauguggacucugaagauucucuaaaguaccugacaaggucuacuuuauacuugaauccucagaaaaaugucaccucaagaacugacauugggaguccucccagccacaguuccacauccugaguguuugcugugccucaaagagcucuggagauauuuauuugcauagggucuuucucuagcaucuagagaaguugauacuuuaagagucagguuuuucaagccauggacaaagcaacuuagugggagggugaaaagauugcccucuuuccaccugguuagaaaagcugguguuagcacucaggugacaugguguauuuggcugccuccugaaauguaccuagcgcucaguccauaagcacugcucauggggcaagaccaaguucuugccccauugucucccucuggggagaaaacugucccuugguggagggcauuguuuccagcuuagcaaaaauauucuggagaggggaacugcugagauguccuucucaaugagaaguuaucccauuguagccaucuuuacagagaugagggacuacagugcacggaucaguuuccacggagcagggaaugacauggaacagaaccuggccuguuggagggggagcugagagcugagcauggggaagcaagcccuuaaggaguuaacagaggagcagaggaaccaggcuucaggccaggccuccgacuucugauccagggucugcugagccaacuuagaaucccugcaaauggaaacacaggccugcaggagaacagaaaaguaggcuaaagcccucgcugagggaaaguuucugcuuguccugagaaaaaugcaccgaguuuauuccaaacuucgaaauguaguuaguauugauugccuguaaugaagcuaugcauaacugguuuuccuggacauuuacaaagaagccuuuccagagucuuaucagccaggauauuugccuggguucaggucuccuggacuuaagucuugcaacugagcuauagcagaguccccagggaaacaaugcucuggcauaucuuccacuggcuccuccaaagagcaggcacacucacacucacaggaaccccggguuguuaugguguuaguacagcaagaggccucaggacccccucaccuccaugccagggagaaguggugggauaaaugcuaguagcaguuggaagaaucugguuggaaagaaaguauauuaucuagaguuuugcuucccacaguuauauuugcuuuugauuuugugugaaaucuguuuuucaaaggucacgugaagaaacuuccuggugacacucaggcuguagcugugcacucuucaaccacgagguugguuuucuccuaagugucacagguggagacaagaugcucugggcacuggcccugcuggcucugggcauagggccaagagcuucuggugaguauggauauaucuucuuguuucugugugcaauggugaauuagcugcagacgagagaccagcaagugguuguagucguauuuugcauaugaagcuuuuuaaacaugcuuguaaauaaauaaaaaaaaaaucaaagauuucugagucuguauagcacagagagauugucuuuuggaaacuaggaauugagaccaaugcacugcaucuaguagugagauacuuacuucacacagcuuguccuugguauauuaguauaauuuauaaaauaauucauaaaacuuggaccuccauauuuaguaacaauagucacagagucuaauuauuuuaauugugucacugucaauaccuuuauaaaaacgacaacauuuaugccucuauacacagcaguuuauucuguguuuucgguugucagugcaugaugagaagcugugcuguguuuuaucauucuagucuuauuuugaauuguuguuuaguuuugaugagaucugaugauuuucucauuggcagcugaauggugacuucaaagaguuacugauagggugagguccauuguugucucaaauacugguucauagugcacaguauuuacuauuuauuggcagucuuucuauagaaaugagaagauguuugagaaagaauaucauccucagaaugcaacauaggacuuaguggauggcgauaaagucaaaggucccccuuccagccucccucuuccccagucccaagauggaggggaggcugugcuuugcccaaaucugggacaaagaacagcagggcucaggggcuggaauucagggccuccagugagauguuguuuauggaugaagccauguucuggguucugggaaggcccagaacaccugcugcacuguaguccuggagaaagccagccuccaugauaguggguagccggcucaggcucagcuagggugggagagaaagacgcacagaaagucucugagccuugucgcgggggaagcccuugugagcuuauggcuuauggcucuccagucugcauucaggaaagccucagcaucagccugugauaacugugacccugugguucccuuuggcagcuggugaccacgucaaggacacuucauuugaccuuuucagcaucagcaacauuaaccggaagaccaucggugccaagcaguuccgagggccugaccccggggugcccgccuaccguuuuguacgguuugacuacauccccccagugaacacagaugaucucaacaggauugucaagcuugcaaggagaaaggagggcuucuuccucacagcccaacugaagcaggaccgcaagucucggggaacgcuccugguguuggaaggccccggcaccucccagaggcaguuugagauuguguccaauggcccaggggacacuuuggaccucaacuacuggguagaaggcaaucagcauaccaacuuccuggaggaugugggccuggcugacucccaguggaagaaugugacugugcagguggccagugacaccuauagccuguaugugggcugcgaucuuaucgacagugucacccuggaagaaccauucuaugagcagcuagaaguagacaggagcaggauguacguggccaaaggugcaucucgagagagucacuucagggugcguacauagcguggcagucaugggauagagccuuguagggagcuuacagcauggggcaagucaguguagcuuuuguguuggaaaggaugugauccucccuuggagaagcauguagcauacacuguggcacaugugugcacacuuugcacaccuguauagacugcauauacauucauauauauauuacacaugcucacuuguucaacaaccuauacuuacaugauaagcacacacaugugcacacucaaguguaugaacauaucacacaugugcaugcacaucacacacacacacacacacacacacacacacacguacacacaccuauauaucuaccacaagugcacacuuguauaaugagugcacuugcuuauauguguaagcuuauacaauacacucagugcacaagcaugcagaagcuugcauauuguguccacauacccucacaaauacacacauuuauacauguguacacacaacaaacauccacacuuauaaguauaacacugacauauacaauugcacauacacaagggacacguacgaggucaugcagacacaugugcaccacacuucagugcacauauucaaagccaucaacucaguauacauagaauacacauucuuaagcuaugugaagcagaauugugucacagauguguugcucuuggaagccugagucagguguugagggaaagaauccgcauuuuccaggaaaccccaaguuacuuuaguaggccugaaaccccauccuagccuuugcucugggaaugaaguuauugaggcacuagagagggacugaguuccuuaaaacaaacaaacaaacaaacaaacaaaaacaaacaaacaaacaaaaaaccacugcugcuuuguaaguggaucuccccauccccaaaccuucauugaggcuuaagaaguuuggauccuucuaaaacugggaauuuagaaccugcaauggcggguccacacagauaacccccaauucuaauggcuuucuugggguuuauucauucuuucucuggcaugaagaccauucacugguggugaagucauacugaggcucuguauuuugacuuuuuauggcccaccaauauugcacucugguccuuccucucaaugcugggcagaggcaagcuaugacuccuagucagucuauaaccucagagaacaaccaaaggugugucuucaaguucaaguguaguaaauggacuuucugcccgugguguuuuaacuuccaaugagugaguguauucauuccacucucacugcagaugaagggauggauaucugaccauugcccucuggcaggcacgcauuuauucuuggaaauaaauguaugucagagauuaguuauuucaguaacaggucuagguaagaauauuuugucaggggcuacugugacugucugacuggcccagucauauuucagcauuagcuuccuucuccugguucuucuccugcgugaaccuagauguuucugaagacuugaaucacaaacaacaauaacacauuucaguucuacuugaggaaauagcccaucaugucuaccugagaauauacagaggacagaaguugccuaucccuaagccucccuaauucuucuccaaaguuauuguucuccuaguuagaaaguuuuuaugcuaacccugcgugcguguauguguguguguguuauagcagcauuuuaaaaauaauaggaauagggugacugauaccuucagaccuguuggauagagcagugcuauuggagucuuguauuuugcauuugcaguguaccaucaccuuccaucaagcuuaggguucaccugcagcccuguuccucucucccucuagggcuugcugcagaauguccaucucguguuugcagauucuguggaagauaucuuaagcaagaaaggcugucaacacagccagggagguggguaagcucuguucuaagaguuucuguacuguucugcuggguugcugcugggccauguguguuugugcccugguggagauuugcaucaaguguuuuuauccucugugggugaguucacugcucaguuuagaucuccaguccugaaaaaugauaaauugucaaggaucaguucugaauagauuuuaagaauaacaaucccaauuuuaagaauaacaauuccaaauuagcggcucccaggagccauucugaggagguauuccagccugcgaucaagaccauaucuuucggggcuucugaacauauucuaacacauaacuuucuucagcggauauuuuggcucagaguuacaagucagccacacaaaggacuauuacaagcaaacacuuaaacauaucuggaggcacugaacccuucuuaauaaaacacacuuacacaggagucuaaaucuguucucuuaagaugaagagaaagacuggaauagcuggauuuaugugcguucaccuggaggucagggcccacugcgaguucuuuacuaaagucuuggcccugacagagacuucugcuuucuucugcuggucacaccagccuugaauauucuauucauucagagagugaacucgugagccuggucucagagcauggcuuuuuggauguuuguuaaaaugggaauuucucuguuucaaggcuaaaccacucaaauuucacagcuguagaaccuguuaugugucgggaggugcacacuggcucaaacauuuuucuaucaucagucuaagccuguccauggcaagugugaacaaaggcacacauugguuuauuuugcuuaacucuaagauaugaaaaagaaguauuuuagauaaguugaagguuuaaaaacauaaacgaagauaaaugaugaauagcccucccguaaauccacuauuuaacagugucccucuacuuaguuauuaaaaauaguuauacuagcauggcuuuuuacgguuaguagcacacuggaaauuagcggcucccagaagccauguagaucgcaacaagauuuugaacccaaguaaugaacucucaguuguggagugaauuccugucauucugucugucuguccuucccuggagccuguccuucccuggaguucuucacucuagcuugacugggaauaacucuguuucuggacuuaucucagagcuacuugggagucaaggagcaugugcaugcauggcccagggagacucccugcgauugugccaggacugugacaucugcauaugagcggcagcagagcauaguguguggagagaagaacgugugccuugggggugugucucugacaugcagauaccuaaguaggcuuuuauucugaaaggaagcccaugaaagggcacucggguugaacuggugcauaggaagguuggggguggggaggggugaguucaugggcuauguguuggaggaauagacuuagggucgaggaugaggaaaaggcagugucucagcucaguuugauugagguaugugauguauggcccugcauuacaagagacuugucucccauuguucugcucugccuuucucuguuccuagucuggaccucugcccuaccaggaaaucauaggaaguaggacagguuccucuugcuaagcaugggucuuaacuggaagcaguggccgucaaauguucuuguguugauggauacaauugagcauguggccacuccaagaaagcagagauauuuauggguauugguuuauagcugcagaggugacacccuagggaugugcucuggugaccaugucaaugggugccagcuuacaguugcaagccugacuccccagagacugugcuccgcuauaauucucucuuuccuuuagcugaagucaacaccaucagugaacauacagagacucuccaucugagcccucacaucaccacagaucucgugguccaggguguggagaaggcacaggagguguguacgcacuccugcgaggaguugagcaacaugaugaaugagcucucuggacugcacgucauggugaaccagcugagcaagaaccuggagagagugguggguaccugguggaggguagagguggaaaaugaggguaguggggacagacagcagucugucagggaagccucaggagccagcccucuggcagccucaccagacagccagucaggccucuggggaccaauacuucauugcuuuggagaaacucugauuagaaagccacaucagggggacacccagaucaggcccuucaggaauccuggccuaccacaaguuagugagagggaagauggagagauguuaaaaguguugcaaauaaaaacagucaggggacacaugugcucucuaaugaugaggaacgcaucucccagagaguaaaagacauccaucucaugugagcagcugaguguugaaaggagcagccacaggcuuuacaagugucugugccauacaguuuuguaagacugacagacaugauuguguguccugaaguguguggaagcaggggacagucaaaugcuccagaaugaggguucuguagcuuugaagagggagagucauauugucuuccaacuguccuucccuguaaugccccugacauugugagauaucguacagggacagggagaucuccucucaaacacugccagggagagaaagccccgcccccaaggucugugcaggguguucugugaggcugucuuuaugugggaagaguccucuucuacugcaguuugccucuuaggacugguccaccaguggugucacuuaauuccuuacuacaccagaaaauacugaggcucacaugugucuugccagaugaccucaaaacagaggucaggagaggcaggagcugagcacagggccuggcagcuucucuacagcugccaaguauuccagucugggucccuuaacacaaggucaaggaaaugugugacccccugaacuugcacaaagccacaggguaguguguuucuguguguguuuguaguaguagguuugcaacacucaugugaucccuaaggccuaguauuccaguucaucuugggggaaacuugggagaaaccuauagagugcugagauggccaaggcaaauacguacauguugaguagcauuucaauucguguuuaucugauuuguaaguuuugccuccuuucccuggcauaaugucuagauggcuggaacuguggcuguguucuucugugccaaucauguaugggcuccuccccucuccccugauaucugcccacugugcacaauggcagucuuucuugcaucuaugaggcauggucagcccagggguugaggagacaucauuaauggaugacuaugcguuugauaugaucugugaacagaggagagguaggggagcuagcgauggagaccguguguguagcugagcuccgcaguacagucuuuguugcaaaguuuauguggguuugcaguauuaucugucuuaaccaggccccagugucugcgugcaguagugucacaccuacacccgauguuugcacugcuagaccuaagcuccuccuuggugaaggaaggccuuugauucuucucccaucucucaccucuguuuccagucuagugauaaccaguuccuuuuggagcucauugggggcccucugaagacaagaaacaugucagccugugugcaggagggccgaaucuuugcagaaaaugaaaccuggguuguggauaguuguaccacaugcaccugcaaggugaguuccagagaugaguccuccuggaggcagauaugcccugcacaggguaggcauguucaaauugacauacacagaucuuaauggcuggcaauggccugcucagcacaucaguauaaaugaugcucaaauacauaggaggcucaguaagagagccuuaaacauggaaguccacacaaauguaacuuggaccucuuugugcugugcacaaaagacaucacaacccagagggugaaauggcuugcucagcauuuuccuguggagagagucagugggaacugagcugucucaguguuccucugguuugcauuugaucccacucaucucugacagggccucagugcucagcagagaugacgagaaaaugcagacgguuuaguuucuccugauuguccccuguccuuguguugaccucaguuauccggcgaucugagacgacucugucauccuuuuucuuccccacucagaggauucaaaagcuggugcugucaucucucugcucacagugggaggacagagugugggugcucagagaguccccuugggccuggucaaacccuauauuugaaguaggauuuggagucagaaaaauaucuagccauccuacugaccuuccccauccagcuccugggacaaugcccauuaugguaaaggacuguuuuccauauauuucucuauacuuucagaaauuuaaaacagucugccaucagaucaccugcucaccugcaacuugugccaacccaucuuuuguggaaggcgagugcuguccauccuguucacacuguaaguccccuguggugagcauguugugagucuuaguaucugauaauuuguuuuguggcuugaauagaggagggugaggcccagauuccuagagauaggcaguggaggggagcagaggguggcuaggcuccgcuucagccacuagccaguggccaggaagccauugagaguucuagaaguuaagugucugcagcuguccuguucuggcucaucccagacaaggagggccccaacgauccugcagggaccaaaguuccaacucccaggccaagaaggcggcccucaugucaguagccgcugagucaggagcugcagcuagaccuacgcugagugaacaguugcauccaaacccgugauauaguaaauaaacacaaaauucagagacucuuacucaaugagggauucaaguaacagagacaugguccaagugacccagacuuggaccauggcggagccaguucugugagguccaacacuguggagacagagcgggccggacaucaggagccuggaggcucagaugcucucuagaagugcccaagcugcuccacucagaacccccauucaccuguggaucccugugucagugcuuuggaucuggccuccaguggugcucaacgguggcuccccagcaugagugggaagcccuucccacccagucaccgucucugaguguucgggaugccucuggccugucuuuauccuggucuuuccuuuugguguguuucuagaaucccagcuaccugcuccauacagcaaugcuacuaccacagugcugggugcccgagucugcuugcccuauauuggcaagggcaaggguacaauggacugacagcuagguugucuguccuuguguugucugugcggcugcucuccuuuccuucuuccauuauccaaagggacccuacugagaggccccuacuaagggacaucuacuaaaagaccuacuauguauguacuuuaccuuuagcccaggccccagcacagguaaaccauacccuaugugucuauaaaaauuuuauuccagagaguugcccuuguauugaauuuucguuaaaguguuuagaaguaaacuaugcagcuucuaauuucaaccagugguuggcauguuguuaucucauacaggucaauagaagcuauguagaaauggccucuuggugaccuugaaaacaucuccuguaaauaagacucagcauucuuuuuccuuuuuuggagccagcuuuucuaaacagaucuagauuacuuguuccucauuacucagcauucucuuccuuuugaagacacuuaagcuugcccagguggugggcucuucccauacacccuucuugcugccaagcucuucccuauuccgaaguccccaaagcaggccccauauggcuguagugccugaucucccuagggcuuguggagagggagcacucaaccucuuguguuugucuaccuucuuggcuagcugcagacagugaugagggcuggucuccgugggcagaguggaccgaguguucugucaccuguggcucugggacccagcagagaggccggucuugugaugucaccagcaacaccugccugggccccuccauucagacaaggacaugcagccugggcaaaugugauacgagaagugagugucccggguagggugggugguuccucauguggguaugccaacagcagcuauuugauggugucuggaggcuauggccccaggggaagguuuuuccuggugagaagcuuucuccugggugaggccgugcucucucuacagcccucucuaguggaaacggggauuagcuggaaagacagaucuugggguuugcccagugcagggucacagcaugggaugcugaccucuuuguguuuccugugccaguccgucagaauggaggcuggagucacuggucacccuggucuucaugcuccgugacuuguggaguuggcaaugucacccgcauacgucucugcaacucaccagugccccagauggguggcaagaacugcaagggcagcggccgggaaaccaaacccugucagcgugauccgugcccaagugaguaggugcugcuggcaaugucguagagcugacagcugcuggucacuaaggccuguuccauccuaaucugguuacuaaaucaaaagccagugcagcuuuggcaguggggauguggccgcucuguugcucugacgucggugaccaccucugguucuacacccugauuuccugaauuagccugaaggucucuguaccuugcacagaucaggcaaguggacaaaaaaauaagccagaaugugaacuugaaccugaagcucaggacagggcuuuacgugucuuagucacaccaagguacagcuugggggacucacagcuuaguauaccaggauaucuccagguaggcugaguucucacaguacacuggaggcagggggauugccuucauaacagguaauccacccagaucuucacugccuccugcccagugcaauaagaaucagucccacaaagucuucuagauuuggaggcuggucuauccuucaugccuggcuugguaaggaaacucaggcuucuggcuguaaaagauuguaagaauuuuauuuuagaggcaagaaaaucuaucagaaacucuguaauaauauugacucccugaaucacagcuguguaaaucacaguagaccaguccuccauuuucccuucuaccccagugucuucaacuacacuggaauagccaggauaucagccucaucuuccuucugaucuugcuagugccagucauaucugaauccuccauccuccucucagucaccuucccugcuucucucuauaguugauggccgcuggagccccugguccccuuggucagccugcacaguuaccugugcuggagggauccgugagcgcucacguguuugcaacagcccugagccccaguauggagggaaggacugugucggggaugugacagaacaccaaaugugcaacaagagaagcugcccuauuggugagugagugugugugugugugugugugugugugugugugugugugugugugaaaggagcuguuccaugggugacagggcaugcauacuugaauguauguauguauguguacccauguguguauauauauauauguguguguguguguguguguguguguguguguguguguguguguguguuuguguguguguguguguguguguguguguguggcaucuugucuuagcccugucucccauccuccaugcagaugggugcuuauccaacccguguuuuccuggagccaagugcaacagcuucccugauggguccugguccuguggcuccugcccagugggcuuucugggcaaugguacccacugugaggaccuggaugagguugguaccucugccuuggguagcugggugucuuaugaagaucuggagagaggcucacuucuguuuguccucacagugugcuguggucacagauauuugcuucucaacuaacaaagcuccccgcugugucaacaccaacccgggcuuccacugccugccuuguccaccacgcuacaaggggaaccaacccuucgguguuggccuggaggaugcuaggacagaaaaacaaguaagugguucugaccuugccuguguaucuaaaggcuugaaagagucugccaagucuaggcaaguggagaagaaauggaaaggaagggaaagggcagccuuguugggggaggaaugcagagaggagccuuucuuaugaaagccucccaggcucuguucaucugcugccucuucuaccaacacagaagaauccagauguuuucaugcagagggcccaugaccuucaggguagcaaugacaccuuggucaguuuuggauacuauagcagaagaccaaggcuggguagggauacaggacaaagauucauuucucacaauuuuagagucuggaaacacaagaccaaggaccagguaccuaguucauguuucugaguugucauugcaugucagaagccagagggaugaggggagggagggaaagagacagaaagagagacagagagagugagcuugagcacugaugagcugaaguuggagggucccugaugacuauacacuuccaaugaggcuuugaagcuaccacacuuggauauggauucuaauccaugcccugggggucacaacaaagccauggcaagcaguguuacacaacaaguucaaaaaugauguuuauauggcucagauaaccauuaaaaaauacuugucgacuuccugagaaaugucaaaaucucuguguccucucacaaugagcuagucucuucggauucucagggguacccguggccaacuucuucccuaguaaguccugucuguauuucauauuucucuugauauucuaggugugugagccagagaauccauguaaggacaagacucacagcugccacaagaaugcagagugcaucuaccugggccacuuuagugaccccauguacaagugugagugccagauuggcuacgcaggugaugggcucaucugcggggaggacucagaccuggauggcuggcccaacaacaaccuggugugugcuacuaaugccaccuaccacugcaucaaggugagagucacagucaccucaggcuaagagcuaggucucugugcuucagucccuucuugagccauugucaggggucugugucuuaaucccucuucagucaguauaaggagcugugccucagccccuuucuuaaguguaggauucugccacuccaucuagcuucaucagugaggagucugccccucaguccucuucagucagugcaaggggcugccccaccccuacccagugucucuucagugauucacugccaggagagauugggccaauuggaagcaaugaucuaaacagggagacacuccaaauuaucuuguuccuuccuacacuccacaugaacuuccuacucugagacuggaccauguaggagcaacacaucuucucacagcugaagggaugaagagagcgugggucugaugugcacugggcacaggcgucuacccaggagucuaccugaagcacugaaugcaacugggcuuccuuuucuucccauuccaggcaucguuaggaaaagcagcacauguuaugaaaaguacauauguacacacaugcauaugaaaacauacacaaugaagguauacacauauaugugcauacacacuauguauguauaaacauacaugcacacacaaugcuguauguauacaggcacacuauauauguauacacacaugugcauagcauacacacacauacacaauguauaggcacacaagcacacacacuaugcauguauauacccaugcauacaugcacacacaguauguacauauacauauguacacaaacuauguaugugaaaauaugcacacuugccuguacacacacacacacacacacacacacacacacacacacagagagucgagaaaaggcaucaaugugguugaaaccaaagcugccuugcccugcccugcccugcccugcccugcccugcccugcccugcccugcccugcccuacccugcccugcccugcccugcccaucuucagucccucaguugggucccugcagcucauuugggucacagcacaguagacagaguagagaggcuuuuaugcuguugcaugucuaucaaaugugaagagcuggagugguguucuucucccuccuucuaagcuuccuucagugcagaauugcaaagcuuagacaauguacagcugugagaggucuuccuccuuugagaccugcuggccggugaggacugagcuugcacgcaugcuggagcucuuaguucauuugaugagcugggggaaagaacaggaugcuaagcaucuggcucugcaccucuccugggacaggcgcccucaccucccucuguucucucaggugucugaucccuuccuggggucuggguucagaacagggcuccuuuugucucuccucacgugcagcagugacauaauucucaggguaggacucagaacagcacacguccaggacagcuggcuccgaugcucgcuccgcuucuaucugaggacuuguaucagauauuuauauccuuggcuucauaauucuuguuuuauuuuccccgauuuggagagaaggacacuuuggaaugcuuucaugguuguuauuucuuucccaaaucacaggacaacugccccaaacugccaaauuccgggcaggaggauuuugauaaggauggaaucggagaugcuugugacgaggacgaugacaaugacggugugagcgaugagaagguaggaugagcgcuguucucaagcaccgagaaguuggaagagauggggauuccgaggcugcucuucugacauauuugugaacagcucccaaagaucacccauagagaaaguagucccugaaaauacugauuagugggugcacagggcucccugggguacaacgcagaaagugcucauaacuucccuuuccuuaauugccucaaaagaccuuauucgcuuccuuuucuucuggugcuugaugcaaguggcagaugcaaucagaagguuuaacaugggcucauauagcuccccgaggauggcuucucuauggugagaguccaugcuuucccuuccuugcacacauccauccacacacucaccuacugucucaucugugacuuuccugugaaggagaggagacugccacuuugcaauaggaaaucucaacacucagggagacaggacagcuguguauggaacugcgaaaacacaggaugcugagccguugccugugcagggcuaacucgcucauuuucucugcuuccuuauugguggucuacuccugaguauugaguugucuuauggcagccugauugccuggucuguguucuuccugaugucuuuuucuggugauuuuuaggacaauugccagcuucucuucaauccccgucaauuagacuaugacaaggaugagguuggagaccgcugugacaacugccccuaugugcacaacccagcacagaucgacacagacaacaauggcgagggggaugccugcucuguggacauugacggagacggucaguggcucugcucacuuuagugacgcagaucaggguuaaugguuguaagugagccagcacuuuguguacuaagguucacagccacaaaucaacuaaccauacagaaagaggauguacagaacaugcacagauuuguaaauuuucauuuauuugugugugugugugugaaaggcagagggugcugcccuguguguguggaggucaggaguugguucucuccaccuucuugaggcaggaucucucugguuucuguugcacuguguacucuagacgagcuguucugagagcacguaggugacucuucugugucuuccauacaucucuccauagaggugcugccaaccacagaugcucacugcugcaucuggcuuuuauuuguuuugucuuaauguggguucugaggaucuaacuuggguuaucaggcuugugcugcaagcacuuuuagccacagagcugucuuacauuguaacccccagaccuuuaccaugcuguucaucuaaacaacgaaauuacaguauagagauggcuuuuaaguauguaggggauucuaacuagaugguuuguaaacaucacuuuauuuuguguaaugaauuuggacaucuggauuuugguaucuuuguggguccuaguagcagcccuccaugugugccuggagcaacugcaauuucaaacaucuuagaagagcucaauuuaucuauaugcuuacgaaaaugauucccuaaauaacuugccuuuucccacaagccugagguccaucuuagaaaaucacagcuuucugcacuuucuuuccuugcugucagacccacagcugcuucaucugacucuuucacugcaucuucugcagugaauacucucuaaaucaucccagagcugcauccaacugcuccgagaaggguaugaggagguuguuugucuuacuucuacucagguuucuuauuguuuauugauaaggccuaaccacgggaccugggaaccaagacagguagagcgacacaggugugccccgugagcucugacauauuacugcaggcugacauuuuacccugagaccuggcgucuucuaugcaagagcccagagacugaccacuuggaacucaggcuccgcucucucagagugucacuguagacuaggagacacucagaucacugcucugcuugacuccucuguguaccccaugagccucacccccuccucaacgaugcacagccuggaguuccuucauccccucugacucuacccugcuauuuagacccaucucaaaguauaugcucuuguagaacuuuccagucagcuucugcauccaaccuuagccucaggacagccucgaucacucugccuucuugaagguugaugcaguuagcaggcaccucaugucuguccuaaagugggcuggugccucuguucugccagcuggggugucagcuucuuauacccugucauuuuaaggguccuuucuguuccccaaaauggucucuucuuccuuuggcuuuaucuuccuucaguuugccacuuuauccuauuauuauuauuauuauuauuauuauuauuauuauuauuauuauuccuuccguacuguuggaccucguucccuauuuucagauuucuaagacccuugccgauccaucugcaccaucacuucucucccacugucugugaacaaugaggaaucaucacccagaggcucuugugugccuacagacuuaacucacuuucugagaucucagugggaacagccaaaacagcaagcgcagaggacacaccacacucacccucuucugacugggcagcauugcccagagaaucccaaacacucauuauauuuuagguuaagggaauuggauuuuuuuuuuuugaggcagggucucacugggaauuugauguuuaauggaaaauauuucauauucucuucaaugaaucuaauaaucuuuaaauuuuugccauuuuucuagugaaggccuguauguuauccaguaugcugggaaaaugaugcaacuucucuaaacucagccugugccuacuuuguuucuuucaccaacagauguuuucaaugagcgagacaauuguccauaugucuacaacacugaccagagagauacggauggugauggcgugggugaccacugugacaauuguccucugaugcacaacccagaucaggugaugagauguguccaaacagggcucugugauccccagcuguugccuggagaugagccuugagggugacccauauccagagcaggguguuccucauccuuaaacagcuugauaaaggugcuccggugugguucucuucugcccugccaagcaugacaacauagcuugcuauaagcucaguugaaacaucuuacagagaccaaaucuaagcacuuuauaucuagguggccccaggccaagggaggaagugacuuucccacacugucugggggaaaauuagucuccaugguuauccagaggcaaacccagaacuagcuacauuuccaggcuugccuuugaaagggaccugaagagugugacuaggacuauggucugcagaguauacaguaaugguagagaaagugguuccuaugauaccugagugguaguuagcaauaagaaguccccuaugagauggggcacuggcugggaaagccugcacccagaagccuccaauccaagcucucuucugugaggacagcaagugagccaucauaccccauuuuuguaccuuaucccccagugcuggccuguaccaagagcgggugugucucuagucuaguccccgagucuuccugugcuuccucagggaguauucauggugcucacuugcugcucugucccccagaucgaucaggacaaugaucucguuggagaccagugugacaacaaugaggacauagaugaugacggccaccagaacaaccaagacaacugcccauacaucuccaacuccaaccaggcugaccaugacaacgacggcaagggcgaugccugcgacucugaugaugacaaugaugguguuccagaugacagggacaacugucggcuuguguucaacccagaccaggaagacucggacggugggugccuucuucaguucacaugugccuugcaaaccgcacgagcagucccacagaggcagaacuccgguuuggaaguucaaaaauaagcaggauggcuaucuaaggguguugggcacaggguuggcugguugucugucuagccugcuggaagcuucagcuucuucauguguguuuaauauucuaccaaugagagaggugagguuuguuugugagugccaggaagaggaaaccuuucagcuucuggguacuuuugaaaaccuuuggcaaacacuuugaaagagauaagguucacugaaugcagccagugacaugauggggagaggauucauaaauagggaaggugcgacauggaaggucuugcacaucaguggucuguagcugugcaggggcuggaggaugucacacuccaggaagaccgcaguccugaauaacaaagugcacagcugcgcuugcugauaggcuggucucuaacucccucccaaugggcaggaugauccaagcucccuuuggaacacacuuauccugaacaaauggaggccaggaguccugggguguugagccaaugugacucagaagcacgugaaaagacuggccagggaccaagggcagcugcagcauucucccagcacaggaaagaaugcuuucagcagagagcccccagcuugaugcagacacuggugcagacagugggagguggccuuuggcucaccuaggaaggggacugggaagaagaggcgagggguauuuuuauuacuuuuaagaugcuguugcugaggcuggggaauagauuaauugguaaagcacuugccuagugugaaaacucagcacuacauagacaaggcauagcgaugcgugccuauacucgggagggagaagcaagaggaccauuaaaaaaucauccuuggcuccauauugccaguuugagaugagccugugcugagguccugucucaauaaaagaaaaugccuguacaucuaauuauguuucccacaguggggaggcuacaguauugaauaccagaacugaaaauugguuugaagaauggggaaaucaagauaucaaucuagauaccaaauaugguuucuuuucuuccuuuugaaauaagaggucauagcagagugccugguuaacuccaucgccucugccuuggggcaucucacuguggccgaggacaggucagcuguaagauaaggcaugaccuagcccccuuugcagaccaaccucauugggucugaucucccuaggggaagucaugugugcuggaaagguucuacuuuaagugccaaauaaauuaaaauggcuccaguuacugagaaugacagugagaagugagcuuagagagacauuagcagcagccaacucucuguuuucaacuuugaauguagggaacagagcuugggcuuaucgcacuauccuuggcuguaguguuugcagugaggauguuuuuuaaaagcaucccugggaugccuuauagcuuuacaagcucaguguuuuggaagcaguugacccucaaaccacaauuaauuacaaggugcauagccucaaaucuuacagacucagaggucucuguuuauacacaugaagggaaaugcaaaccaccuaacuugucccccuuggguucauuucuuccuuauccauaggugacggccgaggugacauuuguaaagaugacuuugacaaugauaaugucccagauauugaugaugugugcccugagaacaaugccaucacugagacagacuucagaaacuuccagauggucccucuggaucccaaggggaccacacaaauugaucccaacuggguaauucgucaccaaggcaaagagcuggugcagacagcaaacucagacccuggcaucgcuguaggugagccugagauccuguggguaguucagagagaccauguggucaggauuuaggauaauuuuucugguagccuuacccuuccuugguauguggaauagucucccuucauaaucugguuaagggcucugggaaagcacagguuugcaacucucugaccuauggaauuugguguucaguaagccagcucauguuauggacucucugaaacaauacaugagacacuggagcuucugucacaaaacugucagcugggucacaaguccuuuugcugcucucucagcgaagagcagagguuaucuaagcuaaucuaagcucuucagauccacguuucugugagauggacuucugaaguucccaaugugcuuuucucugggccaccagaccauccauguuuucucugcacucagguuucgacgaguuugggucuguggacuucaguggcacuuucuaugucaacacugaccgggaugaugacuacgcuggcuuugucuuuggcuaucagucaagcagccgcuucuauguggugauguggaagcaggugacccagaccuacugggaagacaagcccagucgggcuuacggcuacucuggugugucacucaaagugguaaacuccacgacugguacuggcgagcaccugaggaaugcccuguggcacacgggaaacacagaaggccaggugagggacggggcaguugauggccauuuccagacagacccugcacuccuaaccuguuccaaagagauacccuucugcccuuaauuuuaaucaaauagcaaucauuuuaauaguugguguggaauaccuacuuuauugagcacgaaaugcccagugcuucugguuggaaagacugaacacauguccagucuuuugcagagacaggacuuacagugucaguuuuguucauagcuccacacccaagaagcagaagguaugaauucagauccaugacuaucugggucaaguguucaugcucuuaguguuaacacacccaacacuggacuuaggugcacacuguagucucccauaguagaguggauaguaggguagaugauacagcauuugaaaguagaacauacaaaauaaaauguauguacuagggagguaguacagcaaguggaguauuacuuugcacaguccagggcgagaagaauggaagggaggcacauagcucaccuuucaacaaugcuccuauuccacagguccggacucuauggcaugaccccaaaaacauuggcuggaaagacuacacugccuacagguggcaccugauucacaggccuaagacaggcuacaugagguaagggcaguugcacauugucagugguaggcuucaucccagugggucggcuaaucuuuuccauuaaacaaccagucugccuuuccauuggauggccagauagauuuuuuuucaucaaauggauggauagccuguuacccauugcauagauaacuuuuccauuggauggacaaugugcuuucucugucuaccuuccuauuggagaauaucaauaaguaacuaugcuguaaugagcacuuuuauauucuucucuggauuccuuaguuuuaaauguccuuucuugucuauuuugcauccuuucuauacauuacuuacuuuuaaaaaccugaaaaauaagccaugucuuaaauacuuauuggcugauaugcaaacuaccccacacucaucuggauggaauccaccuuuuuuuguagauaauaagcaaauacucuuccacuuagucuuacuccugauggcuauccagugucugcagaucccugagggucuggguguguguguggggggguguaaugucccugcaaagaggucccaucugucauggguuccaucaggaaauucugagggaucacuacccauucugagccagggagaugagacucgggaucuucagggaaaaugaaagcuuugggagccacacucagggaguaccuggcucuaaggacacacacacacacaaacauucaagaaacauccuuuacucuuuacacugccuuggcuguuaaaggcagcacugcacuuuguagucacuggcuuauugcagccauauacaccaagggugcagcagcuuugccugugagaaggaaugggcucugaagucucugcugcaugacaggaguuguuguuccuaaagggaaagcaagucuuguucagacccugagcagagaguggggcuauagaucccuuuuggguugucuggaugucacucuaugguagaucagagagcacuugaauagcauauacaaggccaugcuuucauccuuagcacuaaacagggagacuagauuccucuuagccaacagcuggcauuuaaaaccaacgacagaccgcuggugaaugugcuucugaguucaaguucucuuuugucuuuuacuuccuugccuguuuuagagucuuagugcaugaaggaaagcaagucauggcugacucaggaccaauuuaugaccaaaccuacgcugguggacggcugggccuguuugucuucucccaagagauggucuauuucucggaccucaaguaugagugcagaggugaguauguguucccaucagggaaguggucccacaggagcaggagggacuggcauccauuuuucugccuacagaggcuucauuccagggaaaugaacuguugcuaugagcuggggcuucugcccuucccagcaaagaugugguuuagggauauaguuccuuccuuccuuccuuccuuccuuccuuccuuccuuccuuccuuccuuccuuccuuccucccucccuuccuuccuuccuuccuuucuucuuuccuuucucuuuuauuucuuuccuuccuucuuccuuuauucuucuuccuucuccuccuccuuucuucuucacuuucuuccuugauaguucuuuuguuuuaaauugaaucugaaugucuuugguaguacaaauacuuucugaccuccacaggcuguuaucuggcacuguacugaguccuagagcuuuuuguuuccauacuuccugaauuucuagggucauuuuagauuacuaucucuacuaaaaauugaaauaggaaaggaaaggaagggaaaggguagaaaggaggaaggaaagaagauggagugagggaggaaaggcggccccuucuuaguuauaccacuagaaguuaauuuaucugaaccaaaauauaaaccugaaagcaaacuugaccagucaagucuaaugacaugccuuuuacagagaucaguaaagcucaaaaauguuucucaguacuuaugcauugaaaaugauacacacaucaaggagaaguaaagccaaggacauuguuuucuccccuucuuccacugaagaucuuuacacaugucacuauuccacugaagagauuuauuuuuucuuaacuuauccacccauuaauacaucaaucuacacaugcaucuuuccaaacagcuauuuauccaucuauccauccaaaugccuacuuauccaucuguccauucacccuucugucuuucuaucuauucacucaucuacuuguuuguccacacaccucucugucauuuaucaaucuguucuacuuaucuaucucauguacgcaauccuaaaguuaaaauaaugguaucugaggccauguauguaauauuagcccuggggagcccugaggccagucugagcuacauagugaauucugggcuacaacuguaagauagaaaaacaaggaaacaguaaaacacccccuaguuguuucuuccuaauccuguuguuccuucucuucuagaugccuagagagcagggcuccagcuccagcaaugugcugcaaacaccccuucuuagacacaucaguccaucuuggcacuuguggcuuuucugucauuuggcauuuccuguuucuugaccuuaacugaguggaucuacaccuccuucaucagcaccaaguccaagugucuucaaaggagaaacaucaauugcacuccaagagcuuccagccugcugcuggaaaacauuuggaugagauaugaggcucaccguggagcgaagaccgagcauuccgcuguguugccuuuucuuguuuguuuaaaaagaaugacguuuacauguaaauguaauuacuugcaguauuuauguguauauggagucgaagggaguauuguguuuaagucauucucauaaauuaagcaugaaaaauauggcucacuuacccucagugcuuaauguugucacuguuuuuggauucgugcuguucuauaaugacacacaaauccugugaggcugaacaggaagaaagaucaggugaacucggcugcaguaaggaagaggccagaagacagucaugugagacuguggccccuuguccagugauuugaaacauuaacuaauuagaacauaggaagugaucgaaaaguuagaagaaacgcaguucuuacuuggccacaguuaaagcugacucgacagagacaaagaagcugcauccuuugaaaggggaauauuucaggguuccagcuguaggcuucucagagcuuucagaagaaaaccucagcagaggcaauguccauuucagcugccugccuggguugggcaguguggaaagcauaccuggcuggacgucaucaggcucugcauacucugcauacugacugcuaggaucuuugucugggcauccuuuccugucccugcugcuaggaaacagacuggcaaauaaguuggcagaugcacuuugguacccuguuccuacucuaggcuuuagaaugaugcaaaagcugcuuuugccaaauuugguaaugcauuuccuuaagguuccagguacggcucuuuuguuaauauuuauuaaaugauuuggaauauagcuucacucaucaauaauuuauuuuaaacauacaaaguaacaaguauguaguauauaauuucuagaaauaagcauaugacaaggauauaaugauauaaagacacacuuacaaauaucugcuguuugaaauacaaggauuuaugucaugauagaauggaaccuuaauaugcauccuuaccaauaauuuuaauucaguucuuuuuacuauuaucucuuuguuguauauagguucuuuuuauuuuaaugcuuaaggaaacaucauuuguuuuuuccagacacacccauuaaucagucacaucauuacagacauaugcuugauuuauuuuauuuuguuuuuguuuugcuuuaagcugcaugaucucccagcaggaaguacugccucucucacuucacacgagcucaguggaagaauauuuugucccucuggugggguaguucacaguccccuuucuaguaauggcaacugcauuucuaaguuagacagaaagaauccacgauuuugaucugaguuuccacaauuugucuagauggaguuauuuguguugaaaucucugagggugaguuuccuuguuucuuguuauccugcacuuuuuagauuuuuguggaacuguauucccaaggccagcacaggucaggagacuucuggccaugagggugugaagaacauuuaggcucucacuugggcauuugguucaaugguacaagguggugggagcgaugugaauacauucaauguaccauauuauuuuuguaaauuauuuauguaguuuuuuuuaaaaacagaagcuucucauauacguuaaugaaacauuguuuuuuuuuuuuugccaaagauuguaaauauuuauuuauuuguucauuggguuaaauuucaccacuaaaaccccucauuuagcuagagcuucauuuuuauaccaaagauuaucaacagcaaauaaauuauaaaaagguuucuguaaauga

SEQ ID NO: 8393 - RNA, 9239 nt, Mus musculus
guuagguguuagauaauuuccuuuauuauaguauuuccaauauaaacucuuuuuauuccgaaaguuuuaaaccuucaaaucuuaagaggcuugagugcggaaauaguaauugaauaaacauuauuguugcuuugagaaacaucuuucacugaaucugagcucgagugugugucuuccucugaauaguuguuucuugagauacuugaugccuugcaaagcucgcagccugcugccgucucccucggcgugaugaaacuagcuuccugucuggagcgagcccucggcgacgugagugugagaauccucauggaugaacacagaacuucagaucucuugcuuucuauuacuguuuuucuguaacauacaacgauucucuuuguacauaguuaagaaauccuaccuaguucuugugagcugggaaaugacucaguaaacaaaacaaaaacacuugcuccauaagcacgaguaccugaacuuagauuacagcaccugugguuaaacaaucaaaagcuauggaugguugcuucugcaccuccuguaacaccacccuguguggagaugggguggagacaggagugggauaacuggggcuuucuggccuccauucuagcuccaguuucaauaagagaccuugucucagggaauaugguggagagugauggaggauucugccuuucuuuggccccuaggccagaugugcagucaccucguacauaugugcuugagagcacuugcaugugugcacgggcaugugcacauauauacacacacaaacacacacauaggaaaggaaaucugugucuagcugcuuuucuuuguuccuuuguaccacacuucauucauuaugcucuguuuaaaaauuaucacugcugauuaucauguaauuauuaugugauuucucuuuguuuagguauuuuuacugguugggaaagagugccccuuucuccuaagagaucuucuugcaucugcagagcuugcacaagucuuuggacaugcugugguaagugugcaaauucuacauaaagcauagaguagcuggcaugagcugugcuuuugaucuuccaaagcuaaaguacucugggaagacauuuaccguuuaaccgauuaaguguauucgucucucuuccuucuggaauugucucucucccacauaucccacaggguuucucucuccagauuugauuaugauagaauaaccauaaaauccagccagagagguaguuagaagcauaucacuuuguucauuuaaguauucauaaugauauuacugagucaccauagacuauauuuaccacuuugggaugguaguauuauaucuuuguccuaaaauacuucuguuuuuaacagguaggaauuuaugcuuuuugcagccauucagacuuacaguggcauaauguguguguguguuuguguguuauauauacuauauaacauuauuauuauuguuguuguuguuguuauuaugacgauuaugaugauguagccuuuauaauuuccagaauauucuagaggaacuguaaccaagagacuucaaacuaaagggugacauguaggcagcucagagaggcagaagaccagaacagccauccuaguuguaccagagauccaccaaauucacauuuggggcugagaaaccauccucaguguauguaccuucacccccugcucacucccuggccagcuugaaaauaauuuucggauggagagccugagcugaggcuggaguauggacucuugcuuacugagucauuaaacacauuuuauucccauuaaccaugucccucugaauggacacuuuuguccucuagaugauuuucuguucuuuucuuuuuuuuuuuuauuagauauuuucuuuauauacauuucaaaugcuaucccgaaagucucccauauccccccacuccccuacccacccacuccccuacccacccacuccccuacccacccacucccaauucuuggcucuggcauuccccuguacuggggcauacaaggggccucucuucccaaugauggccgacuaggccaucuucugcuacauaggcagcuagagacacgagcucugggggugugugugugggaggguacugguuaguucauauuguuguuccaccuauaggguugcagagcccuuuagcuccuugggugcuuucucuagcuucuccauugggggcccuuuguuccaucuuauagaugacugugagcauccacuucuauguuugccaggcacugacauagccucauacgagacagcuauaacagggucccuucagcaaaaucuugcuggcauaugcaauagugucuggguuugguggcugauuaugggauggauccccgggugggguagucucuggaugguccauccuuucgucuuagcuccaaacuuugucuguguaacuccuuucauggguauuuuguucccuuuucuaaggaggaaugaaguacccacacguuggucuuccuucuucuugauuuucuuguguuuugcaaauuguucuagaugauuuucuuagcugcugauaaaugguauauaaaaugggggaagggaacaggguucugaggcugcuccggagagauguggcuguugacauggauguuggguuaaaccccucugagcuucucaccugcugguucugcuugaggggcccagaaagcauuuuucccucugcucugcagcagcccacacaaaccaagacugcuucccugucuucccugucuucccugagggcuggcugguguucucucucuugcgagucugugcaggagguagggacacaggacuuggauacagccuaguuggagcugcuauucucauccuucuuaccauauaggcccaugcugccugguauggaguuugugucugcgcuuucugcuguguccagauccugggugccucugaugucuaguguuaaagcuguacauuuugagugcguggcuugcuccuagcccuaggacuacuuugccgguccugguuucugaaacccugggcucaucuucuucacuuguguuacuuuauaugcacagggggaaauauuauugccguccucaacggugagucuagggauaaaugaauugaugaaucauuaaauaaaaugugucuagcauguguuaaccacuuaguaaauguugguuucaggccagugcaauagcucacugggggcaggugccugccaccaaggcugacaacaauucaaauaguagcaugcacuuggugggaauaaaucaacucccucagguucuccucugaccucuagacauuggcacauaccgaauaaaaauguaauaacauuuucauguuaguuucauuauuguuacuauuaacaccagcagaagcugcuggcuuucuuaggacuaagggagaaagcaaacauuuuaggcuugaauugauuuacuccacgauucccuaaucugcugucuuacuggauuagauggacauacuaaaagucuucaucgggucucccugcggacucaaccugagaaacgucuuguggcauggcuuugcuuccccucaagauauuccuccaaagugaguugcugguuaaguaacuuucuuccuuaaucugcuuaagaauuugcuguauuuggggcuggagagauggcucagcaguuaagaguacugacugcucuuccgaagguccugaguucaauucucagcaaccacaugguggcucacaaccaucucuaguggaaucuggugcccucuucuggaguguccgaagacagcuacaguguacuuacauauaauaauaaauaaauaacucuuaaaaaaaaaaaaaaaaaaaaaaaaaagaugaguucgaggccagccuggucuacaaagugagugccaggauagccagggcuacacagagaaauccugucucgaaaaaccaaaaaaaaaaaaaaauagaauuugcuguauuugaauuucacaagaaggaaggauucuuugugaaagacaaaauauuugagacauggguggucaaguuguccaccaacagcagagcagcgugggugggacagaauguguuucagugccuuugcuccuaggaacaagcguaggugccaggauagguagaaagccuuccugguuauuauacagcuuaauuccaucuauggagaguucugaaguuugaugguuuccuuucuuaauucccuuaauuuuuuuacacucauuuauucaugcccauauuguauggaagucaaagggaaauaguggggaaugguucucuuuccaaaugcaggccuaaggauugaacucaagacaucuggcuuggcuauagaugccuuucccugcugauccaucucaauccuccuggcauaauuuuaacacucucuguugaaggagagaucuuuguauguggcucuguucauuuuccaggggcucucugucuccuucccuagauacuguucagccauguugcuguugacggcaggacugggccaguuacugaagaguuaccuucaccacacaaaggucaccuuggcacaucgaccuuuuguaacacucacaaacuuagaggaugugauuguuuuuccuggcaaguccccccuuacuaugucuucguaaagguauuugcgcacucacuuuguaaguaguaucagacuugaauucuuggugaaauaugcgcuugccguugccaagauggcucuguaaguuauuggaagacccuuuuaaacuucaccccuucccacugcuuggaugcuauuggcccugagagucacagcuagagcuggucucuuccucagaugugcuaccauucagaaaucuugggggcauucaugguaucuguucuucuuuccucucaccuugucuacaucuguaugaguggccauuauaucagaugugccaauagugaaaauugcuguaucuucugagacuacuucuuuuuuggggggaggggguggauuucgagacaggguuucucaguauagcuguggggcuguccuggaacucacucuguagaccaggcuggccucgaacucagaaauccgccugcuucugccucccaaguggugggauuaaaggcgugcgccaccacgccuggcucugagacuacuucuuacuccucuaggucaguguccucaacucgcuugagccccacucucaguugcugcccaagucucugaagagauccaguugcccauuuuuccuuuuggcaacuuccuaaggccacuuuacuguagcuguaggccagguacucucccuuuuuagggaugcucugccucaggccacaguucaucugucccagggugcuggcugguugacaugucuguccacauguguuccugacaucuuuccguugcugacuaugguuguguuuacaaagauacuugcucuuuuacaggugugacuuaugagguacugucagcauuagagacagugaugacaaaauccaacuuccuauuaaaaaucauguugccauauugggaaauggcagugagcaaguucaagucgcacagguaacaaggguggcauggugcuauuuauuggugcuaagacgagaggccugcgcaaugcugaggggguagaggugagaccucucagauuaggcugagugcagaaugccuuccuuuggugacucagacaagcccugacugguugaaauauucuguauaaucuucuuggugcuauugauagagcuuuuuuuuguugcuguuagaauaagcuucuuuguauuuuucugagcucuuacuauaaguaaaauauugcaccuaucauaagagaacuacaggagucggggagggaggaagacagacaagccuggccauguauucccucaaaaccaaagccaugcaagagccaggcacagcauguuuuuuuccucagcuacucccugcagcucugcagcucugcagcucugcagcucuguucuggccauccucagaagugauaugcaguguuuauaggaccuuauuggcauuuuguucuacugaaacuaugaaaagguuucaucaagcuuuaaaacaugccccccccccaaaaaaaaaaagaaagaaaaaugguuuuaagucauuagucuauuuagaauuggauccuaguauuuugcuuccacauuagcaaguuguauauccuuguuuucaaugccauauuauuuguguugaggcugcagugcaguaacugagacaccugcuaauagacucuggucccccagguuugccgacugcaccauguuguugcugucacagcuagaagcuggacucaggagacuguuugcugcaguuaacaaguguccugauagacugcucacagccgagguacaaguguuucuguuacucacucaaacugcaauuacuauguugacaauugucuguggcuauuuaaaaguuuuaagggcuggagaugcagaauguuagcuaagcacuugcauaauaugugcaaaaccccagauucaguccuuuacaacacacacacacacacacacacacacacagcaugcuuuauuugcuguuacagcauauauuuauuugaauugugauuacauaagaugguucuguuuccaaacugcccuuucaacuucaugguguugcaaaagcaucaacauuuucugaagccagaauuguuucugauuuugcagaauacugcuguucuuuuuaauuguuucucuuuuuuaucuucccuuuucugcagucaacaauucuguauaccacguuugaugaaguaaguagccaaacuugggaaaaaaaacuugaaaaaauguauuuucuuucaagauacaaaugaagaugcaaugauuagggcuggagagguggcucagaggucagcagcacgugcuuuuccugcaggaccuggauuugguuccgagcacccauauguuggcccacagccggguguaagcaugcacaugguacacauacauacauacacgcaugcaaaaauacccaaugcguguaaaauaagugccuuuaaaacccagaaagauuaacuaugaguagcaugcuuauaggaagauguugaugguaauaggcaagaagaagaagcucaugcaagguuucagcuauagcucuggggcugcauuuagugaaggcagugcuugccuggcagucaugaagcugcgggcucaaucuccagcacugaauauacccagcauggugguacacaucuguaaucccaacacucgggagguagauacaggguuugaagccagccuguaauacaugaaaccguuuaaaauaaauaaauaaauaaauaaaguuuuuaggcuaauuuugaggcccaacauuguuaaucuuauuucuguaguuguucaaaacacaaaguuggaaaaugcagauugacaccauuggcuauaaccacugcugugaacaacuauuuuuagccagggcaacaacuuuggaaauacaaauguuguaauuguauguguacagauuagugucucuguacguguacguacaugacucuuguacaugugucaguuuaacagcuuauugacucaucuauguuugguguucuagauacuggcaaaacacaugagugaugguagcaugaaccagcuuccuuguuuccuuggagagccugccaugguaaagcccauguauccccagucucgcgucuuucugguuaugaacaucauuuguggugugcucaggagccggccugcuuggccugucacagacaccaccagaagcgacugcagccacuucugugcuucugagugccugaugauuuggcugcccucuuucuaaauacuuuuuuuuuauugauucuauguauuuuuacuaaagaaaggauuauauauuuguuuguaaaacuuagcaacagucagauaucuuuaagauuaaguguugggccggguggugguggcccaugccuuuaaucccagcacuugggaggcagaggaaggaggauuucugaguuugaggccagccuggucuacaaagugagugccaggacagccagggcuacacagagaaacccugucuugaaaaaccaaaaaaaaaaaaaaaaaguuuaaguguuggaugauacaauuaauguuuuggcccuuuuuucaaucagcauuuuauauuuuguaagaauacuacagugacuucucuguagacuacaguagauacuuucugucugccuuacugagagaagagcuggauuauaugccccauucauuccuuaugugauuuuugacacccuuccugcccucagacaguaagaugacuaaucuagcugauuuuuuuuuuuuuugauccugaauccccugguguugugcuaagucuccaucgcaaauaugccccggcaaugaaaacacaacacaauuaauaugaauacaugcugugcgccuagauugggcagaucuaccacuacacuaccaucuuccacaucuuaugagaccccuuagaacuugccauuucuccaggcuaugugcuucugcucugcuuuuuuucuucuucuuccuccuccuccccugaguugccucucucaaaucuccuucuccccaccaccccuuuccccuccaccuucccuuuauuugcccaaucaucagcucuccuuuauuuuacaaauuaagguggggagcagcuuuacaggaaaucaccugagugcugacucauuccuuguucgaagucacucuuaagagcagaauuaacaucaaauauaauuagcuccagugcuauccacaacacccuggacucuuccucuguuggcagucaguccacaugagugcuuuucugacuccccacccccaccccgcccccauagucuggcagaggcaggcuuuggccauguaguguuagaagagggagcagccaucuuugcuggcuuaagaugcaggaguaguccauggugaaugcaggggaagcaguggccaagggacagcugcuugguuaugcuccucccagcaagagcagugacuuaggcuucuuuagggaaguuuguuucccuucccuuggugguuggugcucccuccccuccaccccccacaggcaggcuguacugaacaagggcuccccacuacaguuccagcugcaggauggggugagugcccucuuugagacuugcauuucccaucaguuuauaaacaagccaagaacugccaggauacccugccauucacucuucaucugcccagaacacugacagaauguuucucugucaauucuaaaaggaauucuugugggauuuccugaacuaucaggaggguccucguauccgggaucguauaagccauggggagaucaacauacgugaauuuccagaagaggccgcaggccagcugcucacauucucccuggugcugcugcucagauucacugagaaggggacagug

SEQ ID NO: 8394 - RNA, 1179 nt, Mus musculus
cuagggcuaggcaaaugcuaugcaaucucucuguacugagguacagguuagcccaauaccaagucuuccugacguggaaucuuacuuaggcauuuuuuagacccuguggugaagauggggcuuccugggcaagcccugaaauuaucuugaugacgcuugauugagcacaucagucccauaugcuugcaucuucuuugucagguaagcucacauacacaagaucugaugcaaaugugcaugugaccccgccccccagacacacacacacaaacacacacacaaaggaggaaacuuucauuugcuacgagaagccacucagugacuggugugaugaucuuuccaggcagcuggcucagagacacaggcaguguccagugacaccacaccagggauacugacagauuuuauagcaguuacaaagaggugagcauuccuugggcuaacauaauuagugacaagucagaauacauacauuuuaaagagaaagguuuuuuuuuuuuucuugaugugauuuuuauuauuuuuuaaacagugaaagaaaacugauuuuggugcaguuuuaugauugcuaaugcaguuugcacucacacaauuauaacagcacacagcaggagaaaagaggcugaagaccaccauaucacccugggaaugacucacuggcccacaucuauagucuuaagugcuuucuucuucuuaauaagcugucucuauuuauguuucuaaccaugugccugcccuugguucaauucuugaagcaucuaagugcuuggcuaaguaccccugggacaucccagugaguaccuucuggacucagaucuugccuguggaguuugguuuuggcaaagugcaauugacuaaacuugucuuuauccuggugcuuugccuaccccaggucccuuugugccccauguguuguauucuguuugcaacaugcagaauguugcaaaugcuguucucauucauucugcacguuuuaaagacaauaaaagaaacaaaagcuucuauugaccauaauaccaccauuucuuucgcuuuuuguucaguccuaccugaagaauuucagugauauuucguaaaacacaaaucuauuggagauaaacuaccacugcuucucaaucccagaacauuuguauuuuguguuccuugcugauggauagauacucuugcuggguacaaaag

SEQ ID NO: 8395 - RNA, 1812 nt, Mus musculus
cugcuucuaugugguggaaaaacuccuuuggcugcaacugcgguauagugcugaggccaggaacgcggcaaauaucgaagguccagagcacgcaccacaaccaaccgaaagcucagagagaagucaaagaaagcuaauccuugaguguguugcggugaccagguggccacagaaaccucugugagcagggagaugagccagcuuuguccugcagaggucccagcauaagcgaaggcuguaauuuugccaaagucgaggagugggggugggugcgucuuauuguuacuccaagcauuuuagcuucccaguacaagacugcacgcugcaaaacaacguugaaacucugcggaagauuggcuagugauucgaagcgcacaguaagacuagaaauggcaguggggggggggggggguucggggggagacagcaguagagagcccugcagacacaggccaugggugagggaaccagcaaggagccaccauguuuggggcccucugcuacgauauuuuaaaacggauuucagagugugcugagcagauggucacagcagacugcugugccagguguguuaaugaggcaagucaguagcauuccuggaguuaccaaggauacucaguuaaagcggggcaggagccucaggugaaaaccuggaagcgccggccucacauuugcaugacaaaaggccaagaccuggggcugugccaggcuccgccuccuucugcuggacacgugacucccuuguuuguuuuguuuuuuuucucuuuuuguuucucccucggagcgucuuggagacccgcucuuugccuguaacuaagcagcaggcguuuaugcucuaaauagacgguguuuguaauuuuucaccccaguuacccuagaaaucucucaaaugacuucuuuauauaagcagccaucuaacuccaucagcaccacccacuggcccuguccucagaggauaaugagccaggaucggccagcuucccuuguugcuguuucuuaagcccccauggcauagcagagucguccucccuuuuaucucccugugugcgugugcguguguugcgcaugagcauaguaugauaaugcuaccauacacccaccgggagauuccggugaacaggaugggggcaggcagaagggggagcaaccaggagaaucagaaauggagagagccuuauuugcaaccugucagggggcauggcuuuuuguguguaauaaacacgagauuuuugguccccugcaagcguggcacacacaucuucuaguauguaccaugcuaccagggauccuggaacaucacaacucagcacacagucauuucuuagaaauauauguccccaagugcaugucccucaugccugccaacauguucacugcagcucaggcugcuagggacagugugaugaggggaaccccuugcagcaagcccaaugccauuagcacuggagugcuugggcaguuaaguguguaucccuaguaacuccuuagucaaaaccaacccucuguuucagucaugaaauguagcugagagacugugagacgguccaucagaaggaaggacaugauuuuucuacugcccagaauucgggaauucgggaccagggagcuaccaccacuguggacugaguuccugaaaaaguuguaucuuuguuuaggacucuggggguuuaauaagaacuucauaauuggguagaguuggaauguugcagguccagagccagaaauauaucuggcucuuuuauaggcauuuaccuaccccuauaucugaccuaaaacucuuuagaccaccagaaaaaaaaaaaaaaaaaaaac

SEQ ID NO: 8396 - RNA, 9203 nt, Mus musculus
caguaaacaaguggguuucacggggccugcagccacacccguuucccgaaccaggggguggaggagcuugugugugggggcaagguauggggcuagaggggcuuuguguuggccagaaagcaaaauggagaagcaaacuguagggacaggguuugaugguggagugagggugauacaggaaugggugaagggagggaaggggacgauggaaagacauggaggaaaagaagcauugggauugauggguauggaagaaggauggagagggauaggaauggaaggagauacgagguuggcuguagacccuaaggaaaaggaggcuguucagaccucuacagccccacuguagacuuacuugcaagaguugagugagucagucuuugguguacugugaugacguaacuucugugccgugguccacagguccuuccauuccuguuaguugaucuuuuccugagcacuggcauaaaggauggcuggccacuuggaugcuucucacaaaccuggaccauaagguacucacggcaugaugaccauggggucacccguaaccauggucuucuuuggaggguuugagauguacccgcucauggcuguacucugccagaccaggguuucugguguuucuccucacacuggcucuggcuggcgcccuccagugugccuuuccaaggcaccgugagggauugucuuguaugucccagcucagucuugaccuucagugugaaccuggcucaucauuguugcuucaacacacacaccaugagaaacauggucacuccaaucuaacucuccaccaggucaccugugaaauggagugagcugcugaggcgucaaagguacaggccugcagccuucccuccaacacugcacugcaccaagggcagacacugcucugcagaagcauggccuggccaacaauggguccucagacugagaccugguccuguccaguaucgugugccuccgaccccaaguggguaacugggaggaacagaauccuggggacucugccacagcugaacuaucugauguccacauaccgguuucuuauuguuuguggcuauagccuauccauuuauuccugcaaacugcagcuuuccugccgugagugcuccauuuagacagugggugugagauagaaacaguguagcaguccacgcucaucacccugguguuacuuuccaccccuuggucagagguaugucgguuaaagggugaccagcacuggucuaaauuagacuggaaaagucccugcuuccugaccuacguagcuccaugguucccccaggggaauucacccugugagaggcgcagggcuucaaggguuaacaguccaugacaugggaaaacacagaugacccgaaaguuagucugggggcagggcugagccaacauuagcagcugcugaagugggacguuuuucccauuacaagugauaauggucuuagguacaguuacugcuucgagccaauccagccacuccagccaucccugcauggaacugcugccucucuccaucaggcugagcaacagaaggauguuuugcuguugguggccaguggaugcuuuggugagguguaagagguaggggauuugugaauaccaaucaaugaguuccauguccagcacagugcucugugcccuccuccccacccccgacaccuaaguuugucccuuacuacggauguagggugagcuugggacacagcaugagggcaaaagaagggcccugagcaauucugguagcuauucugacucaaggaccuguagggaguuaggggcugacaauucccuacucccugccuuccacuggcuaauuaaggauaccuuggaagcugccagacagccucccccaguucucaucacuagcauccuagggcuuggccauagagugccugguggaggacaguggcuugauugggguucugaacucuguagcuccuugaguuuacaaagaaauguuuccuguuggcugugggugggagaauggcagaacccugaaaacguggucuguucugcaugaugguauaauauucucgagaaaacaggaccauccaugacaucucgggcaugcucucagccugggcaccucucaccucugcacugagcaucugugacgucacaggcauuucucucuccagcugugcuaccuacucacaugcccaugcuuccaucaccugcuccaggcuuugccgagaacucaccuucccguuccuuuccaaaggcagguuuuucaauuucaccauagucagaauccaaguagggcucaugugaaggaggaauggcaugccugcagacugcuacucaggggugaugauggcgcuuuccuuggcagcacccagcaaacagauguauacacauugauguucuagaggaugaugguggagcguuccugggcagugccuggcagggcaugucugcacacuggugcucaggguagaugauaguagcacuuuccccacaggggagcucaaucccacccuucagugagccagaccuacuauuccagccuuuaggcugagacagagguggguuuagacaauggcaggcaauagagaugggaaagucaugcuuguugucaagauucagacaugggcugccuuagucaauugauaggugaaucuccuggcuguccuuuucucucuaguuaagagugaguguccuauuacaggaaaggaggaauagaaaacagaguauauggaagacaaaaugucuuuggacaggcaagaagacagcgggaugcugggaaauacccacucagccucagguguaccuugguuuacggcugcaccugcuugcaguugccuuauuuggcugauaggcuggcuggcucugcuugcaaguguguggguaguggacaagccuuuggaagagccuaaccuagcuccccuuguccccaccaaaacgcagggcuccauaggaacucccguaauauauggggucugagagccaaagaucauacacggugagaugugauaucauggccacugagcaaggagagguaccauaagaggagagagacuucccaaggacagucgcggugggucaaaguuagucugaggacucugggcuucugggagguaccaugacugaaggaagaggacggaaccgugucuuacuuuccauaucuacuauguggcaucauugggacucugguuugggaagaaggauauggcauggggagaggggcuuggggagauuuguggugcaaccagcauaagagauaggaaggucgucauggggguggggagccucuuuugguagaggugggcacuuggacuaaugugaugguugauuuugauugucaaccuugguuggauuuuaagggaauuaggagaugguauacuaagggauaagaaucacucugaauguaauucacaauccccaaagcuugacucaauaacauagggaaauguuuuuccugauuucuuagggcagguguucugaggccaucuguagcugaaauaaaagggggcccagaaacauccacacuaugcugguuuugcaggcaugcaaguguaagaaauaugaggucaugggagccuauauaagguuccagaagaagcuaacaaggccaaggaauguguagcaggacuggagugccugcagggaggcccuaaggacacagugaaugaagcugugauggcaaacuccagcuucaguagaaaccccagacguugccaagaauggaucaucuacugaggaagccgcagacaccaaguggaccacgaaggaugcugugcaugcugcugucaggugaugccacccugggcccuggauugccuauaugagcuucaggaugcagaguuugcucuagugggguucuaaucuugcuuuggucucaucgucuuguucucugauccuccauuuuggaauggcuuacagcuaagggcauggcuugagaagaggcuuucaaacauuggauuucagagucgaguaccuuucucacgucuugucaauguacacaggggcugacaccaugcuuuagaaaguguucuuccucucuuugguucugaaacacucacagguauauuuaauccauuacuuguucucuaucugugggggcaacauaagcauccucaacaaucagaaugagaaggaaguguuccuggugcuccagcaaauacgaacagacagacucacacuguuuuugguuacaggugaauaaucucaaucuccgaauaugggcucuucuggccuuccucucccuacacuuucuccagcgccuuuggccucuacacagugacuagcaauggagauggagaggaagaagguccagacggcugagcacugcaaauggugacagcaugcaaguguggauucugugcaugcaucuuucaacuuuccagcaaggcugaagccaauggaacagcucaaacuacuucugcacugcucucucuguaggccacauugacuaucuguauucauuccuuauuuucaaaaucauaccuauauucgacaucaucucaacugaaauacaagaaagaaaaauaacucuuuaaaguuucuuuucaauacauugccaauauuuugaaauuuuguuuaacagcuuugauuauaaaguggcuguugaguaaacagagcacagaacgaugcuguaaccuugaucuccgcugcucaucuuucuccuuuagagaaauuuaagcauccuuaggauuuaagcauuccaaggauuacucugugugccaaggaaugugaguacucugaguagugguccuggcucauacaguuuuuaugaccaaaacagaggcaugggaagacgugugucccauggcuugggaucaucaggccuccucugcaggaauggauacguagggaacaggcugcuugcuguucucaaggagacccagagacuauaggaaagagggaagcuacauggggcuacauggggcucaugucuccaagcuccacaguggcucauaugucuguugaguuggguucugcagaagggcugaacuuucucugaguccaaagaauaguccuuuggucuuucucaggcugaccaauaucaagaggagcaaacucaugaaaacaccaggcagagagucauauacuacaugccuacucccacccccaguggauucauacauagagaucuggaaggggacauggccucucagaguguagaccaggagaaaccacaaggaucacccuucaagagguucaucaugucccucuugacaccucauguccuuucagugacugagaacucccugguggcuccgaggcucagugucugccaugaacuaaauguuggagauagucccagguucucggcucaccaguucugggauaggagccugcaggcuagggauggaacacuuaaguucccaaccacucccagcuggcucggguaagcuggcacguuaguggaacauuucauauauagagaagcaccuugacuuaauuaggcaaagaggaauuagccaaugggguaaacucugagauucuguugccuuugaggacacggcucuagcugaggcugacguaggcuuagaugagauacugucuguuuacaaacacaaagccuggccaacucccuaaauucuaagauguuccagaugcccggaagacucauugucgcuggucagaugcucagccaacccaggccagccacccuucucaggcuuuggaacuucccuccucaacaauuuuccucaaguagggauuaggggcaggacacuuuugggaagcccugggaacuccccaguggaauucugcucuugaauuccaagaaaguucaucauggaaccaccaauuccugaaccucacuaaguggacacaucaccuuccugauucagcagugcauucuggcugaaugcucuauagcuuggggaccacauagcucugcaccugguggguuguccucuccaggccaaccaguaccuguuuaaggauucaaaagucacaaaccuccaugggaaaucugggaagcugaaccccuggagacacuuauggggucucugacaucugagaaugugggcaugguucagugacccagcuugacaagugaaggugaauaggaagagcaucaugcuggccaagagcucucugccuguaaaagaaagagcauugcacucugaaaugggacucaauugaauuuaugaagaaagcagucauucaaagucaccauggugacuaucacuuacugagcacuccaagcaguaggugcuagaugcucuguuagguuuguuaugaauauuauuaucucugagucuucucaaggauccaauaaaacaucuuguuucacaagggaacuaaggcauugagagaaugugccccacuucauccuccuuccccuuuuucuuugguuucacuuuguagcuuaggugaccuagaacuuuccauuuucuugccuagaacaucccauuuucuugaagaugagcaccccuuugaugggagguuaaaccaggacuaagccuuaggguuucucauuugcuccuaucagaaacgauaauuaucaggcuuguccuuuccauagccucacagaagacucccuuucaggugacuagagcagggcuggguggaucuccuaccuguggcuguguaucacugguguauugggacccaagguuaccagaaugagaugaaagcuuuauaucaucacccccuacccaccuauaggagcaaaauacaagaaacaaugaaccauuucucauggcucacagccagaguucugcaacuccacccacaaccagacaaccauauuggaaccacugugcuugggugucacaugguccagccucaaggccaccucuuugccuguucuuuucuccuagggaacuuggagaaacaaguaugugagaacauucucaguggcaucuucugcaucucagaaaagucucuggagaagguauggucugcaucaccacaaggagacaaccuucauaacccuggcacuggguggcaagcaaaggccauugauucaggcccauuucuucucaugccauccuggggauaaguuuagagacuagaguccaauagcucugcaaagaccaaaguuagcaaacugggaucuaccucugcccuauaccucugggggucuugcaucaauucacauguaugagauugccuaguuuuaggugagucagaguccgugccaugagaccuacuugcacguuacugucuuucacacuacacucagaaggaaagacaaagauaucaccaaggcagagagaccgggaaacagagacccccaauacaaccucuguaccagguggcuaugcuagggauauauacaugagggaggaaggaugggaggcaggcucuagguggcaggcucuuuggcacucaggacuccuguagcuccaggcuugguagagucuaugaaauacaggugaaggacuccauggauaaacagacuacauaggggcaacuuccuacucuuccacaaguuccauggcugcaguaagaccucuuucauagccaucuguucccuaggaccaaugucugccaguaacccuuaccuaccugugguuguugcagccacugguccacaggcucccucucauccagcaggcauguacccuguugggacuccuuagcacaggcucuuugacuuaaacuuucccacacccuggcuugaguauccuggaaggacuugaccgauccauguguauguugaggcuuagggcuucagucccaugauggcuggauugugcaacuccacaaagcugcuuuaaccugagaugaaggguaggugguuccuguaacuccuuugugaggcuaagguuauuuaagguguaaaaauaaagauagcaacauauccggcauaauucaaaguguuuuucaauauggggacuggaaguaggcucugugcucuaggcguuaacaugauuuguguuaaagcugaggauacagaaugcuaguguuugcuucccccuucaacucuguucacaggagggagcugaagaaauucuguccuguguuguuaccugaugccuuaagacucuugcagaccugcaggagggguuggagaaaugggucauggcaaacucuccaggugauccaggugguuauguucuauaaaguauuccuuaaguuuugagaaaaaucuaccagggaauaagacaucaacucccugaaugcauuuaagaugugauugcacacacuuucaggagcauaaggccuaucacuuccuucuauggagguagaagggauauguugucaucuuugaaaggugagauguaaggaccacaugugcccaaaggccucuugauauuagaggugugguggucauacauuuucuuugucuauauuccaguggcuuuguccugagaacaccuuuccuucauagcuaaguuucuaggagugaccaccagcugugcugauucucuucucuggcuucuguccugucugccuucuuugcaguauugggagcucccaagaacaucuccauggaaaggcuucucuccucuggcuucugggaaaccugcuccuuccauguaucuucucuaagugcuucugaggauccuacucaacacugggcacacgcucucaccuguagaccaccuugagcacagcaagacuauauucuugucucgcuuccuguguggugcccaggguuagcuccuuccacaagaaucuucagcuuaaucaagaggacccaagaaaaggaauucagguacaccuuucaugucauucuccaaguagagcuuugccugcagcuugaagcuugggucucaccuucgagugcuggguguaagcagcccuagguauggcugucuggucugcaccucaucucugggugucacagagagcauguuugguauuggauuccacuaagaauucuacucaguuuggaagaaccgucuguccuuuaaguccuuggucuggacaccugguuccaggacaguuguggcaguggaagaucuugaugggcacugagccuuguuuugagagucuuccauaggaagacccaagagccagacccaggagcaauuauggcuaccggaacucuguggguuuucugccuucuucccauggaaguacugccuccagucacagagggacaauguguccucauuuucccgagucccucugcaucugaacccaguaacaugaagcaguuccuuguguuggcgcugccucgacaggccagcugcuucacacagccagaaaggugccaacuuuugugucgugcuaucagaauggaauguuuuaauugagauauuuagcuaagauaaacaagacuuuucaua

SEQ ID NO: 8397 - RNA, 13146 nt, Mus musculus
guuguaguucauuauauuuauuuuggaaaaauauuuuuaaaaugaauuucuucauuaacaaaacaguaaaaaacucaaauaacauuugcacaauauuccauaaauacauuuauauacaaaaaaauauagucacauagacccgaagugccuuuguacauauuuaccaaaauuuaaauuauaaaaaaaugaacgucacaaaauacucaagcuuuacagauaucaugaaaaauauuuuuacaaaucccaaaaaaauaacacacguuuucuuuuucccgucuaggaaaaaaaaaaacacaucucaguaucaaaaaggacaauaaaggcaguuguguuucuaguucaaggaaagacuggcucauaguaauccaagauagacgugugggcagugcgugcuuccuauaugaaucaagucacucguccauuuaaauauauacucuucaaagcaacuguccauagugcaaugggaacaaccagcaggcaguccagcggcagccaaagccuaggcuggcagugucgggcgccucugcuaacucugagagaaccagcuucgccugaaccugguucucagcagcagucccuggguuuccucucccuuccucucucagcagcauucaucggggcuauauccuuggaauuuuauuuaagagaaaugggaauuuugccacaucgcuuccaucuuacaccuagaagggcccaggagacaggacaggaaguuaacugcaggcagaaauggacccucuccacaucacucccguccacgacaagagggccgcacacugaccucagucgcuauaacacacucauccuuuucugcagacagaacauacaccgacugguacuugguguccuuugaaguagaguagacagacucuggccuuuuucugucaggaaucuccccacugaaaggaaaauuagagagaaccacaguaaacacacaggaaagugguugaacgcggauauacccagaacauggaccggucucccugcccuccuugcccagcucagggcacauacccccuaaguguuggggcgaucuucucuucuccugcagagcucugugacuggcacuuggugucacguuugcuguguguaucccugaccguggcuucaucucccuugaggucucgaacgagguuauaguccacagugggguaucggaccuuaaagcugcucuucucggcuccaugguccccgugaaaguccgccuucuuguugguguucuugaucuggguagccccaaugaugcuaacagaaacguccuucucgcgcuggcaauuggcuagguuguucaugguuucugucucucccccacaggguucagguggaggcugguguuucuguagcuucagccggacgcagaccaccacagcagcacagcccagcagcagcaggaggacaagcaccaccccggcacacacggccacccaggggaagggcccgcccuggcucuccauaugccucucacugagguccaccaccaugggcccuggugguggcucagggagcagaaacuggcaguuggggccgccauagcccugggcgcacucacacauguagcgcuggccccucugguggcagguggccccauuauggcagggugcaugcucacaccugcugacaggggcgcugcaguucuugcccguguagccaggugggcagguacaggagaagucguucacacugucccggcaggugcccccauuugcacacggggaggaggcacagucauccacauuguccucgcaguaccucccggagaagccagccuggcaccggcacagguaagaguugccgagguccacacacuuggcaccuagaacccagagcaagcacagucauauuugggcacacagaaguuuguucaccaaacagacagagcaaacauagcacauguaaguccauaauuuacacacacaccacagguacagugacaguuuagucuuguacuacauagccuaaaaucucaaauccaagguuauggggagagaacuccagguagagaccuacacaauagaaacaguaagagcuccccccauacauuaggcaaacucucugcaucaccaaugguccccccauuucugccucaaacaaggucuugcuagauuugccaggguggccuggaacuugacgguccugucccagucccuggaguuuacagauuacaggcucuagaucaguguguugacagcacuauauaaagcauuuuccuuguucacuacauucaccucccaaccaccagacagggcauaauacacuguuagaucuagguuacagguggagaaauuaagaauucaagagaaugucaugcucacuggcuguuggugaaaagucagaacugaaaaccaccggaaaagagggaagaccgaccagaauacagaaggcgagagaagaaggaggggggaaaggagggaaagacgggaaagcaucuauuggcucagccucccuucuaagucuguuuuagguaccucucucucacuagcaagaagcuccugguauacaaagcgugccucuucauacgugguacccaaauuaucaccuggagcuagacuuccuucccaaaacaccguggcugugcuuccuguguuuaagcagagcuugcagagccauggauaggagugacaugcgccaaaacacuacuggccccgagcaagcugugggcugcugaccaggucauuccuugcauuaugaguaugacaccaacacccccccccuuuuugucuuccuuccuccugaauccucacggaauugacuuggggauccacaaacucaaggugacucacagagcaauguguucccuaauaagugcaccugcuuuuggagccaguccuccagacauuuccccauugccccucaccguuagaacaaggggaagagccgcagagauccaucuucuucucacaguugaagccagagaagcccaaggggcaauggcagguguagccuccgucaggguuaucugaacaucguccuccauugaagcaagggccaucugcacaggucauggcgcucagcucacagaccuugccauagaagccgggagggcaggugcaagagaagcuguccucaagguccugcgcaaggagaccacacgcggcuuucuuacgcuguuccaugaacccacacauuuuauuuaaaaccgaggaucuucagucagcacagcgcagugcccccgacucaccgugcagcucgcuccguucuugcaggggcuaggagcacacucaucuacuuccagcucacaguuggcaccuguauacccaggucggcaggaacauguguagcuccccuggcccguguuggugcagguggcuccauuccugcacggcuuauggugaguacaguaguucaggucugcccggguggagacaggaaaggggacaggaagcccaaggucaaauacaggaaggaucuauguuuccagugggcauugggcugcuuugaggagaccuggcaaucuuagaggagggccuuaccuugguugcagaaaaggcccccccagccuuccuggcaguuacacugccaggguugcuggcaggugccauggagacaaccuggguaucggaugcacucaucgcaguagcggcccugccagccaacucugcaccuuggaagaagcaaaacacaaccaugucaccuucuagauucauaaugguauucuagcacaccaaaauuauccugcagcacccauaagcuaccuguccuuaaguagcaggacaucaggccauuuaaaagcuuuaacuccccuaccccugccccgagccauucccucccagagucucagaugaagggcacaggguacccugcuugccuuucacaugcacaaggauuauggauguggaaucucauuuuccauacaagcuuuuuaacugaagccuguauauuuccauuauguacaagcuugaguuaaugaaaaccuaugcucguacauuuucaggccuucaguagaguaauagcuccuacucaacuaacucccuggaguguuuuacagccuauaugugaaauauauauauauauauauauauauaugaagaagaaaaggugagccaggcauggugacuuuagggagccugagaacuauuaugaguucaagaccaggccauauuacauagaaaagcuccugagcaacguagaaagucucacaggaaaaaaagaagaagaagaagaagaagaagaagaagaagaagaagaagaagaagaagaagaagaagaagaagaagaagaagaagaagagacaaaaaauaacuuugcaaacuuacuugcacuccccugguuugucacaguauccauguuggucaucacacccuggcagacagauugcugcaaacaaauaaaaacauagguuggagcuccagcccagagacuccccaguaucaccagguggaacugaggaaaauuagcaggaccuacucuguagguccaggcugaguggaucucaggucacagagccuagcccacccuggcugguggcuuuggacuucauucaggcaaggaaugagaauucuucuuaacauagugcgucuaggacaaaagggcucucagaagccccuacuccuaccccugucccuuuuucuucuaaaagagggucagaagucuucucccuccuccucccccacuucccaauucuaugcacaaagccccaccucuucauaucccagaaagugugugugcagauaagaguggacagcuggugugcagcgugcagggcaggacagcugcuccauugugucuucccucccgcagcugccccagcacaacaaugcugcccccccacccccaccccaccccggcccuagccauguguguaugcgcucacacaagcgcgugugcgcacguagccuucuaccaaugggagcaggcaguguccccaccgccuauccucagagagaucuaaucuauggcacguguaaguaggggcggggagagaccccaguguuugaauaagaaaaguuuagauuucuagccaccccagaacuauuggcccugagagaggaaagcuacugugggaggucagaggcgcccaaagggguaggggggcagggguggccacaggcugaggcuuugagcuggcucacuuccccaguuaugaaacucauuaaugaucagcaacuccaguucuuaagaaaacagccaaauucuuggccaagacgggagggggggcgcucaaaggauaugggaaacuaggcaacaauauguccaggcucucacugaaguguggacccaucauccucaggcaaaaacuaaagcuagaaagugacucgauauccucccccaggcacgaacagagguucugggccucacagaguccaauguucaacugcugcagggcagaagaacaaaaguucaccaggcccugacguuggaaggaaaugccauuccuacagauugggcagaugaggccucagauugcuggagagaggcccccugagguacaaacagaccagaaccagagcagaaguccucccuguggcccugguacccugguuugcaagaagauuauaggacaucagcuacugccuuucuucauuuagacaagacaaggugcccuucagccauguagcccugcacucugccucagcacaccugcuagcauuccacaaucccaaggauugaaggauucccugaaggacagggcacacagaguacaccccagggaaucuuuggaaacagauuucuguaggcaggucaggcacccuaacucuguggaggaaagggagggcuuuccaaugggacauuguugcagcaaggagaacuguuggaaaaugagcccuccacauccccgcucugucccucccuuccuuccucucuucccuuucuaauacaaaggcccuagggagagcacagccuuacuuccugaccccuggccuugucucugaacuccucccugugaagaaaagcagcuuccuacaguggacacaaggucucccuuguuaaaaugccagaauccagccuaacugccaacggccuuagcaaaacacugcucuuuaggccucaguuuccccacugagccaucucuaccaucuccuguugcaaagccucgugucuuuccccauaaauggacccuuaggggucauucuccagaggacucacggucagugcaguacuggccuuuccagccagggucgcacaucuucuccccucuguccccgcaggugaaguggccaaaggcgucaucccgaggucggcagaacacagagcaaccuucuccguaguagugcucgucacacacaaaccgguaagaguaccggaggucugugcggccgcuacugugaagguccugagaccauucuucucccacagugaggugccucuguguggucaggcggcugaugagucuuucuggguuuucugagagagaagaugcucagguugguaaugauaacaccuagacgcuaggaaccgagagagugguauggaugcugucaagccaaggacccuucuucucugaacuccaggugcagagugaagguaagaggccugggcugaguggguaaacuguguaucaauggggagaaugcauaguuuaggggcuuggagucuuaccuguugcgaggucaucgggagagucuguauggagggcuucaaugaucagagagaagguacccuagggaaaggggagaagaugcuugauaaccggaaguguggaggaggaggaaggggaggaggaggaguugggagacuaggagugggaggaggaggagcuggaggaggaggagaggcauuaaagagaaccaaguacagaggcucucagaucucuguguugugccaaugaaggucaacuccuaucacuuuccuuaauuagaagaauuuuaaagaguguccccccccacacacacaccguguguggguuugguuuuuuaaaaacauguuaauacaggaaauuguauuuuaaaaaggggggagaguacuugauggagcaagguggggugcaggaagaggagagggcagcugucauuuguuuucuggggguggaaccucgaggauggagagcagccccagcacugguagcaacccaaccaaggccuaagagcuaggggacaagaacucucccaacuuuggggguaggggagggaagcauucgaccuuucagguaaguaggaggugugugagaaaugcccagggcuugcaaaagccucugggguuccacacccccuccucaacugccagucaguucccaguaagaagucaagaccucaggcgugucuuugugggauuccccaacccuuaucaguggcccuugccuucuucccacugccaaccaccaaccagccaccccuaccccuccagacccagccgagugcgcgcaggugcccacucacuggccaggugaagccgaaggggaaucggaugggguugcugaaggcggggucgaugccugcgccaucaggcaggcugaaggagucgacacccagcacuggcgugacagcacugccguaggugcaggguggcuccggugacacgcuggccugguagugcuugaggcauacgcgaaagaagguccugcaggcgcaaggcgggccagagcccccgcggcagcaguugcgguuccccagcagccccuucuuguugacgaacuccugcagcuucagcucaaauacgccggagcuccagaccugcgcggggaaggggcgugaggucgcgccggcggcggagggacccgggggcgcgcgggcccuugcuaggacgcagaggccgagcgcaccucagcgcccauccggagcugcccgcugccgggcagcucucggggucgucgcugccggagucacuuggggauggacagcugaucggcugguccgacuccccucccuccaccgcgcagcagccccgcccggcccccuaccuggcacagcagggcagagaccacggcaagggcuagcgcgcuccgacggcccaugguaccgcuggacgcccuugcucuccuagaguauccucuuuucuuucuucuucaaagacccagggaugccaggaaagucuauaugacccgaggaguacuggcggaaaggcgucucucggcuccaggugugcuaucagggccaggucgcuucaggagggugcggugccuucagcuagguccccggcaagagcucuacgaggcacugagaaaggacaacuuucgguuuccucuucgucuggcuuucaguccacggagaggugagugucuccugcuuucugguuuugucuuaagcuucuucgcggagggaaagaggagaaaggagauaagacacagagggaagagagcccagauguucagcuuaauucccaagagagcuugcaguggcuuccuucgcaggccuauuaggaagcggcggucuggaaaucccaccggugaggcgauaauccggggccccgaggggcgcggugggaacggugguggcaaggacugcggcgcgcgcccugguuucccggcccggcgucacucggcagccgcugccgcucccagaguguucuagaccgguaucucuugcacuaucgccaagccucgcgucuuccucaagaauucagccaaugccaugcgagaacacacaccgaggaccggaggccgaagcgugggaggcuccgugccgcaccggugcucucccgugaccugcccuggucagacaggguaaccgcgggugcacgccggaggaucuggcccgggcuggcgccugccacccuuaaauccugccggccgcucgcauaacuaaugagaugcaaaugagcagccccccaaucuggcgagagcugucacaaaggagccacuuuuccaaacccuccucucaauggaucgccaaauggucagugagcuguaaaaugugcaacccuccuccccgccccccaccuccccgcccccuaguccucucugccuccgcccucgccccuucgccucccucccccagcgcaaaacccgcucauuuacauuccugcaaaacguucccggagacgaaccgcucugcucccggagcuggagcugaggccgcgucgcccaccgccccaccgccacaggcccgaagacccuaggcacgcugggcggccugagccucccacucgcggucaccgcuagacucgcucgcaggacgcggccuccggaccuuggcguuuccaacacuagccgccuaggcucuccucguuuguucaguccuagggacugaggaaccggggagagguuagaggcccgcgucccugcugcugccccuccucccuggcagccucuuucuaaggaggagucucccggagggggcgggggcggggugcccgguaggaaagggacccuugaagaggugggcaaaggguggcaagagcaccccggcaguuugggaaguuuggggagguuaggcacgcuuauaccucuggugaagccuggcgauugagccucggagagugccgaugggcuagcgauccgggccggacacccccagacaccgcagugucccggagcgcugcugucuccguguuguccacgaucacuggaaauggggaauugggguccggauaguguauucccugagccagcagagccaaaagcuaagcuuaccccuuucccgguguacacacccucucccgggagauuuucaaccaacaccaccuucacugguguccggucccacucuccuggguauuccccucaggccucccucugcuugguaaaaagugaguuuggugugugucguucgcguggcugucauuaaggcagucuguuauugugcgaggcugaaucaguggcucuuugugcgcucagcuguaugguaaugcagacagcaccugcucucugcacaaugcggagagaaagagcuccccuccgcgcacgccgcggccucugcgacaauguccggcacauguuugaaagacuccccccaccucaccccccaacacauaaccuuuacacaaccgucaccuuauuagguuuuuacacauccaucagacacuagaacuuuuguuuucuuuuuuuucuuuuuuuuuuuuuaagggaaaugaguuuauugggagggcccaggacacacguaucacaaugaauuaccuaaacggcuccccugguuacaagcuccagagaaaaguaaauggagauauagucucugacuuagcaccuagcuuuguguugagcaugccaugagcuguauauucccaucuuuagaggggccucuuuacuccacccccaccaccuaggcagcuucauuagaaucccgaggugugauucuuggagcuaguguuccuuugauuguagcacagccccuaggguguaccugacagguguccucacuguagguguugcuguccuguuggugagaaugagcccuguccuggcagaguagcuugaucauuuaggccaguaucuggagcaagauguauauaaugcacagaaagagaggaaaaccuucgcaugcccagagaaacacugcuaacaagaaucuagcaguuacugggcagaaucaucuguguugggccaucuggcaacugaaauuacagcuccuuuucugaugacccagccugccuacugcuacccugucucccaaacacuuucaaaguuucagaaucaacaggaauuucugcacuucacgucgucaucgccaacucacagacaaucaaagaguuaaccaaaaagccauguguauaauacucaaggcugaggugagaaaggcaggguuagaucccacuuuuuaaaaaaccuguuuauuauagaacaaauggaggcuucaaaagauacugacaccccuaaggcacacccccauggccguggcaaaaacagucccuguccuuuguaaacuguguagggauuugcuacaucaccacaaggcugggcuagcuugaauccuaacuuaaucuugccaccuaguguuaggauuccuuuuucacuagcuaauguuuccugggaaaguuacuuucugagaacucuguuucucagagcucugaagcugcucucuguugggacuugggagugggacucaggugacaggggguuccuacagcagaggggauucaaagaagaaaagaaacaaggucagaugcagacuccucugugccuucgagauuacaagaagaaaugaaauaucaggaaccuuuuaauuagaagauggaaguggaaaccaggcuuguuugaaugccuguuuagaaaacuggaaaugaaaaguuucacgcgcaagggcuuagacccugagagggguggacuugucccaaaucuugaacaaaccccccuuaguauuaaguauuuguuaaauugacauggcacagauuucucgauuacaguggcaaagcaguucugaaaggcaucguaaaauccaucagaauccugcccaacgcauucauucuuuuccaacuuaauuuaugccacaccauucuguauuggggaaaucaagcagaaagcucuuuuuuuccucccuccuacuccuucugcucuucuucuuccuccuccucauccuccuguuuccccauucucaaucguccaccccuaaguugguuccuauucccuucucuuucaaacacagagcuaacggggagacuguuuaacuucagugauucuauaggagccuguuguaguuuaacuccugcguaccaguagcugagaggaacaaaggacagacucgagguccagcuauucauccuuucuuugcacuuuaauuuucauugauugggaagacaaggggagcccuuagggauucgagccgggagggggaugacacgccuuuagacgccaucagcccccuagccagccaucugcuccgaaccaaauggcguuuuuucacucccuaacugcaugucucuauacucccacagcuaagcacucagaaccccccaaaugcaggagggagcuuaagccagaguauguuaaauagauuugccugaauguuggccuagccaacagauuuccccuccccacacaccauaaauccucaccuucaccauuagaagaaagaaggaaacuuucuuuuaaaugcuuuuugauguuucagcaaauuuacuguacaaaguguggcucauuagagcugaggagacaccgaauacaucagauacaggacuagaaggaaguauuuguugucuggugguaguguugauuuuuuuccacaugccccccccccccagccccaaucugaauaauugcaauggguggauagggcagacucagguugcauaauaaucagaauuaaagccacaacaagugcaucuggaguucugucuguuauugauccugauuguuuucuguauuuuacugguccaugugguaauaaaaacucccaggcacaauuuuauugaauuagucgugcccauccucagcacaggucaccuaguccugacccaauuccuucaugcacacaccuaaaaggcucacuucucaagauacagaguuaaccguggcugcagacagggcaguauccaugcauaacucccaaacaguuuucagacuaggccaagcacagguucaguuuucuguguaaacaaaucuggagacuugagcgggauuuguguuuucucagacccacugaacacuguauacacaacagaggguucucucaguccuaagaauuaggauccuuguucggaacaacaaaacugaaacuuccaagcagcaaaucugguguugaucaaacaugccagcuugcuugaggggaggaggaagaggaggaggaggaggaggaggaggaggaggaggaggagccuguguauuaauuaguucuaguaucacaucuugcccaacagcccuucuguccauuuuccgcagccaguuuuagaaucaaaagcaguuaaaauauuagggggaaaaaguccuugcguugacguggaaaggaagccuguaccuguggcccaccugucuggugugaucaaccaaguccgcagcacaacuccccuuuuaaauucucucuguggugccagggcuggccuggagcucaagauaccccugccucaaccuccugaauuuuaggauuacaagcaugccaaccauaauccuggcgcacacacuuuaauguuuguacagacaugugcacacuugaaugcaaucagcauuuggcuuccaauuagacuagagacuucgagccucagauucacacccaccagguggaaccgguaggccuagccuccucugcguucugugggcaguacacucaaaaggaguaaugaacccaaaagacuccggcauggcgccccgugaacuucagaguggaucgggguccgaacuccgucaug

SEQ ID NO: 8398 - RNA, 13146 nt, Mus musculus
caugacggaguucggaccccgauccacucugaaguucacggggcgccaugccggagucuuuuggguucauuacuccuuuugaguguacugcccacagaacgcagaggaggcuaggccuaccgguuccaccuggugggugugaaucugaggcucgaagucucuagucuaauuggaagccaaaugcugauugcauucaagugugcacaugucuguacaaacauuaaagugugugcgccaggauuaugguuggcaugcuuguaauccuaaaauucaggagguugaggcagggguaucuugagcuccaggccagcccuggcaccacagagagaauuuaaaaggggaguugugcugcggacuugguugaucacaccagacaggugggccacagguacaggcuuccuuuccacgucaacgcaaggacuuuuucccccuaauauuuuaacugcuuuugauucuaaaacuggcugcggaaaauggacagaagggcuguugggcaagaugugauacuagaacuaauuaauacacaggcuccuccuccuccuccuccuccuccuccuccuccuccucuuccuccuccccucaagcaagcuggcauguuugaucaacaccagauuugcugcuuggaaguuucaguuuuguuguuccgaacaaggauccuaauucuuaggacugagagaacccucuguuguguauacaguguucagugggucugagaaaacacaaaucccgcucaagucuccagauuuguuuacacagaaaacugaaccugugcuuggccuagucugaaaacuguuugggaguuaugcauggauacugcccugucugcagccacgguuaacucuguaucuugagaagugagccuuuuaggugugugcaugaaggaauugggucaggacuaggugaccugugcugaggaugggcacgacuaauucaauaaaauugugccugggaguuuuuauuaccacauggaccaguaaaauacagaaaacaaucaggaucaauaacagacagaacuccagaugcacuuguuguggcuuuaauucugauuauuaugcaaccugagucugcccuauccacccauugcaauuauucagauuggggcuggggggggggggcauguggaaaaaaaucaacacuaccaccagacaacaaauacuuccuucuaguccuguaucugauguauucggugucuccucagcucuaaugagccacacuuuguacaguaaauuugcugaaacaucaaaaagcauuuaaaagaaaguuuccuucuuucuucuaauggugaaggugaggauuuaugguguguggggaggggaaaucuguuggcuaggccaacauucaggcaaaucuauuuaacauacucuggcuuaagcucccuccugcauuugggggguucugagugcuuagcugugggaguauagagacaugcaguuagggagugaaaaaacgccauuugguucggagcagauggcuggcuagggggcugauggcgucuaaaggcgugucaucccccucccggcucgaaucccuaagggcuccccuugucuucccaaucaaugaaaauuaaagugcaaagaaaggaugaauagcuggaccucgagucuguccuuuguuccucucagcuacugguacgcaggaguuaaacuacaacaggcuccuauagaaucacugaaguuaaacagucuccccguuagcucuguguuugaaagagaagggaauaggaaccaacuuagggguggacgauugagaauggggaaacaggaggaugaggaggaggaagaagaagagcagaaggaguaggagggaggaaaaaaagagcuuucugcuugauuuccccaauacagaaugguguggcauaaauuaaguuggaaaagaaugaaugcguugggcaggauucugauggauuuuacgaugccuuucagaacugcuuugccacuguaaucgagaaaucugugccaugucaauuuaacaaauacuuaauacuaagggggguuuguucaagauuugggacaaguccaccccucucagggucuaagcccuugcgcgugaaacuuuucauuuccaguuuucuaaacaggcauucaaacaagccugguuuccacuuccaucuucuaauuaaaagguuccugauauuucauuucuucuuguaaucucgaaggcacagaggagucugcaucugaccuuguuucuuuucuucuuugaauccccucugcuguaggaacccccugucaccugagucccacucccaagucccaacagagagcagcuucagagcucugagaaacagaguucucagaaaguaacuuucccaggaaacauuagcuagugaaaaaggaauccuaacacuagguggcaagauuaaguuaggauucaagcuagcccagccuuguggugauguagcaaaucccuacacaguuuacaaaggacagggacuguuuuugccacggccaugggggugugccuuaggggugucaguaucuuuugaagccuccauuuguucuauaauaaacagguuuuuuaaaaagugggaucuaacccugccuuucucaccucagccuugaguauuauacacauggcuuuuugguuaacucuuugauugucugugaguuggcgaugacgacgugaagugcagaaauuccuguugauucugaaacuuugaaaguguuugggagacaggguagcaguaggcaggcugggucaucagaaaaggagcuguaauuucaguugccagauggcccaacacagaugauucugcccaguaacugcuagauucuuguuagcaguguuucucugggcaugcgaagguuuuccucucuuucugugcauuauauacaucuugcuccagauacuggccuaaaugaucaagcuacucugccaggacagggcucauucucaccaacaggacagcaacaccuacagugaggacaccugucagguacacccuaggggcugugcuacaaucaaaggaacacuagcuccaagaaucacaccucgggauucuaaugaagcugccuaggugguggggguggaguaaagaggccccucuaaagaugggaauauacagcucauggcaugcucaacacaaagcuaggugcuaagucagagacuauaucuccauuuacuuuucucuggagcuuguaaccaggggagccguuuagguaauucauugugauacguguguccugggcccucccaauaaacucauuucccuuaaaaaaaaaaaaagaaaaaaaagaaaacaaaaguucuagugucugauggauguguaaaaaccuaauaaggugacgguuguguaaagguuauguguuggggggugagguggggggagucuuucaaacaugugccggacauugucgcagaggccgcggcgugcgcggaggggagcucuuucucuccgcauugugcagagagcaggugcugucugcauuaccauacagcugagcgcacaaagagccacugauucagccucgcacaauaacagacugccuuaaugacagccacgcgaacgacacacaccaaacucacuuuuuaccaagcagagggaggccugaggggaauacccaggagagugggaccggacaccagugaaggugguguugguugaaaaucucccgggagaggguguguacaccgggaaagggguaagcuuagcuuuuggcucugcuggcucagggaauacacuauccggaccccaauuccccauuuccagugaucguggacaacacggagacagcagcgcuccgggacacugcggugucuggggguguccggcccggaucgcuagcccaucggcacucuccgaggcucaaucgccaggcuucaccagagguauaagcgugccuaaccuccccaaacuucccaaacugccggggugcucuugccacccuuugcccaccucuucaagggucccuuuccuaccgggcaccccgcccccgcccccuccgggagacuccuccuuagaaagaggcugccagggaggaggggcagcagcagggacgcgggccucuaaccucuccccgguuccucagucccuaggacugaacaaacgaggagagccuaggcggcuaguguuggaaacgccaagguccggaggccgcguccugcgagcgagucuagcggugaccgcgagugggaggcucaggccgcccagcgugccuagggucuucgggccuguggcgguggggcggugggcgacgcggccucagcuccagcuccgggagcagagcgguucgucuccgggaacguuuugcaggaauguaaaugagcggguuuugcgcugggggagggaggcgaaggggcgagggcggaggcagagaggacuagggggcggggagguggggggcggggaggaggguugcacauuuuacagcucacugaccauuuggcgauccauugagaggaggguuuggaaaaguggcuccuuugugacagcucucgccagauuggggggcugcucauuugcaucucauuaguuaugcgagcggccggcaggauuuaaggguggcaggcgccagcccgggccagauccuccggcgugcacccgcgguuacccugucugaccagggcaggucacgggagagcaccggugcggcacggagccucccacgcuucggccuccgguccucgguguguguucucgcauggcauuggcugaauucuugaggaagacgcgaggcuuggcgauagugcaagagauaccggucuagaacacucugggagcggcagcggcugccgagugacgccgggccgggaaaccagggcgcgcgccgcaguccuugccaccaccguucccaccgcgccccucggggccccggauuaucgccucaccggugggauuuccagaccgccgcuuccuaauaggccugcgaaggaagccacugcaagcucucuugggaauuaagcugaacaucugggcucucuucccucugugucuuaucuccuuucuccucuuucccuccgcgaagaagcuuaagacaaaaccagaaagcaggagacacucaccucuccguggacugaaagccagacgaagaggaaaccgaaaguuguccuuucucagugccucguagagcucuugccggggaccuagcugaaggcaccgcacccuccugaagcgaccuggcccugauagcacaccuggagccgagagacgccuuuccgccaguacuccucgggucauauagacuuuccuggcaucccugggucuuugaagaagaaagaaaagaggauacucuaggagagcaagggcguccagcgguaccaugggccgucggagcgcgcuagcccuugccguggucucugcccugcugugccagguagggggccgggcggggcugcugcgcgguggagggaggggagucggaccagccgaucagcuguccauccccaagugacuccggcagcgacgaccccgagagcugcccggcagcgggcagcuccggaugggcgcugaggugcgcucggccucugcguccuagcaagggcccgcgcgcccccgggucccuccgccgccggcgcgaccucacgccccuuccccgcgcaggucuggagcuccggcguauuugagcugaagcugcaggaguucgucaacaagaaggggcugcuggggaaccgcaacugcugccgcgggggcucuggcccgccuugcgccugcaggaccuucuuucgcguaugccucaagcacuaccaggccagcgugucaccggagccacccugcaccuacggcagugcugucacgccagugcugggugucgacuccuucagccugccugauggcgcaggcaucgaccccgccuucagcaaccccauccgauuccccuucggcuucaccuggccagugagugggcaccugcgcgcacucggcugggucuggagggguagggguggcugguuggugguuggcagugggaagaaggcaagggccacugauaaggguuggggaaucccacaaagacacgccugaggucuugacuucuuacugggaacugacuggcaguugaggaggggguguggaaccccagaggcuuuugcaagcccugggcauuucucacacaccuccuacuuaccugaaaggucgaaugcuucccuccccuacccccaaaguugggagaguucuuguccccuagcucuuaggccuugguuggguugcuaccagugcuggggcugcucuccauccucgagguuccacccccagaaaacaaaugacagcugcccucuccucuuccugcaccccaccuugcuccaucaaguacucuccccccuuuuuaaaauacaauuuccuguauuaacauguuuuuaaaaaaccaaacccacacacgguguguguguggggggggacacucuuuaaaauucuucuaauuaaggaaagugauaggaguugaccuucauuggcacaacacagagaucugagagccucuguacuugguucucuuuaaugccucuccuccuccuccagcuccuccuccucccacuccuagucucccaacuccuccuccuccccuuccuccuccuccacacuuccgguuaucaagcaucuucuccccuuucccuaggguaccuucucucugaucauugaagcccuccauacagacucucccgaugaccucgcaacagguaagacuccaagccccuaaacuaugcauucuccccauugauacacaguuuacccacucagcccaggccucuuaccuucacucugcaccuggaguucagagaagaaggguccuuggcuugacagcauccauaccacucucucgguuccuagcgucuagguguuaucauuaccaaccugagcaucuucucucucagaaaacccagaaagacucaucagccgccugaccacacagaggcaccucacugugggagaagaauggucucaggaccuucacaguagcggccgcacagaccuccgguacucuuaccgguuugugugugacgagcacuacuacggagaagguugcucuguguucugccgaccucgggaugacgccuuuggccacuucaccugcggggacagaggggagaagaugugcgacccuggcuggaaaggccaguacugcacugaccgugaguccucuggagaaugaccccuaaggguccauuuauggggaaagacacgaggcuuugcaacaggagaugguagagauggcucaguggggaaacugaggccuaaagagcaguguuuugcuaaggccguuggcaguuaggcuggauucuggcauuuuaacaagggagaccuuguguccacuguaggaagcugcuuuucuucacagggaggaguucagagacaaggccaggggucaggaaguaaggcugugcucucccuagggccuuuguauuagaaagggaagagaggaaggaagggagggacagagcggggauguggagggcucauuuuccaacaguucuccuugcugcaacaaugucccauuggaaagcccucccuuuccuccacagaguuagggugccugaccugccuacagaaaucuguuuccaaagauucccugggguguacucugugugcccuguccuucagggaauccuucaauccuugggauuguggaaugcuagcaggugugcugaggcagagugcagggcuacauggcugaagggcaccuugucuugucuaaaugaagaaaggcaguagcugauguccuauaaucuucuugcaaaccaggguaccagggccacagggaggacuucugcucugguucuggucuguuuguaccucagggggccucucuccagcaaucugaggccucaucugcccaaucuguaggaauggcauuuccuuccaacgucagggccuggugaacuuuuguucuucugcccugcagcaguugaacauuggacucugugaggcccagaaccucuguucgugccugggggaggauaucgagucacuuucuagcuuuaguuuuugccugaggaugauggguccacacuucagugagagccuggacauauuguugccuaguuucccauauccuuugagcgcccccccucccgucuuggccaagaauuuggcuguuuucuuaagaacuggaguugcugaucauuaaugaguuucauaacuggggaagugagccagcucaaagccucagccuguggccaccccugccccccuaccccuuugggcgccucugaccucccacaguagcuuuccucucucagggccaauaguucugggguggcuagaaaucuaaacuuuucuuauucaaacacuggggucucuccccgccccuacuuacacgugccauagauuagaucucucugaggauaggcgguggggacacugccugcucccauugguagaaggcuacgugcgcacacgcgcuugugugagcgcauacacacauggcuagggccgggguggggugggggugggggggcagcauuguugugcuggggcagcugcgggagggaagacacaauggagcagcuguccugcccugcacgcugcacaccagcuguccacucuuaucugcacacacacuuucugggauaugaagagguggggcuuugugcauagaauugggaagugggggaggaggagggagaagacuucugacccucuuuuagaagaaaaagggacagggguaggaguaggggcuucugagagcccuuuuguccuagacgcacuauguuaagaagaauucucauuccuugccugaaugaaguccaaagccaccagccagggugggcuaggcucugugaccugagauccacucagccuggaccuacagaguagguccugcuaauuuuccucaguuccaccuggugauacuggggagucucugggcuggagcuccaaccuauguuuuuauuuguuugcagcaaucugucugccagggugugaugaccaacauggauacugugacaaaccaggggagugcaaguaaguuugcaaaguuauuuuuugucucuucuucuucuucuucuucuucuucuucuucuucuucuucuucuucuucuucuucuucuucuucuucuucuucuucuucuuuuuuuccugugagacuuucuacguugcucaggagcuuuucuauguaauauggccuggucuugaacucauaauaguucucaggcucccuaaagucaccaugccuggcucaccuuuucuucuucauauauauauauauauauauauauauuucacauauaggcuguaaaacacuccagggaguuaguugaguaggagcuauuacucuacugaaggccugaaaauguacgagcauagguuuucauuaacucaagcuuguacauaauggaaauauacaggcuucaguuaaaaagcuuguauggaaaaugagauuccacauccauaauccuugugcaugugaaaggcaagcaggguacccugugcccuucaucugagacucugggagggaauggcucggggcagggguaggggaguuaaagcuuuuaaauggccugauguccugcuacuuaaggacagguagcuuaugggugcugcaggauaauuuuggugugcuagaauaccauuaugaaucuagaaggugacaugguuguguuuugcuucuuccaaggugcagaguuggcuggcagggccgcuacugcgaugagugcauccgauacccagguugucuccauggcaccugccagcaacccuggcaguguaacugccaggaaggcugggggggccuuuucugcaaccaagguaaggcccuccucuaagauugccaggucuccucaaagcagcccaaugcccacuggaaacauagauccuuccuguauuugaccuugggcuuccuguccccuuuccugucuccacccgggcagaccugaacuacuguacucaccauaagccgugcaggaauggagccaccugcaccaacacgggccaggggagcuacacauguuccugccgaccuggguauacaggugccaacugugagcuggaaguagaugagugugcuccuagccccugcaagaacggagcgagcugcacggugagucgggggcacugcgcugugcugacugaagauccucgguuuuaaauaaaauguguggguucauggaacagcguaagaaagccgcguguggucuccuugcgcaggaccuugaggacagcuucucuugcaccugcccucccggcuucuauggcaaggucugugagcugagcgccaugaccugugcagauggcccuugcuucaauggaggacgauguucagauaacccugacggaggcuacaccugccauugccccuugggcuucucuggcuucaacugugagaagaagauggaucucugcggcucuuccccuuguucuaacggugaggggcaauggggaaaugucuggaggacuggcuccaaaagcaggugcacuuauuagggaacacauugcucugugagucaccuugaguuuguggauccccaagucaauuccgugaggauucaggaggaaggaagacaaaaaggggggggguguuggugucauacucauaaugcaaggaaugaccuggucagcagcccacagcuugcucggggccaguaguguuuuggcgcaugucacuccuauccauggcucugcaagcucugcuuaaacacaggaagcacagccacgguguuuugggaaggaagucuagcuccaggugauaauuuggguaccacguaugaagaggcacgcuuuguauaccaggagcuucuugcuagugagagagagguaccuaaaacagacuuagaagggaggcugagccaauagaugcuuucccgucuuucccuccuuuccccccuccuucuucucucgccuucuguauucuggucggucuucccucuuuuccggugguuuucaguucugacuuuucaccaacagccagugagcaugacauucucuugaauucuuaauuucuccaccuguaaccuagaucuaacaguguauuaugcccugucuggugguugggaggugaauguagugaacaaggaaaaugcuuuauauagugcugucaacacacugaucuagagccuguaaucuguaaacuccagggacugggacaggaccgucaaguuccaggccacccuggcaaaucuagcaagaccuuguuugaggcagaaauggggggaccauuggugaugcagagaguuugccuaauguauggggggagcucuuacuguuucuauuguguaggucucuaccuggaguucucuccccauaaccuuggauuugagauuuuaggcuauguaguacaagacuaaacugucacuguaccugugguguguguguaaauuauggacuuacaugugcuauguuugcucugucuguuuggugaacaaacuucugugugcccaaauaugacugugcuugcucuggguucuaggugccaaguguguggaccucggcaacucuuaccugugccggugccaggcuggcuucuccgggagguacugcgaggacaauguggaugacugugccuccuccccgugugcaaaugggggcaccugccgggacagugugaacgacuucuccuguaccugcccaccuggcuacacgggcaagaacugcagcgccccugucagcaggugugagcaugcacccugccauaauggggccaccugccaccagaggggccagcgcuacaugugugagugcgcccagggcuauggcggccccaacugccaguuucugcucccugagccaccaccagggcccauggugguggaccucagugagaggcauauggagagccagggcgggcccuuccccuggguggccgugugugccgggguggugcuuguccuccugcugcugcugggcugugcugcugugguggucugcguccggcugaagcuacagaaacaccagccuccaccugaacccugugggggagagacagaaaccaugaacaaccuagccaauugccagcgcgagaaggacguuucuguuagcaucauuggggcuacccagaucaagaacaccaacaagaaggcggacuuucacggggaccauggagccgagaagagcagcuuuaagguccgauaccccacuguggacuauaaccucguucgagaccucaagggagaugaagccacggucagggauacacacagcaaacgugacaccaagugccagucacagagcucugcaggagaagagaagaucgccccaacacuuaggggguaugugcccugagcugggcaaggagggcagggagaccgguccauguucuggguauauccgcguucaaccacuuuccuguguguuuacugugguucucucuaauuuuccuuucaguggggagauuccugacagaaaaaggccagagucugucuacucuacuucaaaggacaccaaguaccagucgguguauguucugucugcagaaaaggaugaguguguuauagcgacugaggucagugugcggcccucuugucguggacgggagugauguggagaggguccauuucugccugcaguuaacuuccuguccugucuccugggcccuucuagguguaagauggaagcgauguggcaaaauucccauuucucuuaaauaaaauuccaaggauauagccccgaugaaugcugcugagagaggaagggagaggaaacccagggacugcugcugagaaccagguucaggcgaagcugguucucucagaguuagcagaggcgcccgacacugccagccuaggcuuuggcugccgcuggacugccugcugguuguucccauugcacuauggacaguugcuuugaagaguauauauuuaaauggacgagugacuugauucauauaggaagcacgcacugcccacacgucuaucuuggauuacuaugagccagucuuuccuugaacuagaaacacaacugccuuuauuguccuuuuugauacugagauguguuuuuuuuuuuccuagacgggaaaaagaaaacguguguuauuuuuuugggauuuguaaaaauauuuuucaugauaucuguaaagcuugaguauuuugugacguucauuuuuuuauaauuuaaauuuugguaaauauguacaaaggcacuucgggucuaugugacuauauuuuuuuguauauaaauguauuuauggaauauugugcaaauguuauuugaguuuuuuacuguuuuguuaaugaagaaauucauuuuaaaaauauuuuuccaaaauaaauauaaugaacuacaac

SEQ ID NO: 8399 - RNA, 43931 nt, Mus musculus
ggaaaucagaacagaaguuuauuaaaaaaaagcaaaaacagguuuuauaggacccagcuauaccauuccuggacacauacccaaagaaacuuauaucccaguagagauacuugcauguccacauguauucaaaauaguguauguaaguguggauguaaaugauauguaaauguauguaaaauccuaaugcugaagacauccauauaggguuucucauuccaauccaggagucaacaccauccucuggcuucugugugcauacggacacaugauuacacacauacacacacacacacacaaaucuuaaaaaacaagauguguauguauuagccagaaaacaaauuaaccacagagauccaagggucagaacucaagcugucaggcuugguggcaaacaccuucacccacugagccaccuccuuagucccacuuuccuuauucuuaaaauacaaaaauauagggcuggagggauggcucaauaguuaaguguguggcucuucuagaugacccauuugacagcucauagcuccuguaacuccagcucuaagggaacugacgccugcuucuggcuucccugggcaccugcauacccuguucacauaaauaugcaugcacguggcacaugcucacggaaacacacacaugaugaaaaguaaaucucaaaauaaauaaauauauccagauaaagaaaaagaaauuauauuagugguuuuauuuuucauuacauacauuuguauguggguauuugcaugugccugucgaggccagaagaggacacuguagccccuggaacuggaguuacaggugggugcuaggaaucaaacuuagguccucugcaagagccauacuuuuuaaacugagaguugucucuccgaccccuaaggaagaaauucuucccaauuugccaugcuuagagaagacacaguguaagaaaaugaguacuuuacauucuuuuuaauaaaacaaacuugugccacagcuccaauauaugacccgcaugucagucuuuccgcaggggaacaguuuccucccugaugcccucuuuggucacgaugcagauccugagagcaucuccaguauacacaucccucucggcugcagaaaugaagacaucuuucaccagccucauggcucuguccagcgucagggggacgugcucuacauucugcauauuuuugaagccaaccuggagagacagaaacucacauggagcaucacguguccccaagaccuaaggccccaaccucccacagcauacaacauccccaugucccaggauuugaauuggauguaucaagucacaucaggaugucuuccaguuuaaggauauucuagucccagcuuaaauacaacagaaauggggcaaugcucccaauuucucaaaagcacaaacacauggaggcagauacagauaauguaaaaaauuuaacaaggaggaagaaggggccuaggcagcuccaucagaaaaauuuaggcaggguuaucuaggagcugagaacaugucuccacaagacuggccugcaggcaagucugugggauguuuuccagauuaaugcuugauguaggaggccccagcccacugugggcaggugaguaaggaagcaguuugagccaguuauuacaagcuaguaagcagcauuccuucagggucucugcuucaguuccugccucaacuucccuccauuacagaguacaagcucuuaaacugaaaugaacugaguuucuuccccaaguugcuuuuggucaugguacucuuauaauggcaguaggaucaaaacuaggagaaggcacugaacuacaagagcaucaaacauugcuaacuaaagcgcgagaucagauaggagaaggcagaguguggcacaggugagaugaacacacagcagcagaaagcaaggcacaggaaccacaggcagcacggauuggguuacugagcuuggaggcugaaggccucugagaaaacccaauaaacgcaggucuggaucaaggugguauuaaaaaaaggggggggggagacaaauuaaaaguuuggggaaucgacuauaacccagaaacaguaaggguaaugaaggaggcauugugugauguaagguaagauggcaugggauaagcgagacaugaccaauggcugcagacagagccuauagagccaugggcagcugaggacugaagggcacugacagagcagagaaaagagcggcgucagaagaccucagcagcaucucagcagaaugagaaacuggaggcuaccacagcugcccacgcugccacaggcagagcucugcucaagcacauuaccugguugucgagcagaggcugcagcauggcacuugcugagccucccgccuugaaagagucucucugguaagagcccacugggucaaagcuguacacagcucccuuuccuuaaagaagaaagaguacaacaacacugucaaaaggaagucaaaacaugaugcagaguguuaucuagccacuuagcuaaacuucugacaaaggucagaacccaguuacuguggugcaguggaccccagcagacuauucuuuauggaaugaggucagagacaagagguucacaucuuagugaccuaacccuguggucaacuugucuaaaacuaaugucauugacaacugucccauggcccugggcaggcaggccauucagacacauuggguaaugaucacaggccuuacuugaaguucuaaccaaaagcuucaugcuaucccuaacaaauaagcuuguggaguuuuagcauaaacccaauaguuuaaauucuucuuagagcuaaaucuaaguaauaaaaccacagacuuauugucuaucauuuuaguauucgaugaacauaccuuuuaacaauauacuguaaaaaaccaccugcaucagcuaguuuuauguugaccugacacaagcuagagucaucagagaggagacaacuucaacugaaaaacugccuccauaacacuaggcugaagccugaccuguagugcacuuucuuacuuagugauugaugcaggagggcccagccacugugggugaugccgucucugggccagugguccuggguucuaugagaaagcaggcugaucaaguuaugaggagcaagccaguaagcagugcuccuccauggcuuccagguuccuacuguuucaucuugacuuucuucaaugaugaacaacaguaugaaaauguaagccaaauaaacuuucuucccaacuugcuuuuuggucaugguguuucauugcagcaauagaaacccgaacuaagacaccauauucuaggcuaaggcaggaggauagugaauccuugguagacucagguaaagagcgagaaccaucccugccaaauaccaccaauuucuaauuaauggcaauauuuaauuuuuuauuuaauauuuaauaaagaguuuuagcaaaacacaaaugcguacuauuaagcgcuuuguuuugcccaaaauguuacagcuugccuugaauuacuggaauaaggaauaacuuaaaaaauagagauuacuuuuauuuauguguauaucuaugugaaugucuacaucauauguauagguauccaugagggccaagagauuuccugggacugagucacgggcaacuguaaguugcccagugugugugcuggaauccaaacggguccucugagggcaugaaagacucuaaaugcuaaaccaucucucuaggccaagaguaauuuuuuuuuccuguaagagaaacauaacucaauacaacaaaccaaccagcaguccuuacagacuccacugaaaucaaacuaugccuuuuggcaggauuuauccuaaaagauaauuguaaauauauacauuuauuacacauuuauaagaaaaagauguaaaucaaagcagccugguaaggaaucacuuuucuugaauuuucaugcccauuagccaauugugccaguuagugacccggaguuuucacuaaugggaugagguacuaucaccaaggaugaaaaaaaaaucaggauaacaacccugguguguugccagccugguuugauacuuugacuuugugaauucuuugugaaacacugaaauuauuguuuguuucuaacauagguagauauuucugcaguauucaaaauagaaaaaaaaggcaucuuaaaaguuauuagaaagguggcacucauucauaaaaccacaucacugucuaaaagguaaagcaagcaaaccuuggagccagcugcugcacucugcugcaccuuguguggucaggguguuggucacaguuacugaagagguuaauauacuuaaccuccucagagccucagagugcucagcaugaguuagcacacugaugagacugggccagggcacuugguaauggcacuugcugcaaagccuguugacuugaacuugauccccagaaccuaccuugugacaggccagaaccagcuuuggaagguuguccucugacuuucauaucugcaccagggcaaacacaccccauccaaggaacugacuuuaaaacagaacuuuuaaaauuucuacuauugagaaaaacuggaagguacaagugaugguuuguauauucuugggccagggaguggcaccauuuagagguguggccuuguuggaauagaugugaccugguuggaguaguugugucacugugggugugggcuuaagauccucacccuaguugccuggaagucagucuuccacuagcagccuuuggaugaagauguagaaaucucagcucugccuguaccaugccugccuggauaaugccaugcucccaccuugaugaugauggacugaaccucugaaccugugagccagccccaauuaaauaauguuuuuauaagacuugccuuggucauggugucuguucacagcaguaaaacccuaacuaagacaguaccauaugcguauauagaccuggaauuuuuaucaaagaacacaucacuacaauuuuagacagucuuuaacaacugugucugaguguuuugccugcccgccugccugccuguagguauaugaugugcauagugaggccagaggagggcgggguucccuuggaacuuaaguuacagaccuuugugagaagccauauggguccugggaacuuaaccccugcagucucugaaagaguagcaaguacuaagccaucccuccggccccuagaagaggucuuuuaaaaacaacugugcuaacaacaacaaaaaagaagaaagaaagaaaaagagagagggggggagaaagaaagaaagaaggaaggaaggaaggaaggaaggaaggaaggaaggaaagaagaaagaaagaaagaaaaaagaagaaaagaaaagaaaagaaaggaaaggaaaggaaaggaaaggaaaggaaaggaaaagaaaagaaaagaaaagaaaagaaaagaaaagaaaagaaaagaaaagaaaaggcugggcagugguggcgcacgccuuuaauccaagcacucgggaggcagaggcaggcagauuuuugaguucgaggccagccuggucuacagagugaguuccaggacugccaggacuacacagaaaaacccugucucgaaaaacaaaaaagaaaaaacaaaacaaaacaaaaccaacuguggagugucuguaauacugucaguugagaagcuggaauaagaggauaauagcaaaccugggcuauagacugagaccuuaaaaaaaaaaaaacaaaaaaaaaccaaacaaacaaaaaaccaaacaaacaaaaaaaccucaaacccaaaccacaagaaacuauggaucaagaucccuggugaaaccagagaugaccacagaagcaggccucuagcuucaacagccccagauaacccccgagaacacagacuacagggaaaaugugucccagucucccuuccagcacaccaggguguuuugagcaccccacuuucaagucagcacagaugugccagcaauuaauuuuacaaauauucccuuuaucucuuauucucuauuauuuaauuucuuauuauuauuuucuuucuugcauauguuucauaaugguuuugcuuuuguuuguauauaauuuaggaguuuuuguuuguuuggguuuuugaagacaggguuucucugucuaguccuagcagucagacacuuccucuguagacuaggcuggccccaaaggcaauuuuuuacucuuuagccacaccucauacacccucccccuuuaauuccuacaucuuccuguccuugaucuuuccucuuuuuauguaauuauauauuuccaaggacaggaagauguuucuagucuccaggcuacacccacaacaagaccaguaucuccagguuacacccucaaccagaccagugucuccagguuauucccccaacaaaccugcaccccagguuacaagcccacccccugguaaugaccaccaaugcagaggggagccgaaguuaagucuaugauagacuuccagcaccagccaaucauguuaaaggccacaggagcuuucuaauuagaugcuugcacacaugcucccugcuugcuguuuacuacaaagccuugcccugauagacauucagggcucucccaucaccaaacccguccugagguggguugcgggggagccccaagcuagcucaaauagaauaaagacccugcugugagcugcaucaaacuggcuccuuuggggcuggcucagugguuaagagugccgacugcucuuccaaagguccugaguucaaaucccagcaaccacaugguggcucacagccaccguaacaaaaucugaugcucucuuuuggagugucugaagacacacuacaguguacuuacauauaauaaauaaauaaauaaauaaauaaauagauagauuuaaaaaaaaaaaauuggcuccucuguguguuuuuggggaucacuaacauuucccuggcacagcaguauaaagaacaaagagcacagugaaaguaguaagagaaaaacagguagacccaucagacaaacaucggauuauucaacugaaaauuugaaagucaguaagacuuauuucaaaucccaaaaaagguaagaaaacuauacuuaacacccauccuacugccuaaaagccaguaagucuuuugagauuuuaguucacuuggugaccuuggcugaguggacaggaaagaucagaagcauaaaacagagacagaaaacugacuuacaaaaagcuccagcuguaagccuagaagacuaaagaucacucaucaugagguauaugggaacuguaauguacuauauguauguaugaaaucaucaaagaacuaaauguuuagaaguuauaguaguaauaauguauacuagaauacugcuuaggacugcuaaucagacuuuucaucacuuuucaugaugaaggaagagcccuaaauuaacaccccauuauaauuaagagccccaguauaaaauacagaauacaagaauuaaaaaaaaaauguagagaacgcagaacuccuaauaaaguaacaaaaguauaauucuuaaaaacuuaaaagacacuagaaauaaaaguaacaacagaauuuaaaaaauaaaggagggaauuuucaaaaaucagaacaagauuuuugcaggaaaucugaucacaaugcaaaucccaugauuguguuguuuacugggaaaaccuauuucuaguuguaguguggcucagccuuagcguacaucuuuaaucucaaacaauaaagguaaaguuaguuuuagaagaagcacccauauuugaaaaugaugucagugagcggcagaaaaggacgaauaagauuugacagaacaggcuaucccaacucucaugagacgagggggaagagaggagacuuaagauaguuuuacuggguacagagacaggcugcagagaacaagccagacacaggugaggacagaacaagccagagacugagaaggagccagaagauuacaacauauuaccaaaguuaauaugaggccaagcagagcaauucagucagaagcugagaaaagccaguuucaaucagucagcguagagaggccaguguugggccagaacagcugagaugaaucagccagcccaaguucagaaacaacuagaaaggaugagcaacaagucucagaggcugaaaaaaucuaggccuaagccacaagcuuccaggacuaagcccagguuagcagacagaggaagcaacccucugacaucaagagaauaaaaguuacuuuuacauaagacaaaaagauggacuauccacaggcaacaagaaugaggaacaaauaagcugcaguuguggagaaaaucaggacaggcaagcaaggacggcaaggacgacaagagcgaggaaacagugaagaggaacaaccuggagggccacugugaagugucagaaccaagcaaaaggacuuagcaaagauccaaaaaccauacucaaccccuccacuagaccaggggaaagacauacaccaccaaagcagacagaaaaagaaagcuuaacaaacgaacucaaggcagcuggagagauggcucagugguuaagaacacugacugcucuuccagagguccugaguucaauucccagcagccacaugguagcucacaaccaucuguagugugucugaagacagugauaguguacucauauacauuaaaaauaaacaaaucguaaaaaaaagggggggggaggagccagauucaaagcaaggggcaagguaaaggacuucuuugugauggucagaaacaauccaggaggcaccauguaccaggcucagaggagccauccaccauggagagaggaaaggcaggggugaaauguacuagcccugaggcaaagcccucaguuucaccuacauuccaucauaggagcucccugcugugauccagguagaaaaagauccagguagaaaaccagucacacagacugguuucucuuuaaaguugcuauuuuaaaaaaguuauuguagauacugguuguauaauuuuuauaaauuacuucuuugauaauuuuauacaugcauauaaugcauuguuuuuauaccaccacuccuaaagacugauuuuuuuuucuuacgucuuagauucaauccuaaaacaacgaauaucugggcuggagagauggcucaguaguuaagauuuguacuuagugcuggauucccagcaccugcuggguagcucacaacagcuucuaauaaacagcagcucugacacaucuggucucacacacuuaaggcacacacacuuacuuacaugcauaucacaucuccacacacaaugaaaaagucaaucuucuacagugguuucuuuuuucucuuucuuucuuccuuccuuucuuucuaagauuuauuuauugggcaucagaucucuuaacggaugguugugagccaccaugugguugcugggauuugaacucaggaccuucggaagagcagucagugcucuuaaccacugagccaucucuccagccccuacaacgguuucuugagauuuaguuaucauuauacauuauuuauuuauuuauuauauguaaguacacuguagcugucuucagacacaccagaagagggcaucagaucucauuacagaugguugugagccaccaugugguugcugggauuugaacucaggaccuucggaagagcagucggugcucuuuaacacugagccaucucuccagcccccauuauacauauuuaugugagugaaaagauugcgcgaggugguguuaacuacaaagaaacucuuuucuggacacugagggacacuugcacacaagaacucacagcaguugugauuuguauacaagacccaagcaagcucaagccagacaaacaugccagcauagagaaguagacaagaaguaccacccuagccaaggagcuuuaggcaacugacagggauugguagagggagucaguuuuaagggugaguccccuaacaggcugaccacauuuuaguggaagaccacacauccgagaauaugaguaacaacaacuguaccugaugguuuaaagaugaaaacaaagaggcuaggaaguuggaugguaaggaaacuagagagugguguaucugggaggaacgggagaugggugaccaugauuaaaauacacugcacaaaauucuccaggaacuaaaaaaaaaugagacuggggagcaaaaacacacagacacgcaaaaaucuuuuguuguuguuuuguuuuuuugagaugggaucucucuacacaguccuagcuguucuaaaacuggcuauguagaccagacuagccucaaacucaagaggcucuucugccuaucugagugcugugauuccaugugccaccagauccagcugaagucuuaaaaaauauauccuaucuuacucugacagaaaaaaaaauaaaaaaagauacauacacugagagcacuagagguacuaacucacucaaaucaccuuuguuuuugaagacagggucuugaauaguccaugaaugauacaacccuuccacuucagcugccaaguuauaggcacggauuacaauauuauguuuuaaacaacaacaaaacagauuuauuucuccuuaaggagucugucuuuugccuaaauguacgaaugugcuguguagcaguuuccuuccugauuaaagcauuuuauccugcagggaaggaagcuaagacagaagucaacaacuuagaacagcuucaggaagccccugaaacagaccagauuuauaagacccaccccccucuaucaagaguaaauaaauauuaccaccagucauguucaugaaaagccaagcugcaaaaaaggaggagagaugcagccugggaaugugucgcucaacuaaaccaccuaacuagaagggacacuguccacccugcaggcuguaagugugcugcaaguuuccagcuuuggugaugcagcugccuuugagucaucucugucccuguaaguaacccgucacccacaguccuguaaggaaccccucagccacaguccuguaaggaaccccucacccacaguccugcaaggaaccccaaacccacaguccuauaaggaaccccucacccacaguccugcaaggaaccccucacccacaguccugcaaggaaccccaaacccacaguccuguaaggaaccccucacccgcaguacugcaaggaacccgucacccacaguccugcaaggaaccccucacccacaguccugcaaggaaccccucacccacaguccuguaaggaaccccucacccacaguccugcaaggaaccccucacccacaguccugcaaggaaccccucacccacaguccugcaaggaacccgucacccaguccugcaaggaaccccucacccacaguccugcaaggaacccgucacccacaguccugcaaggaaccccucacccacaguccugcaaggaacccgucacccacaguccuguaaggaaccccucacccacaguacugcaaggaacccgucacccacaguccugcaaggaaccccucacccacaguccugcaaggaaccccucacccacaguccugcaaggaaccccucacccacaguccugcaaggaaccccucacccacaguccugcaaggaaccccucacccacaguccugcaaggaaccccucacccacaguccugcaaggaaccccucacccacaguccugcaaggaacccgucacccacaguccugcaaggaacccgucacccacaguccugcaaggaaccccucacccacaguccugcaaggaaccccucacccacaguccugcaaggaaccccuauacccacaguccugcaaggaaccccucacccacaguccugcaaggaaccccugacccacaguccugcaaggaaccccugacccacaguccuguaaggaaccccugacccacaguccugcaaggaaccccugacccacaauccuguaaugaaccccugacccacaguccuaugaugaaccccugacccacuguccugcuaggaacccgucacccacaguccugcugggaacccuucauccacaguccuguauggaaccccugacccacaguccuguaaugaaccccugacccacugucccugcaaggaaacccucauccacaguccugcuaggaaccccuaacccacaguccugcagugaugccuugaaccacucacccacauugcugcauugaacccgugacccucacucuugcauugaagcccuaacccacaguccugcaaggaacccgucacccacaguccuguaagaaccccucacccacaguacugcaaggaacccgucacccacaguccugcaaggaaccccucacccacaguccugcaaggaaccccucacccacaguccugcaaggaaccccucacccacaguccugcaaggaaccccucacccacaguccugcaaggaaccccucacccacaguccugcaaggaacccgucacccacaguccugcaaggaacccgucacccacaguccugcaaggaaccccucacccacaguccugcaaggaaccccucacccacaguccugcaaggaaccccucacccacaguccugcaaggaaccccucacccacaguccugcaaggaaccccucacccacaguccugcaaggaaccccucacccacaguccuguaaggaaccccucacccacaguccugcaaggaaccccucacccacaguccuguaaggaaccccaaacccacaguccuauaaggaaccccucacccacaguccugcaaggaacccgucacccacaguccugcaaggaacccgucacccacaguccugcaaggaaccccucacccacaguccuguaaggaaccccucacccacaguccugcaaggaaccccucacccacaguccugcaaggaacccgucacccacgaaccccucacccacaguacugcaaggaacccgucacccacaguccugcaaggaaccccucacccacaguccugcaaggaaccccucacccacaguccugcaaggaaccccucacccacaguccugcaaggaaccccucacccacaguccugcaaggaaccccucacccacaguccugcaaggaacccgucacccacaguccugcaaggaacccgucacccacaguccugcaaggaaccccucacccacaguccugcaaggaaccccucacccacaguccugcaaggaaccccucacccacaguccugcaaggaaccccucacccacaguccugcaaggaaccccucacccacaguccugcaaggaaccccucacccacaguccuguaaggaaccccucacccacaguccugcaaggaaccccucacccacaguccuguaaggaaccccaaacccacaguccuauaaggaaccccucacccacaguccugcaaggaacccgucacccacaguccugcaaggaacccgucacccacaguccugcaaggaaccccucacccacaguccuguaaggaaccccucacccacaguccugcaaggaaccccucacccacaguccugcaaggaacccgucacccacaguccugcagugcugcaaggaaccccucacccacaguccugcaaggaacccgucacccacagugcugcaaggaaccccucacccacaguccugcaaggaacccgucacccacaguccugcaaggaaccccucacccacaguccugcaaggaaccccucacccacaguccugcaaggaaccccucacccacaguccuguaaggaaccccucacccacaguccugcaaggaaccccucacccacaguccuguaaggaaccccaaacccacaguccuauaaggaaccccucacccacaguccugcaaggaacccgucacccacaguccugcaaggaacccgucacccacaguccugcaaggaaccccucacccacaguccuguaaggaaccccucacccacaguccugcaaggaaccccucacccacaguccugcaaggaacccgucacccacaguccugcaguccugcaaggaaccccucacccacagugcugcaaggaacccgucacccacaguccugcaaggaaccccucacccacaguccugcaaggaacccgucacccacaguccugcaaggaacccgucacccacaguccugcaaggaaccccucacccacaguccugcaaggaaccccucacccacaguccuguaaggaaccccucacccacaguccugcaaggaaccccucacccacaguccuguaaggaacccgucacccacaguccugcaaggaaccccucacccacaguccugcaaggaaucccucacccacaguccuguaaggaaccccucacccacaguccuguaaggaaccccucacccacaguccugcaaggaaccccucacccacaguccugcaaggaaccccucacccacaguccuguaaggaaccccucacccacaguccuguaaggaaccccucacccacuguccuguaaggaaccccaauaagacuccuugguucacuaugcuggacuuuggucuguugugggcuaccuuugugggugucuguaugagcaccacgugcacaccugacauccccagagagaggucagaucagaucuccagagggcaucagaccccuuggaaccggacuggaguuacaaaugguugagagccaccauguuggugcugggaacuaaauucaagccuuuguguaggagcagaauugcucuuaaccacgaguucguccagccccugaaauuccuuuucaagaacuguuugagggggcuggagagauagcuuggcaguuaagagcaguggcuacucuucuuccagaggauuuggguauaauucccagaagccacauggcagcccaaaacugccuguaacucuaucuccacgggaucucacacccucacagacauacaugcaggcaaaacaccaaugcauauaaaauaaaaauauguuuuuaaaaaggacuauuugaauuaacuauguuauguaaucuguaagaugaaagaaaauagcuaucaauaccagauccugaaaaaacaaauaacuaucaggucaccaggcaccagauaccauccuugcuguaugucacugagugguauuuaucucuuuuagcuucaguuuguuguacuuucgugaucaaagagcaaagcugcugggcuagauagcacaacuccaggcagaagcacacacauuuaugaaauaacacuuuuguauuugccagaaagcaagcuguuaccuucuucaucaaguccuccaaugauguuguaaacauaguaagggaagaagcgccgugaguacaggaugguagacagcauugcagcaaucgcccccguugucauggccuuguuauuggaaugcuuguacaucuucauggguuauuuuuaguaggauuggggggcggggagggggagacaacagagagauucaguagaguagaaacagaaucugucaagcuucaguaacaaccaguacacacuauagguauuccuuagugaaacacaaaagcuuauuucuuucaugaucaaauaauacaaugguacuaacauaaaauaauauuucauuacauauauuugagaugcucaguagcuuguuuuucagaucacaaacauuuccuggaaaagaagagcaaaacucggaaugugacuaaaccugacacaugccaggaaagcugaaaccaacaaaauucaagagggucuuccucaagguuauacaacaugaacaacugcugagaaaagaaaacuaucacucugaugggagggacucaggggaaggcugcuuccugaacugucgucuaugcuggaugggcacaggaugaugcaacugugcgcaggagcucaggcucgggaaguaggcccucaccaugcuccucuaaauaaccagugaacucauuguuugucgaguuguuguucuguucuauagugguuacagugaguacacgguugucucagcauucaaggaaugaguuugugaccagcccggucuacacaucaaacuccaggacagccaugacuacauagagacccggucuuaaaaccaaccaacaaaaagaguuuuaggaggaagaaugacaagaaggugggguuaaagagccuuucuacucuccccucuuccuuucagacacuacuaauuccacaacaauuuaagacgcagggcauguaaggugagcccggggaagguguuccaaauguaucucuuucugcacuaugcacuacaaugguaucagcaccaggagcuugaccugcugcuaccugcuucuacaaguaaaauucuccucaaguauaaccaaguuguuuaugcugccuucuuaauccaacugggcagcugugacagaaaugaaauggcccuugaguuuuaaaauauuuaugaucuaguaucuuacaaacagaaaucaguugacugcaucauuugggguccacauuaucaaggggaagcagucuuacuucucaaauugucuaccaaggaaaacaguauaaaaagaaugacccuggggacuagagggacugcucagaagaguuaagaacacuugcuuugcaaaccuagguuugguucugcaccuccauggcagcuuacaaccauucacggccuauuccaagucaucuggaaccauuuccuaaccucccaguaccaggcacacccaugguguacaaguguguagucaaacccccauacgaauaaaauaaaugaaauuauauaaucaggauaaaaauuuccacaaaaauuugaguauaaaaugaauuaaguucaucauuuucguuguuugcuuuuugaggcaggguuuuucuguguaacaaccccuuccuggcugcauuagaacucacuuuauagaccagacuggccucaaacucacaaagaucugccugccugucucuugacugggguuaaagggauuccacgacacgcauuucuuuuuaucugacuucauauuuuauuuuauuaaauauuuucuuuacuuacauuucaaaugcuauccugaaaguucccuauacccucccccugcccuacuccccuacccacccacucccacuucuuggccuuggcauuccccuguacugaggcauauaaaguuugcaagaccaaggggccuuucuuccuacuacauaugcagcuagagaugugagcuugggggggggguguaacugguuaguucauauuguuguuccaccuauaggggugcagaccccuucagcuccuuggauagauaugagcccaaaaacauagaccaccaagauacaauuugcaaaacacaagaaaaucaagaggagggaacagcaacggguggauauuuuauuccuacuuagaauagggaacaaaauacccaugaaaggaguuacagagacaaaguuuggagcuaagaugaaaggauggacuauccaaagacuacccuacccggggauccaucccauaaucagccaacaagcauuucuaaagcaaaaccuaagaauuguaagucaaggucagaacacugaaaaauuacaaaaagcuauaugacuagaagcagacaaauacaggauaauuucuaagauaacuuauaguaaaauaugaacuacuacuagaaggcaugauauaucugcuaauaaauguaaauuucugaagcuuucuaugcaaaacguucuaaaauacugugaaauaauuucuccacagccccacaggaaauguaagugaacuuuccaugacuaugagauuauguucccuuaagugaacucaguaggcaacagagaauguggucaccccuacccccaaaaacaucccuaucacaucauaccuaccaccgaagccugccaagugaugggcuaccaccauucaccacguuccagaauuauuuuuuccuccuuuugugcugucuacuagaguggaaggcuguggaggaggagaacggugagcagagaguuccaaauccugcuccuagcuauacgcugcccaggcugucuuuugccacagccagaucugacacacuucagaagagcccucuauacaguagacagcccugccaaggcacagagacuuuagcagaccucuaaccugugcugcaguuuccuguuaccugaaugaccuccacagccaggguuggcucugcuuuauuucuaggauaugcuaacugcaccugcuaacuugcugucucucuaaaugcagcugugcugugaauuguugcaacagagcgacauguucaaaagcaccuaccuuuaaucuugcuucaauaaucuuugucaaagugagacaaucuccauggaaaccacugcagccaauuacugucuugucuguccuguaaaagccaguuucgggagaaugaguugauaaagcaaggcucauaaacugacaaccagccagggcuuuugcggcaugggagcagacauaccaacaucuccuuacaccaaauuaauuuuaggugggccgaagauauacuaugauuaggcuaaggaaaauaaggguuacuacuuauaaucuaguacuagagaaggugaaguaugauguaaucuguuaggagcgacccuguuugaauguuaacugccuugucagccauaagugcuuauuuaccaagccuuggccuuaguggaaaaguauuagcuuaguugagauuucugugagaaauuucugugaguugaggccucugugggaaaguacuacccccacuuaagaacaaauaacuacagaucuuguggacagguaucuagcaacccauucuguucuguuccuccugcugaacuuuuuaccuagccaauauccugcuuuugggaacuggugcguucccccagaaacgaagcgauucugcgucacccccuccccauagccugcuucuauggguauaaaaccugccugggaaaaagaaaaucugucagcuugaucaggguuuuuugacuugcuguccguucuuuguguuucucgcgccccccacccccuuuucuccacagguguuccucagacccuguucggcugucccgcaggucggggcaguaacccaaggaucauauagauguuucauaaaucugacuacuucuacagaaaaaaauaugaaauuaaaacuauaugaacauaugacuaguaaagucuaauucuaauuuccuuaugaaagaacuguuaaugaguuagaaaaauuggguagccaggaacaaggaagacaaaacuucacugcuuuuuauggcagauguagaccaugccuaggaccaacacacagcaaagcugccuuccuuauucucuauuccuuaucaccuuaaccuucuuugcaaaaaaacucaagcccuguugguuccacuuccacuucguuuugugauuagcuacauggauaaucuucccagcugccaccaagaaagcaagugaaaugucuuuaugaauauuuacuugugagcuggagagauagcucaaugguuaagaguacuagcuauucuuccaaaggacccagguggguucaauucccaguauccaaacauauguacaaacacaacaaacauauacuuaaaauaaaaguaaaucucuaacaaaaaacaaagaaagauuuacuuacaguuuguagcauuuggggcuaucucggguaugaauugaaaauccuucacucaaucgagugucugaagcgacgauggaaaaaucuucuccagcaauugccaauacaguacuaacgaauuaaggaaagaaagaacaaacauuaacucuucaggguugcaauucugucccuucaaaugguagcguguccuacaggccauuccuggguaaauguacuaacauaaaagcagaauucaaaugaaagacaaaagacuggagaaacggauuccugacuacaugucauccuggaagagcccuaaccuagagccuaauggagcccuccccauuaagcagcuauaagccagugcgcaaauaaaccccugaaggccucagguuucucagcuacggaacacagaagguaaaaugggacauauugucccaguaccucacugagaagagguaauaggaaagacacugaauaaaaccuucaucauuaaagcacaaaaacauucacguauagcuaacgcaguauuacaaagcaaccugucuguggucuugaagaccaaguauaguuaacaguccuauaagcaagcugaguucagaagaucucuaucuucuuacccaagagcugcuagaauaugucauuacgugaacugucagugucuacagcagucuccucugaacugaaacaucccuugugggguagaaggcuugagagaaaccaaguuauaucuaggggacacuccugagauacuuggagcagccccuuccacccccaccaacagcaacacaggccuauacacaccuugaauuccaguauuugagagggaaaggcaggcuuugugaguucuaggucagcuaagguuacauagugagacauugucuuaacuguuggggguggagacugacuggccaagcuguaagaagagauuuuccaaauugugagcuaccuacuagugcacagaaauccagagccacggcuuuuauacguugucaacuguucuggaguggacuuuuuuaugauacaguugauucugggucauccuugcgucucuaaguaucucccgacacuccugacauaguaaucccaauaaaaauccauuguucuccaaucaaauuuuaaccaacugcagagcaauugcaguaacccaagggucacguagauguuucauaaaucguguagggguauguauguaugugugugugggugugugugccuucccaggaaaaguugucauaccauagucaaaaagcaagcuuuucuuuucuuccuguacaauuucugauaacuuacugaagggcaccagagaaaaaacacaaaaguagaaccuagauacuacuguugcuuucucaagcaaaguacuucuuaaaaacuucaauuucuuuaaaauaugagauuacuuagaaacuaucucauauuagugugcuguauauaaggauuaaauuaguuaacuauaaaauccaccugacacuuuccaguucuucuagcaagugaacaauaaccauuguagaauacaguaagacagcacuauguguacacaguaggacggcacuaugugaugacuaagcaccugggcacuggaauuauucaugccacuuauuaguugugugacuuuggauaaauuucucauguucaaauugaugguacuacagucccuguucuguuauagagugugagaauuaaacacauaauucauguaagugccuauuuccuaguagaaaauaaacauccagaaaacauuaccuacuauuuuuacugaagcaaguuuugcacuaaaacuccaaagcaaaaaagaauggcauuacaaauaccaugaacagcaacagaagggaaaaaauauuaccacaggccacucaagcaacuuaauuaagguuaccagagacauacaaacuccucaugugaugggcugcuguagaagaccccaagcaccaagcuggaguuuagaauucuagcagaguuacacagaacaaaaaagagaauguuccacuugcaaagugagguuuuaauacaauucucccaauaguacuacgugaaaugggacauaauacugcuccaguaagagugcugugacagaaggaacgcaggaugacaggaggaagaagggcaaauucaaauacgacaccaauguaugcaaccaagguuuuacaacucccuagaugugucugcugaggaaaacaacauauccccaccccuuuaaacugagccaagacuuccaaggagcagcaguaacugaaaggaacaauuacccugcuuguuuuguuuacuaacauggguuauggagagaucagaaaacucgguuagauacgguuucccaaagaggccggaauuucagggacuuuugagaaauaguuacagaaacagacuuaggaauuauaaaagauuaguaauuauauaaaggccucaagugacaaaaaccuggaagcuacaaagagaaauuuauauauuguagaaucugaggcugcuugcagggcuaguugcaauaaaugcuaaaaggcacaaaagagaaaagugauuuaauggauagguguaaguaacuaugaacaaagugauggauaagaagaaguaaaggagguuaaaaaaagugacucaugaguacugcauucggaacaccuugaaauuaacacaucuuacaaaguaaguacuuaguguucacgugcagcauuaagcagcauacuggaaaagcaaacugaaacuggacucggcugagaacgcuaugaauuuaaauccgguucuaauucacaccagcucuauagccugggcuguuuagaugccaagagucaagaaguaaaacuaugaaauuauucacuuaacugcuugaaauuaaaacaaacaaacaaacaaacaaaaaaaccuaccuugagucuuccccaaucuauaaguaacugaaaggagcccacauaguacauucacaauugcucuucaaaagguacaaccaagacuaaaaucaaccuuucacuaucuguaugaucaacgcucaacauucauaaagccauauuuaacguuuuugcuuuucuuucuugagacaaagauucuccguguagcccaggcuguccuggaacuugcucuguagaccagacuggccacgaacuuaagagacccacuugccuuugcuagcaguaaaggcgugcuccaccaccgccuggcugguuuugcuuuucuuaaacaagccccccccccgccccccuuuuuuggauaauuagcuguuucaacuucuaauuugaugaagaauaccccuguauugucaacgguccuaaauacaaaggaaaaauaucuucgaauaaagcggauaauuaaaaugcuaaaguaauuugagaguaaaaauaaacacacacaaggguccgacugccuaaggcuguggaugcagcucaguagaccuugcccagcaggcuacgucucaagagcagaacaaaacaaccuucacuuucaucccugaaauuaagucugguuaaucauguuaguuuccucuuaaaacaacaagugaucaggcggcccagcgacagaaacagcuacucgucuaacaaccaagacaaaucauaacuucauguucgcccguuggcuuuagaaacguguucaagcccuaccaaacaacaggccauagggcggaagauugaggugggagcccgguugcuggagcaaacggcaccgagggcguccaugcacaacugagugcugggcugcaggcuacaucccugccauucccacacccgcccgucgcgaccccaggcucgacccaggugagggcagcaggcccaggcuuuuacccuccguugaaggcauaaggcgaaaaccgcagcugcacagggccggcggagccgugaggccccauucccagcucucguuccacgucucgguaagcagcaguggaaagcaucgcgccuaacuccugcugucucacggcaaaauggccgccgggaccgguccacuuccgccucccucgccccgccccccuaggcuccucuagccugcacucgucguugcucuuggaggucuacgccugcguccggcuagcgcacaaccuggauccgccaauccugccaacagagaaaccuguuuuauaacccuaagaaaacguuuggauuuacucauggcggauagaaaauuaaaagucugaccauaccaaaaaaauuaacccaauuacagagcaacgacaacucggaugucacauuggcgaaguggcacagcguuugagacggguuaguaguucaugcugcauucaaggccaaucaggacgcaugucaacugugugguguacgcagccacgagacccaggaagcaauaccagauuucuuuagccagaauaugaugguuaauauuguuaauuucacagaacuuagcaucauguagguaaaacccauggaugcgucuaugcggguguuucaagguuuaauugaggagcgaagacccaacuaaaauauaagcggcgccaccucauugccuggauuucccgacuaaauaaagaagaagcgaacuaacauuuaucuauuuauguuucuggucuguggaugcaauccaguuggcaugcuucccccuggguuguaucuccucaaacaguaagacaacauaaaacccgcuucccuuauauugccucuugacaagccuuuguuaaguuuucucaauuccccagucuucugagguuuccuguacuuucaagagaaaauguuuccuuuaggggaaaauagauacacaguacuauuguacuuauuagagucuguguaaauagacaaccuauacaacaccuacacacauaacacacagauacuguccaucacacacacagacacacacacagagagaaagagagagagagagagcgcuaaccuuaaccuaaaggagcucauuaccucguugauaaugcaaaauacaagggaaaggaaguacgcagaacaacacauguauaugccuuagaugaacuucagaaggaaaaaaaaauuaagauauguuggaaucaaucaagcauuaugaagcagccuaagaaacagcugacguuuucuuguggcagcaaggaagagagcugguagugaccgagcuaaaaauagaaaugaaucugugacuacaaagucgcuuguuuuguuguucuuccuugaacguaaguuaacaucuacugagaacaugaugaggagcguuugcuugacauuuuccuuagccaccucacaaaucucaaaggggaggagccaguaagcuugccaagcaaucucuggaguucgaagccagccaguucuacagagugagucccaagaaagucggggcuacacagagaaacucuuucucacaaaaacaaaucauggaagacugaggauguaguucagugguagaacgcuugcuugggcuugaucgccauugccacauccccaacuguuuccgcuacacacucaauagaucucucuuugacagcuagaaagggccgucggaggccccgccccggaacugcugguacccggcccgcucguuuccuucccagugucucacagcuuaagcacaacaaaucggacugcagucaagagcgcaacuggcggaagugacggcaucagaugugcgucaggcguucgguggaucgaguccgguagcgguggcggguaucugcuggcgguuuggcuagguuucugcggucgcgucauuuucuccgcagugcccagguaacgguccuuucauccuuuucucugcuuggaggccuuaauaaaggcgacuucugcagcggguccccggaguuugccggaggagacgcgagugggcgcgcggccgggcugggaacgguccuccgcgcgcgcugcggcggcuccgcgaguaaccagucucuggaccaucgccucggcgggguccugaaacccaguaccaagggugagcgucuccgaggggcuggcaccggacagccccgcgcaccgcacgucucagccgcuucccccggugggagaguuuuacccaggccugcagccgcccguuuuguccccaguaagaauaauucuguuaggaagcgguucucgagacucagcaucucgccagaagccugagagucaagcuaaucgagauuaacauaaaaacgcaugcugcuuuauuuacacacugucggucuuuagccucaaguuaaggugguuuuccaaaacuccggguaggcuucucuggaaaaagaugccggaccgguuaggcagacgcuugaagacugugcggaaucgguuucccaaauacucaguuugauggcucaguuuccaaaagaugaaaacccagaaaacagccuaaaaauaaguuugugcagcgauuauugcgauuuuaagauugcagacgagaaaaggugguuuauaucgucugcaggugugaaaugacuucugcgaagcguacaacaaauuccccagucuauauaaucaagcguucaguaaacuucguuugcagaaagagaucuggauaaauaacugguuauacuuuggacaugaaauccaacuuuuuuuuuuuuccucaaccaaagcagugauugaaauugaauuuucagucuucaauuuucucagauuuaucugcucuuugacacaggagauacucaaacugcaccuuaaaauccuuaacuguuuccauugccuguguaaugacaucuuacauucugaauuaugcaaccccaccuacagcugcuuugucaucuuuuguagugacuuuacauacugagccugucacacacugcaugcucuuccaaggcuuugucccccccuuucccuucugugauuugugcugcaccuagagugcugauuuguguuguuuuguuccuuuugcuccuuuugcuagaccuguguuacauugccccugcuuugugcgaguuccggccucucagaagguacuugacuuuaguuaugucuuucuuaacuuuuuaaaagauuuacauaugugaauguuuugcuuaucugucuauaugugcaccacaugcuuguccgggcccauggaagacaaaagagagcauuggacuccccaggacuggauuuacagcuaguugugaguagccaugugggugcuaagauaaucaaacccagucccucugaagagcaacagugcucuuaaucgcagaacagcucucuagccccuugacuuuaguuuguauucucucuuccauagcauccauucaugagcacaaaugccaaguccuguccuagguuucagcuuuucaacauuuugccuugcuuaguaaaugccugcaguuuuuuuuuuuuuuuuuuuuuuuuaagcaucuuuaaaaaauugagggugggccuuugccuaccauuuaggaggaucuggguucuaucacuacuaccauuacaaaggaaaaacaacacauuucauagucucuuagucuuuauucauauuucauguccaugaccucgaaagagaugaugauuaaagaaacccaguucuaggcauaguuuucauuaauaugcucugaugagauaauguuucaucuuuuguuuagucugccuuuaauugaaacacaaacaacuaccuaaagcauauuguguccaguucaauauguauggcgcuuuaugcuugagguauugugaaugguauaaaacugagcagcauauuuaaaaucaagaagugaccuaauagacugugcaaaucaugccgauaaguguucucuucuaacaguauaguuuguuuaggaauucuuucccccaaccucaaguccuuugcugggggguggggggugggaagugaggguggagguuguacaaagggcuggccccugaugcugugagagauggcucagagguuacgagcacugccaacucuucuagagaaccagguuggagccaucucucacacccuaaauuugauuuuuguuuguuuguuuguuuguuuuguuuuuuugagacagggugucucuguguagcccuggccuuccuggaacucacucuguagaucaggcuggccuugaacucagaaauccgccugacucugccucccaagugcugagauuaaaggccaccacugccuggcuacaauuuuaucuuaaucuaaauauuuauugucuaaauucacaaagaacacacagguuucaaaguuacaaguuguauauccaaagacccauguuuauuuuaaggauacauaugaccccaugguagcucaauuccagggcaucugaccuucucuucuggccucggaaggcaccaaggcaugaaagugauguacaggcauauauguagacaaaauacacauauaaaaugaauuacauuuaugugaagaauuggcugugagaguuuguucucuccuuucaccauuuggauaaaugcacaauauuaggauuagcagcaaacgccuuugccugaugcaccguuucuugccagcccuuucuccaauaguuuuuauuacuggucuugacaccuuaauuuucaguacuauuagaauauuuaagcacacagcaacaaagguuuugucuuuguuggugauuuuacaugagucacaggaaacauggacuaggcuuugagaguaaaagauacauauauucauauguuuguguguguguauguauuuacacacacacuccaaaauaguucuguguuuauuuugugugaacaugaaaccuauguccaucuauuaaacuuaaaacauauuuuuccaagcagcaucacuauuucauggugugugaagauaacccagaacauugaagacguuucuaaggagauauucagaggaugcucuagggaagaucugaguacugaagaaagggagaaucauggaccagaacaacagccuuccaccuuaugcucagggcuuggccuccccacagguaauagagcaagagggaggggcagagagggcucauauucccuuuaagagaaagcaaaagacagugacauuuaccaugcaguagugaacguggauuuuuagguuuuuaagcuuguuuuacuuugugaagauuucugaguuagauagcugugauguucuuuuguuugggaaguuuaguuggaaccuaauuaauuagaagacucucuaugagcuguagagcauuuaucuuauuuacuccaauaaauaaauuuauugcuccuguugcagucacuuuccuauccugauuacuaccaaaucugcuuucaaaauuaaacauugguuuugaugcuaaacaugugcacguauguguguauguguuugcaauagaauuagaccuagauuguuaccaauuccauauacauuuuaccaucuccaguguucuucugccuccacauaaauaauuaguucuacuuuauuuuuauaaauaaaauguuuaauuauaauuaaauauauguaagacauagaagcauuauagaaaaggcaguugacaguauuuuacagacuuuguugauuuuuguuuuuaguagaauaaauuacuuuuuauuaaauaguaugauagaggcauccaugagucugucauccaucauccaugugauccgucguccaaaacugacacgugcuuagucaguggauaaucaucauauauuaaauaguacuuugugggugggggugggguugagacaggguuucucuauguaacaacaucccucaaacuugcguuguaaaucaggcuagcuucaaacucacagagauccacuugccucugccuccagagcuaggauuaaagacgugccaccaugccuggguacugggcaguacuuuaaauugggacauaggcuuuuuucuuuauggucuagauacacaugagaggcuaaacaucuuccuugcauaucauaaauaacauuuucaaauccuaaguguucaucuucuauggucaguacuacagaagauaguugugcaucucaggauacaaauucuucccuaguauuuaaugaccuauuauauucagaaaacauuagucuuuuuacuuuacuuggguuucacuagggaaaaaccuaaauuacucaccaucaguaucuuaaucauugcucucuuugcuuuccacagggcgccaugacuccuggaauucccaucuuuaguccaaugaugccuuacggcacaggacuuacuccacagccuauucagaacaccaacagucucucuauuuuggaagagcaacaaagacagcagcagcaacagcaacagcagcagcaacaacagcaggcaguagcaacugcagcagccucaguacagcaaucaacaucucagcaacccacacagggugccucaggccagaccccacaacucuuccauucucaaacucugaccacugcaccguugccaggcaccacccccuuguacccuucaccaaugacuccuaugaccccuaucacuccugccacaccagcuucugagagcucuggaauuguaccgcagcuucagugaguaccucucacaccaccccagccccugugcguaacagugagugcaugcgcguauguauucaugcguuuucuguuguguuccuuguccucuguccccugcccuuugucucugcaccaaaggaggcgcucaguguuauuguacuguuugcuuccagacacuggauuuacuuaaggaaguggcccagugguaauucuguuauacugugacuuuaucuguucuuguaggaauugaagcuacagagugggucaguacucucagcagagacuuucccuuagaaauggaguugcuuguguuuguguauucgggccacagaaaugcaaacugagcuucagugauacuguggacauuuccuuguagcuaauuggcugagucacuggccaguuggaucacagcuuugacuguaucagcacaggucuuagggguccaggauuuucuucaguuuuggcugugagggcuguauuuauaucuuuggagaucuaugucacucucagaguagggauagcaguucuuaucuugaugaauuuuucugccuaaguaaaguauuucccacauguaaaaaaggugggagauucaggcuuuuuucuuccucaaacagcccaaacuuuccagauaccauuuaguaacaagaaucuagcuuuacuuuaagaaagcuuaaaggcugauuaaagaguucuuugcagacaacacuauuuggguuuuguguuuaguaacuccaccuuccuacuuucagcguuguuuccuauuuacacuuagcuuucugcauauauaucgucauuuguaagccaugccaccucauuuuuaagcuaaguggcauaaccugauucuaccuuggcuguacacaauuuuaaggugacuuuugaguuuaaagagauaagcccuauaagcacuccuuuuguuuguacuguuguaaacuauuucuuuaugccuguuugacguccacaggcauucaggcucauacuucugauuaaaaucauuugugagagucagcuuaggacauacacuuuuuuccauauccacagagcaugcaaucaaccacauuacuguuuccauuaucuaaaaacauuccuuauuaggugucaguucagcagccuuauaaagaauucagguaaauauuuaacuuuuuuuuaaauuuauuauuuuauuaucuacauuccaaauguuacccccuucccaauauuuaacuuucuaaaauaacacauuuaucauuugcauggcuaaauuugugacaggcgcaccaaaguguaccugaaaauucacuucacguaugggcaugcugagucaaacccauuuuuaaguaaaacaagaauuuuucuuaguauuucuuagguuggggggaaauagauauuggaaaauugaaaacauuugaucuaccucacuuucugauuauguacuagagaaaacuaguccaguaaaauuuaauuuuuaaauuaaauuuuuggggguuuuuuugagacugucucacgugauaaagcuggcuaggguggugcugucuauggaauauaagcuagcugcuuugaauucuugagaauacuccugccuaagccucccaccguguugccuugcuguucagcaagacuuugagucacaagauuucaaaaguauucuuuguagagaguaaaaagagagcagggagcaacaaugaacuagagcugguugucuggaguucuuguguaacaguugauggucuauuaauugcauuugauggcauuguucauuucaggucugucuacuuugaaagaccuagaaaacuacagaaaaaguugaguuugcuauguuucaguuuuuauuaaaaguucuaggccaggugguggaagcacaugccuuuaaucccagcacugaagaagcaggggcaggcagaccucuguguguuccaggacaaccuggucuacagagcaaguuccaguauggccagggcuacauagagaaaccuggucucaagauggaaaacaaaguauuucauagacaacuugaagagcgggauauagugucaugaaacaguccuuuagaccuggguggaaaauggugauguuuguguguguguacaugcacccucugugugucaguagagagucugaaguguucuuucucaggacacuacccacccugguuuuuauuuuuuaauuuuuuucuuuuguuuguuuuuguuuuuugagucagguauagcucuggcuagccuggaacucacucuguagaccaggcuggccucgaacucagaaauuugccugucucugccucgggauuaaaggcgugcgccaccacugcccggcuucacacccugguuuuuaagaugggauuugucacuagcaugaaaugugcugguuuggcuaagcuggcuaguuaucaugugcaucccaagccaaagcuaguacauucccucgaggcucagccgcuuugucugaauaugggaggaguaguuaacaccucauaggacauuuugaguauaagugagaauaucugguauggagcacuuuuuggacuaaagucagcagaguuuuauuauguuuuuuuaaauuaaagcuuggugaaaaaacaaugaauuaucaauuaaucuuaaucauauuuucuuuucaaauuucuugcagaaauauuauauucauagaaaaucuugguuguaaauuuuaccuaaagacauugccuucguuguuuaaaaguuauguauuuucaguaaucauguuuucaaauuucuugcagaaauauuguaucuaccgugaaucuuggcuguaaacuugaccuaaagaccauugcacuucgugcaagaaaugcugaauauaaucccaaggucagacccauuuucaugcauuucauacuguaugagauaaacagaaaauauuuccuaaauguuggugagaaaacuuauauugugcuuguuucucaauaucaacaagauggguauauaccaugcguaucuugaauguuaaaugcauagaaaaaguuuauucugggauguuuucauuuuguuugauuuuccuguuuuugcaguauugguauuggaguuugaaccuaggacccuaaccacucuagggaagagcugcccacuaagcuguguccucagcucugugacuuguauuuuauuaaauaccuacuauauauguggcccucuaaauguagaaauccauauaauaaacuaaguuuauauacacucacauuguagugaacacccagcaugaaguuggaaaacagaauaucccauuuggauccugaagcauaccuagugacauacuuguaucuacuucaauaaugcaguggaagaguugggaugggugguaaaagaugggucagaaauaauuguuggcuauaaguacaaaaaguuuauuacauguuuuccuaccucuguauaacuuaagguuuuuugauagacaagauugauuaguuaggguuuuauuguuguaaacagauaccaugaccaaggcgagucuuauaaagggcaacauauauuugggacuggcuuacagguucagagguccauuaucaucaaggugggagcauggcaacauguagacaggcauggugcacauaaagcugaaaguucuacaucgucaucugaagacucgauuccagacagauaggaugagggucuuaagccugugcacacagugacacaccuauuccaacaaggccacgccuccuaauagugccacucccuggcccaagcauauacaaaccaucacuuuccacucccuggcccccauaggccuauucaaacacaugaguuuaugggggccauaucuagccauagcauaauaauaaaguacauuuagucuaacuuccaaaguccugauacucuauagcagucucaacaauguuaaaaguucauuguugaaaguuucuugaaauccauccagucacuuaacuguaauccccaaaucaagacaggaagcaagcugggcaaacuccaagcugcaucuccauaucugaugucaaagcggucuucagaucuccaaguccuuuuucaucuuuguugacuacaaaaaacuucuuucuucuggguugguuccacucccuguuagcagcuuuccucaacagauauccgaugacucuggcaucucagacaucuuggggucuccaaggcaacuucagugucuggaauccauacauaaucuuuugggcuccuucaaagggcuaauaucacuucuccagcacugcccucuguagcacucuaagcucagguugaucuguucuuggugaucaacccaugauaccgguaucuacaauaaacugggucuucugaugcaacuaggcuucaccaauagcaagguucucuucauagugccaagcuucaacuccuuugcaugacccuuucaguccugggcugucagcuacaacugaggcugcaccuucaccaauggccuucuauggcuucucacagugccaagccucagcugcucuucuugaccccuucaugccuucaaaaccaguaccaucugggugacucuuacacauuaacaaguacagcugcagggcgagguacaaccuuggcuaucucuugaacacagcuucuuuaugcucucagaaaacacuuuccagaagacucuccucagugaugcuggucucuuaauuaccacugauuucuuagcugaagcuaaccagcaucaauuaucccaguagucccuucuauuuuucacucuaaagccaaagccacguggccaacgcugccgucuucuacugcuugcugggacuggaacauggcccccuauucuauuaccagcuuucuguuuucagacucccucucagccuaagcuuggccuuccuggaacuggcucuguagauugaccuugaacucagaaaucuacauggcucugucuccugugaugcugaaauuaaaggcauguaccaucaagccugcguuuaagcuuuuuuuuagcuagaaccugcuuugucccaggcuggccuugaacucagagaucuguuuggcuuugucuccugggauuaaagguguguaccaccaugccuggaucuaaauuuaguuggguaggcucuugcccccaaaucccuuaaccuguuauuuccuagaauauaggauccagcuccauuucacuuccuggugccucuuuaauacuugaaccauauauuuuauauuuuuccuuucuaagcuugcuacacuuguucaaaacguucuucaugagacuuagccagagaacaaagucucuguugagcuucuuuuaagacuuccuuugucagugcaauuaauacaaaucucuuuacuuuagacucagguagacucuuuagacaaggguaaaaaguagcuacguucuucaccaaaauaccacaaaaacaguaucuaggccacauucugaaguucuccacugaaaccucuugggccaggucugcacagcucaaaucauacucagcaacuaagucuuccauauuccuacuaggauagcccauugagcccaacuuaaagcauuccacugauuuccaaagucccaaaauccacauuccuccaaacaaaaacauggucaggccuaucacagcaaugcccgacuccuauuacuaacuucugucuuaggguuuuauugcugugaacagacaccaugaccaagacaagucuuauaaaggaauauauauauauauauauauguauguguguauguauguauguauauauauauuugaggcuggcuuacauguucuuaacaucaagaagagaacauggcaguaucuaguccuaggcaugguguaggaggaucugagaguucuacaucuucaucugaagccugcuaguggaagaagacuugcuuccagacauaggaugagagucuuaagcccacacccacaguggcacaccuacuccaacaagaccacaccucuuaauagugccacucacugacccaagcauauacaaaccaucacuaagaccaaguguguucuggguggaauggccacagacggcuuuucuaauacagaaccugcaggaccuguauggcuugugguagagcacugccuagcaaggucaaagacuugauucugucaccaugugucuuaguuacuguuguauugcugugaaccaucacaaccaaagcaacucuuacaaaagaaaacauuugcuuguugggggcucacuuacaguuuuagaggguuagcccauggacaccauggccagacccagcuaggcauagugcuagagcauuaacugagugccuuacuuucugagcugaaggcagcaggcagagacacacugugccuggagugggcuuuugugguuuuagagucugacucagcaacacaacaaagccacacuucuuaauccuucauucuuaaacaauuccguucucuagugacuaagcauccaaauauaugagccugugggcuccauuguucaaggcacaacauuggaauuuaaaagaaaaaaagaaguacgagggagaaagcaccaguuuccaagaugacagccuaggguguguuaaaaggcuuuucuuuuuuucucuuuucuuucuuuuuuucuuuuuuaaccugcaccaguaggaaagguuuuuuccucuuuuuuucuguagggagcaucugcacugauagaugagcagacaguugagagguguagauagagagcugccugggugccugcauggggaaggagaaggcuaggcugggaacauuuguagaaacaguuuccugaagugggaagcguucacccaaggguacuguaaaccuguacuguggaaaccaguaccucauagauucccuuuaauaaaggaaaagaagauguuugugggugugcgcacacguauacauguauauaaguuuuauuagugaaaaagaaaaggcaacaagagaacucaggacagcuacugcuggcugguggccaggaagaggguaaucaggcuuuuguccuuuuacaacuugaugggucguuaaggaacacacuauucuaguuacuuguaaauucuucagacaccuugaaauuuucuguaccauaaccuggcuguuagucucacuaccguauuuuaguuuugcuggguuagccccauuuccuucacuaguuaaucucagucccucaccuugccccuuuuuguauauuuuuaguuaguauuggccaugagagccgcuacuuucuucuguuggagugccuuaugcauucuccugugagcuccuuggcuuuuuuauuuaacaguuccuuuauaggcauuaguacagaucagaaagaaauacacuguuagaaaugagggugugcuacgugaaugagaaaggacucaagggccccugauugcugggcaacuauagaacuaaaggagagaggcaucuggguacuagggguaugguuuucucuuugacaaacagauuuagguuauauaaccugucuauugugaagucugucuauggugaaacugauuuuagugauaugcauacccaguuuugcaugguaauaggauauucuccuuaaaaguuuacucagagggcauaguuugccuuuugcauccaaaacaaucagaauuaagcaaucagucucccccaacacacucaacuauacuuggacauaacuggauaucugugcuugaugaucaucaaaggaaggugacacuuaguccauuguguuuaagugccgugugugugugugugugugugugugugugugugugugugugugugugugucuaucuguguagguuggauccugguuuguggguccuggguuucuggguuuggagagggcuguauguguauugugcaugcaggucaggcucucaggcugccagcuucauuauuagcagaaggguauauuccuagcccaaaccaaguggaguccuaccguauagacauugccugccuuauguuucuguccguaauagggcugcauacuuuauaguaugauuuuuuuucauuuuuuauggccucaaacucauucugucucugccuucugaaugcugaauuaaaauguaugucauuguucccagcuuuguacuauaauuucauuaguugugugucauccugaaacuggcaauagagcaguaucuagagacugagggaaagaauggucuuaaauauaggaaaugugggaucuauuucauguuguuuuuaguugaguagaaggguaauuggauaucuuacuugguggacauucacccuuguuaagauguuauagcaucaucacauguuuguuugaagccugcuuucuuagauaugaguguaguuaccccgcuuguuuucugugucuguuugcuuuauuauuuucauuugcauucacuuucaguuuguacaugucuuugccauugagguguguuucuuacagucagcagauguugggauuagaaaaaccaacuagacucugucuuuugauuagauaguugagacaauuuacauuuagaacuauuauuggaaaacaucugauuccugaaauuugauugauugauuuuucugguuggcuuucucuccuauccuuauuaggaguuaguugguuuacugagucugacaggauugauucuuucuugguucucauuuacucaucuguuccucauaagauuauuauucuuuccugagcuuucaugucugacugucuuuuuuccuuuguguguagcauaaguauuuucugcagugcugacuucaguacucguggguugcuuuaguucgacaaacuugcacaguucaaaagagaagaaaggaggaaaagguuagaaaaugguagaaaaaagaucaagucuucuaaaaauaaauuuuagaaauuuauaaagaaaugcaaaaaaguagauaaauguaagaaaaagaauuuuuaaaaaaccacuuuaagugauacuuuuuaaguucauugguaagaauaucugauguagcaaagauagucugaccugggaccuacagcaccacagcucuguuuccucagucaucaugaagacagcuuuucuuuuuacccuuucguucacaccuuuuuaaugccucuuucugaccauuuuagcgauuugcugcagucaucaugagaauaagagagccacggacaacugcguugauuuucaguucuggaaaaauggugugcacaggagccaagagguauccuuaaggaaugcuuuguuucuaguggguguauuaugaaagaaaaaaggcucuagcguccuucuguuaucaggcuagcacuuuucauguuauuuuugaaugguuugcucugauuacucugcauagcuuuggugccccacacuguuacuccugaucuccugggcucugguuguagcacugccauucgcauucugauauucaaaugaaaacucuugaguuggaaaaucauagcuuuauccaauagugguguccuaaaaauggauagagauuugauguaaaggaagauagaauuuguauuucccaauaauacauuuuacuaauuuuuuuuauaaagaugaaguuuucauuucaguagagauuuauaggucauaaugaggugaugacgguggccaugcuaauugaaccacacacuacaucgaguccuuuaaaucugagggcuugacaguaaugugccacauagaaggcuuauguuuugguagguuuaugguuucuguugaggacacggagauaguuuaauuacuuuccuaauuuagacucuguuuguuauucaucuaaauuacucuauuaggcuuccauauauaacucacugauuuuccuuucuguagugaagaacaauccagacuagcagcaagaaaauaugcuagaguugugcagaaguugggcuucccagcuaaguucuuagacuucaagauccagaacaugguggggagcugugaugugaaguucccuauaaggcuggaaggccuugugcugacccaccagcaguucaguagguaggucuaaguaguauggggaguaguuuuccaacaguccauuuauaacccacucaggcaucauuucagaugacguacauauaagaugugcaguuucuaagcauguaugacauaacugcaaguuaaguuaagguauugcuacauuugagcuacugcacucuccacugucuuuacaaucccuauuuccuuagucacaugacacccagacucucucacuggaaugauuuagcucaccucuguauguaugccucaccauuuuguuagucaguaaguagauguaaauacaugaauuuguaguuucuucuaucacuuuucuccuaguuugaaucuuuuuuugucagcauaccaacacaguguaaagaugagcagcagagguagacugcccaguauuauuucuugccuuucucugccugaauauugguggagcaucccuacucacauccuuauaacaucuguuuucucuuugcagccacaccacugagcuuaccaguucucucguacucaccagguuccucuugcuccauggccucugcacaugucacuuuuaacccugacauauuggguacaauuuucaucauagaaacuccuguuugaguuucaggaauucacucauguugucuuccucauauagaccuguccugaguuuaucucuggaucacucacaagaaaggcagauccuuuuguagacugaacuaagaaaccugaaaucgcuguguuagaguauguuaacuaauguccguucgaauagaugguaugaccagggagucgguucauggccaagcucaugucugguuucucacucuaguuaaggcaccuguuagaaaagcaggcaucuccaggagaguucuguucaggaaggugagaugauuacagggcugacugccacucuuagcuuaggagugaauggugagauuuugauaaggugcuauaacuagacuagcuuuaacugcaucuaaauaaggcucagaccguguguauacaacucuuguuuuuaucacagaaccucuagagucugaagauagcauuaagugauaggaggacauguagcuaguaguugguggcuauguccaugacucauggcuccuggcugguuucuuccuguguguccuacuugugacaccuggauucuuuacucaggacuuucuggcacaaagccucuuguauucagaaacacaaagaacuggugauuucuaaacuguauucccauuuucuuucuagcuaugagccagaauuauuuccuggauuaaucuacagaaugaucaaacccagaauuguucuccuuauuuuuguuucuggaaaaguuguauuaacagguaaguugaaaggaaguggaugaaacugcaaaggauguugggguggcauuuucuguguuagaacaguugucuagccauguguaaggaugcuuuuuaaguuuugcacaccauucuaaccuucuugagaaggguagaagaaugagaagaacugcagaggccugcugcugauguagccgucagcuagauuaagcuugacugugggagcaggcagggaugggacacugacuguuuucaguuggcccuugcaccuuggggguuaguagaguaugauuacaagacugagaagagcucaauugaauaccaacaguugggagaauaagauuucaguccucagugcuugucagauaccaugucacucagguccaaguaugggaaggaacuagaguaggaaguagauauugucuugcugacuuguggauccugaucucagaccaacuauauagugaggaaaugauggucuaggguguuuaaaagucgcuaaguguaucacuuuuuuuuuuuuuuaaagauuuauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcccguguaucacuuuuuaaaacacuuagaaaauacuguucuaaaaacauagcuggagagcuagcugggcauggcccuuaauccuaguaauucauaggcagaggcauggucuaugcaaguuccaggagagccagagcuacauagagaaacccugucucaaaaaaaggggguagaauaguggguacagcuaggauggugauaaggggauuccaccauuuguuugucuuaacuagguauagagagaacuguauuuauguuuuaagguaaugaugcuacuucuuaaccaucucauuucuguuccaugugucuuuguaggugcuaaaguuagagcagagauuuaugaagcauuugaaaacaucuaccccaucuuaaagggauucaggaagaccacauaguugucugccauguucuccugccuucccuauccacguguuuuuuaaaaccagucaguuuugguaccacugaugguacaguuggugaggacacucaguuacagguggcagcaugaagugacacuguguguccuacugcaggauacuagaaagguucccccucugcacugaaaucacccugcagcacuacugugaguugcuugcucugugcugcuacuugggcggcacugcccauuuauuuauauuuagauuuuaaacacugcuguuggugauuguugguuuaagggacagaacuuuaaguguucaagccaccuguacaauuggacuuuucauuuuaaucuuucccacacaagccaguuuuuauauuucuaccagaaaaguaaaaaucuuuuuuaaaaguguuguuuuucuaguuuguaacucuuaggaguuauuuuugugccagauacauuccgccuucccaguauugcaggacugaauaguuguauuaaucaaaacaauggcuguacauacuuuucuuucuucagaguacucugcacaaaaacgcagcuuguaaauuguuagauuuuuguuauaaaugauaccuuguaagucaugugaucauacugucaaagaaauuuauuuuagauauaaugccugagaccauuguuuuguuugcuugucuguuugauuuuugguuaacauuuauugucugucgcaguaagaauggacacgccgcugauuuuaugacucccauugaacacccucuugucuccuagauugcccaccgugucugggauuuuuaacaaauuaguuguuuuguuccuuuuucagccuuugccaaagccuuguccaagguuccauagcuaguaagagacagaggguaaguuaguaauucaaguauacaaguugaugcccuauccacagauagcuaauucucucguauuauauuuuugucauggcuguuuucucuugaaauaccagguggacacuucuaaagccuugaguuguuuuggagagcauucuguccuuuuaaauucuaaaaguacauuuugcacaguuccaaguauguguaaucagaaggaagucuuuuucuucccagccuuuccuguuuccccaggguaacguccagauuagugagugggugucuucaucuuccgcuauauuaugccugcacucuccaguaugccugaugguggcagcaggccuuuaggguuacuaggguccugucugagauaacaagacugagaagagcgccacugagugccagcagccgggaggauaagguuuuguccuuaguacuacuaucugucaccuagccaacuauccugucacucaggacaaagugugggaaggaaccguggacugggugaguggggggugggucucaccuugcugacuugugaaguguggugaggugguggacuaggauguuaaaguuaccagcuguuuugcuucucuaauuuuuaacgugcaaauccguccuuuggggcugcuguauuuuggaaaaauaccgaaacauacguuuucuugugacuuuugcagucaguguaucagcuauacuuacauugcauuauaagacauugcaucugcaauguccuagauaccuugauuugaacagcuccccuagugauggcagugcacagugcuguacaguguuggaccagguauucuuguauguguguuuugaauacguacauagauuccuauaguauacuuuuacaagagggauuucuguauuauagacaguuuaugugacuuaaauuuugacaaaucaauacuagacuucaauagcccccccaaaaguguacaaaguacccuuuuuuuuuuuuuuaagauuuauuuauuuuaugugaguacacuguuacucuucagagacaccagaagagggcauuggaugucauuacagaugguugugagccaccaaguaguugcugggaauugaacucaggaccucuggaagagcagucagugcuuuuaaccacugagccaucucuccagcccuauuuguuuaacuacuauuaagaguugauugcauuugaacacuaaguucuaggcauguaaugguugauaaguaguaauucuguuuuuucuuucugguauuuucaguauuucaauggccggggcuuuaauguauguaccuugcuuguuuucuuucuuucuguuuuuuguuugagacaggauguugugg

SEQ ID NO: 8400 - RNA, 8096 nt, Mus musculus
ugauuaucuuagaguuucuuuuauugugauaaaauaccaugaccaaaagcaacuuuuguggaggaaagggcuuauuucagcauauaguuauaguguaugagagaaugcugcuuacuggccugcucagccugcuuucuuauacucccagggguggcaccacccacacauugauuugggcuugccaacaucagucaauagcccccacccccaccccccagacuugcuuacaggccagucuuacagagccuguucucaagauucccucuccccguuuaugucuagcucugucgaguugacaaaacaaaccaagacagugguuuaaagugagaagggaucuugcaaccacuuagcccagacugaucaggcacuuagccuugaaucuguggacuuccaagauugacccagauguaaucaagugagugccuagcuggguacauucacguccacacugccuagagauauccucaaauagcccuugccguuuauaaaugccuuagugcauuuacuuuuaaagcccuuggcauuuagaacuuucuguaauacauucugagcagacagcauugcuggucauuugggaugugaagccacacucacaccucugucugagucuuuuuccugagucaguuucuacauguuugccacuaauugcuguaaauuccuuccacagcuauggacuaugauacuaguucuacgugguucuuacugauuuagcuucaaguuaaaaugaacagcauuucccccuuaaaaguagccugguuccucauaggaaucucuaaaugaucccauauaucuuaauguacacguaggugguaugaacucauaggccaggacuuuguguaaugugcuguagucagaaagucaaugguaguagagugugauguggccucuuaaaauucagagugaacaagaaugcuaggguaacaugauacaacagcucuguucagguuugucuugguguagaucucugauguugagaauucacuuuugagugacaacuggaaagaccauuaaccuuuuaagauuuagucauugcuuggcaguguauccuauggaauaccccacaccugaaagauggcucaggcccacucuacucagguuacugcuuccagggccaguuucuucucucuucacuuuccucugucaaccugugaagacagucuguacaaagggaagacaagggucuaguuuaucaaucuucuauaagcagguucccuagcuuuucaaagucagugcugaagucgggccucaaauccaggcuccggccaucccugguacuucuacuuuacuggcuucuccuuuauccuacuuagucuaacaaagcucagugucucuuuguucuguaccagacagaauuugucuacuucaguuuuaccuacauaccucuuuaacuguguaaauguagagguggggaaaugcugugcagguuuauaggaaacauaucuguaaagcuucccuuuccagauacucuuaagacuuuauuuucuguuuguguaucuggggguuaugccacauaugcaugcaugcccacaggggccagaaaaagggcaucagauccucuggagcuggcuauuacagguaguugugcgcuuccugaugugaaugcuaggaacuggacuuggguccuucggaagaguagcaagcacuauuaccuagcugagcuagagcuggcugggagauuaacugagcccaagcuauuuuugcagaagacccagguuugauucucaguauucacccagcugcucacaaguaucuaacuuccacagaacccagcaucaucuggccucugaaaguaccagguacuuuguggugcucacacauucaggcaaaacauaaauagacuuaaagugacaguaauaauaucaaacagcugagccaucucucuggcagauuuuuuucuucacacacaugaguauuucuauaaaacuaacaugccaugaaaaucaauaaauaacguuaguuuacccccucuuggugucuauguacuauucauaccauugcccugguacuucuacuuuacuggcuucuccuuuauucuacuuagucuaacaaagcucagugucucuuuguucuguaccagacaaagcgaguuugauccuugggacccacacaguggaagaaguugacuuccacacgagugcugccaugugcauguguguacacaauaauuuuuauuguuuuagaagauucugacauuuuaggaaugucagaaucuaccuaucgcuguggagauaccucaguuuaauucccugucacuggguacuugucuuaguaaugcaaacacuguaaaucaacaucuucauacuuaugucuuugguaacuguuuacuuaggauaaaguccuagagauggaauuaugagguacugaggcauaaguuuuuaguuuuuauuuaaguuuuuauuuuauaucuuuugcaagaauuuaaccccuuuuaagguguaucugucacauccugcuuccacacaaauucuucuguguagccgcuacccaggcuacagcucucagcacaggugaagacagccaagacaccccagucgaugcuucugccgagucugucugccuucaggugguucaacagcugaggcaugaccugggaagaggacaacauaagaagggcacuucugucugcucugacuuuauagccccucuguucuggcauguugagccaccuagaucaauuuuucuaaaaauaguaauuauuuaaggccauaccuggaauucaaauauucucuuggcaccacacgggcaaucuggaauaucuuuuucuugaggaauauuuucaccagaaauccagauggguuuaaucccucuuccauaccugagaaucuaaaaaucaauauaucucaucuaagaauguccaauagaacccugaucugaggacugucuggaaaagaucuacaugggcuccuauacgcugccaacaccccgaaaccucaaaggccauuauuucaccugauuuccuuaauagugauauuccuuuccuaaaaugucagaaucuucuaaaacaauaaaaauuauuguguacacacaugcacauggcagcacucauguugaaguguaaguguggaagucaacuucuucuacugugugggucccaaggaucaaacucagguuaucagguccagccacaggcacugaccccacacuggaaugucagcccuaucacuacucuguacuaacucauuacuggagucugcauacaaaauguggcauaagguagcuaauuagcacuugucuucauauauagccaccaacaugggguugguucaauuguuuuaaaaaguaaauucacuauaauuggcuucagaguguuuuuccugucuuucauuuaagacuuaucaccauuuccagaaaccaccaucaaagcuuccuguuauccuggacacuuaguugagcccguguuuuugggaagcugccuuuaguaauuuuuguuuacaauaaagcaacuuaggaaaacuugacauuaacaugucaugguuuuuuuuuuuuuaauauuuguguagacauuuauguguguacaguguguaaacgugaaucauauagguuugauaagguggcugucauuuugagaacacaaugaaguauaaauaccauuuuaccugcucugguucaagggcuauuuuagauuuaaacuuuuggaauaugugaucuuccuuggauucgugcuuugccauggaaucuaguucuuccucaggaauucccccugaaaaaaaaaacacaacacaauaauuaugggaugaucccauaauuucacaacucaaacgucuguggaagcuaguucuaauuagauagcuuccucuagucaaguaacauuagugcuuauuuugggguaacauguaaucaauauaaaucuagucuuuaagguuucaaaacaaaauaugguugauggcucaggacuauagcagucugucugugaggcggcacuaacuaauggcacuuaacugccauauagagccaggaugcacagagacugagguucucucaagugugaaagcaaugcauuaauaauuuagggaaccuuaggaaacucccagaggcaaaaaaccuccuguguccucccucuuaaccucuuucuccuugcaguccaaacaaguucucagcuacaacacaguaaccucagggaagcauuuuaaaaauuuuaucuuguaaauguugaacauauacuauaguuaauugucaaauaccaagaaucagcuucaaaucaaauucaagaccuccaagucccuuuauuuuaucuacaaguaauuuuugaugaucaaugagauuucuguuuuucagaaccagaaauugaaucaauuccugguacacauuaggcaaaaugcucuaugcuggguucaacccucaucgccuuuauucuucuagguagggucucacaaauuuguucaggcuugacuugaauucaaaacugaacuucaaaccugccuuuaaccuccugagucgcugggauuauaugucuaucacuggacccaauaauaacucaauucuuuuauuuuuugagacaggauuucaauguguguagcccuccuggaacucacucuguagacccacuggccuucaacucagagauccugccucuaccucccuauugcugagaaaaccaugauaacugaauucuuaacuauuaacuucuucaaguucuuauaauaacuacuuccucccuaguucuagagucaaucaccucucuaaauacaacauuuuauagauauggagucuaacuacaaauaagacggucauuauuucuaaaucuuuguuguagauaaauguaguugccggcaucuuccaauauaaauucagaccuucaucuuuuugcaaaucuguacuacucuuuucccagacccaauacauaaauuuacucaguaaaauaacagcagucagguauaaaaugauguaacuaagaccuguaauauuugcacucuggaaguggaagcagaagacaguucaaggccagcuuggccuccaugagaaucugucucaaacugaaagaaaaacaugugcauuuaacuuuuucagcuuuuuucuucauucauggaauauauuuuacuaggaaucuacugucaagucacuggcuuggauuaaguaguucuguaauucaaacacuuuuaggguugcgucuuauauaaugauuacuuauauagaugauugcugagucuuacacucaacucuugaguacaccagcccucccaauaacauccuuucugaaggaaaacacuuucaugacuaccaauuguaaaaacaugagcaacaguacacgcgugagcagacaguguaguuacguccagguaguuccuauggcacauguguucugagagaauauuuugcagaaauguauguaaguauguaugugcacgucaaggccggaagagagcacuuggaucuggaguuagaaaagugccauguagguuuuagggaccaaaccuagguccucugcaagacuaguaauugcuuguaaccucugaucuaucucuccaguccuucauuauugugucagucacaagacguuuuacuuggcuaagcuuucuauggucucccuucugagaauaagcccucccccugaugacuggguaccauucuuccugcaaaugaggccauaaacugagacucuaauuuaguucuauaaaccugacuuuaugguuuaaaaguucagauucuagaguaagaucuaaguucuuuguucaaacacaggauaccuagaacuucaguuuguucacuggaagcaugaggcaaagugugucgcuggguguuugagcccaugaauaagcaaucuugaggcagggugaaugcuggacugaugaucagcaccugugugggccaacaaagacacagccccaaagcauggacucuagaggaaguagccaaaggauguaugugaaaguggagcuaaaagacuacauuacaaaggaccucucuugucagacguucuguagugacuuaggcucuauaaucuucuaccaagacguucucugccucaccacagauacacacugauggugccuuuccucccugccguuuucccccuaagguauauuuggucauaguacuguaaaauugaugcacagacuccuuacccaugcuuccuguaacuucagaauaauccuccauuuccacaaccucaggcaaaauuucaucuucuguuucuguuacaauuucaaauucuggaaacaggaaguuguggucuggaaccauauggucuauuuugucuacaauaaaguuauuagcaucauuaauaaacauugaguuuugaggaccuaaaauuuucccauuucuaagacguuaaguucugagaccuguguuguugagugaauucaucacaguugaacaucagagcugcuauggaauagggcaaucacuauguaaccucauacaagccaucacaugaaguaauagacaguaaaugugugugugacacugcuacauauauaacauggcuuauugucaguagacaggcucuuacuauguugccuagauugcccucuaacuccaaauccuccugcagcuggcacucgagugccaggaccacagauaggcaccaccacuacgagcugaguaacaacuguuagcacuugcuuguucuuaaguauuagauauuauacacaauaccuaacacuaaagaucuguuuacaccaacaaaagcaugaauaaaguggagagauacagucuacaaagacacugaacaauuaagaauucauuauucggaucagggaugcaugaaugugauuguaacgcuuuuugcaugaccacgguuaacuacucuuaauaauacuaccuguuaauaaagcugguuguacuaaccaguaccccagagcucgugucucuagcugcauauguagcagaagauggccuagucggccauuacugggaagagaggccccuuggucuugcaaacuuuauaugccccaguacaggggaacaccagggccaagaaucaggaguggguggguaagggagcagggcuggggggggggggggggguauagggaacuuucgggauagcauuugaaauguauauaaagaaaauaucuaauaaaaaaauaaagcugguuguguuuuagauuagcgaaguguucauguuaccaguuccuaaaacuuuuaaaguauguuuucuaauuucaaguuuaaccagaaacuggaguaccucaguugacagagacgguaaggcuaaguugucuuaccugacuguguacaagccugcuugugucccagccgccagucuaaugucugaugcuccuugcugcaguaaugugccuguuugcaccuagagcaugucauaggggccaagcaaccacaaacccgacagagaugggcuccagacuugagcuggaggcacacacauuccguacccaaagcuucuguuucagaagggggcucauaggaguagaaugcguuguuccuugguagcugauuacgaaaaacugaaaugaagaggagaaagggguacgugagauuaucuuuccgugaaacaaaauaauugaaacauuugaaccguuuucggugcuucaccucauaaaaccucauuuaaggaaaaccuaagguuuuugcuuucggggugggggggcgguuuuuauaugaaagggaauaaaaauaaaagcuaaagagcuuuuaaacccgggaagaguuccgucugacaagagaaauuggcuuuaaggaguccgugcccaggaugaaagggacacgauucuaagacaauuccgguaccugaauacaaccacucgcgccaaccgaucguccuacguccaggguucagcccccguggcaacccucgcccggguccugucccggcggccgcucaccucgcaggccggcgcagcacggcggcucgcgacagcagaagagaaagaggcugcgguggaaggcgucgucccggcccggcagcggugcguacaccugcagcaggaaggcgagcgggcggccgcagcgcgcacacgccagcgccccgggccccggcagcuccgccaagcccaaccacgcgggccgcccgcccacuuugcugggaaacugcucgcugcgcagccuccaggccggugccuccucggcgaagcccaacuccacaggaccaggggcggcugcagccaugcucgcagcaggacucugccaccaggccg

SEQ ID NO: 8401 - RNA, 978 nt, Mus musculus
agaagagaggaagggcagugacauccugcgacugaucaaggaacuggcuaaauaugaauacauggaaggucaagucauuuuaacugagaaagaucuccuagaggaugguuuuggagaacacaccuucuaccacugccugguugcagaagugccuaaagagcaguggaccccggaagguuacagucucuagcuucgccauguaaauggcccuucuguguauauggauggguggggaaguaacuaaaagauccuuuacacaauaaaguagaugaucaugauaaaugaggacacagcauuguuggguucagcauguaguauuuuaccugugacccauggauuggcaaguuacuguaucuugaagacuucuucgugaugagugauuacagaggcuuugguauaggaucagaaauuuugaagaaucuaagccagguugccaugaagugucgcugcaacaguaugcacuucuugguagcagaauggaaugaaccaucuaucaacuucuacaaaagaagaggugcuuuggaucuguccagugaagagggguagaggcucuucaaaauugacaaagaguacuugcuaaaaauggcagcagaggagugaggcgugccgguguagacaaugacaaccuccauugugcuuuagaauaauucucaacuucccuugcuuucuaucuuguguguagugaaauaauagagcgagcacccauuccaaagcuuuauuaccacugacauuguuguauguuugaaauucauucuuuuuaaagcggcacucauguaugugguuuggaggcagaauucuugaacaucuuuugaugaagaacaagguaguaugaucuuacuauauaagaaaaacaaacuucauucuugugagucauuuaaauguguacaauguacacacugguacuuaagaguuucuguuuugauucuuuuuuuaaaaaaaaauaaacuacucuuugauuaaaaaaaaaagaaaaaaaac

SEQ ID NO: 8402 - RNA, 1792 nt, Mus musculus
uguggucuucgagcccagugucccaccgcagcagccacucggagcucuugguacagugcagagccaagggucgggcaagcagucugaggguugggguggccaagggacaggagcagcggacccuagaugaagcgagugaugcucucacaaacuuccacgaucgcuggagcuaugaacauggucgcucccuggacucgguucuacucccacagcugcuguuugugcugccauguccacaccggcaccauccugcuaagcgucugguaccugaucaucaaugcugugguccugcugauccugcugagugcccuggcagaucccgaucaguaucacuuuucaggcucugaacuaggaggggaguuugaguucauggaugaugccaacaugugcauugcuauagcaaucucucuccucaugauccugauaugugccauggcuaauuacggugcauacaagcaacaugcugccuggaucaucccauucuucuguuaccagaucuuugauuuugcccugaauacuuugguugcaaucaccgugcuuaucuauccaaacuccauucaggaauacauacgacagcuggcuccuagcuuucccuacagagaugauauaauguccgugaauccuaccuauuugguccuuauuauucuucuguuuaucggcauucuuuugacacuuaagggcuacuugauuagcugcauuuuggagcugcuacagguacaucaauggcaggaacuccuccgauguccugguuuacguuaccagcaaugauaccacagugcuacugccuccguacgaugaugcuacugcugugccuagcacugccaaguagccaccaccaccuuacuugucugccugaaccuggugcugaagagcugagagcaucaguuugagcccuuagcugcauaaauuauccugugguuucacuuccauggugaacucuuugaaccauauuuuacaauuuagauguuaagcugaagccucuguugacacaugcccuguagcuaagcacugacuagggaggcuguaggaguguagugugaugaguucccagagucuuucucaaaacuauagacauuggucccuggucuggcuuauaccugacuggccccagagcugggugggcagucauacuuuucuucuccauucccucugacuguuuugaaaguauaaaauuaaaauuagaugauacuuaaaucuuuccaguauacauaauacaaauaauauuaauugcucuaauuagauaguuaggagcccuuccauauaugauauaagaauuucccuacuaucccuaaauucaaugauacucugaauuugcuggucaaggauuuucuuuaggcuaaauaaagaccccccaagguaacaggcaacagugagggcaagagcugccugggcugccuguuguuuugggcuaugguugaugugucucccugugugaaauggggaccagcuugcucugcacugagagacucacacucacuuuuccuugguuaccugcaccaacagaaccaccauguauguuugggaaaagguguucacacucuuuucuugcaagguacaaccugcuuugaauuucuaaguaugccuaaucauuuauuaaaaugucaagcagucuucagaaagauaaggagguuuguucccacguagaauacucuagacugucuggauugugaaagacauuuauguucaugucucugaaugugagcaggucuccugcuuggucauugcucaaugugcuguacacaaaggcuuugcaauuaaaguuugucugcauccaaggggaaaaaaagagaac

SEQ ID NO: 8403 - RNA, 26518 nt, Mus musculus
uaagaggagggugguucuuccggaauucuuuucgcugguucccuguaauuaagcaggcuuaagugauuuguccugugugcugcuggguacugugaaggaaacucaggcaaguucugaaagugcgacaugaugaggauauugucacuucccacagaggugaggagcgggaucgggugugcuggguccuacggaaggcugggucggaaccagcagcuacaugcaggcaccugcgaguugccucgugguuuuagccgcuucuggacccaacgguggcucuugcauaacuuaacuaucugggcugaauauucacaaaaccuuucgagcaggguccuguguauagaaacacccuuagcaggaugccaaagucagacaggcuaaguuucuuucguguauucuacaaguuguucucuuggccuuuagcauugagcucuguacaaggagguaagaauggaucaauucgcauucuucuacaugcuaaccgccaauugagccagcaacauuuguugaagaugcuguccucuuuccccuggaugguuugagcuccuuugucaaagauuaaguggacauagaugugugaguuuauuucuggaucuuaaauucagcuucauugaucugacugucacuguaccaguaacaugaaggggguuguuuguuuguuuuuguuuuuguuuuuuaucacaauugcucuguacuacagcuugaguuucgggaugaugauuccaccaaagguucuuuuguuguugagauaguuuuugauauccuaggauuuuuguuauucuagauuuauuuacaaauugcccuuucuaauucugugaagaauugaguuccaauuuugguggggauugcuguguaucuguagauugcuuucagcaagauagucacuuuuacuauacuaauccugccaauacaugagcaugggagacguuuccaucuccugagaucuucuuugauuucuuucuucagagacuugaaguuauuauacagaucuuucacuuccuuaguuagagucacaccaauguauuuuauauuaauugugacuauugugaaggguguuguuucccuauuucuuucucauccuguuuaucauuucuguagagaaaggccucugauuuauuugaguucauuuuauauccagcuacugcacugaaguuguuuaucagguuuaggaguucucugguagaauuuuuaggaucacuuauagauacuaucauauccucugcaaauaaugauauuuugacuuuuucauuuccaauuuguauccccuugaucuucuuuguuguggaauugcucuugcuaggacuucaauaguuauggagaaagugugccgccuugucuagucccugauuuuaguaggauugcuuuaaguuucucuccauuuaauuugauguuggcuacugguuugcuguauuugccuacaagguaauggccugcucuuguugaaagacacuguaccuauucauacuuucaauaauaucuaucuuuuaaagaagucaauucuugauaacacuuuuuuuuuuuuuuuuuuuuuuuuuuuuuuuuuuuuuuugguuuuuugagacaggguuucucuguguagcucuggcuguccuggaacucacuuuguagaccaggcuggccuugaacucagaaauccgccugccucugccucccaagugcugggauuaaagguguaugccaccacgcccggcucuugauaacacuuuuuaaguuucauuuucuuagaauuucucugaacaucuagauuuuuuuuucucuuuaguguuucuggagaauuuaaguauuuuauccguuuucucaacugcuaugauuauuuguuucuauuuagaggaauuucuucuauagcccagacuugccuuuugcuauguaauuucuuugaauaccuaauccugcuucugcuguccaaugccugaagagaagcauauaaauucuuccaggaugagcccugacuggucaaugagggaaaaagacagagagauaugaaugaaggaaugaaugaauguucuccuaccuccacaacauucuaggggaaauuauagaucaagagggacauugguaacaauugauuucacugaccaacuuugaaaaugguguauucacagcaaccaaagggagugggaagaaugauggagggagcuuucuuuuaaaauaccuucuauuaucagugcauacuaauguuaucaauguuagaugaucaauaaaaggccaaacuugaaaauuuacgugguucacagaaaaagacaaucaagaaucuagagaaggaaauggauuaauuuuuagaaacuaaauaucuguacguacaugaauucaaccaacauguaagugcuugacaaauuucugugucugugccuaguaggaauuuuacuauuccaauuuuacagugugcauugggagagaaauguaugaguaauaccugguuugucuaauacuuggauaacuuuucaaucauaaagccaauuucagcuuuuaaaaauaaauuuugauauuauaauuaaauccuuuagguuuauccuuucucacuguuguuaagucuuauggcccagcacaaauggcuuaggugccuauuuaacaaaucaaagcaggccagaaugucaguuucuccccaaaucccccaguuacccuuuacaguguaugccuaacaaagcacacccuggaucuuagggauugggguauacaucucccugcuccccuuccuuauguaauccacccaaauuuguuagaauaucuuuuucaucuaucauuuacccaccucaucacuuugucugguuuuccucuccucuccuuccucucuucacauggcuuugguuccacuugauucuggucacucucuaagaugugccugucucuaacuccacucucccauguaucagcaauaaacuuucuguuccaccaugucuaggaacagccauguuccuuuccuuuuuauuuccuuuuucugucaccuccuauuaaccacugcuugcuuucacauuuauggccacaucuaccuucaauuguugcaacauuuuuaauuuaauuucuuucgaauauuuaauuugauuugauuuuaauuuuuugaauuuaauugaauuaccagccacaugguuguguuuauggaaauuaaauuccaggccauauaaggaguuuugaguuucagggguuuuucaggugugcauggugcuuggcacaaagcagacauuaaauuguucuuuaccauuguuuugcaugugggcuucaguuguuguccugaaauuacaaagaaguaugaguggcugcagagacauacaaacccuuuugcucaucugaauucacaaagagagcuguaacauauugagcugcucuauuuggaggagagaucaguaguaucuuuuuuuuuuuuuccaguuuuuaaaaucugguugaaacaccacuaaacaugguacgaggggaaaaaaaucucuuauuaaguccucugaaugaaaauugugcaaaguuccugaagagacagaaaccgcuccaucuccaagggagaauacucagcguaacuguggcuucauagaaugaauugguuguguuccuucuguuucuacuuugugaacuagauugaagaguauugguagugcgucuuuuuugaaggucugauagaauucugcacuaaaaccuguccugggcguuuuguuuguuuguuuguuuguuuguuuaggagacuuuaaaugacugcauguauuucuuuaggggcuuaagagacuguuucaugauuuaucugauccugauuuaacuuugguuuuuauuaucugucuaaaaacuuguccauuacauccggauuuuccaguuuuguguaagauaugguuuuaguaguagaaucugauaauuuuuugaauuucuucaguuucuguuguuauaucucccuuuucauuucugauuuuguuaauuuggacacugucucugugcccucuaguuugguguggcuaaggauuuacauaucuuguucauuuucucaaagaaccagcuucuuugaaccaguuuuguugauuauuugcauaguuacuuuucuuucuguuuggcuuauuccagccccacguuugauuauuuccugcugucuacuucucuuggguuuauuuucuucuuuuuguucuagagcuuucagguguacuguuaagaugcuaguguaugcucucuccaguuuguuuuuggaggcacucggagcugaguuuuccucuuagcauugcuuucauugugucaccuaaguuuugguauggugugccuucauuuucauuaaauucuaccaaguuuuuaauuucuuuuuuuuuuuuuuuugcuuaaccaaauuaucauugaucagggcauuguucugcuuucauguuuaugucagcuuucuguuguuuuuuguuacuauugaagaccacccuuaguccuuggugaucugacaggaugcauggaauuauuucagucuucuuguaucuguugaggccuguuuugugacugauucuauggucaauuuuggugaugauaccaugagguacugagaagaagguauuuucuuuuguuuuaggaugaaaucuucuauagcuaucuauuaaauccacuugguccauaacuucucuuuguuucagugugucuguuuauuuuguguuuucaugauuaguucacugauaagagugcaguuuugacuucucccacuauuauuguugaugugcaacgugugugcggaggcuuaguuguguguguagaggcuuaguaguguuucuuuuaugaaugugguugcccuugcauuuggaggguagauauucagacuagagaguuccucuugguagauuuucccuuucagcaguaugaaguguccuuccuuauccuuuuuagauaacuuuugauugaaaguugcuuuuauucgauauuagaauggcuaccccagcuuguuucuugggaacauuugcuuggaaaauuauuuuccagcacuuuuuuucugagguaaguagcuuucuuugacacuaaggugaguuucguguuugcaccaaaauguuggguccuguuuaugcauccagucuguuauccuauaucuuuuuauuagggaauugagcccauugauguuaagauauauuaaggaguagugauugcugcucccuguuauuuuugauauuauuuuuauguuucuguggcuauuugcuauucuguuuguugaaagauuacuuuauugcuuuuucuaggguguaguuuuccuccuugauuuauauuuuccaucuguuauccuuuguaaggcuggcuuuguggcaagauaugguguaaauuuguuuuugucacggaauaucuugguuucuacaucuaugguaauugauggugaagggcaaagcagggagaugggguaugggauaaggggcuauuaggagggggaaaaaaacaggaaagggggugacacuugauguaaauuaagaaaauauccaauaaaaaauguccucuauuaucaucaugagaagugauuuuaaaucuaaaccuugcuuuuccagugugaugggguauccaggacuugcuaugcugggagaguugggugcagaugaugccagauagccuuaguuucuguggcuuauguucuuguucuugccucuccccaucugauuaucucuauugcuacuugcgcucacugucucugacuggagccugucucuccuguuauugugguugugucagaacucagaguccagcucugucugugauccugagauccuguguguaagagcuccuggaagucaagaugccuuugggauccugaaauccuggugugaccaaguucugccauccuguaauccuauuauccuauaauccuggguguguuagagcaccucgagugcagcuuccucuagguguugugggauugggugcacagcuagcagccaaggucugcucagggacuggcucaggcuagaaagacuuaauguauuauauagugaauguaucaucaauacucuguaacauuaaagaugauuuuuuguuuguuuguuuuuauuguuuuuguuuuuugguuuuuuaauacacaguuuuguguguguuuguguagcccuagcuguccuagaacgaacucugaagaccaggcucgccuggaagucagaaaucugccugccucugccucccaagugcuggaauuaaaggcuugcaccaccacugccuggccauaaagauguauuuuucauuugaauauuaauucaaacauuagguuuucuuaaagggaagcaagaauauuuuagaauucagugagcagauaccuuuguaauuccacuauuccaacuauugaaaaauaauacaagaaaaugacaugagcaaguuuuauguuuauauguuguuuuguguguguguguguguguguguguguguguguguuuguguauguauuucucacuuugaggugggcaaaacuuugauuuccuacguuaaguuagggccuaggaaugugcuugucaugaacuccugcaugauguucaucuuguacccaaacagaaugagaacuauauaugucaaaauaaugcuucccuugucuccauuuuaugcuuuucuuuguuuauuguuguuucccuucuuccaugaguuuucucuuaggaaauguuggacucauuuaauuggaacuagauucuucucucauacaguauagcaaggccacuguuuuccucccuccacuccauucacuuauccucacccucuucuauccuccuccuccauggaucuccuccccuucuucuguucucucaaaacaagauagaaaagccaugaugaaagcucuccuuuugaucuuggacuuggcaagcaaaugggaagaaaagagggucaagaccaagcaaaagaagcagagauacaccugcucccagggagagaaauuauucaaauucccaugguaauagccacgacauagaggaauaaggccuagcuaacauacaugcuagccccauuuuugccuaauaaguccaugugaggauuccuagaaauccagacaguguaagccauggguucccucugauguccagcucuucuaguuaauucaaauguugucuaaccacccaauaaauuugucacaaccuuauucaggcuggagagauugcaguuggaggguuuuguagcuuuuauuaugucgaggauuuucuauuuauuuauuuauuuauuuauuuauuaugugaguacacuguagcugucuucagacacuccagaagaagguauuacguuucguuacggaugguugugagccaccaugugguugcugggauuugaacucgggaccuuuggaagagcagucggcacucuuaaccacugagccaucucuccagccccccacgauuuucuuuuuguggcccagggaguacccucucuccacagagagacuagaacauauuuccagcucuuuuuucgaacauaggggugaaagacccaagccuuuacacacuugauuuucaguuugaaauggcugugucaaaguugucuucaagaaugagucccugaggucaguuuucagugaguaauuuuccccccuaaaaucagcaugagauccuuagagaccucuuuggccaacaucucaaagaaaugcaaaccuuucuucacagugcuggcuauaaagauggccaguucagaaacuccuuuagucguggucaauaggaucgccaucauuguuuccugaagguuuucaguacacuagguuccuauacuaaccuggaaauucccccuaauuccagcucuuucuucuugcaucuccugcucucuuccuacauucccaucuaaaugaucccucccacuucuuuucacauucaccccaaucuaaccauggagucuguucuuuuuccccuuuccagaaaggugcaugcuucccucucuaucucuccucuuccucuaaccuaucagggucuguagaagguagcagcugagugauaguccauggugucaauguaccuuuuuuuuuucauccauucuucagcugugggacauauaaucuuguuuuuaguaucuggcuaguacaaauaaaucuaucaacagaguugaucaagucuauugucgauggagaaacuuuugcauguaugccugucuuagguguuuauugcugugaagagacacgaugaccaaggcagcucuuuuuuagauuauuauuuauuuauuauauguaaguacacuguagcugucuucagacacuccagaagagggagucagaucuuguuacggaugguugugagccacugugcgguugcugggauuugaaccuaggaccuucagaagagcagucagugaucuuaaccgcugagccaucucuccagccugccaaggcagcucuuauaaggacaacauuuaauugaggcuggcuuacagauucagagauucucuccaucaucaucaaggcaggagcaccagcguccuuacaggcauggugcaggaggaccugagaguaccuacaucuuccucugaaggcuccuaggagaagauugucucccaggcagcuagcaugaggauuuuaaagcccaagccagacaguggcacaccugcuccaacaaggccacaccuacuccaacaaugccacaccuccuuauaaggccacuaucugagccaagaauaugcaaaccaccauaaugcccaagagagugguauaccuggguauugagguagauggauuccccuuuuucugacaaccaugauauugauuuacacagugucuguuuuagcuugcagucucucacaagcugcagagguauacucucuauaaugugaacagucacucuguuauugaucuuaacuauucugacauguuuaaugacauagaagguuuccuuuccauuucuguaauguugaauacuuguuucuaagccauugaagauuccucuguugaaaagucucuguuuauauaugaacccugcuuuugaucugcuuuuguuuguuuuuauuuuuagacuaucucgauucuuguggucuguauauauuuuguauguuaugucucauauuuuucucuuauauaacacuaugagauauggauauggcaaaaaucuuuucccauuuuguagacugucucuugucccauugacuggauuuugccuuccagaaacaucacaguugcaugauguccaauuuacuaauuacugaucuuauugccugagcuauucguguucuucccauaagaacaguaaugugucuccugugacagugcacucaaggccauugcccgcuuucucuucuaucagggccugugugucugguuuuaaguguuuaauccacuuggacuucuguuuuguucaggguaaagaauguagacuucuuuacacauucuucugcauguagagcauguuauaguuuaacaagcaccacuuguugaaggugcuauggguuuuuagguauguuuuguuuguuucuuuguucauucuuguuggcuuuuuuguauguuucuugauuccuuagcaaucaacagguuuguguaugucauaggaauuauaucugugucuauaccucuguuccauuaaucaacugucuauuugugucccaauacauugcaugguuuaguuuauauuuaauuuuuggagacaggguuucucuguguaucccuggcuguccuggaacuuacucuguagaccaggcaagccuggaacucagaaaucugccugccucugccuuccaagugcuggaauuaaaggcaugcaccaccaacugacuggcuauauugcagguauuuuauuguaauagauggcuuuggcucuccaggguuuuuguccugggagcuggaaacuauccuuucaaggucuauuacaagcuacuuuuuuaauuuugacggggauuuuauggaauuuguagaauacuuuuggcaagauggguauuaaucauacuaaucuacgagcaugagagauuuucccaucuuccuauaucugcuucaguuuuuucacauaguugaacuuuuuuauuauuuuuuauuuuauuuuuuguuugauuguuuguuuguuuugcucuagacaggguuuaucugucuaguccuggcuguccuggaacucacucuguagaccaggcuggcuucgaucucagaaauccacuugccucugccccccaaagcacugggauuaaaggcgugugccaccacugccuggcauaguugaacuuuuaaucaugcauguacuucaguuccuguuuuaaagugguuacugguuaguucauauuguugauccacuuguaggguuuuagaucccuuuagcuccuuggguacuuucucuagcuccuccauugggggcccugugauucauucaauagcugacugugagcuuccacuucuguguuugcuaggugccagcauagucucacaagagacagcuauaucaggguccuuucagcaaaaucuugcuaguguaugcaauggugucaguguuuggaggcugauuaugggauggauccccagguauggcagucucuagaugguccauccuuucgucucagcuccaaacuuugucucuguaacuccuuccaucguguuuuguucucaauucuaagaaucuccuguauuucuuuacgggagauauuuauuuccuccuuaagauccuuuaucauuuccaugaaaugggaauuuuagaugauaaucuugcuuuucagauggguuaggguauccagcguuuacuguauugggagaauuggguugugcuguugcugaguaccauugguuucuguaacuuauauucuuguguuugccuuacaccauccugauaucucuguuguuauaugaaguuguugucucugacuggugcuugucccuccugagaaccugguuauguugggccuccuugguucaggcuauaucuucaggcuguaucucggugugggaggggggucuggagcaccugaucugugagccuggcuguggcagacauccugggagacaagcugacucugggucuagguggaguuaguguacuaguguaguuccagggcacuguuucagacuagaaguguguaucucuggcagggugggaguuacugugucuucuggggcccaggaugggaaucccaggucagguguggaagacucaccugugagucugguaaugucagaacuucuggaagucaugcugugagaugugugcaugggagggaagggguugcuggagcacacagucuuaugucacuguuucuaauggguguuuucuguacuuaugaaaaugauugugugugugugaguaugagugugcacacaggcaugcaaguucaugcccuuucaagaguuccacauauauaaaaguaaaacaugaaaaguaaaauuuccagagcauuugagaaugcucccugcuuuuacugauuauccaaauugaauaccuagcauucaaguccuuuggcaucugucuuuagaguaugguauccaacucuuucuucuggcuuucugugacucugagauuugguagcuaccuguggaaaauaaccaucaauuaagagguggauuccauguaggugaaucaaauaaugcuauuuuggauagcccauaagaccuaaauacuccacacaguuuauuaccaauauaaaaucuucagaccagcagguuaagccaaaacccaaguauuuggaggucuuuguguacucuugaggaucaagaacacagagcauuuaaaggcccuguccucgcaucauacuuaacagcuucuuggagaugacgcauacaguuuuauaauagcuaaauaauuaugaaaaccugcccguagaauguuacaauuaauuuuguuguuuaugcauugaauuugccaucaaguguaucaaauucuaguuaaaucugaaauuaccuccacaacuggagaaaccuuugaauggaccugccauuucaaagacuccucaacagaggaauggauacagaaaaugugguacaucuacacaauggaguacuacucagcuauuaaaaagaaugaauuuaugaaauuccuaggcaaauggauggaccuggagggcaucauccugagugagguaacacauucacaaaggaacucacacaauauguacucacugauaaguggauauuagccccaaaccuaggauacccaagauauaagauacaauuucuaaaacacaugaaacucaagaaaaaugaagacugaaguguggacacuaugccccuccuuagaagugggaacaaaacacccuuggaaggaguuacagagacaaaguuuggagcugagaugaaaggaugguccauguagagacuuccauauccagggauccaccccauaaucagcauccaaacgcugacaccauugcauacacuagcaagauuuuauugaaaggacccagauguagcugucucuugugagacuaugccggggccuagcaaacacagaaguggaugcucacagucagcuaauggauggaucacagggcucccaauggaggagcuaaagggaucuguaacccuauaggcggaacaacauuaugaacuaaccaguaccccagagcucuugacucuagcugcauauguaucaaaagauggccuagucggccaucacuggaaagagaggcccauuggacacgcaaacuuuauaugccccaguacaggggaacgccagggccaaaaagggggaguggguggguaggggauuggggguggguggguaugggggacuuuugguauagcauuggaaauguaaaugagcuaaauaccuaauaaaaaauggaaaaaaaauaauaaaaucuaaaaaaaaaaaagaaaagaaaagaaaaaaaggacugagucagcuagcugguugucaguguuuccaaggcggaugaaccucucugcaccuuuggcaaaaugaaggcuuagcaauuuguugagcucccuucuccacugcuggcaccuaaaaucaacaauugugaaucaaggcagaccuauagcuauggagcuaacauuauuuggacagugaugccagucaugugggccacaauaggccuuucuuuuuugcaguuuauuuucccaaugucuuaggaacuuucguaauuugcuucuauauuacuuuauagaauggcauaaaaauaucauucuuacuaacacagaccccugugcacuucaccuucugaaauuguuuguuuaaaucaucuuucauugcuuacacuguucucaauuauuuuuugaggguuacauaucccuuagaaaauacugcacauauauauugaaaaaaaauuagacccuauaucaaaagauaaaaaaguaaaucuaccuguccucucccuaaaaaaaaccaauguacucuuguaaaauuuguaaguuugccaccauuguuauuagagcaaauggggcguguauuauaaauucaucucacaguuuauguuauuugaacugguggauuuauuuuucaguucaaguaauaaaugaacauuuguucuagugugagaagugcucugugcaccuuccauacacugacuuauuugugaaagcaucaagaucuauuuuaucauauaagauaggaaauaauauuuuugaaguaaugauuaaaaauauauuuuauaaaagcuguauauacauuaaauuaauacucuacaugauuagcuaugauacagugacuagaauaugugauacagccauugagaaugauauuguacaaauaauuucagguugcauuguauuugaaauaaacuccuaaagacagcagcuaauuucucucaauuacauuggaucugagagaauuaacauuauagugguuacauugagacagguugauauaguuauauguuaucagucaucuugcauucauauagauauuuugcuuuauaucauuaugaauaauuaauuuuuauucauugccacaacuugaauuuccuauaccacuaaccauauuaaauucacauuuacauguauuacacauaucgcaagauaggcagaaaacccacuuuccauguugccuagugugagccuuugacaacuuuuaagacucucucaaucaaagcuauuagccuuugugguauauauguuauaauucaguguucuacguuucuaaauguaggacaaaucuugcugguggguuuucacgauuauuucuccauggaaaaauuauauuguggagaauguacugugaaacucaauucucaacauguuggcaguuucugcuuuugaugagaacacaagaccaugauauaauugaaauaugcaaaguuuaaauuauauugaccuucugauaccauccauaggacuguucuaaaauacucuuuuauuaguaauuucauuauguauuuuauuagcacuguuauucauggaauauauaaauuucaucaugccgcccuauagucagagcuucaugaucagaaagcaggaagaaauuaaagaaggcauuggaauaauacuuuuacuguggauugagacaaagaaugaauaaauuugaaauugaaaacaaucuuuacuauugucucaaaaacauaccauaaugucaauacuauaguggcuacaaaauguaugaucauuucacacagaagagaauaucuuguucuucaaaacuacuaucaaugauuuugucuugaaaaugagagauaguaaugaagacugucaugcauuucuuacaugcuuaaaguuucuccccaguauggauuuugaggugaauuugaauaugugagguauugguaaaauacuuuguacauucuuuugacuuguauuuuuuuuccuauauggguuccaguauauacugaagaccagcugagauauugauacucaggcacaaguacugaagcacuacuggauucuucaaauucucauugauuuacaccucuguuuggacuaauuggcccacagcaugagacccacucuaauaaauccauuuucaauacuuauaaaguaaaugauuaaaaugaauaaauaaauaaaugauaaaaauaugguugaaaaaaaugaagaaaaacauaagacuuaagauguagguauagaccgggcaugguggcauacaccuuuaaucccagcacuuggaaggcagaggcaggcagauuucugaguucgagaccagccuauucuacaaagugaguuccaggacagccugggcuauacagaaaaacccugucucaaaaaaacaacaacuacaaaaaagaugcagguauagauaaagaugaacagaaaggaacacacaaacaaaaauaaaaauuaauagguugaucagaagaguugaagaagacuaugaauauuuggacuggauauccugcugccaucacucagcagggaugugaugacuucuguaauagcuucagcaagaauuggaaguccaguuaacagucaagauacauuuugaguaagugagugguaugcaaugcgugaguugugguagcaguauccacauuuagaguagcaugucaugaagguaaagcuuccauuaugaagaauuuagacuuuuaguugcacaacuaguaauaaauaugaauacauaauuguaucauuucuugaaauuuuuugacaacuauaaucuacuuugacagauuuucaguccuccaggaauacaaauuaauccuccaauccacaaaguccauaucuccaggucaauaguauaaaaauauuaguaaugcuaacauuuauauauauauauauauauauauauauauauauauauauauauauauauacacacacauaaauaaugaauaaauuuggaauuauguauuauguauugugaguauuaccaaggacacugcaaaaccacugaauaagacugcucugugacugcaaaaagauauguauauacauguuucucaggcugucucuuuuggauacaaaaauggcaaaacuugaggaaagccuuggaagauuugaggggguaaauuugcagugagagugaguguagaagugggaauaguguggaagauagggugguauuccuguggcucagaaagccuggggucucauguggguuauaugguauauguuacagguauguguucauauguggcaauagaccaggcucagcuucagagaggaucugagagaagaggugucuggcaguggugaaaagaaaaagcauagauucaaaguggaugacauuuauuuuucuggauauggauuuuccuucugcuaauauuucugugcugcucugucucucucuggagauuuccuugucuauauucugcuugauugcuauucugagagaccucuaugucuauguccugcuuucuugcuucucucucucucucucucucucucucucugucucucucucugucucucucucucccccucucccucucccugucccucucucucucccacucucccuuucuccccgucucccccucuccccuucucccucuuucccuccccccucuuucucuguguguguaugcauguguacucauuuuccuagcaguuuucucuucaguuuaaacauuucucugguaagcucaucuccaacagaauacaaguacaguuuuguuuuguuuguuuguuuguuuuauuuuaccuaucaaucuacucauuuacuccagguuuuagguuuuuuuuaaucuuaggaaucagcauuccaugaccccaagccuuugauucuuaggagacucggguguacauuuuuucuuagcauugcaaaauaacucaaagcucugucugccuuuguuaaacacagaugauaggcuaguugggugugacccugcacugaacuuaucauuuccagcaagccagaggguaaccuugcuguguccuaguuugauccugaacucaggaaccugucuugucuuccuaagcuuaagcaaucaaacaagcaaacaaacaaauagauguaacuuucuaacaaguuggcucauaguguacugcuuuuguugauucagaauugugaagacuaucacauaauucauauugaaucauuacuuuugcauaguugagaaaauauauauucaaacucauguauagaggguucuuucccuuaaaugcuguacugaagguccuaauauuuaccauuuugcagacauagccacacccuuaacuccuggacuccagcuguuucuaauuaucauggagucauuaaccuuaacacugaggacauuccuugcagauugugaaauauguaggucuuugggucgauuccauugguccacauaucuguuuuuguaccaauaucaugcaguuuucaucacuauugcuggagcaauagugcagcuuaaguugagggauggugauuccuauugaaguucuuuugcuguuuaggauugcuuucacauuccuuauuuuguuuugguuuuuuguuguugauuuguuuuguuuucccccuaugaaguugagaauuucucuuucaauauuuguaaaaaaaaaaaaaaaaaguuguguuagaauguuaaugggguuacacugaaccuguagauugcacuugguaacuugcauauuuucacuauauuaauccuaccuauccaaugcuuggcugugaauaucuccaucucucauucaguuacugguagagccucucagagaacacccaugcuaagcuccugucugcauagcaggcauagcauagcaucaguaauaauguuaggguuuggugaccacccaggagauggaucacaagucggccagaaaguauucagccauuaguuugugcucuccuccauuuuuauccccagauucuuuugagaaaggaacaauuuugaacggaaaauuuugaaugugagggccuccacugggguggagguggucucuucagguuccuuacucccuuuauugcacuuuugacuaagguuaccccauuguguccucagagccuccccuuagaguuucuacucuaagggaauucuucucagucauugguaugccaaaugucagugccuguaguaacaaagcuagcuccuaaauaauugaaacuggaccauuauauucauuuauuuaucaagcuuuaaaggaacgauaagcaagcauuuuucuucuauuuucauccucugaguuuaucugaccaauucccagucaaaacuccugugauacugcauuuuuuucacugaucugugucucuaggcuagggguguuuucuccuucugaauuuuuucaauaaaccuauuaaguccaugacuaagcaggugauagaauaaugcaagaccuccucuaaauaaaacauggagaagaauaaugggaguggugauucaguccaggaguuaucaagagaaaacaccccuagccuagagacacagaucagugcaaagugaguuccaggacagccagggcuauacagagaaacccugucuuuaaaaaaaaaaaaaaaaaaaaaaggaagaaaaggaaaaaaauuauauuugaauccuuuaggcuuauccuuucucacuguuguuacaucucaaggcccagcacaaauggcuuaggugccuauuuaacaaaucauagcaggccaguuugucaguuucuccccaaauccccagucucuaccuuuuauaguauauggcucacauaaccuacccuggaucccagggauuggucuccaacucucccugcuccccuuccuuauguaauccacccaaauuuguuagaauaucuuuuucaucuaucauuuacccacuucaucucuuagucuuguuucccucuccucuccuuccucuuuucacauggcuuagguuccacuugauucuggucacucucuaagaugugucuuucucuuaacucugcucucccauguaucagcaauaaacuuucuauuccagcaugucuaggaacagccauguuccuuuccuuuuuauuucuuuuuccuuucaccucccaguaaccauuccuuguuuuuacauuuaugaccacaucuaccuucaauuguugcaacauuuuuaauuucauuucuuuugaauauuaaauuugauuugauuuuaauuuuuugaauuuaauugaauuaccagcaacaugguuguguuucauggaaauuaaauuccaaagcacauagggaguuuuuaggguuguuuguuuguuucagacaggguuucuugguauagugcuggcuguccuagaacucacuuuguacaccaggcuggccuagaacucagaaaucugccuccugccuccugccuccugccucugccucgugcugggauuauaggugugcgcuacuacugcccagcugaguuuugaguuuuagagguuuuucaggugugcaugguucuuggcacuaaacagacauuaaauuguucuucauuguuuuuuguggggacugcaguuguuauccugaaauaaaucauaaugaacugagcaucugcagagacauauaaaccauuuugaucaccugaauucacagagaucuguagagcauuagaccuuucuguuuguaggagagacuaguagcaacuuuuuuuuuucauuuuuaaaaucuauuucgaacacuaaacauaauagaaguaggaaggagaaaaaaauuucuaccuuguucaugcgaagaucaugugccccgguacagcgcgaugccagggccaggaagggggaguggguggauuguggagcacaguguagggaggguauaguagggggcuuuggagauagcaucugaaauguaaaugaagaaaauagcuaauaaaaaaaaagugccuaaacaaaaaagaaaaagaaaaaaaaaucucuuaugaauccucuaugaaaagaaauugugaaaaguuccugauuacacagaaaccacuccaucuccaagggggaguacucaguguaacuguggcuuccuagaaugaacuggguuguguuccuucuguuucuaguuuguggaaauguuugaagaguauugauauucuucuuugaagaucugauaguauucuacauuaaaaccaucuuauccugggguuuuugggggguuuuuuuguuuguuuguuuguuuguuuuguuuuguuuuugguugggagacucauauauuauugauauuaauacuaauauauauauuuaccagauauaccaaaaagcacaccacuccaagggguuccacaugagagagguuuauuguguagggacaaaggggacagcaaggcaaguagagggguggagaagaaagagagugaggagagggugaucuccuaauuuguauggaaaaugacaucacacauguaagggugggaggugaacugaguagauucugggauugagguuguuggcuuggcaacacaggacaugggucacaucuuuagcaccuggguuuagaauguccgccugcuaacagacuuuuaaugacugguucuauuuuuuaguggguuauacgacuguuuagaagguuuaucuaauucugauuuaacuuugguauugguaacugucuagaaaaccguccauuucaucuacauuuccucaacuuuuguugaguauaguguuuuguaauaggaucugauauuuuucuucaauaucuguugucucauguggguuuuaugguauauguuacagguauguguucauaggugccaaaagaccaggcugggcuuacagagauguuuugagagaagggguaucuggguguggucauuuuuacuauguuaauccuaucuauccagugcuugccugugagcaucugcaacugucucauucagcuauugguuaagccucucaaagaacacccaugcuaagcucaugucugcaguuacaacacagcaucaguaauaaaguuaggguuuggugaccacccaggggauggauuccaaguuggcucagucaauguucagccauuuguucaugcucagcuccaugauuguccccacauuccuuuuaguaaggaacaacuuugaggugaaaauguuggaugugagagccuccacuggggcccuguccauguacuggagguggucucuucagauuccauauucacucuguuacacauugaacuaagguuacccacauuugggccucagagccuccccuuagaguuucuacucuaagggaauucuugucaggcauugguaugccaaaugucagugccuguaguaacaaagcuagcuccuaaauaauugaaacuggaccauuauauuuauuuauuuaucaaguuuucagggaacaauaacuaagcagauuucuucuauuuacaucuucuaaguuaaucugaccuauucuuggucaaaaauccaaugauacuugcauuuuuucacugaucugugucucuaggcuagaggugguuugauucuuuaauuauuuuuuuuuuguuuuuuuguuuuguuuuguuuuugguaaggaauaguguaucauaguauacaacucugacuauccuagaacucauugccuauaccaagcuggcagcaagaacaaugagauguuugugccucugaauccucagugcuguaauuaaaugcauucacgaaucuaagcaccuuguucauuacuuuuguaaugagaauauuucauacaauaucucugugugcuuacuaguauugaucuuuuugcuugucucuuuaugugcauucauuggcauuugucuuccaagacuuucuccaacucaaagggugaaggaaugacagaugagaacucauuauucaguuuccuucaaaaaagacuuggugaucaugaauacauuauaacuucugugucaggaaacaagugggcgaacuaccaacauuauuugaaaauauugucaaugaaauguacaagucuaauauuucauucucaugcuaauuuuguauguauacaugggauguuuuagaacgcagugacguacuaugauguccuggugagcuuuacucaggaagaaugggcuuugcuggauccuucccagaagagucucuacaaagaugugaugcucgaaaccuauaggaaccucacugccauagguaagauugugaauguuauuuaucuuuuugaaagagggggcaacuguauuuuaguugugugguuguaugugugguugcuuguuuuucuuuuuguuauugacguacauguacacuuucauuugagaagaaggaagaaugaugagaauaaauuaggcuuguuuguaaggaucacugaagauaguuucuuaaauuuugccugaauuccacaaauauaucauguauuuccuuguacugucuucuaggcuauaacugggaagaagauaauauugaagaagauugugaaaauucuggaagacccacuagguaauuuucuugugcaugcugauccaaauaugccuuugaagaaaucuuaguuuguucuugaauuuuuaguuaaaaucagggguguaaauaagcacaguuuuauggauacugauuauuaaauacucauaaaagggacaacucagugucagguauuugauuguguuugcaaggcuuuccuuuaagacagaaaacacggaaacacugccuuaacagacaguaccuuaucaagcacagccccauucauucuacgguguagaucugccagucuguuuagucucaugccacucagcuaguauaaaaacuguacacacugaguaugaaaucaguuuauauccaaaacugucugauaugcaaacaguccauaguauacugauguuacucauauacuuguggcaagguugcuucuauuauugaguguggaaguucauggaagugaaaaaguuuguugugaaaccuuaaucuaaaugccacaugucuaggaggaacaaaaauuaaaacuaagugaauacaagguauauauauuuuguuauucuuccuuauguaguuguauuauauaggacagauauaucuguuugugugucuguauaucugucuaugugucugucuuucuaaucugucuaucaucuauucauugaacauaaaugauauaauacucugccuaaggcauuuugacauaaaaccuauauagcucgcucaggacaauuacaagauugguuaauuuucccaacauagaauaaauuugucgaaaauuaugaaggcguacaauuaauugaauucacaacuucuuugugaauacaucaaaaaccucagacuacagaaaauccuaugaguauuaguaauguagaaauauucuguuuguccuguuuaacuucccaaauguuguauggcucauauuauaggaaaauucaugaauccaaucauugugguaaagcugugaaugcuugcacauuuuaucaaauauaugaaaaccucauaaaggaaaaagauauuguaacuuugagucauuugauaaaugcuuuuuccaucacagguacuuuuaaagauguaaauaauaaccauaaugaaucaaacuaauauggauaaaaacaacaugacagaaccuuauuauaucggauuccucuuuacaauuggaauagauuguuaaccuaauccauacagauacaugauucauugguauaauaaaugggguaaaccuuauacauuuaccaauugcauacacaggcuuaaauaaaaucauacuauagagaaacacucugaaaauaucuaauguguuaaacucuauuuauaucacaggcaucuucaaagggauggaccaaguaauacuggagagaaacccuuugaauguauucaauaugauggagccuuugcaagaaaccaucaucaguuacauaaggacacuggaucuuucaugucuuauacugaucgucaaauacauagaagaccacacacugaagaaaaagucuaugaugguaaccaaugugguaaaaccuuuucaugucacaaccauuuugaaauccguaaaggaacauauacuggagaaaaacccuaugaauguaaucaaugugggaaagccuuugcacgccacagcaaucuucuagaccauaaaagaauacauacuggagagaaacccuauaaauguaagcaauguggcaaagacuuuacccaucacaguacucuucauauccauaaaagaauacauacuagagagaaaaccuauaaauguaaccaguguaugaccauugcucaucuucaaugucauaaaauaacacauacuggagagaaacccuaugcauguaaaaaauguggcaaaaccuuugcauaucacaaaacucuucaaauccaugaaagaacacauacuggagaaaaacucuaucaauguaaccaaugugccaaagccuuuccauaucacagaacucuucaaauccaugaaagaacacauacuggagagaaaccauaugaauguaaucaauguggcaaagccuuugcaugucuuagaaaucuucaaaaucauaaaacaacacauacuggagagaaacccuaugaauguaaccaguguggcagagccuuuagacaauauguuuaucuucagugucaugaaagaauacauacuggagagaaacccuuugaauguaaucaauguggcaaagccuuugcacgucacagcacucuucaaagacauaaaagaacacauacuggagagaaacccuaugaauguaaucaauguggcaaagccuuugcaugucccagauaccuucaaauccauaaaagaacacauacuggagagaaacccuaugaauguaaucaauguggcaaagccuuugcaugucacagauaccuucaaauccauaaaagaacacauacuggagagagaccuuaugaauguaaucaguguggcaaggccuuuacaugucgcaguaaucuucaaauccauaaaagaacacauacuggagagagaccuuaugaauguaaucaguguggcaaggccuuuacaugucgcaguaaucuucaaauccauaaaagaacacauacuggagagaaacccuaugaauguaaccaguguggcaaagccuuuacacaauuuuuuccucuuaaacgucaugaaauaacacauaccaaagagaaacccuaugaauguaaccaguguggcaaagccuuuacacgccacaguacucuucaaauccauaaaagaacacauacuggagaaaaacccguaugaauguaaucaauguggcaaagccuuugcaggucacaguacucuucaaaaucauaaaagaauacauacuggagagaagcccuaugaauuuaaccaguguagcaaagcuuuuacacaauuuguucaucuucagugucaucaaagguuacauacuggagagaaacccuaugaauguaacaaugugggaaagccuuugcaugucacaguacuccaugaauucauaaaagaacacauacuggagagauacccuaugaauguaaccaguguggcaaagccuuuacacaauuuuuucaucuuaaacgucaugaaauaacacauaccaaagagaaacccuaugaauguaaacaauguggcaaagccuuuacacgccacaguacucuucaaauccauaaaagaacacauacuggagaaaaacccguaugaauguaaucaauguggcaaagccuuugcaggucacaguacucuucaaaaucauaaaagaauacauacuggagagaaacccuaugaauuuaaccaguguagcaaagcuuuuacacaauuuguucaucuucagugucaucaaagguuacauacuggagagaaacccuaugaauguaaacaaugugucaaagccuuuacaugucacaguacucuucaaauccguaaaagaacacguacuggagaaaaacccuguguauguaaacaauguggcaaagccuuugcaugucacaguacuccaugaauucauaaaagaacacauacuggagagauacccuaugaauguaaccagugugguaaaaccuuugcacgacacagucagcuucaaacacauaaaagaauacauauugaagaaaaacccggauaaugcagugaaugugauaaaggcuuuguuauuguagucugaaaaggaauuuuaaaaacaaauucuugugaaaacccuauaaauguaaucaaucuaauaaagccauuuguuagcagucaccuucuaagggaugcaacauaguuuaugggaauauagugggugggugugucugauucuuuugccuacucucgagaugguucaugucuuaauuauuugcuuugcgagguuugauaugaguguuugugccuauuuuuaucaaaauaugguaugccuuguucauuugcuaucucugaguaugcugcucuguuuucaggggaaaugguagaauauaugggugugauguuaguuugggagggcuauagagaaguggagggauguguacugugguccagauauaaagugggagaugagaacaagguaaaaaaaaaugaaaagaauguaacuguacauauuuacacacacacacaccccuuuuaaacaagguaugaauuaaguauauaauaaguuguaacaaacuaagauaaccuagguauagaauuuucaguguaugucuccaugcccucaaggaucguaaggugauauagguucaucaggucaaugggagcacacagcaaacuugagguucacaagcccagugcaaauggacaacgaaugaucaaugcaguaccagcggcagggagucugaacaacuuuuuggugauugaaggcuuauauaauuugcaggacugggccuaggaacuuccagaauggguaaagcugaaugcugagaauaccaaaaugccucauuagcaggggcaagcauuucaggaaucugagaaucuaggaguauggguuucuaaaucaggaugaaguuaguucauccuauauuccaguuaagucacugugauuuuccucagggugaguucugugcaagggcuuuaaauuccccagacauggucagaaaaguagaagcccugaaaaugaaggccauuuuccauuauguguugacagaaaaggcuaguuagacauugguggacuguaaccuuaauaagcagaguuuucccacauuuaaaaguauaaauauu

SEQ ID NO: 8404 - RNA, 99547 nt, Mus musculus
cagucauaagaggaggguguuucuuccggaaucauuuucgcugguucccuguaauuaagcaggcuuaagugauuuguccugugugcugcuggguacagugaaggaaggucaggcaaguucugaaagugcgacaugaugaggauauugucacuucccacagaggugaggagcgggaucgggugugcuggguccuacggaaggcugggucggaaccagcagcuacaugcaggcaccugugaguugccucgugguuuuagccgcuucuggacccaacgguggcaccugcauaacuucacuaucugggcugaauauucacaaaaccuuucgagcaggguccuguguauagaaacacccuuagcacgaugccaaagucagacaggcuaaguuucuuucguguauucuacaaguucuucucuuggcauuuagcauuuugguugucauucauuucgaguuaaauuugucuauguuuaauauguaucucauguguuuggugaaugaaagcacauuuuuuuuucaauauuucuccgugguuuuuuuuaauaaccagaaaaaguguggacuaauuuuagaacagcuucgucuuuaguuuuuuauaaaauuguuucugagacaaaguauguugacacguggguccuagucucuuucucuaccuugcuaaacuucauaauucauuaguuaaauggcuguaccacaagagaguuuuaaauugcucauuuuagucauguaauguacugcccuuugcaguagaaguagaaguacuugcauauggagcauggcuucugucuucagacuucaacaggaggaacaguuuacuguguacaguucagggcuaaacaguguagacaauagcuagcuccuacacuguaguuuaagggaaucaucugcaggggucaucauuaugaacaagcuucugaugguguaauuuacaauuaccaagguaaauuaagucaugcaugugaauaaaaauaauccagauugguggguauaccaccuggggagguuauguugaaccaaacuucauugaucuagauaaggccauucagaaauuugaaucaaggguaauuggcuuuaucuaugugugucaaguuauagacuucagcagcuaauguugcauauaaugacgggaucauacauuaucuuauugaugccauuucccuaaaagguaauagccugcuauuguugaaagacacuguaucuaggcauacuuucuuuuuuauuucuuagauauuuucuucauuuacauuucaaaugcuauccccaaagcccucuauagccucccccugcccugcuccucaacccacacauucccuccuccuggcccuggcauuucccuguacuuggccucaugaucuucacaagaccaagagccucuccucccauugauggcugacuaggccauccucugcuacauaugcaacuagagacaaagcacuggggguuacugguuaguucauuuuguuguuccuccuauagaguuucagaccccuuuagcucuuuggguacuuucucuagcuccuucauuaggggccccguguuccauccaauagaugacugugagcauccacuucuguauuugccaggcacuggcauagccucacaagaagagcuaugucaaggucaugucagcaaaaucuuucuggcauaugcaauagugucuggguuuggugguuguauauggaauagauccccgaguggggcaguuucuggaugaucauucguucagucugcuccacacuuugucucuguaacuccucacaugagcauuuuguucccccuuucuaagaaggacccaaguauccacacuuuggucuuccuucuucuugaguuucaauuguuuugcaaauuguauguuggguacucugaguguaugggcuauucuccccuuaucaguaagugcauaucauuuguguucuuuuguaauuggguuucuucacucaggaugauauccuccagauccauccuuuuaucuaagaauuucaugacuucauuguuuuuaauaguacuucauuguguaaauauaccacauuuucuguauccauuccuccauugaggaacaucugggaucuuuccagcuucuggcuauuauaaaugaggcugcuaugaacauaguggaacauguguccuuauuacauguuagagcaucuuuuggguauaagcucaggacugguauugcuggguccucagguaguccaauuuucugaggaacugcuaaacugauuuccagagugguuguacaagcuugcaaucccaccaaccauggaggagugucccuuucuccacauccuugccagcaucuguugucaccugaauguuugauuuuaaccauucugacugcugugagauggaaucucaggguuguuuugauuugcauuucccugaugauuaaggauguugaacauuuuuucaggugcuucucagauauucaguauuccucuguugagaauucuuuguuuagcucuuuaccccauuuuuaauaggguuauuuaguucucuggaagccagcuucuugaguucuuuauauauauuagauguuagccaccuaucagauuuaggauugguaaagauccuuucccaauuuauugcuagccuuuuuguauuauugacuuacugucuuuucccuuauacaagcuuugcaauuuugugaggccccauuuguugauucucgaucuuacagcauaagucauugcuguucugugcaggaauuuuuccccugugcccauaucuuugaggcuuuucccacuuucuacucuauauguuucagugucucugguuuuauguggaguuccuugacccaguuagacuugagcuuuguauaaggagauaagaauggaucaauuugcauucuacaugcuaucugccaauugagccagcaccguuuguugaagauguuguccucuuuccacuggaugguuugagcuccuuugucaaagaucaagugagcauagaugugugaguuuauuucugggucuuaaauucuguuccauugaucugacugacugucacuguaccaguaacaugcauggggguuuuguuuguuuguuuguuuuuguuuuuguuuuuuuuuuuuuuguuuuaucacaauugcucuguaguacagcuugaguucggggauggugauuccaccaaaggcucuuuaauuguugagauaguuuuugcuauccuaggauuuuuguuauuccagaauuauuugcaaauugcccuuucuaacucugagaagaauugaguuccaauuuugauggggauugcagugaaucuguagauugcuuucagcaagauagucauuuuuacuguacuaauccugccaauccaugagaaugggagaccuuuccaucuucugagaucuucuuugauuucuuucuucagagacuugaaguucuuauacagaucuuucacuuccuuaguuagagucacaccaagguauuuuauauuauuugugaguacugugaaggauguuguuucccuauuucuuucucauucuguuuaucguuuguguagagaaaggccucugauauauuugaguucauuuuauauccagcuacugcacugaaguuguuuaucagguuuaggaguucucugguagaauuuuuagggucacuuauagauacuaucauauccucugcaaguaaugauauuuugacuuuuucuuuuccaauuuguauccccuugaucuucuuuguuguggaauugcucuggcuaggacuucaaguccuauacugaguaguuauggagaaagugggcagccuuaucuacucccugauuguagugggauugcuuuaaguuuuucuccauuuaauuugauguuggcuacugguuugcuguauuugccugugagguaauggccugcucuuguugaaagacacuguagcuauucauacuuucaauaauaucuaucuuuuuuaaaagucaauucuugauaaaacuuuuacaguuucauuuucuuagaacuucucugaacaucuagaauuuuuuuuucucuuuaguguuucuggagaauuuaaguauuuuauccguuuucucaacugcuaugauuauuuguuucucuuuagaggauuauuuguuucucuuuagaggaauuucuucuauagcccaggcuugccuuuugcuauguaauuucuuugaacaccuaauccugcuucugcuguccaaugccugaagagaagcauauaaauucuuccaggaugagcccugacuggucaaugagggaaaaagacagagagauaugaaugaaugaaugaaugaaugaaugaaugaauuuucuccuaccuccucgacuuucuaguagaaauuauagaucaagagggacauugguaacaauugauuucacugaccaacuuugaaaaugguguauucacagcaaccaaagggagugggaagaaugauggagggagcuuucuuugaaaauaccuucuauuaucagugaauacugauguuaucaauguuagaugaucaacaaaaguccaaacuugaaaauuuaggugguucacagaacaagacaaucaagaaucuagagaaggaaaugaauuaauuuuuagaaacuaaaauaucuguacguuagagaaggaaaugaauuaauuuuuagaaacuaaaauaucuguacguacacaaauucaaccaacacgaaagugcuugacaaauuucuguuucugugccuaguaggaauuuuacuauuccaauuuuacaguguguauugggagagaaauguaugaguaauaccugguuuguuuuaguacauaugucuaauauuuggauaacuuuucaaucauaaagccuauuucaacuuuuaaaaauaaauuuugauauuauaauuaaauccuuuagguuuauccuuucucacuguuguuaagucuuauggcccagcacaaauggcuuaggugccuaauaacaaaucaaagcaggccagaaugucaguuucuccccaaauccgccccucccccccguuacccuuuacaguguaugccuaacaaaacccacccuggauccuagggauugggguauacaucucccugcuccccuuccuuauguaauccacccaaauuuguuagaauaucuuuuucaucuaucauuuacccaccucaucacuuagucugguuuuccucuccucuccuuccucucuucacauggcuuugguuccacuugacucuggucacucucuaagauguuccuuucucuaaccccacucucccauguaucagcaauaaacuuucuguuccaccaugucuaggaacagccauguaccuuuccuuuuuauuuccuuuuccuuucaccuccuguuaaccacuccuuguuuucacauuuauggccacaucuaccuucaauuguugcaacauuuuucauuuaauuucuuuugaauauuugauuugauuugauuuuaauuuuuuuuaauuuaauugaauuaccagccacaugguuguguuuauggaaauuaaauuccaggccacauaaggaguuuugaguuucagagguuuuucaagaaugcauggugcuuggcacaaagcagacauuaaauuguucuuuaccauuguuuugcaugugggcuucaguuguuguccugaaauuacauagaagugugagugacugcagagacauacaaaccauuuugcucaucugaauucacaaagagagcuguagaauauuaagcugcucuauuuggaggagagaucaguaguaucuccccccccccccucagucuuuaaaaucugguuuaaacaccaguaaacaugguacaaauggaaaaaaaucucuuaugaaguccucugugaacgaaaacugugacaaguuccugauuagacagaaaccacuccaucuccaagggagaauacucaguguaacuguggccucauagaaugaauugguuguguuccaucuguuucuauuuugugaacuagauugaagaguauugguagugcgucuucguugaaggucugauagaauucugcacuaaaaccgucuguccugggcguuucuuguuuguuuguuuguuuguuuguuuguuuaggagacuuuuaaugacugcauguauuucuuuaggggcuuaaggggcuguuucaugauuuaucugauccugauuuaacuuugguuuuuauuaucugucuaaaaacuugucuauuacauccagauuuuccagcuuuguguaauauauauggcuuugguaguaggaucugaugauuuuuugaauuucuuuaguuucuguuguuauaucuccauuuucauuucugauuuuguuaauuuggacacugucucugugcccucuacuugguguggcuaaggguuuaccuaucuuguucauuuucucaaagaaccaccuucuuugaaccaguuuuguugauuauuugcauaguuccuuuucuuucuguuugguuuauuccagcccggaguucgauuauuuccugcugucuacuucucuuggguuuauuuccuucuuuuuguucuagagcuuucagguguacuguuaagaugcuaguguaugcucucuccaguuuguuuuuggaggcacucagagcugaguuuuccucuuagcauugcuuucauugugucacguaaguuuugguauggugugccuucauuuucauuaaauucuacaaaguuuuuaauuucuuuuuuucuuccuugaccaaauuaucauugaauacggcauuuuucagcuuucauguuuaugucagcuuucuguuguuuuuuguuacuauugaagaccacccuuagucuuuggugaucugacaggaugaauggaauuaugucauucuucuuguaucuguugaggccuguuuugugacugauucuauggucaauuuuggugaugauaccaugagguacugagaagaagguauuuuccuuuguuuuaagaugaaaucuucuauagcuaucuauuaaauccauuugguccauaacuucucuuaguuucagugugucucuguuuauuuuauguuuucaugaucaguucacugauaauagugcaguuuugacuucucccacuauuauuguugacgugcaacgggugcguaaaggcuuaguuguguguguagaggcuuaguaguguuucuuuuaugaaugugguugcccuugcauuuggaggguagauauucagacuagagaguuccucuugguagauuuucccuuucagcaguaugaaguguccuuccuuauccuuuuuagauaacuuuugauugaaaguugcuuuuauucgauauuagaauggcuacuccagcuuguuucuugggaccauuugcuuggaaaauuguuuuccagcacuuuuuuuucugagguaaguaucugucuuugacacuaaggugaguuuccuguuugcaccaaaauguuggguccuguuuaugcauccagucuguuauccuauaucuuuuuauuagggaauugaguccauugauguuaagagauauuaaggaauagugauugcugcucccuguuacuuuugauauuauuuuuauguuucuguggcuauuuucuauucaguuuguugaaagauuacuuuguugcuuuuucuaagguauaguuugccuccuugauuuauauuuuccaucuguuauccuuuguaaggcuggcuuuguggcaagauaugguguaaauuuguuuuugucacggaauaucuugguuucuccaucuacgguaauugauggugaagggcgaagcagggagaugggguaugggauaaggggauuuuaggagggggaaagaaacgggaaaggggguaacacuugagauguaaacuaagaaaauauccaauaaaaauguccucuauuaucaucaucacaagaagugauuuuaaaccuaaaccuugcuuuuccagugugaugggguauccaggacuugcuaugcugggagaacugggugcagaugaugccagauagccuuaguuucuguggcuuauguucuuguucuugccucuccccaucugauuaucucuauugcuacuugcacucacugucugacuggagccugucucuccuguuauugugguugugucagaacucagaguccagcucugucugugauccugagauccuggguguaagagcuccugggaguuaagaugccuucucgauccugaaauccuggugugaccaaguucugccauccuguaauccuaucauccuauaauccugaguguguuagagcaccugggagugcaccuuccucuagguguugugggauugggugcacagcuagcagccaaggucugcucagggacuggcucagacuagaaagacuuaauguauuauauagugaauguaucaucaauagucuguaacauuaaagaugauuuuuuuuguuuguuuuuauuuuuuuguuuuuugauauacaguuuuuuuuguguagcccuagcuguccuggaacucacucuguagaacaggcucgccuggaagucagaaaucugccugccucugccucccaagugcuaggauuaaaggcguacaccaccacugcccagccauaaagauguacuuuuuauuugaauauuaauucaaacauuagguuuucuuaaagggaagcaagaauauuuuuagaauucagugagcaguuaccucuguaauuccacuauuccaacuauugaaaaauaacacaagaaacugacaugagugaguuuuauauguugucuguguguauguauguauuucucacuuucaggagggaaaacuuugauuuccuacauuaagucagguccuauuaaugugcuugucaugaacuccugcaugauguucaucuuguacccaaacagaaugagaacuguaucugucaaaauaaugcuucccuugucuccauuuuaugcuuuucuuuguuuauuguuguuucccuucuuccaugaguuuucauuaggaaauguuggacucauuuaacuggaacuagauucuucucucauacaguguaccaaggccacuguuuuccucccuccacuccauucacucacccucacccuccucuauccuccuccucugucguuggcaucccugggugggcggcaacacgaacgacacaggcacgggucggguucacacaacaacuuuacuucgggcuuuuucuuuuauagcccucuuccgcaguagcuucuucucaugacaagggcuaaacuacuccuauucuacuucuggcuucuaccuagggcaaggguaaacaacucuuauucuacaucuggcuucuaccuaaggcaaggacuaaacaacaacucucuacucauuacucgcaccgacucaucucccucuagcuccaccccaccucauccaaucagaauucacacacgcuccaggcucgagcuuaggucauucacauauaggcugacaggucuggaucacgaggaacuguccagcccgacagucagcccacgaaugcagucuuccugcucaugcuccagcaaggcaguaaacaaguggguuucacggggccugcagcagcacccgcuucccgcacuccuccauggauccccucuccuucuucuauuuucucaaaacaagauagaaaagccaugaugaaagcucuccuuuugagccuggacuuggcaagcaaaugggaagaaaagaggaucaagaccaagcaagaaaagccgagauacggccgggcgugguggcacacgccuuuaaucccagcacucaggaggcagaggcagguggauuucugaguucgaggccagccuggucuacaaagugaguuccaggacagccagagcuauaaagagaaacccugucucgaaaaaccaaaaaaaaaaaaggaaaagccgagauacaccugcucccggggagagaaauuauucaaaugcccaugcuaauagccacgacauagaggaauaaggccuagcuaacacacaugccagccccauuuuugccuaauaaguccaugugaggauuccuagaaauccagacaguguaagccauggguucccucugauguccagcucuucaaauauuggcuaaccacucaaaaaauuugucacaaccuuagcucagaucauauucaggcuggagagauugcaguuggaggguuuuguagcuuuuauuauguccaggauuuucuuuuuguggcccggggaguacccucucuccauagagagacuagaacauaggggugaaagacccaagccuuuacacucuugauuuucaguuugauuuggcugugucaaaguugucuucaagaaugagucccugaggugaguuuucagugacugauuuuccccccuaaagucagcaugagaucuuuagaggccucuuuggccaacaccucaaggaaaugaaaaccuuucaucacagugcuggcuauaaagauggccaguucagaaacuccuuuagucugggucaauaggaucgcccucauuguuuccugaagguuuucaguacacuggguuccuccuauaacuaaccuggaaauucccccuaauuccagcucuuucuucuugcaucuccugcucucuuccuacauucccauccagaugaucccucccacuucuuuucacauucacuccaaucuuaccauggagucuguucuuuuuccccuuuccagaaaggugcaugcuucccuuucuaucucuccucuuccucuaaccuaucaggguguguagaagguagcagcugagugauaguccaugguguaaauguaccuuuuuuuuuaugcauucuucagcugugggccauauaauuuuguuuuuaguaucuggcuaguacaaauaaaucuaucaacaaaguugaucaagucuauuguagauggagaaacuuuugcauguaugccugucuuagguguuuauugcugugaagagacacaaugaccaaggcagcucuauuuuagauuuuuauuuauuauauguaaggacacuguagcugucuucagacacuccagaagagggagucagaucuuguuacggaugguugugagccaccaugcgguugcugggauuugaaccuaggaccuucagaagagcagucagugcucuuaaccgcugagccaucucuccagccugccaaggcagcucuuauaaggacaacauuuaauugaggcuggcuuacagauucagagauucucucugucaucaucaaggcaggagcaccagcauccuuacaggcauggugcaggaggaccugagaguaccuacaucuuccucugaaggcuccuaggagaagauugucucccaggcagcuagcaugaggauuuuaaagcccaagccagacaguggcacaccugcuccaacaaggccacaccuacuuuuaaggccacuaucugagccaagaauaugcaaaccaccacaaugcccaagagagugguauauauggguauugagguagauggauuccccuuuuucugacaaccaugauauugauuuacacagugucuguuuuagcuugcagucucucacaagcugcagagguauauucucuguaaugugaacagucacucuguuguuguucuuaacuauucugacauguuuaaugacauagaagguuuccuuuccauuucuauaauguugaauacuuguuucuaagccauugaagauuccucuguugagaagucucuguuuauauaugaacccugauuuuuaucugcuuuuguuuguuuuuauuuuuagacuaucuagauucuugaggucuguauauauuuuuguauauuaugucucauauuuucguauuauauaacacuaugagauauggauauagcaaaaaucuuuucccauuuuguagacugucucuugucccauugacuggauuuuugccuuccagaaacaucacaguugcaugauguccaauuuacuaauuacugaucuuauugccugaacuauucguguucuucccaugagaacaguaaugugucuccugugaccgugcacucaaggccauugcccgcuuucucuucuaccagggccuguguuuuaaguguuuaauccacuuggacuucuauuuuguucaggguaaagaauauagacuuguuugcauucuucugcauguagagcauguuauaguuuaacacgcaccacuuguugaagguucuauggguuuuuuugguguuuuguuuguuucuuuguuuauuguugucggcuuuuuuuuguauguuuuuugauuccuuagcaaucaccagguguguguaugucuuaugugucucuaccucuauuccauaaucaacugucuauuugugugccaauauauugcacagauuuuuuauuuuuauguauguauguauauauguauguauguauguauuuauuuauuuauuuauuuuggagauggguuuaucugugcaguccuggcuguccuggaacucacucuguaccccaggcuggccucaaucucagaaauccaccugucucugccucccaaggacugggauuaaaggugugcgccaccacuggcuggcauaguugaacuuuuuaucauguauguacuucaauuucuguuuuaaaguuacuguaaccuuuuuacauuauuugaagcuguuuuguuucucugauuuuucucuauuuguccuuuguauauaggaggcauaggagaggacuacugauuuauuuauuuauauauauauuuauucguuuauuuauuaguuaacauuguaucaagccauuuuccugagaguauuugucaccuauauaaaguugguacuggaauuuuugggucacuaauguauauuauuauacgaugaauucuaauuaugauauuuuaaguucuuacuuuccaaauuauauuucagauugugguuuucuccauuuuuuuaauggauuuauguguuaccuguuuaagggcuuguaucuauuuugcuguauucuccuguauuacauuuuuuuucauuauaucugucuuuguuauuguuauuauuauuauauuagguauuuucuucauuuacauuuccaaugcuaucccaaaaaucccccauaccuucccccccccaacuccccuaaccaacuuacucccacuuguuggcccugguguuccccuguacugaggcauauaaaguuugcaagaccuaggggucucagaauccacugauggccgacuaggccaucuuuugaucauauucagcuagagucacgaucaccaggggguacugguuaguacauauuguuguuccaccgauaggguugcagaucccuuuagcuccuuggauucuuucucuagcuccuccuuugggggccuugugauccauccaauagcugacuguaagccuccacuucuguguuugcuaggccccggcauagccuaacaagagacagcuauauuaggguccuuucaucaaaaucuugcuaguguuugcaauggugucagcgauuggaggcugauuaugggauggauccccggguauggcagucuccagaugguccauccuuucuucucagcuccaaucuuugucucuguaacuccuuccauggguguuuuguucccaauucuaaaaaucuccuguauuucuuuaagggacauauuuauuuccuccauaagaucaucuaucauuuccaugaggugggauauuuagaucauaaucuugcuuuucaaauggguuacaguaucgagcauuuacuguguugggagaauuggguugugauguuaccgaguaccauugguuucaguaacuuauguucuuguguuugccucacaccauccuguuaucucuguuguuaugugaaguuguugucucugacuggugcuugucccuccugagaaccugguuauguugggccuccuugguucaggcugucucugggugugggaagggggguucuggagcacuugaucugugagccuggcugugccagacauccugggaaucaagcugacucugggucuagccagaguuaggguacuggugcuguuccagggcacuguuucagacuagaaguguguaucucuggaagggugggauuuacugugucuucuggggcccaggauggggggaucccaggucagguguggaagacucaccugugagucugguaaugucagaacuucugggagucaugcugugagaugugugcaugggagggaagggggugcuggagcacacagucuuaugucacuguuucuaaaggguguuuucuguacuuauagaaaaugauuuugugugugugugugaguaugagugugcacacaggcaugcaaguucaugcccuuucaagaauuccacauauauaaaaguaaaaugugaacagcugggcgugguggcacacacgccuuuaaucccagcacucgggaggcagaggcaggcggauuucugaguccgaggccagccuggucuacaaagugaguuccaggacagccaggagugcacagagaaacccugucucaaaaaaacccgaaaaaaaaaaaguaaaaugugaaaaguaaaauuuccagaucauuugagaaugcucccuacuuuuacugaugccccaaauugaauaccuaccauuaaaauccuuuggcaucugucuuuagaguaugguauccaacucuuucuucuggcuuucugugacacugagauuugguaguuaccugugaaaaccaucaaauaagagguggagaccuuguaggugaagcaaauaaugcuguuuuggauagcucauaagaacuaaauagaaagagaaagaaauuagagagagaaauuagggaaacaacacccuucucaauagucacaaauaauauaaaauaucuuggcgugacucuaacuaaggaagugaaagaucuguaugauaaaaacuucaagucucugaagaaagaaauuaaagaagaucucagaagauggaaagaucucccaugcucauggauuggcaggaucaacauuguaaaaauggcuaucuugccaaaagcuaucuacagauucaaugcaauccccaucaaaauuccaacucaauucuucaacgaauuagaaggagcaauuugcaaauucaucuggaauaacaaaaaaccuaguauagcaaaaacucuucucaagaauaaaagaaccucugguggaaucaccaugccggaccuaaaacuguacuacagagccauugugaucaaaacugcaugguacugguauagugacagacaaguagaccaauggaacagaauugaagacccagagaugaacccacacaccuauggucacuugaucuuugacaagggagcuaaaacuauccaguggaaaaaagacagcauuuucaacaaaugaugcuggcacaacuggcgguuaucauguagaagaaugccaauugauccauuucuaucuccuuguacuaaggucaaaucuaaguggauuaaggaacuccacauaaaaccagauacacugaaacuuauagaggagaaaguagggaaaagccucgaagauaugcguacaggggaaaaauuccugaauagaacagcaauggcuugugcuguaagaucgagaaucgauaaaugggaccucauaaaacugcaaagcuucugcaaggcaaaagacaccgucaauaagacaaaaaggccaccaacagauugggaaaggaucuuuaccuaucccaaaucggauaggggacuaauauccaauauauauaaagaacucaaaaagguggacuccagaaaaucaaauaaccccauucaaaaauggggcucagagcugaacaaagaauucucaccugaggaauaccgaauggcagagaaacaccggaaaaaauguucaacauccuuaaucaucagggaaaugcaaaucaaaacaacacugagauuccacuucacuccagucagaauggcuaagaucaaaaacucaggugacagcagauguuggcgaggauguggagaaaggggaacacuccuccauuguuggugggauugcaagcuuguacaaccauucuggaaaucagucuggcgguuccucagaaaauuggacauaguacuaccggaggaucccgcaauaccucucgugggcauauauccagaagaugucccaacugguaagaagaacacaugcuccacuauguucauagcagccuuguuuauaauagccagaagcuggaaagaacccagaugccccucaacagaggaauggauacagaaaaugugguacauuuacacaauggaauacuacucagcuauuaaaaaaaugaauuuaugaaauuccuaggcaaguggauggaccuggaggguaucauccugagugaaguaacccaaucacaaaggaacucgcgcaauauguacucacugauaaguggauaauagcccagaaacuuaggauacccaagauaaaagauacaacuugccaaacucaugaaauucaagaagaacgaagaccaaaguguggacacuuuacccuuucuuagaaaugggaacaaaacacccauagaaggaguuacagagacaaaauuuggagcugugacgaaaggauggaccaucuagugacugccauaugcaaggauccaucccauaaucagcuuccaaaugcugacaccauugcauacacuagcaagauuucgcugaaaggacccaguuauagcucucucuugugauacuaugccggggccuagcaaacacagaaguggaugaucacagucagcuauuggaugggucacacggccccuaauggaggagauagggugguauuccuguggcugagaaagccuggggucucaagugguguauaugguauauguuacaguuauguguucauauguggcaauagaccaggcucggcuucagagaugaucugagagaaggggugucuggcaguggugaaaagaaaaagcauggauccaaaguggaugacauuuauuuuucuggauauggauuuuccuucuguaauguuucuaugcugcucugucgauuucuggagauuuccuugucuauauucugcccgauugcuauucugagagaccucuauguccauguccugcuuucuugcuucucucccucucccucucccucucccucucccucucccucucccucucccucucccucucccucucccucucccucucccucucccucucccucucccucucccucucucucucccucucccucucccuauucccccucucacuuucucucucucucucuuucucucucucucucucucucucucccucucucucucucugugugugugugugugugugugugucugucugucugucugucugucugucugucuggaugcaugugugcacauucuccuagcaauuuucucuucgguuuaaacauuucucugguaagcucaucuccaacugaauacaaguacaguuuuuuuuuuuuauuuuaccuaucaaccuagucauuuacuccagguuuuaguuuuguuuaucuuaugaaucagcauuccaugacuccaagccuuugauucuuaggagacugagaaguauauuuuuucuuagcauugcaaaaugacuuuaagcucucucugucuuuguuaaacacagaugauaggcuaguugggugugacccugcccugaacuuaucauuuccagcaagccagaggguaaccuugcucuguccuaguuugauccugaacucaggaaccugucaugucuucccaagcuuaagcaaucaaucaaacaagcaaacaaauagauguaacuuucuuacaaguugacucauaguguauugcuuuuguugauucagaaucgugaagacugucacauaauucauauugaaucauuacuuuugcauaguugagaaaauauguauucaaacucauguauagaggguucuuucccuuaaaugcuguccuuaacguccuaauauuuaccauuuugcagacauagccacacccuuaaguacuggacuccaguuguuucuaauuaucauggaguccuuaaccuuaacacugaggacauuccuugcaggauugugaaauauguaccuuauugcccauagcaccccacaacacucuaggaagcugacaccagggccaucugccaggugcagaaacugucacucagucucauuagguccaagcaaggcuugaucuuccauugcagaagucaauuucagacacuugccaccucccaaccgccuuugcuugcauacauucuaauggccauuuggcuaucuguccucuccuucccuaaaccugauccugaacccucccaauuuccuccuuugucuccucucccacccaguuccuuugauccaucugccaaucauaacuauuuaauucugcauucuaagugagaucuaaguguccucacuugugcauuauguguucucuaccucuuuugugccuguggaguauaaccuguguauccugcauuuuauggcuaauauccacugauaagugaguacauaccaugcauguccuuuugcgauuggguuaccacagucaagauaauaauuucaacauccauccacuugccuguaaaauuauugaugucuuuacuuauaauaggugauuaguauucuguugccuagguguaacacauuuauaucauccacacuuuauuucaagaacaccuagguuuuuccaguuucuggcuauuacgaagaaagcuguuaugaacauaguuacgaaagacccaccuugugaggacccccccuccauguucugacucaggagaggcgacaccccaaaucacuuuugagaaauggucuugaugcaaacugcaagaggacuuuuauuccaagagcgcucugggacccacaguuguacaccaugcaaggguagaggauggugggccccaaguagcuggaagaguggguauuuaaaggaagaaaccacaacuuaaggggguuggaagggcuuuguuguaaaauaccaaaaauaccaguuaagagucaaaaggaagucacaaggaauaccugcuaauugugcaguuauuucucaagacaguuucuaugagccucuaacaauagcacauuugcauagcggguuccaugaauggucaggguggaccuuuuugaacaaauacugccugaacccaggaagcagguggguggaggaaugucaguaucuguuuuaugauuagcauaccuuggagcauugagucacaaaggucacauucucaagccugggccuaaaggccuacuuuucuuuuuuguuuuuauauuacacuuuuucagucuuuguggaauguugaagccucuuuuggguauauggucaaggguugggcauauagcuggcucgugagguagaaauauucccaguuuucugaaucugaauuuccaaauugcuuguacaaguuuucucucccaccuaagauggaggacuauuccccuucuuccacauucuugccagcuuaugguauacuuugaguuuuugauaucagucauuuugauggguguaaagguuguuuugauuuucauuuuccugaugucugaggacuuugaacaguuuuuuaguuucaucucagccauucaagauuucucuguuguugauucucuguuuagcucuguaccccuuuuuuuaaucggguauguuggguucuugguguuuaacuucucauguuuuuuaugaauuuuguauaguaacccucuguaggauguagaguuggugaauaucuuucccaaucugucugcugccuuuuuguucuauugacagugcccuuugcuuuucagaugcuuugcaauuucaugagguuccauuuauuguugagacuagagcaugagccuuugguguuaugcucagaauauugccuccuguucaaauaguucaagucuuuuuccuguaagacucuggggaaccuuagcuuaccagggacccacuuagugaacuauguggagccaggaucgaugcaaaaagcaagaggauuuuauuguuccagugcauuggggucaucagagacccaaagaagagccaacgacccccagcacagauuuggcggguuuuguauaugguuuccaggggcagaauagagcaucagugacuaggcacaauaugauuggcugaacagugcacccuuaaacugauuagucuuuaggaaaugaggugaaaaggacuucccuugucugaggugggcaaugguacauccuguggaauguguccccacucacaggucuguucccucccuguggucugaaaaauagggacuugccucucccuuccugaggcgcauguguuucaugaccuucccaaaauuccugagcugaccuuuucauuccuacuuucuauucuaugagauucauugcauacaguuuugagguccuugauccgcucagacuugaauucugugcagagugauaaauaugaaucuauuuucguuuucccacaugcagauaucuaguuagaccaguaccauuucuugaagauguccucuuuuuucccauuguuugcuuuucuuuccuuaucaaaaaaucaaauugguuuauuugugggucuuuggguugauuccauuugucuacauaucuguuuuuguaccaauaugcaguuuucaucacuauugcuuaagcaauagugcagcuuaaguugagggauggugauuccuauugaaguucuuuugcuguuuaggauugcuuugacuuuccuuguuuuguuuuguuuuguuuucccccuaugaaguugagaaucucuuuuucaauguuuguaaaaaaaaguuguguuagaauguuaaugggguuacacugaaccuguagauugcacuugguaacuugcauauuuucaauauauuaauccuaccuauccaaugcuuggcugugaauaucuccaucucucauucaguuacugguagagccucucagagaacacccaugcuaagcucaugucugcaguuacaacacagcaucaguaauaauguuaggguuuggugaccacccaggggauggaucacaagucggccagaaaauauucagccauuuguucgugcucugcuccauuuuuguccucacauucuuuuuagaaaggaacaauuuugaacggaaaauuuugaaugugagggccuccacuggggaggagguggucucuucagguuccuuacucccucuauugcacuuuugacuaagguuaccccauuguguccucagagccuccccuuagaguuucuacucuaagggaauucuugucagucauugguaugccaaauaucagugccuuuaggaacaaagcuagcuccuaaauaauugaaacuggaccauuauauuuauuuaucaaguuuucagggaacaauaacuaagcagauuucuuuuauuuaaaucuucuaaauuaaucugaccuauucuuaggcaaaaauccaaugauacuugcauuuuuuucacugaucuuugucucuaggcuagaggugguuugauucuuuguuuuuuguuguuguuguuguuguuguuguuguuguuugcuugguugguuuuuuuuuuuuuuuugguaaggaauacugggucauaguauacaacucugacuacccuagaacucauugccuauaccaagcuggcaucaagaacaaugacauauuugugccucuguauccucagugcuguaauuaaaugcguuugcgaaucuaagcaucuuguucauuacuuuuguaaugagaauauuucauacaauaucucugugugcuuacuacuauugaucuuuuugcuugucucuuuauguguauucauuggcauuugucuuccaagacuuucuccaacucaaagggugaagaaaugacagaugagaacucauuauucaguuuccuucaaaaaugacuuggugaucaugaguacauuauaaacuucugugucaggaaacaagugggcgaacuaccaacauuauuugaaaauauugucaaugaaauguacaugucuaauauuucauucucaugcuacuuuuguacauauauaugggauguuuagaacccagugacguacaaugauguacuggugagcuuuacucgggaagaaugggcuuugcuggauccuucccagaagagucucuacaaagaugugaugcucgaaaccuauaagaaccucacugccauagguaagauugugaauguuguuucucuuuuugaaagagggggcaacuguauuuuaguugugugguuguaugugugguugcuucuuuuucuuguuauugauguacaucuacaauuucauuugagaaggaggaagaaugaugagaauaaauuaggcuuguuuguaaggaucacugaagauaguuucuuaaauuuugccugaauuccacaaauauaucauguauuuccuuguacugucuucuaggcuauaacugggaagaugacaauauugaagaagauugugaaaauucuggaagacccagaagguaauuuucuugugcaugcugauccaaauuugccuuugaagaaaucuuaguucauucuugaaguuuuaguuaaaaucagggguguaacaagcacaguuuuauggauacugauuauuaaauacucacaaaaaggacaacucagugucagguauuugauuguguuugcaaggcuuuccuuuaagacagaaaacacagaaacacugccuuaacagacaguaccuuaucaagcacagccccauucauucuacgguguagaucugccagucuguuuagucccaugccacucagcuaguauaaaaaguaauugaauauggaaucaguuuauauccaaaacuaucugauaugcagacaguccauaguauacugauguuacucauauacuuguggcaagguugcuuauauuauugaguguggaaguucauggaagugaaaaaguuuguugugaaaacuuaaucuaagugccacaugucuaggaggaacaaaaauuaaaacuaagugaauacaagguauauauauuuuguuauucuuccuuacauaguuguauuauaugugacagauauaucucugucugucuaucugucuauguaucugucuuucuagucugucuaucaucuuuucauugaacauaaaugauacaauacucugccuaaggagagcuaaaccuguauagcucgcucaggacaauuagaagauugguuaauuuucccaauuuagaauuaauuuauugaaaauuaugaaggcauacaauuaauugaauucacaacuucuuugugaauauaucaaaaaccucagacugcagaaaaucccuaugaguuuuaguaauguagaaauguucuguuucuccuguuuaacuucccaaauguuguauggcucauauuauaggaaaauucuuuuuagacaggguuucucuauaguccuggcuguccuggaacucacuuuguagaccaggcuggccucgaacucagaaauccgccugccucugccucccgagugcugggauuaaagccgugcgccaggaaaauucaugaauccagucauugugguaaagcugugaaugcuugcauauuaugucaaauauaugaaaaaccucauaaaaaaaaaagauuguaacuuugggccaugugauaaaugcucuuuccaucacagguacuuuuaaagauguaaauaauaaccguaaugaaucaaaacaccauggauaaaaacaccaugacagaaccuuauuauaucugauuccucuuuacaguuagaauagauuguuaaccuaauccauacagauaaaugauucauuguuauaauaaaugggguaaaacuuauacauguaccaauugcauacacagucuuaaauaaaaucuuacuguagagaaacacucugaaaauaucuaauguguuaaacucuauuuauaucacaggcaucuucaaagggauggaccaaguaauacuagagagaaacccuuugaauguauucaauaugauggagccuuugcaagaaaccaucaucaucaguuauauaagagcacuggaucuuucaugucuucuacugaucaucagauacauagaagaccacacacugaagaaaaagucuaugaugguaaccagugucguaaaaccuuuucauuucacagccauuuacaaauccauaaaggaacauauacuggagaaaaaccguaugaauguaaucaaugugggaaagccuuugcacgucacagcaaucuucaagaccauaaaagaacacauacuggagagaaacccuauaaauguaaacaauguggcaaagcguuugcauggcacaauacacuucgaaagcauaaaauaacacauacuggagagaaacccuaugaauguaaucaauguggcaaagccuuugcauuucacaguacucuucaaaagcauaaaauaacacauacuggagagaaacccuaugaauguaaccaauguggcaaagccuuugcauaucacaaaacucuuaaaguccauaaagaagaaacacauacuggagagaaacccuaugaauguaaccaauguggcaaagccuuugcaugucgcagauaucuucaaauccauaaaaaaacacauauugaagagaaacccuaugaauguaaccaauguggcaaagccuuuguauaucauagauaccuucaaauccauaaaagaacacauacuggagagaaacccuaugaauguaaucaauguggcaaagccuuugcaugucuuaaaaaucuucaaagacauaaaacaacacauacuagacagaaacccuaugaauguaaccacuguggcaaagccuuuacacacgccuuucaucuucagugucaucaaaggauacauacuggagagaaacccuaugaauguaaacaaugugguaaagccuuuacaucucacagauaucuuaaaagccaugaauggagacauauuggagagaaacccuaugaauguaaccaaugugacaaagccuuugcauguugcagaacucuucaaauccauaaaaaaaaacauacuggagagaaacccuaugaauguaaccaguauggcaaagccuuuacacaauuuguucaucuucagugucaugaaauaacacauaaugaagagaaacccuaugaauguaacuaauguggcaaagccuuuacaggucacaguacucuucaaaucaauaaaagaacacauacuggagagaaacccuaugaauguaaccaauguggcaaagccuuuacacaucuucagugucaucaaaggauacauacuggagagacacccuaugaauguaaccaauguggcaaagccuuuguaugucacagcuaucuucaaauccauaaaagaacccauacuggagaaaaacccuguguauguaaacaauguuggcaaagcauucucaugucacaguacuccaugaaaucauaaaagaucacauacuggagagaaacccuaugaauguaacuagugugguaaaaccuuugcacgacacagucagcuucaaacacauaaaagaauacauacagaagagaaacccugauaauacagugaaugcaguaaaggcuuuguuaugguggucugaaaaggaauuuuaaaaacaaauucuugugagaacccuguaaauguaaucaaucuaauaaagccauuuguuagcagucaccuucuaagggaugcaacauaguuugugggaauauagugggugggugugucugauucuuuugccuacucucgagauguucuugucuuaauuauuugcuuugcgagguuugauaugaggguuugugccuauuuuuauuaaaauaucguaugccuuguucauuugauauccccaaguaugcugcucuuuuuucaggggaaaugguagaauauaugggugugauguuaguuugggagggcuauagagaaguggagggauguguacugugguccagauauaaacugggagaugagaacaagguaaaaaaaaaaaugaaaaaaauguaacuguacauauuuacacgcacacucacaaccuuuucaauaagguaugaauuaaguauauaauaaguuguagcaaacuaaaauaaucuagguauagaauuuucaguguaugucuccaugcccucaaggaucauaaggcgauauugguucaucgggucaaugggagcacacagcaaacuugagguucacaagcccagugcaaauggacaaugaaugaucaaugcaguaucagcggcagggagucugaacaacuuuuuggugauuggaggcuuauauaauuugcaggacugggcauaggaacuuccagaauggguaaagcugaaugcugagaauaccaaaaugccucauuggcaggggcaagccuuucaggaaucugagaaucuaggaguauggguuucuuaaucaagaugaaguuaguucauccuauauuccaguuaagucacugugacauuccucagggugaguucugugcaagggcuuuaaauuccccagacaaggucagaaaaguagaagcucugaaaaugaaggccauuuuccauuauguguugacagaaaaggcuaguuagacauugguggacuguaaccuuaauaagcagaguuuuccuacauuuaaguauaaauauuggguuauaaguuuuagccuaauuuuugacagauuuucaccauauguaauaaacuuaccaaugugaacauaauuuucagcauacucggaagacauauuuguugaaacuacaggcauuuuagagguaaauauuuuaaaaauauuaaaaagcaacaucuuagacacaaguacuuuuaaaauggggggcagauaaauuuuauauaugagguacuauuuauugcuuucucagaagucugugagucuaucugccucaagacccaacuaauccauucuuaggcacaaauccaacagauacuacaucuuugcacuaggacacuugcucaauuuugugaaugcagaggacuccugcucauuggaugaugaauacuuggauguucuaugaaacuaaaacuuuacaagaaaagggcuguaucugcccauaauguggaagggcagaucuguggaggccuguucugucugacucauuuggguucuaauccuccaguaguugaggggauauugugcuguuuccaagcuggauggucacaggaagagaagguucuggaaagauagaaauuaggagcaccagggcauguagcucacagguuuuuuccaggauucuuaucagauccacuuggagggagguguuagauaagcugugccgugugugcgggagaggcaccaggaaacacaggauggcuaaacucuccgaguuccuucugauaggacuuagcuugaccaucacugugguucuuuugguagauguacaaacguggccuuagccauugagggucauuuaauguggaguuccccuggagaacaagagacucuacagcucugaucauaaaaagcuguguuguuuauaauaucacugcccaguauacauaacagguguaacuuuugccaugcauugggaagaaagauuuuuuuucaauuuuuuauuagguauuuucuucauuuacauuucaaaugcuauccugaaagucccccauauccuccccccacccccgcucccguacccacccacuuccccuucuuggcccugguguuccccugugcuggggcauauaaaguuugcaagaucaaggggccacccuucccauugauggcugacuaggccaucuucugcuacauaggcagcuagagacacgagcucuggggguacugguaaggucauauuguuuuuccaacuauaagguugcagaccccuuuagcucauuggguacucucuuuagcuccucuauugggggcccuguguuccauccaauagcugacugugagcauccacuucuguguuugccaggcaccggcauagccucacaagggacagcuauaucaggguccuuucagcaaaaucuugcuggcauaugcaauggugucugcauuuggaggcugauugugggauuguuccccgggcgcagaagucuauagaugguccauccuuucaucucagcuccaacggguaauaacccaugcuccacuauguucauaccagccuuauuuauaauagccagaagcuggaaagaacugagaugucccucaagagaggaaugaauacagaaaaugugguacauggacacaauggacuacuacucagcuauuaaaaacaaugaauuuaugaauuccuaggcagauggauggaucuggagcguaucauccugagugaaguaacccaaucacaaaagaacucacaugauauguacucacugauaagugauauuagcccagauacuuagaauacccaagauauaauuugcacaacacaugaaacucaagaagaacgaagaccaaauuguggacaguucgccccuucuuagcauugggaacaaaacacccuggaaagaaagauuuaaaaauugaauguguguuuucuagaaguucuuuaauauugcguuccacaaucuuuugguuguuugucaugacugggauucucuguauagcccuggcuguucuggaacucccucuguacaccauacaccagguggucucaaacucagaaauccuccugccccugccuccuaagugcugugauuaagggcaugcacuaccacuaccaggccaaaaucaguuuuguaugauaaauuuuaguaagaguuuagaaacuguuagaaaaaagaugauagggaucuaacguccacaauguuuuauuagaaaccuuuuacaauuucugcuaucgcagugauuuguguacacugggaccucuguacugggacaagagauaaguaauauaaaguaauauaaagaaguguaacaauuuucaaggucacuuugaguuauuuuuccgggaguuguuucguuuguguuuguuugauuucuaugcacauaaacauauuuaaauuuuaucaaguucauauuucaagaaauauacacuuaaaaaggcucccuacauucuaugcccuauuggucaugaaacuucauaacacaauaacagcuuaagcacugucaagcugacucucucaucugauaucucuaauggcacucucauugcacucucagaugaaagugagucuucauccgacuugucugcauuacagguugaaauagaaaaugaagggcaggaagcacagaaucuagcugaagcauuuacagucauagguuucuuauaauauucuuuuauuuuguaugugaggaagaaaauguagguauuaagcuuuuuacagucacaguuuucagauagaugagaagcaaauagcuuuuauacuauaguauaaaaacccagaaauuuguuuuauuugaguguaaugaaaacuuuucugagaauaagucggagugaaugaaaaacuggaaaugacauuaagaaguagacagaaggggcuggagagaugucucagcaguuaagagcacugacugcucuucuaaagguccugaguucaauucccagcaaccacauuguggcucacaacuaucuggaacgagaucuggcgccgucuuuuggagugucugaagacagcuacacugcacuuacauauaauaaauaaaucuuuaaaaaauuuuuuaaaaauaaguagauagaauuauuuuuguuugaacuuaaauaaugacuauaaaugauagaugaacaacaaugcaauagcuuuagacaagugacucaccucuuucuuuucuucugaguacauagccagucuuagaugguaacccauucauuuuugauuuggagaauguuuuuaaacacugaacgucuuuuacauagcauuuaauguuugauauauaaguaaugcaucaaugcuggguaaccuuacacauguauuuuuauuuuuggaacccuuauucaaauauuaguuuuuucuuagagggaaggauagauauuuuuauaauuaaaugagcaguuaaauugucuuucugugaccuauggauuuccuucucuccacaaaaugagaacaucgugugugugugugugugugugugugugugugugugugugugugacauugcagacuaaaaacuugugauuucagagaccuacacagggccuagaagugaucuagucauaaaguccugugugaugcugauccucuucacaaaagaaugagaacucucugucaaaucaugcuuuccuugucuucacuauuuugcuuuucuuuguucauuuuacuuucccuucuuccuugaauuuucguuuaagaaacacugaauuacugugugaaaauagcugcuccuuugguacaauauagcacgaccacaguucuccucccuuugcuuguuccaguuacauaacccccaccucuucuauucgccuucccuugacauaccaccccaccuucuguuuugucuauuugaaaaaggugcuuucaaagagaggagauucaaacaaaacaagacaaaauaguaaagacagguagaaagcucucauuuugaggcuguacauagcaagacaauaggaagaaaagagcaguaagaucaaggaaaagaaucagagcaacaucuguuuccagaguaaggcauuauucagaucgaaagauaauagccauaacaugcaagcaacagaccugacugagacaaauugaagccccauuuuugguauuuacaucucugugagauuccuagaauccaggcaguguaaggauaguguucucucucaagugcagcaccucaauuuaaaccaaauauuuguuggcacugaacaagauuuguuacuaccuaggcucagcacaaggcaggagauuguagguugauuuuguagcuugcuugcuuuuuggguuuuucuuucuauggcuuguggaacagcuucucuccacagagagacuagaagauaggggugaaggcuccaaggcugcauccauccacuugauuuucacauuuagugagcuguguggaauuuguccaaagcaauggaaucauuuggucaguauccauagagcaaaauguuuuuccugaaaucagcaugcauuguuuaguggccucuuggcuagcuaccucaucaaggaaauguggucuguucacaauacugaagccuuacuggcuauaaaggcuggcaaguucagccuguugcccuucauuaguaggaguggucacuaggaucacccucauauuucccuaaaaguuucuagugcgcuaauuuccaauaccgaccuccaaauggccucuacuuccagcucuuucucccuguaucaaacucuuuccuuauauaccacccuccaaauguucccuccccauccauuucccauucaccucagucuaccuggauugucuacucuagcuccccuuuccaacaagauccaugcauccccuauguaucucuucucuuuacauaaccucucugaaucucuggaggauagcuugauuauaguuuaccaaaagccuaguauccauuuaucagugaauauauaccauuucuaucauucuagauuuuggguuaucuuauuuagugugauauuucuucuaguugcauucauuagccucuuuucaugcauucauuuuauguuguuuuauuuuagcagguuagugauacuuccauuauauaaucauagcacauuuucuuuauucauucuucagcuuuaagacaucuaaguugucuuuagcuucuggcuaguacaaauaaagcugcuauguacauaguugaccaugugucuuuucauuuuguggauggaguucccuuuguguuuuugcccaagacugauauagauggaucuguuauauaaacucccacuuuccuaagacaucaugauauugauugccauaacauuuguauuaauuugcauaccuacaagcagaauagucgaaguaaaauuacucuauauucucacaaauauaaacaaucacuagugugauugaguguaaccauucugacauguacuauggaaguacaaaguaguuuuuauuugcauuuccauaauuguuguaugcaggccuguggccuacuugaaccggguacaccagggaugcaggcuggggcuaaaagagacuuagguggugagagaauaauggagccaagacaugauucuguucaaggcccuccauuuuacuaagagaguuuacuuauaaaaggggaaggcccauccccugccaguccauucuuggugucuggagccagccuguagguggugugcagaauaggaugaaccucuggaaugucucaggggcuucucagcagguagcagugucuuggagagagcaguggcaggugacagccauccagguuggaaggcuccaccuuugguaauuuccuucucaguggcagcaaggucaaagucuggaucagcgugauucagggcugagggaggauacacauaaugauuaaggauggugaacauuucuucaaguguuucucagcuguuugaaauuaucuguugggaauugaauucucuguuuaaagcuguucccaaauuuuuuuuuaccuguucuuuguuuauuuguuuguuuguuuguuguauuuuuagaacauguaguuacuugaggucuuuauauauuuuuguaaguuaugacuaucaggguaaaaaaaaaaaaacuaucccgauuccuuacauugccucuuacauugucucauuaacuuggcuuuugccuuagagaaacauuacuacuccuugaguuccaauuuauuaauugcuaaucuuaaugccugcaaucuuaguguuuuucagaaggcugucugcugugacagugcugccggggauguucugcccuuacucuaccaucagguucaugcgucugguuuuaagucuuuacuccacuuggauuuuaguuuuuugcaggcucugcauguagagcuacaguuuaauaagcgccacuuuaugaaguuaucugugcacaugguggguguggcccaugagucuugcaccuaggauagggcccugguuagagcagcugugcauggaauguccuugauggagacagagugacguuuuauuuaccccugggacaggccccaggugugagcuucuacuaguguugauggcugcugugugcuuacagcuuguuuguguaauaauguacauauuuuguggauccacuaucaguggaguacucuuuccuucuaaggaauauccucccuguuauuguuauugacuagauaauuagaaacagcaggaguacauaagaugagggugugucuauuucucaucaaaaugguaaacacucggaauuucagaacagcauuugaugcugaggggaagagcuguacauauaugaguuugaaaauauauaauuucucaacuauggaaaaaaugaauuaaaugagaggcuccuucaagaaucuaaaggaauaaaggcagauacacuuugacccaccuugucagaaagauucaaggcaggaagaaacaaaggcaggcugauuccccaguucaaggucagccugggacacagcaggcacaggagcaggcauggaagaaaugguacuuucagggcagcaucuacacuauuagcuuaucaaaugcagacagaucugugaguucuuuugacaccuuaagggauguugauucaugucagggcacucugguggagucagcuugugaggcagaaaugccaaaaaucugcucaugagaaaugaauuucuaggacucuccuccuggaugucuggcgaaagccaacucuccaguuuggaucgguuugucaggcgaaaagccuggaagcuguuucacgaggauaagaguuccauggaaauuuuccucccagaguuauggcauuucuuucccuaacccauaauauucaaauuuccaccacauuagucuaguguauagauucacgugcacucuauuaagcauuaccuuauaguaaaugccuuuuaagauuguauucuaacauagcuaaagccuuuucccaguguucuuagauuccagauagcagcaaagaguuuaaccuauucaguaacuaauuaagcucuaccauaaaacaauaaagcacuugccauuaacucagcugucugaaagagacuaaaauucucacugagauagaaauucuuauuacagacuacauuccaugccaagagcaaauuaguauacuauacugaaaauggauagucuccagauauagauaagaauuaacgaggccuagagaauuuuggggucagugacacuacauuauucuugaggcgugucaagaguuaacuacccugggacuauuaacucuaaguguaaaacuggcagaaaaugcuaaucucuaauguaaacauuuaucuggucccuacaaauucccuuuguagucacuccccuugcaucugugcuaaucucuaguguuaaacauuuaucugguuccuuuugaagucacuccuuuugcaccuggaaaaauucaaugugccuuauucuguuaugauuugcaauuuauucuguauuauaaaagucugaggcucgacuggaaaauuacauucagauuaaacaccucucuuguguguuuggcugucugucacuacauccgacucuuuugcccaucugccuaagaaauccuguuccucgaagaccagggacccagagggucugcggcagauucauaagauacucaaaaggaaaccuggaguaaaagauuggauuuuuauuagcauuaaaaacuggaccaguguucugcaacagaugagguuuccagaaaauguuuuuggauaaaaagagaaauccuuggagaacucucucucucucucucucucucucucucucucucucucucucucucacacacacacacacacacacacacacacaaagacagaaagauuuuuuagaguaguaagcaagcagaauauagacagaucuucagggagaaagcagaacauagagaaagcagacuagaaaagccauauccagcagaacccaguuggucaacuugaauucacaauuugacuucaagucccuuuugcugcucccaguuacuccuucacucagaaccccuugucggcccuaggcugguccuggcaccacuuguugaugaugaugcucuuuuucucugcaugcccagguagaugccuuagaaaacaccagauaacuauaugugauuggaauuaucucagggucuucaacuccauuccacugaucaacuuguguauuuguaccacauauaguuauuuuauuguuccagauugcuuauggugcuaauucguguucucucucucucucucucucucucucucucucucucucucucucucuucccucucuccccucucuccccucucuccccucucucucccuuccuucuucccucccuccauuucuaggaauauuuugccuguauguaugauuuuguucaccauucgugccuguaggguauagagauuauguuaaaaccccuggaaccugaguuacagauaauagugagcuucuuuauguacugggaauaaaaccuggaugcucuuaaaggaaugcuauguucuuagguucugagguauuuugcaucccauuauuuuucuaaaccaauaauguuuucuauugaaggcauucuaggucacuuggggauccagcuucuaugcagggggacccuuuagguaucagauagugaagugaaccauguuaagagaggagaaugaaaaccuggugcaggucgaauuuaucuaccugguauagacgaggggagucuaauuccagccaaaucauuaccagaauauauuuuuuaaaagauuuauuuauuuuuguaugugaguacacugagucuucaagcacaccagaagaggguaucagaucucauuacagaugguugugagccaccaagugauugcuucaaauugaacucaggaccucuggaagagcagacagugcuguuaaccacugagccaucucuccagcccauuaccagcauauuuaaaauacaguacaauuuguggaaagauuuccagacaacuaucagucuaaucaguccaauucuaaguacauaauauaggcuaaguuuugacaacaaagaaaccauuuuacaaaguacaugugaccaaaauaauggguuuuauucauuaaaggcauaaaaauacaucugacauuucaccuaacggugguuaaaagucuagggaagaaagucuggcagaauuguucagcagaacuuggauaagaucugccuugauagccaaagguaggcaaggucugucuuaaaguagcaaaaaagucaccaggucauuaucaacauacacucugagccuuuuggauugaauggaguaauuugucuccuucauugaaaagaguuccauguguuuuuuaauauucuuggauucccuagugaacuguggguacaaggaaauaugcugccgauauuuuguugcucauuacagagugaaacuuuccagcaauugaaagaauuagccucauggaagaugaucuccccaauuugaguacucagugcaacguggccauuccugaagccauuauacacacacacacacaagggaauguacucagaaaauuuuauuccuauacuugagcauacuuaaucgcacauacuuaacagugaacaaaugagcugggauauuuuuggaaggcauuuagagaagaauaaggcaaaacugacuuaauauauuuuaaugaaaauguuuaauagucaauguuauuuaaaaagugacuauagauauacuuugugauuuaagagcaaugagccuucuuacaaaggacacagguucuauccccaugaaccacauguuaucuaaauauuugcuguagcuggauucccacaaucuccugccuucuuuagacaccuuugguaauucacacagacacaugcaggcaaacuucccuauauauaaacuaaaggaaaaccuuaauuugauuuguacacagugauuucaauagcagucagaucuauuuaaauugaaauauuucuggcccugcaugcauguaaauaccugugaccuuccuuugagucagccugcucagaggcaaaaagcuccugauucugagguaaacugcuucucugacaacaguguucaaagaccugauaggcaacauuuccucgaauauuucugaaucuguucucugcccuuuagaugagaauuuugucaauaauacaugugucuguuagaucauccaucaugaacagguagcauuggcucccaagcaaucuacuuucaaguugucauuacuucacuuuucagcuaauaccuuauggcccaggaugaacauuccagagucauuucugcccauccaucaauuuuuuuuauaauuuacauauguuucuuauggcuuugagguuaaaaugcccuuaaauagcccuacucuuacacaguaacauuguucacaccaccuuuuaacuaagcaugcuaugagcaagcaaacuuauguguguucauuuccagaaucucuauguaaaaccucaauguuuuccucugcuuaagaaaauuauugcuucagaagugacuccaaagcacacuuggggugccuggacaaaaaugaaaucuuccucagcucuauaauccugacuguuuugauuucuaaucuugauacucuaguugaccacauaccaaauuaacuaaauaaagagaguugaguauugugggggggggguuguuuaauuauagcuuuucaaguaugaaagcccuucuucacuuuuaguauuuuuaggugauaacaucuaacuuuaaucuaggccacagcuucuggugauagccuacauauauaaagguuaugagagaugguagcucuuugucugcuuucccuaccucuggcuaucacguucacuuucccccuaucauuagagccuauuucuuuguaauuauguuuuuuacuaacuaucaccugagacagugagcaacaggaacugaaauaauacugucuucuucaacuuuccauugguagacugauuucuuggacuaauuagaccacauauucuaagccauuacaauacuuccucuuucuucauucauucauuaauuuuaucaguucuauccaucuuacuagcagagcugggggaguuguuuuguuuuauauguauguauguuugauuguuuuucuuaaccuucccacuggaagauuugcugguuagcaauauugcuuccuccacagugauuaucaucugucucccaggauugucuaauaccuaccagggggaaaggagccacaguuuacauuaacccagcaugaaauuacaaaauuaaauguuguuuccugaaaucuccccuuaguuggcaauauucuggaaacuccugcaugagugggacagauuuuuugcccuauugcaaguuuguacuaugcugugaaccuuuucaaccuugauuacaggaggaguaaggggaaauugccuaaugaauucuaaggugaaagcacaggcacucuugcaaguugugaucuucugagcacagggucucugcccacaaagggaaggaagaagauaauccugggugagcaauugugguggguccucccaaagguuagcuggguagaaaguaggcuaaggggaaggcaugcacaagugcuacugaaauacaaaucucuacagaucuggaaaagguccugcucuugauugaaagccuaggccaguaaccacuauacugugucacuucagcacacucuaacccugaaggaagugcucaugucauucaagacucacuggccauucagggccuccaggcagaccugccagucggaagacaaggaggguucuuccuguugguuugcugaaguuucccuguagcuaagcaggcuaaaauacuucaaaaugcuuugcucugugugcuacugcuggguugugucaggggagcucaaugcccucaauuagguggagcuggagaggacugaaaugguggguccuuucaaggccuggaugggaaccagcagcuagauguacacagcauugaugucccuugugguaucaggcauucccaagacccaguguuccuagcugaauuacuuagcugugagguugcaccugaagaaaucaucuggagcaggagcucauguacagaacuauccuuggcuggauacauugaagaggccuucuuucuuuaguaucuucuacaaguucugccuuuagaauaaacauuuagguguaaaacccauuggaagguaaauuuuuggaggucuuaaauggcaucucaugaguuguauagcacuacaauguuaagcugugauuuaaaugacuaaaauguauuaaguauuuaccaguucucaggagauuauaagucucacuaaauagaauuuauuugacugaagacugccuguauaacauucacaaauaaauauuauuccaaccaggcuuauuagcaauuacaacccuaggauauacuaguuuuuuucuccaagauugaacagaaauauaacuccaaaucauaaaaugugacaacucugauuuacagccagccacugugaacaucuucuaucaaagaacaggcaucuaaauaacugcugaauggugcauuacaugaucauaguaaauaguaauaucuguugugccauagaagcucaguucuguucuugaaaaaagcacuguucuacaacauggacaagaugacacuaggugacaugguuugaaauggaaaaacaccauucuauuguggucugggcuggucaaucacagcuuucaccaaggcccuuaugaaugggcaaugauaaaguuauuucucaaauccaggaaagugcuuagcagagcacagaacuaucuggagccuaggcccugggaacuucccuaaggccaugagguaaagggaaaauaaaaacaguuuaucuucuaaaacaaggaauaugcuauggaaagcuaagaaugaccuuuucccaagguuuuaggggaggucuugcuuaagauccugaaauugcaacucuuccuaccacaugaaacugugguucuuagucccaaguuuacuggagauuuggucaguaauauucuagagcuucuuguauuccccuugggcagcaucuuuuuauuagacuccuccuaaauuucuuccauuuuaugauaguuuuuuugcugacuucaaaggucucaccuguuucuuucccuguccuuuagacuuaguuuacaagagucuauuuucccuuaagaagccuacuuaacaucagacugcaagaaugcaccacacuagcuuuuuuaauauuuucugaaacggguggcaaagcaacaccaauguguuaggcaaaaauccacuagaaauauauagauauagauauaaaacuacacuguaguugucuucagacacacccuaagagggcaucauaucucauuacuuaugauugugagccaccacguacuugcugagauuugaacucaggaccucuggaagagcagucagugcuccuuuuguugagccaucucuccagccccugaguuuccuuuucuuuuuucuuuuaaauuuauuuuuuauuuauguauuuauuuuacacuccauguuuuauuccccccccauguuguucacccuccuacuacuccauaucccauaccuccuccccaccucccuacaccaaccccgucuccaccuggauguccccaccuccccacaccaugugaccucuaaacucccuggggccuccaguaucuugagggguuagguucuucaucucugaaugaacacagacccggaaguucucugcuguauguguguuguuggccucauaucagcugguguaugcugccuguauggugauccaguguuugagaaaugucagcaguccagauuaauugagacugcugguccucuuacagggucucccuccuccucagcuucuuucagucuuucccuaauucaacaacaggagucagcugcuuuugcccauuaguugggugcaaauaucugccucugacucuuucagcugcuuguugggucuuccagagugcagucuugcuaggucccuuugaugugugcuccauggccucauauaauagugucaggccuuggcaccuccccuugaacuggaucccucuuugggccuguugcuggaccuucuuuucuucaggcuucucuccauuuccaucccuguaauucuuucagacaguaacaauugugggucagaguugugauuaugggaugccccccuucccucauuugaugcucugucuuccugcuugaggugggcucuaucaugucccucucccuacucuugggcauuucaucuaagguccauaccuuugaguccugagaguaucacaccuccuaggucucuggugcauucuggagcuccaccuccacccucuuaccuccugaaguugccucuuuccauucuuucugcugauccucuaggcuucaguccuuuucccucacccaauaccagaucaguuuccccuccccucucacuucuccaccuccauccacuuucccucccaggucucucucucccuccccacuugugauuucuuucuucucucucccaagugggacuguggaguucucacuuggucacuucagcuuguuaaccuuuuugaguucaguggacuguaucuuggguauucuguacuuuuuuguuguuuucggcugauguccauuuauuaacgaguacauaccaugcauguucuuuugggucugaauuaccucacucaggaugauauuuucuacuuccauuugccuacauaacucaggauguccucguucuuaauagcuuaguaguauuccauuguauaaaugaaccacauuuucuguauccauucuucugucaugagacaucuaggguguuucaccuagaugauucuggcuaucacagauaaggccgcuaugaacauaguggaauaugugccccuauggcauggugcagcaucuuuagguauauucccaagaguauacugauucuucacugaaaucagggacaaggcaggaaugcccacucuccccauaucuacucaauauaguacucgaaguauuagcuagaacaauaugacaacuaaaaaagaucaaggggauacaaauugguaaagaagaaauaaagguaucacuacuugcagaugauaugauaguauacauaagugcccccaaaaaaucuaccagagaacuucuccagcuaauacacaacuucagcaaaguggcuggauauaaaauuaacucaaaucaguugccuuccuuuauacaaaugauaaauagucugagaaaaaaauagggaaacaacucccuucacaauagccacaaauaauauaaaauaucuugguguaacucuaaccaaacaagugaaagaccuguaauaacaaugacuucaaaucuuucaagaaagaaauagaagaucucagaaaauggagagaucucccaugcucaugcauuggcagaauuaauguaguaaaaauggccauccuaccaaaggcaauguauagauucaaugcaauccucaucaaaaucccaacacaauucuucaaagacaugaaaagagcaauucucaaauucauccaaguuuuauuuucuaggugagagaaaggugacacucagacaagucauguggacucaagcucaggaaccuugaaacaaaaaaccucucccaggcucugagguccccugcuguggaaaaaaauaaagauggcugcuuugacucagggaggcagaaaauggaagcugccuacaucuuggggcagauacugacuuaacugugaauuuuuaaaauccggauuauuugcuguugagauuauaacauaauuacaucauuucccccuuuacuacccuccaaaccuucccauaaaucauuccuugcucuuuucaaaguucaugccuccuuuuuuucauuaauuaguauuaaauacacauacauaucccuguuuauguaaguacaaccuucucagucugucuaauguuacugguuaguagguuuucauagcuuaccauuugguauuuaauaaccaauuggugugcuagguccugaacaagacuauuuuaaaccucaggacucgaauuugcaauucauguuaagaauuucuccacuacuagaauagucuugaacucauugucacaggaaaagacuuucugaacagggcauccuuaacacagauacuaaaaucaacaagaaauaaaugaaaccucaugaaacugaaaagccucuguauggcaaaggaugccgucauucagacaaaguagcagccuacagaaugggaaaguuuuuaguaacuacaugugugauagagugcugauauccaaaauauauagagagaauuaaaaagcuagauaucaagaaaacacauuugcuuagaaaaauuuuccagcccuuuaauuuaagguaaugucuaucuuuauggcugagguguguuucuuguauguagcagaaugauggauccugcugacacauccauucuguuaccgugugucuuuuuguugaggaauagaguccauugauguugagagauauuaaggaacaaugauuguuguuuccugauauuaugauguugguguuguuaauguguaugugugaguaugaguguguguguguguguguguuugugugugugugugugugugguuuacuuguuuuugcugguguggauuuacuuauuucuuguguucucuuggauauaguuauccuccuuggguagaguuuuccuucuaguauuuuguguaggccuggauuuguagauagauauuguuugaauuuggauuugucuugaaauaucuuauuucuccuucuauggugguugagaguuugcuggauggaauagucuagguuggcagcugugguuuuguuuagagguuucgggauaucuguucaggcccuuauagcuuuuagagucucuuuugagaagucgagugugauucugauaggaauguuauuugaacuuuuucucuuaccacuuuuaaauucuuucuuuguuauguagauuuuuuguuuugauuauuaugugcuaggaggauuuuuuuuuuuuuugguccagucuaguugggguuuuauaugcuucuuagccaaagcaauccugaacaauaaaagaacuucgggaagaaucaucuugccugacuucaagauguacuacagaacaauagugauuaaaaaaaaaaauucaugguauugguacagaaacugacaagcugaucaauggaauugaaucaaaaaacccagaaauaaacacacauaccuaugaauaaugauaauugauaaugaagccaaaaccauacaauggaaaaauuaaaguaucuucaacaagugaugcugggcuaauuguaugucugcauguagaaagaaugaaaauagauccauacuuaucacccuaaacaaaacucaaguccaaaugaaucaaagaucucaacauaaaacuggauauccuaaaccucacagaagcaaaggugggaaauauccuugacuacauugguacaaggaaugauuuccugaacagaacaccaauggcccagucucugagaucaacaauugauaaguaggaccucauaaaaccacaaagcuuugguuaaggcaagggacacuaucaauaggacaaaccagcagcccaaggauugugaaaguuccuuuaccaaccuuauaucugacagaaggugaauauccaaaacuuacaaagaacucaagacugagggaauaggcaacaauaaccagcccaaacugagacccaugccaugggcaagcaccagucccuaacacuauuaaucauacucuguuaugcuugcagacaggagcauguuguccucugagaggcucuacacagaaacugacacagauauagacaccuacagccaaacaauggacagagcuuggggauucuuaugaaagaauaggaggaaggauuguggauccugaaggggaugggaaugccacaggaaaaccaagagagucaacuaaccuggacccuugggacucucagagucugaaucaccaaccaaaaaauauacaugggcuagacccaggccucccugcucauauguagcagauaugaagcuugaccuucauguggauccugagcaacugaaggggagcuaucucaaaagcuguugccuauacuuaggauauguucuacuagcugggcugccuugucuggccucagucauagaagaagugccuauccuugcacagacuugaagugccaggguagggggaauacccaggguggcuccuacccacucagaggauauggggaggaagaggaagaggaggagaagaaggagagagaaggaggaggguaggacuauuggaagggguaacccggagaagggcauugagcagaauauaaaguaaauauguaaaaaaaaauuaauuuaauuuuaaaaaagaaagaaaacacauugacacaauuuuuaaaauagaauacgagucuaaagagauauuucuugaaagaggaaacacaaauucuugagauaaaauuaacauuaaaaauguucaacauccuuagucaucacagaaaugcuaaucaaaucuucuuugagauugcaccuuacacuagucagaaugaccaagaucaacaagcgacaguucauguuuacgagacuguggaguaaugggaaaauuuauccauugcuaguaggauuguacccuuguacaaucacuauggaaaccaguauggcaguugcucaggaagaugagacuugaucuaccucaauaucuagcuauaccauuaucgagcauacccccaaaggaugcuucauucuaccacagagauaacuguucagcauguucauugcugcucuauuuauaauagccaaaaauuugaaaaaaccuagaugucccucaacagauaaaugaauaaagaaaaugugguacauuuuuacaauguuacuugaucauuaaaaugugaaaucagccaccuuccauucugcaccuucgccugaacccuuggcuuauuggcaagccugccucucugccucucucccccagacccacagccuacuugucucccaggaggucugccauaaccagcaacacagacugaugugccugcccccggacuccaaauccagccugucucccaggagaucugccauaacaagggucacagggacacagugggcacgcuccagccagggacacaggaggccugcccuaaccauagacagaacugccugccucccagaaggccugcucuaaaccaggucacaaaguucucccuaccuccaguugugcuccaaucugagacacccaggccaguuaacaccagauguaacuagauguugaaaggcaagaacaagagcauaagcaacagaagccaauauaauuuggcaccaucagaacccaguucuccuaccaaaucaagccuuagauacccauaacucacccaaagagcaagauucugaccuaagauccugucuuaggguuuuauugcugugaacagacaccaugaccagguaggggauuggggggguggguaugggggaccuuugggauagcauugaaaauguaaacgaggaaaauaccuaauaauaaaaaaaagaaaaaauaugguggcuaggagcacacuaugcaaaaaaaaaaaaaaaaaacaaaaaaaaaaaaacauuuaguuggggcugacuuacagauucagagguucaguccauuaccaucaaggugggagcauggcaggauccagucaggcauggcgcaggcagagcugagaguccgaagucuucauccaaaggcugccacuggaagacugacuuccaggcaacuagggugaggaucuuaugcccacaccacagugacacacccauuccaaccaggucacaucuauuccaacaaggccacaccuccagauggugccacucccugguccaaggauauacaaaccaucacagaucccaugucaugaagaugauagagacuuuuaaggaagauauaaacaacucccuuaaagaacuacugaaaaacacaggcaaacaaguagaaccccuuagagagaaaucacauaaauccuuuaaagaaauacaggaaaauacaaucaaacaggugaaagaauugaacaaaaugguccaagacccaaaaauggaaauagagacaauagagaaaucacaaguggaaaaaaccuuagagaugaaaaaccuagggaagagaucuggaacuacagauaaaagcaucaccaacagaauacaaaaaagaaagaaagaaagaaagaaagaaagagagagagagagagagaaagagagagagagagagagaaagaaagagagaaagaaagaaagaaagaaagaaagaaagaaagaaagaaagaaagaaagaaagggagaaagaaagggagaaagaaaagaaaagaaaaaaagaaaagaaaagaaaagaaaagaaaagaaaagaaagaaaaucuaaggcauagaugauaccauagaagaugucaauacaucagucaaagaaaguacaaaggguagaaaguuucuaaccaaaaacaaccaggaaauuugggagacaauaaaaagaccaaaccuaagaauaauacaaauagaacaccaaauagaauaaaccagaaaagaaaauccucucgucacaaauaaaacacuaacugcacagaacaaagaaaaaauauuaaaagcuauaaugggaaaaggccagguagcauauaauggcagaccuaucagauuauaccagacuucucaagagaugcuaaaagccagaagaucuuggccagaugucauaaagacccuaagaccacagaugccagcucagguuacuauccaacaaaacucucaaucaccauagauggagaaaucaagauauuccaugacaaauccaaaguuaaacaauaucuuucuauuaauccagcccuacagaggauaguagaagcaaaacaccaacagaaggaggguaacuacaccccagcaaauacaagaaauucaccaccuuacaacaaacccaaaagaagagaacuacacgcacauaauaaccaccuccaacaacaaaaauagcaagaacuagcaaucauuggucuuuaauaucucucaacaucaauggacucauuccccgauuuaaaaaaaaaaaaaaaaaaaaagacacaggcuaacagacuggauauccaaacaggauccauuauuuugcugcauacaagaaacauagcaacaaagacagacacuaccucagaguaaaaaaaaaaaaaaaaaaaguuuuccaagcaaaaggucccaagaaucaagcuggagucaccaauaucuggacaugagggggguggugcgggaaggggucaggaucagguauggaaagagacagaagagaaguccagaggaucaggagaauaaguagaaauaaguagcagggggcagggggaacuugaagaaccacuagaaaguccuggacaccaggguugggagaugcucccaggacccaguggggauaacaauuaacaaaaugcccaauaauagaaagauagaacauaaagaggccaucuccaguagauaggcauggccuccaguugagguauggagccacccaaccaucucaaaaaauuuagcccagaauuuuucugucucaagaaaaugcaggaacaaaaauauccagaaaccaccccaccaugaaauccauccuaucugcagaucccaaaccccaacacuauugcugacgccaaaaugugcuuauagacagaagcuugguucugcuguccucugagagucagcaccugacuaaaacaugcagauauucacaaccaaccauuagacugagucuggagcccacaguggaagaguuaagggaaugacugaaggaacugaaggggauugcaauacaguaggaagaacagugucaacuaaucagaccccucugagcucccaacuaaaccaccaaagaguauaguauauauaggcagguuaauggcucccacuacauauguagcagaggacugccuuaccuggcaucgguaggaggggagccauuugguccuuuggcgacuugaugccccagagaagguggaugcuagaggggugaugcugaaguggcuggauagaugaaggugcauccacuuagagacaaagaggagacugaugggguggaggcuucguaaagcagaaacugggaagggggacaacauuugauauguaaauuaauaaaauaauuaauuuaaaaaaauaucugugacuuugaccugggcuuuuucuuuuuucucuccuucuccauuuccuauuauuuuuauauuuggugguuucauaguggcccagcuuuccugaauguauugugcuacaauguuuucagauuuaacauuuucuuugacugaggauauacuucuucuacuguguauucaaugugauuuuuccaucucuugucuucaguugacuaggcuugccucuaagauuccuauuuaugucacuaaaguuuuacucuccagauuuuccucagguuggguuuucuuuauugauuccauuuucacuuucaagucuugaccuguauucaccuuccacugcuugcauuuucauugauuuuuuaacagguuuauucauuuccuccuuaaggaccucuauuauauuuauacagguuauuuuaagguucuugucuuacguguaagcauuguugcaauucucagggccuacugcaguaaugcugcugggcucuaguggaggcuugcuguugucuuagcuauuccugauuguggguuuuuuuuuuuuggaguuuauuuguuuauuuguuuugcuuauccaaauaguuuuauuugauagcaaaugugaaaucauaguccuuacucagagugaacuaggaaggaauucccaggaagggaagcuuauuggcugaacacuaggggccugucuagauucccccauagucauggagaauuucagguuuuuacgcuaagugacugauugucuugguccucucaguggggugucaugguuauguguuccagaucagguagcuugguagggaucuggcuccacuacaaaauguuuuaaaacauguacagaaaacaugaaagaaaacuguuauuagacgcguucucacgaccggccaggaaagacgcaacaaaccagaaucuucugcggcaaagcuuuauugcuuacaucuucaggagccagagugcaagaagcaagagagcgagaaaacgaaaccccgucccuauuaaggagaauucuccuucgccuaggacgugucacucccugauuggcugcagcccaucggccaaguugacgucacggggaaggcagagcacauggaguggagaaccacccucggcacaugcgcagauuauuuguuuaccacuuagaacacagcugucagcgccaucuuguaacggcgaaugugggcgcggcucccaacagaaaacaaugaggcauuguggggaacuuaacaaauacacuauaugugaauaaucugcaaggaauuaaucacaacauucacuagaaauaaguuauguaaauggaacagcuuugaguauguaacucaaagaaccagcuccugauuuuggugauucuuuguauaguucuuuuuuguuguuguuuuguuuuguuuuucgagacaggguuucucuguauagcccuggcuguccuggaacucacucuguacaccaggcuggccuggaacucagaaauccuccugccucugccucccaauugcugggauuaaaggcaugggccaccacugcccagcauucuuuuuguuuucaauugguugauuucagcccugaguuugauuauuuccugccaucuacuccucuuggguguauuugcuucuuuuuguucuagagcuuucaggugugcugucaagcugcuaguguaugcucucuccaguuucuuuuugaaggcacucagagcuacauguuuuccucuuaggacugcuuucauggugucccauaaguuuggguauguugugccuucguuuucauuaaauucucaaaagucuauaauuucuuucuuauuucuuccuugaccaaguuaucacugaauagggcauuggucagcuuccauguguaugugggcuuuccauugucauuguuguuauugaagaccagucauagucugugaugaucugauaggaugcaugggauuauuucaauuuuuuuuuaucuguugaggccugauuauuuauuuagguuuuuuuuuuucuuuuugguuuuucgagacaggguuucucuguguagcucugguuguccuggaacucacucuguacaccaggcugaccucaaacucagaaauccaccugccucugccucccaagugcugggauuaaaggcaugcgccaccacuguccagccaaggccugauuuuugaccgauuauauggucaauuuuggagaagguaccaugaggugcugagaaauagguauauucucuuguuuuaggaugaaauguucuacagauaucuguuaaauccauuugguccauaacuccuguuaguuucgcugagucucuauuuaguuucuguucccaugaucuguccauugugugaggugcaaugugugcuuugagguuuaguacaguuucuuuuuuuuuuuuuuuuuuuuuuuuuuuuuuuuuuuuuuuuuuuuuaacgagaucacuuuauuggauuugagccaggggaggugacacuauuuuuccagacuucaaaggaggcugcuauagcauaggucaccugaccaucuuaaacagcaauaaaaaaguaaaauagaaaccuuuauuuagaauuaaagccaacacuugagugugacaaacacagcauucagcucgaagaagcaccccgcuaauggagugagcguuuauucugcacaaucacgacauguggacuaacccaggagagggcacagggacacugggcagggcuggcaccuaguccuccucacccggguccucucucuccagaguguagaccaugaagcaagcgucgggucucuuggggacaaggggaugcccgggucucacaaucucaaagccaagaaagcugaagguucggaguagggcggcucuguccucacgguucuuggggaagcagaugaaaacguggucagccuggaguugcuccucugcgaacucuaggagagcugcaaaacuguccuuacugcccucaggcagagguccagcugggagcucgauguagaggccaccaccacuccacaccgcccuccaggugaccugcuuggccuccgugagcguggacuggaugcucaggacccuggucuugucguuagacgucggcuccucugucacauucagccgcucgucggaguacaggaugcuagcugaaagacugugaucccgcugacuguucccucgcccaccugggaucuucaggggugggugagggacaucaggagcaccaccgaggccccggacccagguuacuacagcaauuaagggcaacccuagaacucucgcugcugcagccgccggggcugugcugacuaagaagcggcauggugcggcuggcgugaagcguggcgcugcguuuguccccuuccuucucucuggcgaagcaguggcuguugaggauccgcugcagggaggauuucaccauccggccgcugggguccgaaaccagcaaaaaccuccgcugcacuucccgcgccgccgccgcugcucgccguucgcaaaaaucuuaguacaguuucuuuuaugaauguggaagccuuugcauuuguaacauagauguucagaauugagaguucaucuuggucgauuuuuccuuugaugaguaugaaguguccucccuuaucuauuuugauaacuugguugaaagucaauuuuauucuauauuagaauggcuacuccagcuugcuucuugggaccauuugcugggaaaauuguuuucuagccuuuuacucugagguaguguaugucuuuguccgugagguucauuuucugugugcagcaaaauucuggguccuguuuauguauucagucuguuagucuauguccuuuuauuggggaauugagucuauugauacuaagagauauuaagaaaaaguggccaggcgugguggcgcacaccuuuaaucccagcacucaggaggcagaggcaggcacauuucugaguucaaggccauccuggucuacagagugaguuccaggauagccagggcuacagagaaacccugucucaaaaaaaccaaaaaaaaaaaaaaaaaaaaaaaaaaaaaaaaaaaaaaaagaaaagaaagaaagaaagaaaaaagaaauaaagaaaaagaaaaagugauuguugcuuccugauauuuuuuuuuaauuugguuagagguagaauuauguuuauguggcugucuucuuuuggguuuguugaaagauuauuacaacuuucuugcuuuuucuagguuguaguuucccuccuuguguuagaguuuuccaucuauuauccuuuguagggcgggauuugugaaacgauauuggguaaauuugguuuugucauggaaaaucuugguuucuccaucuauguuaauugggaguuuugcugauuaugggcuggaauuuguguucucuuagggucugcaugacaucugcccgggaucuucuggcuuugauagucucuggugagaagucugguguaauucugauaggucuaccuuuuuuuguuauuugacccuuuucccuuacugcuuuuaauauucuuucuuuguuuagugcauuugguguuuugauuauuaugugacaaaaggaauuccuuuucuagucuacucuauuuggaguucuguaggcuucuuguauguucaugggcaucucuuucuuuagguuagagaaguuuuugucuguaauuuuguugaagauauuuacuggccccuuaaguugggaaucuucacucucuucuauaucuguuauucuuaggauuggucuucucauuguguccugcauuuucuggauguuuuggguuagaagcuuuuugcguuuugcauuuucuucaacuguugugucaauuauucuaugguaucuucugcaccugagauucucucuucuaucucuuguauuuuguuggugaugcuucuaucuaugacuccugaucucuuuccuugguuuucuaucuccaggguugucucccuuugugauuuccuuauuuuuccuauuuccauuuuuagauccuggauggucuuguucaauuucuuauccuguuugguuguguuuuccuguaauuuuaagaaauauuuguguuuccucuuuaaggacuucuaccuguuuaccuguauucuucuguauuuuauuaaugaaguuauuuauguccuucuuaaaauccucuaucaucaucaugacaagugauuuuacaucugaaccuugcuuuucuaguguaaugguguauccaggaguugcuauggugggagaacuggguucugaugaugccaaguaaccuuggucucuguugcuuauuuucuuaugcuugccucucgacaucugguuuacucuagugcuaccugcccuugcucuuucugacuggagccugucccuccugugauccuaguugugucaaaacuccucagaguugagcugucucuaugauccugugauucugggaucccgaaauccugagauccugggugugucagagcuccugggagucaaacugccucuggcauccugaaaugcuggugugaccaagcuccugagauccuaugauccugagcauguuagaggucuuaggagucgaguguuccucugaguguuguaggccuguuguugagguagcacccaaggucugcucagggcacuagcuuggacuggaaggaacaagugccacuggcugggcagggguuccugcaucccuggaucccacuagucccagcuacucccaguguuggggcagauguuuuggccuccucaccuaugauccugggcauguuagagcaccuccugauuguguuuuuaugcugucaucuaggagucugacuuaggauuaauugaaauucuaggugcucguauuuugucuuguuuuguugggugggugcuuuguuucuuggauucuguguccuuucuaguucuuaagaggaugugguaccuguguguugucucauaggaaauucuggaaucaugacagauguggccacugggguuuccagacuucuagguauugggaaaugacucuuagcauccuaaggagggcuaggaugauggggcugaaggagucucuagcagggaggaauguaggauguuccauuaggaucuuaguucccugagaaugaggacaaaaagugaggaaaggccacacagauagcuuccugcagagcuggggaugagacuggggaaauggacugggagaagaggaaggucugaggcucaccuuccugcuuaggugaaggugagccuuacuugcuucuauggcaagauuggcugacaggcuccuagggaauaccugccgaguugggggcuuggauaauaagaugaauaugaaggcaguuuggaagauauauuucuguucaacuagacauuggaagagggugguuugcuucagauuugguagugagaauggaaaauugguuuugaaggagaagugaagaucugcuguuagccuaacugcuuccauaguggaacuggucagcauguugccaaagaacaccuacuugugauugucacaaggauaaugggguuacuguagagauggaagguuggaagagaaggucuguauaauccaaaaaagggugggcagagaagaaagggaggcugcagcagcuugucugcuacaaagcuggguauaagccugaagacauauugauagaaacacaaaagauguacugaagguaacuauucaaaauaaaaugaaaagagaaaaauaagagacuaaaagaugagcaggauaucagugagcuguggagcaauuucacucauacacauauggguaaaacuaaagucauuaaagaaaacaaaacaaaaagaaaguauagaaaaacguugaaagaaacccugaaauauuuuuuaaauuguaaacuauaaacucaaauauccaggacagccagggcuacagagaauuccugucucaaaacaaaacaaaacaaaacaaaaacaaaaacaaaaacacaauaacaaaaacaaaccaagaaacaaacaaacaacaaaaaaacccaaaaacccuaauuaacuaauucaagacuacagaccaaauaaaauaaaagauuucaguaauuaaaagccauaaguuauauaccagggucuaggaugcaguaacuaaaaugacggcacacagaacuauaguccaaguaugcuaccccucaauucagcuaacagcaggcuuacuauugucagauaguacaggguuccugaaauugaaauaugaauuugucuauauaaaaauucuccacuguuaaguaguugccauugaucccacuuuccagaaccacccuuucagaccauuaagcaaaggucaacaauuaaauuggcuaucucaaaauuucuacccuauauuucuguuugaacucuguauaaauuuaggaagucaggauccaaauacucagauaaacacagcucccuaaauaucugaaaugcuugacccuacuucuuugaacugugauuuucacaagagaaagaauccugauauacaugcaaagaaacccauuacuucauccuguuuuucucccuuccuaucaugcgguucuauaaaacacuagaugacaaauacuuuuaaccuuaaacuccacugaaauagaauauacucuauuagaaauaccucaucaaagaugagcaccaccagguuuauguaaacgcauaaaugcucaaaacagcuguucuaaggucuacuauuuuuacaagguuguuuugaaaugcuuuuuuaaaaccauaguuucuaaaaauaaaucaaauuuugaaaagguuauaauuauggaaacacgaggaaaaaagaaauuuuuuuaaaaucucaguuauucaauaauugauaauaaaugcuuuacuuuuuacccuguuaauuaucuuucauucaucacaaaauaaauauaugaaauaaacauuuaugagauaaagaaacauuagucuauuuuuuuaaaaaggcggguuauaacauuggaauguagcauuacaaugauaaacaaucucuauuacacacuacccauugcuggagagauaauagacuugaaaugaaaaccuacuacuuccauuuuccuaaaccaauauaauuucuaacuguacuuuugaugcuuacccuaauaacacagacaaguauaacucucgccccucgucaaagaaccuucuuuucuccauagcuagagacuauuucagggucccacggcuggucaacaugcagagaguaaggaacucugggauacugaacaccaauugauacauuugcaacccaaccucuacaccuaaagcucaggaaaaaaauuaugggaggaguuggggggguggggcaguuaagagccagaggcucuggacaguauuuuccccuaugaauuucccuaauuucaaggaaaacuauaccuaugaaaucucaacacuaugguugucugaauaagacaaacaaugacaauaauaguuaacauuuguaaagauggaaaaggcaaauuccaugucauuccaccccuagaugaagagccccagaucaucauggcugcugagagagagcccaucuccaggaaugagcucaugcagaggaaguccaauccuacguaguuaacaaacaugcuuugcaucaugaaaggauuuuuuaaaucacuaaaauaaaaacuauuuugugagucuccuaaacagcuuaaacucaagaguguaugaaaacucaagaaagugggcuggagagguggcucagugguuaagagcccuggcuguucuuucagaugaugauggugacucccaaccaucaguuagucaagaggauccaauauccucuucugucccccacaggcaccaagcuuucacauggugcaaaaacacccauaaacauuaaauagauagaugauggauagauacauaggcagauagauuuuuuuuaagaacuccuaaaagaaaguuaaaagaacaaauuccuggcaaauacagaaguggaugcucacauucaucuauuggauggaacacagggcccccaauggaggagcuagagaaaguacccaaggagcugaaggggucugcaacccuagggauggaacaacaauaugaauuaaccaguacccccagagcucgugucucuaguugcauauguagcagaagauggccuagucggccaucauugggaagagaugccccuuggucaugcaaacuuuauaugccccaguacaggggaacgccagugccaagaagugggagugaguggauaggggagcagggugggggugggguauaggggacuuucaguauagcauuugaaaaguaaaugaagaaaauaucuaauaaaaaauugggaaaaaaaaaagagaacaaauucucuggacaaucaaugcaagagccauaaacucuugaugaagaaaauuuuaauuguauuauagaaaguaaaauaaaguuuaaauguuaccagaacauuuucuguuuucaaugaugucuuaguuuggguuuuuaaugcuucaggaaaacaccauaaccaaaaguagguugggaaggaaggugcuuauauggcuuacacuuccagaucuuaguccaucauuggaagaaaucaggacaggaacucaagcagggcuguaaucuggaggcaagagcugauucagaggucauggaggggagcuguuuacugguuugcuucccguggcuugcucaaccuguccuccuauagaacccaggacuaccagccuagggauggcacuacccacagugggcugcacccucccccauugaccacuaauugaaaaaaugccuuaccacuggaucucccaaaggcauuuucucaacugaggcuccuuccucacuaaucuuccucuagaaugugucaaguugacccaaaaccagccaauaaaaauggcaaugcaagaugugaaugucaaacaaaggguaggugguguaaaucuccuucaaaaaccuuugaugauuugucugucuuccccgguagacgacaagcucuguaaggcuagaagccaggacaguuuuauccauccugccauacucagccccuaaaacauaggaacagaguauuuuuaaaugaguagaauaaaaaaacacgucaucuacuagggcauaugcuauaauucuacuaaauaccgcaagauggaauuccugguuaaauaauaaaaaauacagaaguguuuaucaaggagaggcagcuuuaaaaaugaagugacauugaaagcuggcugaugacuuucccuccuagauguuccuugguaaugcacccuuccccuucaauuucuccauuuaguugugauacaugaugagacuccuugacagaaaccaaauguaugcugacccaugcucaggaaccuuuggauuauaagauaauauuuuuuuuuacaaauuacccaaaguccaagaaccugccacaauaauaacagugagcuguuucggaauuuacaagugaagcccauggcauagcauaugaccaaaaugguagucacuauaguuuaaauaagcaauaauuuuaauaacuaaaauauaaaauccauaacaucagucuuuuuggcuuacucuuucauacuucaaagcucuuccgggguuuucgguuugaacugcuaagaacuagagaauaguagcauaaauagcuuuuagcaaagagcuaacugccaguuaugaggauccuuguaacacauugaaguccucugaaccaauccacaugauaaggacauuaggcaaaauuucuuuuaaaaaucuagaaggggaagaaugaacuaagaacccagaaucaugagaucacagcugcuaucaaagggaauggaugcaccagggaagacuuggaguccagugugaguugggggugaggaaggugcaagcauccuugcaaaucagcaauaagagguggccuccugagaaggggucaucuagggguacaacgaaagagaagaaggaaauggccauauggauaucauucuguaaauguguaauuaagauugucaauuuguuaguuaccuaauugguuuugguuaauuuuucuauaaucauugauccuauuuucacuuauaucagaauuuguaauucaugagaaacaauagucaaaaagaaagcuuaagcugagaaaggguagugccaaugucucaggaggcugaggcaggaggagggccugagcgcagaaauuuaaguccagccugagcagcauaguaaauaaaacccuauuaauaaaaauacauaaaaauguacaacugucacuuagugagcacucaauuaguauguuaaauacauaccucuaaugaggcaaauuaaauuagcaugcuugaguuuuagagacuacccuucgccaguuucaaugucuuaagagaauucauauaacaauguuguuuuucuaacauuaguuuaaaauguggccacuauuuuuuaccauaacauaaaauaugccuaugacucuaaauaggcugacuagcauauuugugguucuuauaaagcaaggcacauacacuguacaguuucuauuauaaaguauaauuaaaaagagcugacaaaaaaguauugggaaaauuacauggauuguuuucuguacucagauuuugauauguguuccaaaauacgaaacuauacaacuagagugauaaaaucauaauuuaaaaauuuucaagagaaauugagaacaaauaaaaaccauuuaagacuagaaauguucaagagagaaaaugaaucauguaacagagcccugaacucucaacuaguucugaaaaauguucauguuggauuguaaaauaauauuuuaauauccucccuagcauauuuuaguauuuccauaaaccaauuuaauucacguauaauuuauauuucuaugucaaacaccugcaaguuauaaauauauuaguacaaaaacuuauuuuaagguuuuuauuaaaucagaaguauguaugagcacacuuacaguugaagaaguuaaugcaagaguuacuggcuaguuaugguacaaaacugagccaagaaaaacauucacuuauuuauauacugcagcacuugaaaaugucucuuuuacacugugcccagaaccacaaaauuuaucaaauaaauuuccauacccccaaaaucuaaccaaaagauacugugaaacuggcauuacauuaaaaauaaaauacuaguacuaugcaguuguaugcauguucaggaagaaaaaaaaaggucauauucuauaaaugaugaaaauaguaacuugcagauuuuuauuuaaaaaguaucucaaauaaaaaguaggacaguaaugaacuguaugagcauuuuaugcaaaaagagaaaggccacauaaaauaaaacuuaaaaauaaggggauccagguauuaaaccgacugauguuacuguauuuuuaaaaaugcuacaaaaagaaaaucuucugcuuaaauuauuuuuuuauaauaccuacaaguaaucuuuuauucuagcauggaaaaacuaugguaucugacugcuuuaucuacuccauuagcauaaagagauaaaguucagcuaauuaucauuucaugauaauucagcacuucaaaacucuauguaacuuugcccuuuucccugggagacauuuaucaaugucuagaaacauguuggguugcuauacuggaguggaaagaggagacacagccaugccauuggcaccuggucucuuguugauauguacuaggacuauugucaaacauucaacaguaaucaggacagccuucaaaaaacaaaaaacaaugacaccaauaauuauccagucccagauauuaacaacaccaaauuuuggacauccuaucuuuuaguuacuuuucuguuaccauauaauaaaauaccuugacaaaugcagaaaaggacaaaguguuuauuuggguccauaguucaucaugauggggaagacaugauagcaggaaggaaaggcaugguggcaggaauaggagacuagauaucauugauaucauugcacccauagucagaaagaauaaaaugagcaggaaaugagguuaguccaucuccagugauccacuaacuccaaaggcucccucuccuaaagguuuuauacccuuuccaaauagcaucaccagcuagggaccaaauguucaaaacaucugagcauaugggagacauuucauauucaaaccauaaugucuuuauuuaaaacccaaccccuugccugggacaaucagcuaugagaagaauuucaaacugaaacaaaggaauaaucuucauaaagguguucuaagaaaagagcaauauauagauaauacacuagccuguauaugucaggaaaauacagagugugcugauuuuagccacuacccaccccuccuaugugacuaaaaauuaauuuguuccacuccccucucuaugcuucuuuuuuacuuuuuauugugaaaauucucauguauucacaaaauaaaauaauauauccaccaugcaacuuuaagaaaugucaacacuaucauuuuuuaaauguauguuucuuucauucagaaaauuguuuuuucuuagauauuaaaagcaagugccaaaggacauuuuuuauaccagcugaauuuaagauguuuguuuguuuguuuguuuuucaguauuuacccuugaagaaugcugauccagauaagcuauuuacaaugcacaugaaaugaaagcuccacugaagggucugcaacccuauaggaggaacaacaauaugaacuaaccaguaccccagagcucgugucucuagcugcauauguagcaaaagauggccuaguuggccaucacugggaagagaggccccuugguauugcaaacuuuauaugccccaguacaggggaaugccagggccaagaagugggaguagguggauaggggaucagggcagagggaggguauagggaacuuuugggauagcauuugaaauguauauaaagaaaauaucuaauuaaaaaaaaagaaagaaaaagaaaugaaagcuccaguaaaagagagucaguuagaccaugugaggaagggaugccagaaacaagaacagcuaucccagauccaaacaaaugguagggaaagcccuccaaggauucaccacauaagcacgggacuggacagaagauugaaaggcacuugucuuagucaggguuucuauuccugcacaaacaucaugaccaagaagcaaauugggaagaaaaggguuuauucagcuuacacuuccauacugcuguucaucaccaaaggaagucaggacuggaauucaagcaggucaggaagcaggagcugaugcagaggccauggagggauguuacuuacuggcuugcuuccucuggcuugcucagcuugcuuucuuauagaacccaggacuaccagccccggggauggcaccacccacaaugggcccuuccacccuugaucacuaauugagaaaaugccguauagcuggaucucauaaaggcauuuucucaagcgaggagcauuucuauguuauaacuucagccugugucaaguugacacacagaaucagccaguacagcacuggugguagcauuuguacuuagacauaaaggcaacaugugaggauucuggacagaaaggcagaagugaaaugaugccacagagauacaagcuauaaagauucuagaucagaaauguugauaaauccuaauguucucccagcuuuaacaaucugacaucuauauguggagggagaugauaaaacugauacucagcagaaaggacaaaaauacacgggagugcagcguagggaaauggucacaccuaaacuacaagaaaacaguugggguuuauuauuuaggagcuuaaauaguaaaacuuuguauaggacaucuauacuacuccccuaucagacauccagaagaaggcagaaagaacauaagagccagaggaagagaguguuauuuccauagcacucuuaacauaaacagccucaaugaaauuuauuuacacacacacacacacacacacacaaagaaauucaaguaaaagaauaaaugggagguccaggaggagaugagcuuuaauguaauuuuucauuacagugcauaguaccuuagacuuccuucaucuggcuuccaggauucucagauaauguuuuccuuuugcauacauuccuuccuccuguagagagaguuuuaaagccauugagaaugugauuugguacccaccccccaugccagaaaaaaagaaugucuucuugagccaggcgugguggcgcacgccuuuaaucccagcacucaggaggcagaggcaggcggauuucugaguucgaggccagccuggucuacagagugaguuccgggacagccagggcuauauagagaaacccugucucgagaaaaaaaaaaaaagucuucucuuuuuaaauccuguauguguauaugaugugguauauauggguagcauggucaugugugugaauguggguacauguaugacauagcauaugugcaguaaucagagaacaaccuccguuguggguccuccccugucuuauuugagacuaguucucuuuuuaguucacugcucuauauauuacacuaugccuccaucucccuucuccuccugggaguauugggauuaugggugcacacuaaugugccuaacuuuuauaugaggucuagggauuccaacucauccuaagcuaucucaccugccccaaacuacuuauucuuaauucccauggccaaaagaaagaaccuuuacacuucaaaaagcaagaugagacuuuauagguauauguaccuaggagauaaaauuucagagcaaguucuuugauccucugacucuuaucuuucugcuacuucuuccacaauguucccugagccuuaccuaacagaaacuauguuguguaucacuugggcuccaagugauuggguuuuuguuuuguuuuguuuaccaagacaggauuucucuguguagcccuggccuuccuggaacucacucuauccacagggauggccuuaaaauaagacauucgccugcuccugaaucccgagugcuaggauuaaagggaagcaccacugccacguuggcgguuugggcuuucuguaauggucucuguugaugcaaagaaaaguuuccuugaugaagagugaagacgacacauaucuauggaaauaagagcaaauauuuauaguuagggauuauccuaguuuaauaaaguagugguuauaaguucucccccaagguccaugacaucacuagcccuguguaguugacuggguuucacacaacacaguaccaggccugguuucucuccuguucaucaggucuuuaaucuaauuagagagcuguuaguuagaacauauacucauaaaauuucaccaacaugacuguuagaaaugagcugaacauugagaaaagaucuuuaccaacccuacauccaauagagggccaauauccaauauauacaaagaacucggagcuggagggauggcucagcgauuaagagcauugacugcucuuccaaagguccugaguucaauucccagcaaccacauggugacucacaaccaucuguaaugugaucugaugcccucuucugauguggcugaagacagcuacaguguacucauauaaauaaaauaaauaaaucuuuaaaaaaaaaaaacaacucaagaaguuagacuccagagaaccaaauaacccuauuaaaaaaugggguacauagcuaaaccaagaauucucaacauggaauacugaauggcugagaagcaccuagagaaguguucaacauccuuagucaucagggaaaugcaaaucaaaacaacccugagauuccaccucacacaaguccgaauggccaagaucaaaaacucaggcaacagcaguugcuggcaaagauguggagaaagaggaacacuccuccauuguuggugggauugcaagcuaguaaaaccacucuggaaaucaguuugucaguuccucagaaaauugagcauaguacuaccugaggacccagcaauaccacuccugagcauauacccagaagaagcuccaacauuuaauaagggcacauguuccacuauguucauaauagccuuuauaauagccuggagcuggaaagaauccagaugucccucaacagaggaauggauacagaaaauguggaacauuuccacaauggaguacuacucggcuauuaaaaacaaugaauucaugaaauucuaaggcacauggguagaaaguaucauucugagugagguaacccaaucacaaaagaaaacacaugguauacacucacugauaaguggauauuauuagcccagaagcuugaaauacccaagauagaauucacagaccacaugaagcucaagaagaaggaagacccaaguguggauacuuucguccuucuuagaagggggaacaaaauacccaugaaaggaguuacagagacaaaguguggagcagagacugaaggaaaggcuauccagagacugccuuaccuggggauccaucccauauacagucaccaaaccuagacacuauuguggaugccaacaagugcuugcugacaggagccugauauagcugucuccugagggacucuaccagugccugacaaauacagagguggauacucucagccaaccauuggacuaagcacaggguccccaauggaggaacuagagaaaguacccaaggagcugaaggaguuugcagccccauaggaggaaaaacaauauuaaccaaccaguacccccagagcucccagggacuaaaccaccaaccaaagaguaucauggagggacccauggcuccagacucauauguagcagaugaugggcuugucagucaucaaugggaggagcggcccuugguccugugaaggcucuaugccucagaguaagggaaugucagggccaggaagcaggagugguugguuagcagggggaaaaggaaagaggauugggggcuuuuggaggggaaaccaggaaaggggauaacauuugaaauguaaauacaaaaauaucuaauaaaagaaacuaaaaauuaaaaaaaaaaugggcugaacaagaacaauagacaugcuaaagugguugggagaaacuucaugagacuucaaugccccacaaugaacuauaggcaacuaaugaauguugaaagcagaaguagucuuccccaaggaaaagugaagacuacaccaauugguuauccaauaccaaaugguccacccugagaacauacauacaaagaacauuauaaaaacugagcagguuauauuuaagaauguauguauauacuuguauggggaaaagcucaugaauuugaaagaaagcaaggaaggguauaugggaggguuuggaaagaagaaaaggaagggggaaugauauuauacuguaucucaaaaaaauuuuuaaauaguaaauauauauacauaaauauauauaagcugaguauuguuuuaaaaacagaaaucuguuaauaucacaccuugcucaaaacucucaucgauuuccucuuuaacccaaaauaaagccaaauauucuacccugugcagauccagcucuuaaucuacuuuuucuuucucugauaggaaaggguucugcuucauucucuaucuguguuggucuguccuuccuuucucagaugaaaaucugugaacuugugaugcccaagacauuguuuuaaguccuucacaugugcaugccauuuaauccuuucaaaaucucacaggagagguccaaucauuauccccacugcaccaugacagauucacauacagugcucacaaaagucuucaacaucugcacuuuaauuacacucuucuacugaaggauauagacagcauuuugaaaaauaccccugagcuuuucauacccacacaucacauaagcacccacacaagcucucaaacacccauaaaaaguuuaccauuuguagcacagaagcuucaucugguuugcauggguguuaaccggcaaaauacuccauaauauacaauuaaaaugugaguauuggguuuuaauguauucggauuacuuaauggaucaagaacucuguggugauuugaaugagaauagacucugucuuagucaggguuucuauuccugcacaaacaucaugaccaagaagcaaguuggggaggaaaggguuuauucggcuuacacuuccacauugcuguucaucaccaaggaagucaggacuggaauucaagcaggucaggaagcaggaggugaugcagaggccauagaaggauguucuuuacuggcuugcuuccccuggcuugcucagccugcucucuuauagaaccaagaauaccagcccagagauggcaccacccacaaggggccuuucccccuugaucacuaauugaaaaaaugccuugcagcuggaacucguagaggcauuuccccaacugaagcuccuuucucugugauaacuccagccugugucaaauugacacaaaacuagccaguacagacuccgcaaggcucauaaauuuggauacuuaaucaccagggaguggcacuauuugaaaggauuaggagguuugacuuuucuggaagaacugugucacuggaaaugggcuuugagguuucaaaaaucuauuccaugcccauagucucucuuucucucuuccuacugcccccauaucuagauguagaacucugagcuacuucuccaguacuauaucugccuguaugugcccugaugaaaauguacuaaagcucuaaaacuguaagcaagcccccaauagaugguuuauuuuaugagaguugccauggucaugguguaucuucauagcaauagaacaccaacuaagauaaacacuaauguugacauuucucaaccaaucaauaaucugcaaucauauaaauaaaaauucuguucuggguuuuaacacaugaugauugaauugaugaauguaaauauuucucauuuuaaaaagaaaacuaaauguauaacuacagaauucuugucacacaauauuauugauaauggguucucuaagagaauuuaaaggucaaaauucacugaaaacacauagaauaagaaaacauguagauuauagauguuuugaaacuuuugugcuuugaaaccauuuuagacuuaagggaguauuacaaauaaggugccacugccuauaaucucucaaccuaaaauuauaucaguguggucuauuuaucaaauugagaauuuaaagagauaauaugcugggcaguggugacucacgccuuuaauccuagcacuugggaggcagaggcaggcagauuuccgaguuagaggccagccuggucuacagagugagagugaguuccaggacagccaggauacauagagaaacacugucuugaaaaaccaauggaagagagagagaaagagagagagagggagggagggagggagggagggagggagggagggagagagagagagagagagagagagagagagagagagagagagaacacacaggaacaggaagguugugagaaggaaguaaaaggagaacaaauggcaagucagugggaccucaguccccuagcuaccuaacaccagguuaccauugacuacauaguucaaauaaauaugaggacuaaaaaaaggacagaauaaugaaccaaaguauacauuucaccagcuuuccuagcaaugcucuguuuguguuccaguauuguuuaguucuguuuucuccuuagucuccucucaucaaagagagcucacauuaaccaaauauauuuuuuugaggcaggguuucucuguguaacccuggcuguccuggaacucacuuuguagaccaggcuggccucgaacucauaaaucugccugccucugccucccaagugcugggauuaaagaagugcaucaccaccacccagcuaaccaaauaucuuaaagcauucugugaacucacuacuucugauauauucuuuccuguguauguaugccuuggaauuucugcauacaaauuaugucaucugugaauagagaucuauccuggucuggaugccuuaugcugccuuucuugucuaauuggcccuguuuuauccucuguauaaaguugaagggaagcauuuagaacgggcaucuuuauuuuguugcuauucuuaacaccaaagccauuagucuuucaccacuaagaaaaauauugcaugcucgcuuaggauguggaaauugguuugcauaagcauuuugaccaugaaaaaagaguagaguuuucuucgugugcuuuauauacaucuuuuaaacuauccuaacugcaguuuguauucccuagaucacuaucguuaugaucuucagguaccaguacauagagucagugguccucuucaguguucacauugagacaccugcauaaucagagaaugaucaugccucagacacuagaaucccucuuucauaaaaucacuuccaaacuucuaagaguuaaaucaaucaguuuuugugagugcgaucaaagugaggcacugaaaacuuaaucuucagaaauccagaaaaucauaaugauauacuuuagaacucuguacucuaccaaauuagaaaaaauuaaaaugaagaaauuucuugauauauacuauuaaaaacuugauauauucuauuaagguuaaaucaagaucagauacgcaguuuaaaugaaccuauaacuguaguaaauuggaagaaagagaaagugucccagccaaaagaacccauggaccacggggauucuacacagaauucuaccaggcuuucaaagaaaaauuaacaccaguacuccuaaaauuauucuccaaaauagaaacagaaggaacauggccuaauucuuuuuaguaaagccacaauuacccugauaucuaaaccucaaagacccaacaaagaaaaagaauuacagaguacuuuccccuaaagcauauaugagcauauaugcaaaaauccugaauaaaauacuugcaagcugaauucaaaaacaucauccaucacaaucaaguagacuucauaccagaaaugcagggauggcucaacauauguaaauugauaaauuuaauccaccauauaaaaugacugaagacaaaaccacaugaucaucuaucucauagauguaaaaaaggucucugacaaaaucuaacacaccuucaucauaaaaguccugaagagacuagggauaaaagggauauaccucaauauaauaaagucaguuuacagaaagccaacagccaacaaucagucaaagcagaagcucaaaacauuuccacuagaggcuggagagauggcucagugguuaagagcaccgacugcucuuccgaagguccugaguucaaaucccagcaaccacaugguggcucacaaccacccauaaugagaucugauaaccucuccuggugcaucugaagacagcuacaguguacucacauauaauaaaauaaaauaaauaaaucuuuaaaaaaaaaaacauuuccacuaaaaccacaaacaaggcaaaguuguccauuaucuccauacuuauucaauauaguacuugaagacuuagcuagagcaauaagacagcugaagaucaaagggauccaaauaggaaaggaagaaguaaaaguaucucuauuugcagauuucaggauuuuuauacaucgaugacccuaaaaacaggaaaauucuacagcugauaaaaacuuccagcaaaaucaucauaauacaaaauuaagacacacacaaaaaaaaaaucaguacucuuccuaucuacaaacgacaaauacugagaaagaaauaagaaaaacaauaacaauaacucaccauagccucaaaaaaauaucuuaaaguaucucuaagcaagccugugaaagacuuguacaauaaaacguuaagacacugaagaaauaugaaagaaauauaagugauauccacaaauaaggaggaagacaaaucccaacuaaacauccucccaacccagugaaaccuccagugacugguacagcgacagacaaguagaccaauggaauagaauugaagacccagaagugaacccacacaccuauggucacuugaucuucgccaagggagcuaaaaccauccagugcaaaaaagacagcauuuucaacaaacggugcuggcacaacuggcgguuaucauguagaagaauucgaaucgauccauuccuaucuccuuguacuaaggucaaaucuaaguggaucaaggaacuccacauaaaaccagagacagugaaacuuauagaggagaaaguggggaaaagccucgaagauaugggcacaggggaaaaauuccugaacagaacagcaauggcuugugcuguaagaucgaggauugacaaauggaaccucaugaaacugcaaagcuucugcacggcaaaagacaccgucaauacgacaaaaaggccaccaacagauugggaaaggaucuuuaccuauccuaaaucagauaggggacuaauauccaauauauauaaagaacucaagaagguggacuccagaaaaucaaauaaccccauucaaaaauggggcucagagcuaaacaaagaauucucaccugaggaauaccaaauggcugagaagcaccugaaaaaauguucagcauccuuaaucaucagggaaaugcaaaucaaaacaacccugagauuccuccucacaccagucagaauggcuaagaucaaaaauucaggugacagcagaugcuggcgaagauguggagaaagaggaacacuccuccauuguuggugggauugcaagcuuguacaaccacucuggaaaucagucuggcgguuccucagaaaauuggacauaguacuaccagaggaucccacaauaccucuccuaggcauauauucaaaagaugucccaacccguaagaaggacacaugcuccacuaugcucauagcagccuuauuuauaauagccagaagcuggaaagaauccagaugccccucaacagaggaguggauacagaaaaugugguauauuuacacaauggaguacuacucagcuauuaaaaagaaugaauuuaugaaacuccuagggaaauggauggaccuggagggcaucauccugagugagguaacccaaucacaaaagaacucaaaugauauguacucacugauaaguggguauuagcccagaaacuuaggauacccaagauauaagauacaauuuguaaaacacaugaaacucaagaagaaugaagaccaaaguguggucacuuugccgcuucuuagaauugggaacaaaacacccauggaaggaguuacagagacaaaguuuggagcugugacgaaaggauagaccaucuagagacugccauacccggggauccaaaugcugacaccauugcauacacuagcaagauuuugcugaaaggauccagauauagcugucucuugugaggcuauucuugggccuagcaaacacagaaguggaugcucccagucagcuauuggauggaucgcagugcccccaauggaggagcuaaagaaaguacccaaggagcuaaagaggucugcaacccuauagguggaacaacaauaugaacuaaccaguaccccccggagcgcgugucucuagcugcauauguaucagaagauggccuagucagccaucaguggaaagagaggcccauuggucuugcaaacuuuauaugccuaaguacaggggaacaccagggccaagaagugggagucgggggaaggguaugggagacuuuugggauagcauuagaaauguaaaugaagaaaauaccuaauuuuaaaaaaaggaaaaaaaaaaaccaguaacucaccauagccuaaaaaaaaaaaaaaaaaaaaaaaaaaaacuaucuuaacguaucucuaagcaagccugugaaagacuuguacaauaaaauguuaagacacugaagaaauaugaaagaaauaaaagugauauccacaaauaaggaggaagucaaaucccaacuaaacauccucccaacccagugaaaccuccagugccaggaauggauuauaugucauugaguuguuagccaaagggaccucauggaaauccccaacaacccaaucuauugccaaggcuauugguugcucuccacaaagugauggucaugcccuuuugcugauggcaacaccuacauaacucaucgaacaugaagaagucaaagugaugccuaaugagacccuucaucucuacugacugauguaguacugaaaggcauacugcauucuaccagaggaaaaacauaaauuccaaccaagcuacaaacucugcucuacaauggugaauugccugaaggauacgaugguguaauaguggcacaaacgugggagcaaucaaccacuaccugaugggauuuaaggcccacuccaugagaugaaaugcaugccugaugcugaucagguggccaagagugucaaacuagauaggccauagaccuaggggaaaaccuaacacuuucuauucuucuaaaggaaugcagcaauacaaugacauucugcuauauucauaggucaguauuuugcucagccaucaucagagaagcuuccuccuacagcagaugggaacaaauacagagaccuacaacaggacaaugcacagugagagaccuugaaacacucaguccuaaaagggcugucuaucagaucccucuccucugugggagaggagauggagagauuguuagagcuggugggaguagaggaccccaaagaaaggagaguuucuagacacaacaggaugaaagccccugagagcucauagacacuguggcagcaugcacagggucuauacauguccaagccaaaugggaucccagagcugagaggagaaauguucacauuucuuuuuuauuuuaauuacuauaguaucuuuuauuuuuuaaagauuuauuuauuuauuauauguaaguacacugucuucagacacucagaaaagggaguuagaucucguuacagaugguugugagccaccauaugguugcugggauuugaacucgugaccuuuggaagagcagucggugcucuuacccacugagccaucucaccagcccaauuuuuuuuauuaaauuuguacucaauuuacauggcacucacugucccccucccaaucaccccuuccucaacccuucucccauccuccucuccccuucuccucugagugggcaggggccccuggggauuccccccaaucagguacuucaagucucugucucaagaggcuaggugcuuccucuaccacugaggccaaccaaggcaguucagcuaguagaacauauccccaaaacaggcaacaacuuuugggauagcccccgcuccaauuguucaggacucacaugaaggccaagcuguauaucugcuacauauguucagggaggucuagguucagcccauauauguucuuugguugguaggucagccucugagagccccaagggcccugguuaguugacucuguugguuuuccuguggaguuccuauccccuucagggcccacaauccuuccuccuagucuuccauaagagucaccaaguuccauccacuguuuagcuguggguaucugcaucugucugcaucagcugcuggguggagccucucagaggauagcaugcuccuuucugcaagcauaacagaguaggauuaauaauguuagggauuggugcuugcccaugggaugggucucaagcugggcuaguuauugcuuggccauucccucagucucugcucccuccccuaugccugcauuucuuauagaaaagauacauuuuggguugagaguuuuguggguggguuggugucucugucucuccacugggguucgugucuggcuacaggauguggccucuucagauuccauaucuccaguguagugagucauagcuaaggucacccccauugauucuuaugugccuccuuuauccccagucacugucuugaccuauucuuauuuguuuguuuuagaugucugucuuuucuacugugaaaagagacauugaccaaagcaacucuuagacaacauuuaauuggggcugacuuacagguucagagguucacuccauuguuucaucaaggugggagcauggcaacauccaggcaggcaugguguagguauagcugacaguucuacaaguucaucugaaaaagauuuguuuguuuguuuguuuauuauauguagcugucuucagacacuccagaagagggagucagaucucauuacagaugguugugagccaccaugugguugcugggaacugaacucaagaccuuuggaagagcagucagugcuccuaaccucugagccauuucuccagcccccgugaauguacuguuuauuagcauguauucauugcacaaaauagugacuuuuacaaggaaauuuucacacaugcauuuuuauguauuuuaauuacauucauugccuguuacccucucuugucucucuucccuucugucuucuucucaaauagaagcucuacuguuacgagguaccugaagagaaaaacucccaagaggccugaaaaagcagaauggagucuucacuaaccaccaagcagaucaauaggaagcaaccgugacuuccauuuaacuuuuuaaggguaaaaaaauccacaauuguaauguacgcagaaagcaagcaugguucgcagaaguaauuuacagaaguggacagguaacaacuguagucagcuauggucagauaguuaaccuuuagcucaaggucauauuguucaggaauauaggacugguccagagacuaguuuaccuuaggaauuuagggcuaguacagagaucaguuuuacccaggguaguuuuaauacuuaaaguauucuuaggaauauuuucaugagaugguauaacuauaguuccuuagcccacgacacugccuccaugacuuucuacagcccacauucagcauagauuauguuuuucuuucugaaucuggcuuacuuuguuagugugguaaucaccaguucaacucauuuuuaugcaaaugucuucuuuguggaugaauuaauauuccacuguguagauaucacaguuuucuguauccauugauccaucuuagaaauguaaacuuguccagcaacuuugaaaagcaacauagagguuccuuagaaaacuaaaaacaaaauauaugaauuacauggguagaaaacugaccagagcagccauggcagcaaagcccaaauguguucaauuuauuuacaaacugaacagucguuucagugacuuuacaagaugcacaaaauguaucucuuguacacuaauauuuguagaaauagugagaggucuaaaaagggucaacaacaagcuauguuuugaugaacucuaaaagcuuuuauuucauacacacuuacguuauauuugcuucuguaaaacaaaccaucuuaacaagaacaaagaguggcagccauacaucaacuaaugccgaccuuugacuuccuuggcaagaacaccuugguucagaaaugaguuagggguuuugggggcaauaguaacauaggaaacccccuuugcuguuuuaaaaagcugauucuaacauguuuagguguccuuugacugucuacagcagcuuaacaaagcucaaaguuggaugagaaccaauaauugcauucacugaagaccuguuugaaaggggaagucauauaagaaaaaucauaugaaccugccucagaaacaagggcucccaaaaacuagcauaaaacauucucaugccuaaaucucucucucccucccucccucucucccucccucccucccuccuccuccuccuccuccuucuucuuccucucucucucucucucucucucucucucucucucucucucucucucucucucucucucucucucuucccccccccccuggaaucucauuuuucauugguuuaagccaauagaaagucuuuauuagcuggcugguaacuaugcuggguuugagaucugaguguagcacugagccuuucucauggugagcuuuuaagcacaaaaaccauguucuaguuugaaacucuuugguuaacaagaacaguuuuccagaagugaaacuauaagagcuaaaaaguaggguuaguacauuuugguauuuucccagaacuauauggucuuugauagauuaggccuuuguuuuaguuuugguagguggugcugucuaccugcugaguuuuacaacuugaauaguauuuccaacauggagugaguugugcuaaggucugggggcuuaggucuggggcacugcuacaaaauuuucuaaagcaugauagaguuccagcagauauuuugaaguauuuguaaacuugucugugggggaaacuguaauauuuggagguuugccaugguggcugucuuucauuaaauauugcuagaauccauuuuaggaauugaaaauauaggaaguauuuuugggccaguuguauaaaauaaaagcuguuuccuuuucuuuccuucuuuccuuccuuccuucuuuccuuccuuccuuccuucuuucuuuuucuuuuuugguuugcuuuaguuuugguuuuugguuuuugguuuuuggagacagguuuucucauuguggcccuggcuguucuagaacugacucuacagaccaggcuggccuuggucaagagauuugccuucaggcaaucucagcauuuaagagcacugacuguucuucugaaaguccugaguuuaaaucccagcaaccacacgguggcucacaaccaucuguaaugagaucugaugcccucuucuggugugucugaagacagcuaugguguacuuagauauaauaauagauaaaucuuggggccagagugaggaguuccagaucgagcagagguccugaguucaauugucagcaaccacaagauggcucacaaccaucuguccagcuacaguuuacucauauacauaaaauaaauaaaucuuaaagagaaagggaggggaggggaggggaggggaggggaggggaguggagagagauuugccugucuuugccucucaaguucugggauuaaaggcacaugccaccacaacccagcuaaaagguuuuucauagguaacugucuaagggaguugcaauaagaacaaacagacaugacuacaaacugacucaaagagaugacauagauuguuaaauacauugaauuccagacuuuaaaaaaaaaaugagaacuuuaggcacucaggguccuuuaugagaagcaacaugugucuguaugaguuugacuacaguggagaagucugggaaagggaaauucaacauucuuaguccuuggcuuuucuguuacauccagugguuuuuuacacaucuccuucccauaaguucaaguuuuaggacuugggauuaaguuuccccagagccuagaaaaaaaaaagugguaucuauauuugauaaauggugaauggaugaagaauaggcuaagucagcuguggguccagaccccuuugggaaccccgucuccaaaaaaguauuugcauuacauuaagaauuguaacaguagcaaauuacaguuaugaaguagcaauaaaaaacaauucuauuguuggcaaucaccacaaaauaaacuguauuaaaggaccgcuguacuaggaugguugggaaccacuggcuuaagucacacuaaguauggugagaaaggaagauugaauuuaaauccuuuacucauaaaugacuugauuacuaaaaaaacaaacaaacaaacaaaaaacccacaauauugaaaagaugagaaaucuggacugugauuaccccaauauuccagaacuuggauccaaacccacucaauuagugguggcucuguggagcaaugcugaaaggagacagaaagacagauaaucaaagcuucaaacuuuuuguuuucacauguucuaauguuaauguagaaagaaaaauuccauuguguacaacggucuuaauuaguuaaguccuaauuagauaugccuagaauccuguauucaagcauacaagaccccaaagacaggaacauagagaugaaaaaggauugaucuuuuguuucgauuugaugauuuuagauuaccaacuacuuuagcuggaccgauacggacacuacagccugcugucugccccuaugcuuuaugaaagagcuuacuccaggaagauacucagcaccacucuccaaaaggaggaaaugaauacauuguuucuuggaaacuggaaggaguggaguauggaaggaacacgaagguaucuuaaucugaguccuuaaaguuugcacauaccucaaaaaaaaaaaaaaaaaaguuacacaccagucguuggcaaucucucaaguauaaagcagaucauaacacuggacacuuauagcgcccaagcuuaaccuaagagcugaccagagaagaucugcagcuuaaaggacugaaauauagauaauucgugaaaugagaaacacagguacugaauaucacaugagucacacuuguuacuaugcugcugcugucgggaugaagguacgguaauaaaagucuuugucuuggguacauugucuuguuaagccucccaaaugcuccuggacccaagaaacauugaggugcgcgcuuucuuuggaagcgagcacuggauaguacguacagaagcuccuccuaacccguccugggaucagcgucccaggccagcggggcagcuccuaacccggcccuccuccgccggacagggguggggcugccgagagacagcgcgugcggcucuguggccacccuuucagugguuuugcuggccuccggucucgcuuacucauuucccucccugacuuuacagugcacaguugcugcacuaaaagugggcguggcucggaacgaauaaaacacgccccucucgugacguaagcacuguugcaugcggaaguccggccuuaauuccaaucagguccuagcagcucugaaaaguaacguggcauacuauguaaaacauuugcaacuugccaaaucagucaaacguaaauuauuuauuuaggggcugaaaaaucacuucugccugauuuuuagcuacaaaaacgagaaaaaaauagcauuuuucuacugcuucuugagcacguguucuuaccuagcgauaagcaccuuaaauacagggcgcgugcgcgggcaggucgccgccgaaagccugcgagauuacccagcaacuuugcgucuucccagagagcguccgugguggaacugggcaagcauggggaaggugaauguagccaagcuuagguacaugagccgcgaugacuucagaguucugacugcgguaaggaguacaccuuucuugcuuauccauucggugacguccuccuccugcuauucuaaggucgcugggagcugagugagggcucucugauuuguggauuguuugccgaggcugggaucuggguaaagggcaccaaggucugauuuucaugaagcuuugugaaaaaaagaacuaucuuuuacuaaacaugguucuuccuuucagcuucuuuugcugcagaugugcuuacgucucuguggcccgggaaauuucauugaucuuuggcuuccaaacuaggggagggugggaguuaaguccucuaauagacucagacacuuaauguuaaaaaaaaaaagucagcuuucucuaucaaauauaacagcagagugcaaaacaaaggaggaaaggagaugccucuuagucgaccagcaaaucaauauguuaacaauguagucagauaguaaguaccgugaagguaacaaaggauaaagaaauagaaaguagccacguguuggaaggauacugucuuugaguuuuacagugauggagacagaauccaagaaucuugucuuuacuguuaaucgaacuacaaaguuuguccccaccccccgaaccaaugaaucuuaacugccggagaaaaaaguguccuuggagagaguuguagaagagguguccuuggagagaguuagaggcaaauuagagcaaaaacucagagaugggagggagagucuucauagaagagaaagguucgauauaaugguuggggacauacauggaaaaugagaaccaaaccauauaagcccuugcaggccuaguaaacgauguguguguaagcccgugauuuauuuuuauuuauuuuuuaauucauuuauuuauuuauuuauuuugguuuuucaagacaggguuucucugggugucccuggcuauccugaaacucacucuguagacagacuggccucaaacucagaaaucugccugccucugccucccaagugcugggauuaaaggcgugcgacaccacugccugaccugugaauguuuuaauuaggaagaugacaaaaucugauucuguaguuuuaguguuguggcacagaaaucaggacaguuauguaagguuagaaugagucaggcuuuguuuaggaguugcugacuuuugguaagggcuguguugcauaauaggauaugaaaugugaguugccugguucauguauuauuuuaagccuuuguagccaaguuaaguagguaacguuuacaaauucaucaaaugcaagguccacaugaacuuuggcaugugcuuccuuuuuccuauagcuuccuuaauuaaccuggcuuuuucuuuaaguaauggcuuuccuucucagcacauucauucauuucucagugucuugacaaaaauaggguagucgauaaguguauuggaggauuggggaagcaaggaaaggagauaagaacgagcuaaaacuuucaaaggcgcaguuauggugggacaccagaguaaagauuuuucuuccagaauuucuaagauccuaaagacucaccuaggcagcagacuuaacauucuggacucaauggaugccaccagugcugucuucccuggcugcucccuguaggaacuucuuugccauuucuuugccaguuaccauuucuugacuuguugcauguuuaauguucaccaccaccccccacacacucuccccaguuuuucacauccccaucucauuaauauuuuuaauaauccuuuuucuucaguucagaauuuugacucuucauuucuuuuacccuuuuacauuguugucuggaucuccccuacuacuuccugaagaucuuuaauucaauggagaacagucuagaaagacaugaacccaggccuccacacagugcacacacauggaaaacauaccacauaugaaggggcaaaagaaucuuaaugcccuccuuucauuaccaccaccagcuggcccuugcugcuuccuauuuucaucauagcuaaggcacuauauuaauucucuaguacaguccuuccaguuuuuguauguuccuacuagauugauguccuaaauauaaccucccucucucucccugucccucuccuguagcucugacuguccuggaacucucucuguagacuaguccggcuuugaacucagagauccaacugccuccaccuccagagugcuguaauuaaaggcgugugccacuauaccugucucucuuuccauuaucucuuuugacagugcaucuuuaagaguuucccaguuuucucaguauaagacuguuacccuuuuguuucuuaggcugaaguguuuuuuggccuuaauugcaggggccauaacguguugacugcuucuaugucaguugucccuuguguuugguagauaccauuucuaaaacucuccuuccaacaguacuuuguguccauucauuguacucauucuccgaugucacccccccccuuuugaaagugaucucucagcuagaauucuuguucugcccugagcugcugcuucugauucuccagggauaaaaauucuccccaauaguuaccaaaauccaugccuuucauacuacaccuucucguugcugauacuuaauaucucgaauaucuauaguuuuuaaagauagguguuuagauguuaaguauuuuaauaucaaccaugugucguuaacuuuucaagaacugaguuuuuacucuggaaguugagaggcacuaucacuauuaacuguauuuaucaagaaugaauuuaacaugguggagauaagagugacuguauuguagaaugauagucauaugcugccuuaaccuuuuucuuuugccauaggacauaaauguauucagcaaaauccccuaagaucaugcugucuaguaacagaauagcuaggcuaagugcccauuagugcuguguagccuacacuugcuuaacaguacauuucuuacgaucuauaccuguuaggcuacacagcuguggcuagagagcuacuuaguugagagaguuucgagaggcuaauuucuuagcaagauuuuaaagacaaggcuuugguuaugcaucauaaugauuccuuucauuucagguugaaaugggcaugaaaaaccaugagauuguucccugcaguuugauugcuucuauagccagccugaaacaugguggcuguaauaagauucuaagagaauuggugaagcauaaacuuauagcgugggaacguacuaaaagugaguauuuuauguaacuuaugucaaucuucagcuagucagcuuucuguugagcugaccugcacagggcaugaaguacagguugccugacuagacagggcaagaacugacacguucuucugccauucaaauuggucaaaacagucacagaguccacucaaauuaaagugugcugcagaacaagacagauagucauacagucagacaccaacuuuggaacggucagccugucacgggacuccagaggguugccucucgggccuuuugugaugaggggcgaagguuugaacaccuguggcagaucuuuuauaaauagauaaaaguaguuacuggagaaaaaaaaggggauaaugguuacauacaaaaacaggcauaaguucauugucaguucaauauagaauauuuugaacucaaguacuucguuuuaguuuaagugcauaucugucacagacccucaaacgcaguauccauacacgcaucacuguaauagagaagaaacugcgaacuuacaagucuggguaaaucggcuucucuagcuaacacuucccaacuuuaaaugcuugccuuguguugaugugucuuguugcuauacuacaacuaauggucuuaccuaauuuuugucuagcugugcagggcuaucgguugacaaaugcuggcuaugauuaccuagcucugaaaacgcugucuucuagacagguaguugaaucuguuggaaaccagaugggugugggcaaagagucagguaaguacuaacaguauugucgaaagcauugcuuaagcuuuuauuuuacuuuugagaaaggauuucucuuucauuuuguuucauagucccaucaaaaucaagacgucagaaacuuggcuguaagcaauacagauuaggaacauaguuggcuauauuuauuaagaauaauuuaguagguucuaauuaccugcuaauuccagcacuaucauuuugguaauaccaagaaauaauuuccaucugugguuuuggguuuuguuuuuaguuuggauuggauggggggaggguuguugggguuuugauguuuuuuguuuguuuguuugggggauuuuuuuguuuguuuuuccuuccacucccucuuuggugcucuggacuaaacuugggggucacacauaagauuuuuuuucgaguuguagccuggaauaggagaugcuuucugagccguagccuccuuuauaccgucucuguccugugcacuuucuccuaucugauugacauuguggcuaaacuagggaagcacaauuaaacuuggaaaugagagcauugucaaaacugcucccaaaaaggucccuguagacuuuuauaugguuugagugccuucuguguuucuaucuaaauuaugguaugcauaaugcuaaauagaauacggacucugaguuggggagagcguguguacaugaaaauggauaugaauguuuaaacacaauagaguauuuccuuuagguaaccuaacuuuccuguugauugcuuuugcauuugaauuuaaaauuaugaauuaacuauuguaaauacuuuaauuaugagaaaacuaaguccuuaagaaacagauucuauugaaaguauuuuuuaauuuuuaagaaauuaguuaaaugguaaaaugguaagcauuaacauuguaaaaauagaaaguacaauaaaauaaaaugagguggguuuuuuugggguuuuuuuuuuuugguuuuucaugacaggguuucucuguauagcccuggcuguccuggaacucacuuuguagaccaggcuggcccuaaacucaggaaucugccugccucugccucccgagugcugggaucaaagguaugcgccaccacacccggcuuaaaugagucuuauuuuaaauccacauuucaguuaauuuuuuuguucauuagauaccauagcuaagacuauuucuuauuuaaucugagaaauuuccuuuauaaauacaacuauauuuguauauauucagguuuauuuuuguguucacauacaaauacgauuguaaccaagagugaauguaaguauuacucaggauucuauacuuuuaauucuugucuguuuaucacccuugcugauaacugcucagcgaguaucuuuuucauaauuguacaguguuuugaugaguagguacucuucaguugauuuuuaccauuuuccaagcaauagugauuugaguuucauucauucuucauuaugaauaguaauugaagugccuaucuugagauacauacauuagaauuuagugcuucagugugggaauguuugagaagcacaauucauuccauaauagaaaaaaauauauaaauuuugacauauauucuuucgguaagguaugauagccuguuuuuaauagaaauaaaauugcuuaccauacuuagaauguguucuuaaugucagcuauacaaauaacuuacucugauaguugacaaaguacuuauuaaggagauuucauuacagggucauagucuaacacauuggucauuaaagcaauuaaguugaacguguugaaauagaagguauuaacauagcuucucauggccugaggauauaaucucaugguagagcagaagccugccgugugcaaggccuguguuagaccccuagcacagagaggauucaggggagauuaguuuaguuuuuuauuuaauuuuauuuauuuauuuauuaucuuacuagaaaugccuucucaaugaauuaaugcuugguaugacauuagaaauguaaccauugaacaucuuugaaagcaggaguacccauuggcuaaguaccucuuugguuuuauuuacaguuacaaaugaacacauccugggucgucauuuaggauaugaaguguuuugccaaaaaauaacuaccaguaggaaagauacuggauacagaagagggcagaugaagguagaacuauuuaaccagcuguaggaaaaguauccuaacaaugcuuuuaccauuuucgcugcagacauuuacauuguugccaaugaagccgggcagcagcucgcacugaagcuccacagacucggaagaacuuccuuucgaaaucugaaaaacaagcgcgauuaccacaagcacaggcacaauguuucuuggcuuuacuuaucucggcucucggccaugaaggaauuugccuauaugaagguauuuuuuaaugauuuuacauuucucaaaagaaaaagaaaaaauauguagcccauuuuagccaaacuuaugaagcucuuaaugacaagucucucucugaccccagacucagucccuacagucaacuugaacuccuuugauuaugcucuuuucccaguggcuuccucuuaaugauggcauuuaguguuaugcaaauuugugggggguggcucugaauauccuuuuuauugaaagugguaucuggaaaucuugguguuucacaacaaaauuaaacaaaauaacauaguuaugccuaguaguauuuguuaaaaaucuacuucauuguguuagaauauacuugauuauuuuuagguuuguguauguguuguguguguguauguagacaacuuugcagaacucacuaguuuccuuccacugcggggugggcugcagaccauugugugccuuuacccacggggccgucauaaggacuuagguuuuaguuugacugaaugguuuauuuaaucuggcccuuaaauuguuaauaguaguaggagaaucucuuaaugcagucuaaauaagcaauucugauauuauauguuacguuauuuucuuuuauaauauaaggacgcaccuuggcagaaaucauuagcuauuuccucuaaacuguagugggugcuuuuuaaagugauccuguuaaagguacagagagaaccugguucaaugcauuguuuucccaagaggaaaagaguaagauaaagaugaagcuaugacuugaacauaaauucuagaccagugguucucaaccuuccuaauccugcaaugcuuuaauacaguuccucauguuuuggugaccccccacccccaccccaaccauuaaauuauuuuuauugcuucuuuauaacuucauaaaguuaccgugauuuugcuacuguaaauuuaaauaucugggauuuuuucagugaucuuaaacaaccccugugaaaggaccauuugcaacccacagguuaaaaaccacuguuggagacaaccuuuuuuuuuuuuugagaaaaccauuuauaaucuuuaaguuuauguuauguuguuuggcugccgagacauguugauggucuacucuuuaaaaauaaaaauuucugggaaguaguguauuucaauuccuauccacagaagguggggacuagguagaaagcuuuuaaaauuaaguacugugguaaugcaugauaauggauagcaaaacacuagccuguauaggccacuauaaacuugggaagauaacagacacaaagaauaguuuauauguuaagguuaaagugaagaagaagauaguaugaagugaaugggaauugagugaauucauaaagauggauaugaucugacuuuaaggaaaagacuuugcauaauaucagguauugaccaagacaugaaugcaugcgagcccuauguguguguauaagugguacugaaguuacucuccuggcuauuuugguacugacugauucaauuaaagagaauuuugaaaacucaccaguuuuugguagacaagaaauacaaaagugguucagacugagauagaauaucuaccuccauuguagauacuuuaaaauuaugcauuggcacaggcagcaucuggucugauugauccucccagcuuagacuaccgugauguuucuacuuguaacuuccaugcccauacaguguaaccugaagagcagcaucagugauuuacagacuaaaaugccugaccuuugagauaacuuacuucuuacgccaggaaccuuaaaccaaaauuuguuguuacuacaauauuguaaacacauaucaacaagugacagacuuuaaaaaauagaaaggaaauacccuaagggacuauacgauuuuuguacauucaauguuaugacuuaauguacauaauacauaguaacuguauguuuuaugagggaaaguuaauucuaagaaacuugaauuguuuuuauauauagcuaauucuuacuguaaguaaaccaugcauuaaauaaccuaagguaaacuaaauuuuauaaagccuuguuuaaggaagauacauucuuuuguucuuuuaaaaacacaauuuuagggcuggugagaugacucaguggguaagagcaccugacugcucuuccaaaggucccgaguucaaaucccagcaaccacaugguggcucacaaccauccguaaugagaucugacuccuucuucuggagugucugaagacagcaacaguguacuuacauauaauaaauaaauaaaucuuuaaaaaaaaaaacacacaauuuuauuaguuucucauauuuuucuguuuuaggcauuauaugagaggaaauuuccaguuccaaagccaauugauuauaaucgccaugcagugaucauggagcuuauuaaugguuauccccuguaaguauucauuaaacuugaaagcauaggugcuaguggaggaauuuaagguucaugauuuuuaaguaaaacauucaauuggaauguugcuucuuucuuagagguuagaaauuucuaaagagguauaaaaaaagucggguaguggguggcgcacaccuuuaaccccagcaccugguagacagaggcaggcagauuucugaguuugaggccagccuggucaacagagugaauuucaggacugcauaaagaaauccugggaggggguggggggggaggaauuggaaacccaguuucauccaguuuguaaccucugccauuuuuucauugauuuaaucugcuucauaccaaauaccucaaguccagcauagcauaaaguuccucuggcccucagacuaaacaauagauaccuagugaaucaguaagugcuauuaaaaaggucagugaagaggguagagcuaggagauuccuaguuaauaucagauagucaggaaagugcaguucacagggugaaaucuugggaaacuagcuagggcaauauuccagguaaagaaagggcguuauugauccuugggugcucacagccauggaacaaaccaguauuuagagcagagugacuuaggugagcuggggcaggagaaaagggagcugugaaccgugagagcugaaaaguaacgagggaagguaaaccaggaaaauuagagccguccaggcaaaagaugguaauagcucugauugcagagacagucagaaaggugaggauggugcucagacucucaguguguucuccaggaagcaacacaguuacuuggauugcauuuggauguuaagaagugggaaaucugcagggcggugguggcgcacgccuuuaaucccagcauuuuggaggcagaggcaggcggauuucugaguucgaggcuggccuggucuacggagugaguuccagcacagccagggcuauacagagaaacccugucucaaaacaucaaaaaaaaaaaaaaaagaaagaaagaaagaaagaaagaaagaaagaaagaaagaaagaaagaaagaaagaaagaaagaagaagugggaaaucuggcauagagaggaacugugaggaaagaacauuugaaagggguaguaccugacaauccacagaagaaagaauuucaaggagagcaaagaagucaacugacuagaaauggaaaugauaagaauuuagcagcuuaaagaaauuaagccuugacuguuuuguuuaaugagguggaaggaagucuguuaaaaguagauuauugaaagucaacggagugaaauuagaaaagccuauguaaaaaggaggcgagcuguaaggaagaugugcgauaggacauaauagugauaagcagacagauuggaacagugugugaccuuuuaguaguugagccacuugccugugaugauaaugaggaggaaacuggcaagauaaggaauggaaaugacacacucauuaaaaugauaaccauguacacauaaccuacucauacuuucagaugucagauacaucauguugaagacccugcaucaguauaugaugaagcuauggaacugauagucaaacugggaaaccauggacugauucauggagauuucaaugaauucaaucucauguuggacaaagaugaccacaucaccaugauugauuuuccgcagaugguuuccacaucccacccaaaugcugaaugguauaugcuaaaacugauuguaguuguggauguauuuguauaucacagaaucucuuuuuauuuauaauuuuccaguuuucuauuugaucaguaaaugauuucaauuaaggacauuuguuuuucaauuaauggauauggaacuacuagaauuuucccuguaagaaaaucuuuaaagaagaacuuuuaaaagaaaaaacuacacuuagauccuauuuuaacccuaauuauuaugcuaauccuguguucuggaaaucuaaauggaacugacuguccaccuaucuuauacauaaacugcaauguagauaucacuaaaaaaaaguuggacuuaacacucaaaucaagcuuucuuagccagggagccauuuauucaagcagaacuucaagaaggagucuggguuuuaaagacaaagcuuguucauauguggaaaaaguauguguccuguauagaaguaaauaaaugaacacgaaguaggaaagaauuuuaaaugaguguuuccuuuuacagguauuuugacagagauguuaaaugcauucgagaauucuucaugaaacguuuuagcuaugaaagugagcucuacccaaccuucagugauaucaggucugucguauacugcuuauaaugauagagccgcuucaguagauuauuugcuuaauucuaaagugaauguccagacaguguauuucugauuauuuuuguauauauuuguauauucuggugcgugucagaagaaggcaucagaucccauuauagauguuugugagccacugugugguugcugggaauugaacugaggacuucuggaagagcagccagugcucuuaccauugagcugucucuccagacccuacaauuguacuuuuggaugcugaauuuuuuuccuauuuugacugcuguaucaaauauucauagcccauuuuuaagaaaucaagugucaaaucuuagugaaauuggugguuuucuuuucuuuuucuuuuuuuaaguuuuuguguuuuauuacguguauuucuguaucuucauuacgguuucaauugcuguaauaaaacacugugaccaaaagcagcuuaggggagaagcauuuauuugacucacagguuacagaccaucauccagggaaacuaagucaggaacacaggacagguaccugggggcaaggacugaaggggaggaaaccauggaggagcucugcuucuugacuugcucuuucauggcuugcucaguuuaguuucuuaauccuuccagaagguggcacuacccacagugaacugggcucucccacaugaaucaugacucaagaaaaugccagcaggcuuguauaucggccaaugugguggggacauuuucucaguugagguucccucuucccauaugauucuagccuguacuaaguugacaaaacacuaagccgcacacugcauaagugcacagaagugugagugccagcagaggcugggagagacucauuucccuggagcuggugguugugagccaaccaaaguaggugcuaggaaggaaacuccccuccucuagaaaaguagucuaugcuaggccgugucuccagccuuggguuuuucucuuauauauuucuugaguuaaucguucuuuauugguuuuauaugcuuuuaagauguuuccuguuuugaguuuuauugcugcauacuuuaaacaacaaucuuuagccuuuuuuggaaaguuaauuuacaggggcuggugagaugacccagcagguaagacuucucuuccgcucuuccaaagguccagaguucacuucccagcaaucacaugguggcucacaaccauccauaaugagaucugacacccuccucuggugugucuaaagacagcuacaguguacuuacauaaaauaauauguguuuaagauuaaaauauggaaggccggcugaacucacuucacauuuauuagaguggugcuauucaucucagauaucuuuuuucuguguuauuuaaugcugauaccuucguucucuaggaaggaggauucucuugauguugaggucucugccagugguuacacaaaggaaaugcaagcagaugaugaacugcuacauccaguaggcccagaugauaaaauuacugaaacagaagaggacucugacuucacguuuucugaugaagaaauguuagaaaaagccaaaguguggaggucagaauuggaaaaggaagcagacccagcagaugaaucagguggauccuggugcugcucgucuacagacagcaaacaaauaaaggauggcggcuuaccagaggagagugcucauguguccaguuucgaagugacggcauuaagccaagcuguagaagagauggaaaggcagguucuuccccacaggucgguuacugaguucucugaggagagcaggagaacugaaaaugaugggcagccaggucagagaagcccugcuggcucugaggacugugacgaugaacccccccaucugauugccuugucaucagugaacagggaguucaggccuuucagguacagagguguuuuguuuguuuguuuguuuguuuguugcuuuuaccuuuaaucuugagaucuuugauucugucaagggaggauauuugaaaaaagaaacaaacaaaaaaaaaacccacugugacaagauugugucgugccauuaucauguguaaaaaugaaaguuaacuuuauuguauugaaacaaauuugucuuuugaauuaaucuaauucccaacacucgauugacuaaauuucacagaauuuuaccuuaaacuuagacucacugaauuaauguaggucucuuaauauuaggucuguuuuuagaauggguaaaguguucuguuucauugauauauuuaagguauguuuaaacuaugaaguggaugugaguaugugagacaugcaguaaaugauuucuauguuaauuaucuacagagcauguuuccuggagcuuuggggcuuccaucauuuuguuugauuucuuaugugcacuuaaagccacauaauaguauuauguuuuaacuuuguguuuguuuguuguuuguuuuuugucuugaaaguguuaggcucauaguagcaaacauccuauaaccgaauuuuuagauuuggaauaguuuauccagaagcaaacaauaguuuguugaaauagugaucuuauuuaugucaaaacauuaauaugacaaaacuagaucagcacaauauugauaagcauuucucggugcaucuucaggggcacagcccuuauuccuuuagaguuacuuuauuaaaauuuaaguguauaaugacuuagcuaauuuuuaagaaaagaaaacuuugucuccuuauaucaugauuccaacugauacuuuuuaaaaccuugagaaacauuucuuaaaaguuucacacccccugacauauauaaccuuaacauuaccaaagaaggaaugcuucuuucuacacucuuacaaaagccacuaaaaagaaaauuaagaagccaagaagcgccgggcagugguggcacacgccuuuaauuccagcacuugggaggcagaggcgggcgguuuucugaguuugaguacagccuggucuacagagugaguuccaggacagccagggcuacacagagaaacccugucucaaaaaacaacaacaacaaaaaagcuaagaaccugguucucugugucugcucugcugucuucugccaugucacugcagacauuuccuuaacauuguuuuuuuuuuuucaaaaacuggaagcgguuuuguuccucugggcucucauccucagauucugagugcaccguggagcccauggaaaguaagcagcucuggauuagcccggcucucccuagccgccauuuccuuaacuaccuccaguaucugcuuccuccaccaugugaucacucggguuccugccgccacuauguuuuccauuguucgcugggccaucguuacaaugucgcugaugauaauguccacaucccauagcuuccuccuccauaguuaucauaaagaaucccguagucccuguucugacugccauaucugguucaccaccauuuucauuuucauaaccagggccagcuccaaaauuaccauccccagagccucuuccaaaccacuuauaucuaugcaccuucaggacaccuuuaucauugcagucacuugcuaccaagcgugaccccaaguucaauucccaggacccacaugguggaaggaaagaagugacucuuacacauuuuucucugaucuccacaugcacguuguggcaugugccaucuguacaaaaaaauaaauguaauauuuuuuaaaauagguguuucagaaaaacacugacuauuaaaaguuaauguuuucuggguucguguaaauguuuauauuaaaauauugagcacuuaaaaguauagacauaaccauggugauaguauuuauucugacucacagugcaguuucagagaacugccucuggcugggcauggugcuauauacuggaaauccuugcacuagcacuggggggcuagaggccugagauaggaggaucagccuuggauacaaaugagacccugucuuagaaagagaaugaggacauuguaucuauacuaugucugcuuuuguucagaauguggcaaaaugauauugagugugaaaaauagauuuuuauaauuuagugaaaaacaaaugaauuguagggaaaugauuacauuucaguuauaaaacauucuauuuggaaaguuugaugguaacauugugucagaacauucuaagaauguuaaacuauaguggacugaguuguagguaguuucauuuuuauuuucauaaauauaauucugaggcauuucacuuuaugcuucacugcaaaaaaagacacauuaauauuacguuauagaaauuaacugguuagauaacuuguuucuuaaauuuuauuuauucuagagacgaagagaguaugaguaguguuacucggcauagaacaagaacauugaguguuacgucugcgggcagugcccuaagcuguucaacaaucccuccaguaagugcuacaugugccaguuguuggggucagagcugugggcagaguggugaccuuuggguacugucaggauuucaggucauuuagauauuuggaucucauauguuaauguuauaacauggucagcauguagaaguuuucaccaggaauaagcaaagcuuucagggauaaggcaacauauaaauuaguuuaaauuuauggaauaaaauguuaauguaguuuguaguuccccaugauucagucuuugguuuuuaacaaggaagguuacaugacauugcccaaagguagcaauauggcugaaauguagagguauaucacccccccccccccuugcuuacaucugggaaaugggugauuuuaaaugucuuuacuaucaaauuuuuguuggucccuugggcaucuuacauuuguauccaagcaguuuacaaaagggauauuuucuagacaggacagggagcagaauauucuagcccagcugagguucuggcauguaagccagccucucuuuagaccuacccagaaggaagagucaguguggagaugaccgcaccccacaaagcagcccccucucuguggccuuuggagaagcguuucucuaacuccacacacauuuggauuaugcagcuacuaggucucauucacaucugacauuuggaaagagcagggauuuacaagucauuauuccucucaggaaucgaggcagacuuuguuggguuugcuugccuuccugauccguuagcagucagcagaagucacccaccugccucauuucaggauuaugcaguguguuuugaagacuaauugugcuuccuaaaaauuauuuucugucuaaaauuuaaaaaguaaacuuggcaauagccauguaacaaaauaguaaguaauuuaucaaauuuugaugcuuuacagcaauuuuuguuauguuggacucuuuucuucuguuuaaguaaaauuguguguuacuaaagcuaguuuuuagagauaauuuccucauagugaacaaagaaggaaacaguucagaagggaaaaaaugaaaaagugaaauggcuguacacagaguaaacucaagauaaauuacuucauuuuucuaaauguauuaaaauucagauguuauuagugaauuagaauguuuuguuuuggauagaaugagacauuauaauauuaaaugagagcuauccagaaugacauuguaucccaaaugcacacauaaaaagcuagcuagacguggugagguaugucuguuaacucaccacaaacaagugaagacaggagaauuccuggagcuuguugacugucaccagguucagugagagacagacccugucucaaacgaacaagauggggaguggcagaggaagacuauauaugcuggccucuggcuucagcacacacguguacacacaaggaugcauguacacacagaagaauaaaguaaaaaauagcuaauaguaguuucuauuacaguucuggggcuguucagaaacauuuaggauuuggcagagcaauaacagugaaauucucaaaaauguaauuuuuucauauuccuucuaaacuugucuaagaaaauuuacuugauuuucuaaauauaaaauugaaaucugugaagcauguaauacauuaaaagauaaaguuuugagccaggcauggaggugcacgccuuuaaucccagcacucgggaggcagaggcagguggauuucugaguucgaggacagcuagggcuauacagagaaacccugucucaaaaaaccaaaaaaaaaaaaaaaaagauaaaguuuucaguacagauaucucgcaguucauuaaauaaccuuuuugcuuuucgcuuuuauacucucuguucuuacugggauuuaucugcccccuuucuuugauuucgcaguaucagaacagaauugguagcagguucagacuuguguggccuucuguguggcugugccgauggaagcagaugucaagcugcucuaguuccucuuuaccaggcagaggcugcucuucucauguguugugguuuuagucuucaagguuuugucuugagcuuugugaguuguagaugagccuguauccuaaggagaauacaagaccuucagccuaacuccaugaacagagaucucugugcacacaagguugucuuuaaacuuuuaauugaaaaucauuuuuuuucguacacuauauucugagcagaguuucccuucccagcucugcuuccuuucauccacccuugcuccucaugccucugcucucagcugcuaggauggcaggccauagccaacgccuccugacacuuuucucauacugcuucuuuucuguuuuguaaagaugacagaagaaaacaguuaccucaguggacuuggugguggugguuuuggaauuuauauaaagacaaaaagggcuuaaauuccuuaaaauuguaucauaaaaucuguucccuccuuaauucuuuuaucauuccuauuuauuggcucuuaugcuauacauaaacuuauaauuuauaaacacaauagucauuuguaaauucuguucuugaaaacaugaaacagaauuaaguaauuguugccuuuauacauacauguggcuagagcuaaugggagaccuuuuuacucuuaacagcaagugaugauuuccauguaguugcuaaaauaacacaauauuuuacuucauguuguacccagguuuuucuuacacacaaaaaauuaccguguaggauuuguacauuguuuggaauugggcuauaagagaaaccaaaagucauuaugaacugaauuuuuuaaaaaaacguuuucagucaugugauuuguacauauggcauuugugguuguuaacuaugagacagugcucugcaucugcauacucugugaggacuuccuaugcgugacugccgcccccaggccucuucucugucccaagcaccacagggcuggcuacguaauuccagccuuuggaagggcaggcaggggcuagaagaucgaggccaucugacuacgguccaguuuaaggccagccagggcacccaggcuacaggagaguuuaccucagggagggagggagcgagcaaauaauuacaaaaucauguguuuuaccaagacggguuuuuccccccaacucauuguucauaauggucacuagguggcacucuagcaguugauaauuuaaacugaccacuuuugcuguauaaucuguauuucugggaagaauauaaauuuuaaaaacuuucaacagcuucuccuguuuuaucuacuaguucauauaguguccuuaggauucuuaaaauucaucuuuaacauguaaauuugaaagauacuaccaguguaaaucuuggauaauaauuugauaaugauuucucugcuccuuaucaagaugguugucagugauacuaauucacaagaucuuugcaggaacuggugaagcagaaggugaagcgucagcugacaaggcagcagaaggcggcugccagacgccggcugcagaaaggagaagccaauguguuuaccaagcagcggagggaaaacaugcagaauauuaaaucgaguuuggaagcagccagcuuuuggggagacuaauagauuucugauauguauuauuuuuuuagaugcuauaauuuuauuuuuagccaguauauuggucuuuuuuggaccaaagccaguaaauuauggaaauaaagccucuuuagacucagagcuuccaaggucugauuaauaguaaaucugccaagcacucuguuucuuaaaauuuuucagguaacuaauuuaaauauaaaauaacgugugaaaaaaacuucauuggcaguaauugcaaaacauggacaucauuuuuauuucacugugauguucagacucugccuuaaacagguagaaaaaugacuugccucagauucuggauuuacauguaauaaauaauagaacaacuuaaugcaau

SEQ ID NO: 8405 - RNA, 1108 nt, Mus musculus
agauuuuugcgaacggcgagcagcggcggcggcgcgggaagugcagcggagguuuuugcugguuucggaccccagcggccggauggugaaauccucccugcagcggauccucaacagccacugcuucgccagagagaaggaaggggacaaacgcagcgccacgcuucacgccagccgcaccaugccgcuucuuagucagcacagccccggcggcugcagcagcgagaguucuaggguugcccuuaauugcuguaguaaccuggguccggggccucgguggugcuccugaugucccucacccaccccugaagaucccaggugggcgagggaacagucagcgggaucacagucuuucagcuagcauccuguacuccgacgagcggcugaaugugacagaggagccgacgucuaacgacaagaccaggguccugagcauccaguccacgcucacggaggccaagcaggucaccuggagggcgguguggaguggugguggccucuacaucgagcucccagcuggaccucugccugagggcaguaaggacaguuuugcagcucuccuagaguucgcagaggagcaacuccaggcugaccacguuuucaucugcuuccccaagaaccgugaggacagagccgcccuacuccgaaccuucagcuuucuuggcuuugagauugugagacccgggcauccccuuguccccaagagacccgacgcuugcuucauggucuacacucuggagagagaggacccgggugaggaggacuaggugccagcccugcccagugucccugugcccucuccuggguuaguccacaugucgugauugugcagaauaaacgcucacuccauuagcggggugcuucuucgagcugaaugcuguguuugucacacucaaguguuggcuuuaauucuaaauaaagguuucuauuuuacuuuuuuauugcuguuuaagauggucaggugaccuaugcuauagcagccuccuuugaagucuggaaaaauagugucaccuccccuggcucaaauccaauaaagugaucucguuaaaaaaaaaaaaaaaaaaaaaaaaaaaaaaaaaaaaaaaaaaaaagaaacuguacuaaaccu
